United States Patent 7,868,149 (PLANT GENOME SEQUENCE AND USES THEREOF) - sequence listing, part 98

SEQ ID NO: 51806 - DNA, 2366 bp, Oryza sativa
ttgtgtctacacaaaattaaaagaaacaatttttcattggaaaaatactttcatcacgtaccttctctctttttattccttgaaggtcaccaagcatgctatgcaaaataaacccatttctatacttttatatgctcatatttttttaacaaatactacgaatatattgaaaaaaaaaacaagtagaagcggatagatctttttttaagtagaagccgatagatcttaataaatcaataaagctcttaactgagacatattaaacttataaagcacaaacaaaagataatggtaatattgtttcaccaaatttacttaatgcgatggacctattattttataccatcttaagaactcaaaaccatttatctatgttaaaaaacaaactcccttcacccaacccaaccatatggatcctctccactgctattatatgtgcatgtactctctccgattcaacttcttcctcttcctttctctaactaacaacttgtaaacataaaaacaatcaataacgagaaagctgaaaaatcataattattaatcctttagtttgtttgaactattgatttatttataatcaaataaataatttaagatccatattaatcatattttttactttataaaaaattaaaatatatcatttgaacatagacccctgtcctttgtatgccaaccaaataataacaacattaatgaaacaacataaataaataaaatgacagcatgcatcccgtgcatcataggaactagaaaacatagattctttatctttcgtatacttaggattattattgttgtaatttactttttggtttggatagttttcgcaactattatatctatttacacaaatcactctaaatcctttgcagcgctcttaactcaccacgtgtcaagtactaaaaattagaacaaaaaaaattccaagggaaaaaaacatttgacaatgggttttcacttaagtcagtggattcattattttcaaccattaggtcttcctttagaaaaaatcttaagccgctatgtgtcacgtcttcaaaattagaaaaatcttagaaactataagaaaaaagcaaaacatatgatcattggttttagttaaattatttagaaaaataaagtccccaatgcatcgcccttcccagaacatgcattcacacaacactgaacgcccccttcccccttggctcacactctccactctccactactccccccttctaatttaagctatcaaactaaaacacaaactattaataataattgcaaagatcgtattcttaagctataaatctaatttttaatttaattgttgctcttttaaataatcaaaccaaaaatacatgatccataatgtctgtatttttaacctaaaatgtctgtattcataagtagaaaaatgtcaatagggattgaattaaatcaattggacaaaatataaaaaatttgtaaaacaaatagttattacttttcaaaaactggataaccattgtacaatgttcgattgccataaccatctttaagtgcttagatgttaatggccttccatccatcctacaccatggcattacgagtttctcaatgtattattgcatatacaagacacattaaggtagcagtgcgtagaagtacgtagttgtggttaaaaagttatgcattgctactattaactttaaatttaggactcatattggctagatattttttttagaaaacgctatagatcacatatataatagggaagcgaggtatacaatatgtatatctcctatgtatttattgacacgttctttccagaaaatgaagaattattgacaattgcttgtagtaatgaattaaatattatatagttcaaatcttacaaaaatattgtaaaaattatctaagcaatgtagatggagaaaatttatgaagaaattaaacttttcaagcgtgacaggtgtcatccggtagatattccaccttacaagttagtcaagcgtatcctattttacgtgcccgcgcgaatgcgcgggctaccttcctagttaatttaatagccaattcatacaattgcctattatctggtcccacatgtcatgcacacatgtatattggagtccgtgctgaagctagctacaaatctatagtccgcagctcttctcttcctctttttatctccttaaaatatgtttgtagctgatttataccctgtacttgcttttagagcaagtttaatagtattccaattcatttatagccaatctaatagccaattcataccatagttgcttactatactactaatatatggtctcacctgtcatacacacattgcgttttggagtccgcgctgcagctggctacagatctgtagcccg

SEQ ID NO: 51807 - DNA, 875 bp, Oryza sativa
tcttggggtcacagaaagttcatcaaacgggaagatttcgagaagtccaatgatctcagggacgactccttcaccatccggtgcgacgtagcggttatcggagagatccgaactgagaagacgaccgagatcccatcagccacaacattcgtcactgtacccccgtctgacctgaaccagcagctcgtcgacctgctggagaccgagaagggcgccgacgtggtgtttgaggtcagcggtgagacgttcgcggcgcacagatgcttgctagcagcccggtcgccggtattcagcgcggagctctacggcttgatgaaggagggcgacaccgccggagtcgtgcgtatcgaagacatggaggcgcaggtgttcaagctgttgctccgcttcatgtacaccgactcgttaccaaagatggaggaggaagacgtcatgtggcaacatctgcttgtcgcggcagatcggcatgatctacagaggctcaagctgatctgcgaggacaggttgtgcaactacattggcgtcagcacggtgttgaacatcctggtgcttgctgatcagcatcactgcgacgggctgaagaaggcgtgttttagttttcttggctcactggagaacctgagtgctgttgtcaccggcgatggcttggagcatctgagcaggagctacccctctcttatgaaagaactatttgttgtgatggcacttccaccgaatcatggttaatattcttgtgctctagcaatgatagttgttggtttctcaatctgaagttctgaacctttctcatcaggtagatatgttatcttcttttagcacgcaggcatggtgctgtactccctgtgtatctatgcttttgttatcaggtacactat

SEQ ID NO: 51808 - DNA, 954 bp, Oryza sativa
atagggtcaaaattgaagtaggtcgttatgattcaagctcttttgtgctaggtatatccgtatatgatgttcgtaattccataaaatttatatgagttactccctccgtcccatgaaaggatttcgactttttacttacactatttgaccattcattttatttaaaaaatttgtgcaaatataaaaaataaaaagttgtgcttaaagtaatttggaaataaagtaagtaaaaaaataaaaaaaatttcaaatttttttaataagacgaatgatcaaacagtgtaaacaaaaaatcaaaatctcttatattagggacggaaccggctcctgtgacatagagaattctacgtcagagggatgttggacttccgatcgccgtcgcttgcgcatccaatggctcctgtccgcgtgtgatgatagccttctcgttcggcccataagcccattcgtcgccatcagattgctctagcatcgtctgccggagccgcgatagcgtgacggtgagcttgggcacacagctgagcaactggacgcagccctcccatgcgctgtccttgatgggctccgtcttggccaacaggtcccctgacgacgcggacgatgagcacctgcggttcggcagcgccgagagaagcgccaggtgtaagtgtcgcccgatgaacacgatgatgtgttagagtttgtgtcgaatatgtgtacgtatcggttacagtttagaacttggagttgtaataggtattaggattagagtatgagtcggactctatcctaggatctctcataaatagaggggcgtgcctgttgtaaccgcatggtgacttagcatagcgagagggagcggctgccgggtctaccggccgtgagtcgttgtaattctgatacgctgtatatggtggatcggggaggagcccccataatcagtgccccggagatgtaggctacggctgaactccg

SEQ ID NO: 51809 - DNA, 761 bp, Oryza sativa
caaaggcggtggcgggaatcggcgacggggagagaggaagcagagagagcgagagagagagagggcggcgctctctctcggctcgggcacgacgctcgtgctctgcacgtgcgaaggggagggggatcaggctgagaggagggatgggccgagggaaaggaattcagcccacaaaacagagggaggaaaaaatagacttttatagggaatttgagttggagagatttggggcttgggtttaaatttcaaatttgagattcgatctcgggggtttagggaggaatcaagggagactcaaggaaaggattcgagatgggaatttgatatttttcggaaatggggacaggtatttggcggggattcaaagggaggcgattgaatttcggagtttgatagccggaattggaatcttgaggtggacgatttgatggcgacgagagggaacaacgggaaattgaattgagatccagggcacgacttagactcgcacacaaagaacgaaattttcgcaattaggattttgccgaattagtttttaacgtctcacgagaagcggagcgttacagcgcacgtgcttaattaaatcaccctagagctaccacatgatgctaagctacccgagtaaattttattcaattgcttgcattagatttatccttcatgtttcattgaactttctttatatagcaaaacacagtgtaagaacatctaagctctcatcagcatttctatttgtggaatcttcaaaaattattttatca

SEQ ID NO: 51810 - DNA, 1513 bp, Oryza sativa
tcagtgacagtcaatttgatttacacattttttttgccttagtgtaggaaaaagtgaaggataattattagttgattatcctgtaaatttcttacccttcatgcttaattccatatcaatctattctagagttcttttgctctcactgcatttccatgtgataaacacaaatctgtagtatcgtgctgtaccacttgatataactatctgtattgagaagtaaaatggaaatattatgttgccacgcttcctaaatccaattaacaagtgtcttatgagcttccattgatactgatttgaaaatatcctccgaaacattttttttaaaactcattgaatgctgatggattgtgcttgaacaggtccattgcaattagtactccagatgtgaacctttcagcggagaatgttattgccacaatgtcttcttttgactggtagatttgtatgatcaaatatagttgtaccatcaccatggacacattattccgatcattatgtaaaactttattttcattttttatatgcattggtgcttcatctttagattgtaatgtgtaagagttttgttctcagcagaatctgtacaacgatgtatgcaaaattactcatcaacagcatcccctgcaaatgtattcgtgggttttctccttacataatcattgattcagccagaaaacaaatgattagtctacagtaatcaaccaatctatgtgtaggcggcgcgccattggcgcgccccagcatctagttaagtttaataccaggtaacaagtgacaatccatagagatttaatagtgaagctgtagggatagtaaaaaaaactgagacgatttctaacttctgcttaggatagatggtaaaaggcctaaacacggggaattcacccgcatatcagtgtgctaaaagaagataagcaaattaaactacctgatgacaaaggttcaaactcagcaacaaaaactaccactggccattgcaagaacacatgaacagtaagtcactaagcatgactccctggaagtgccagcgtgacaaccagctcttccataagagaggggcaactcctgcaaagatgcttgaagccatcactggcgacgacagcactcaggtttgccagtgagccgaggaaatcgaagcacgctttcttcagcccgtcacagtggtgctgatcagccagcggcaggatgttccataccgtgccgacgctaatgtgcctgcacaacttctcctcgcagatcagcttgagcctctcgaggttgtaccggtccgccgcgacgagcagatgctggcacatgacgtcttcctcctccatctccgggagcgagtcggtgtacatgaagcggagcaacagcttgaacacccgcgcctccatgtcttcaatgtgcacgactccatcagtgtcgccctccttcatcgagccgtagagcgccgccctgaacaccggcgaccgcgccgcgagcacgcaccggtgcgcggcgaacgtctggccgccgacctcaaacaccacat

SEQ ID NO: 51811 - DNA, 1971 bp, Oryza sativa
acgaagcgagagagcattgcgtttttccttgggcccacctatttatagggctattgtgggctcacccgtgtatatgggccgagaaaatcggtccaatggacggacggcccatgcttgctatggcgaattgtcgatcaacgttatgccagctttaccacatacgtgatgatgatgcggttaaattacaactgatctgcgcagttattcttgctgcagcaaaaggtgagtagtttccatatgcctcaattttcaggagaaaaggcctcgactggagaataaaaggttgcatatttacttggctagcatatagtataggcttaaaaaataaaaaatgagttaatatgatatcccataataattgtatttctaatatttgattttgttccaaaataattgtcacaatagaatactaaggatagcattaatcacctctcatccaaatttatctctattttaccctcaacaaccctccactcttaatataaaccattgctacgggtattatagttttttttttcaaaccttaatatatgataacaacgtaaaactacaattaatttagaacagaggtagtatttcaaagcaactttcgtataaatttgttttaaaaaagaaaaccctatgtaacactgcctcaaaactttttcggactgtggtttataattttaatcatgggtttgctactgtaagcctgtaacgctgatattgtcaatgctcaatcaaccaaactaacctattaatcgcattcgcgcgactctaattactctttctatttaaatgtcattacatgttatttatgtttaatactccctccatctacatgttatttatagtaattagcttgatgtgaaagttgaattgaacttaaatgtttgtggagtgatatatcatatgttaatacatcttcataatttttttcataactatttaagtgacgtgcaaataacgaagggacatcccctcgaggattaaaatctactcccaggatactagcaagtgtaggaaaaaattttagaaatatacgcattttctgtagaatttgcaagaaaatactgaacgcgtgaagatttgcaaaaatataccgccgtcgcggtttcattgagcgagaccacggtctcacaagatcgaggcgcgagaacgagagcggtatcgctcgttcggtctgcgaggacggagcgcacacgatggcctaggcggtcatataatatcgctttgctaattagggagagcgcacggtgtcgcactctaagggtgagtttgaggagaagaagattaagaagattaggaagatacgcaaaacgaggtgagccattagcgcatgattaattgagtattaattatttaaaattttaaaaatagattaatataattttttaaagcaactttctaatagaatttttttaaaaaaatgcaccgttgagtagtttgggaagcatgcgcgcggaatacgatgggctttctcacccaatcccccaggaacgaacgcaccctaaaagtgcgagagcaagtcggtgggtcccggaactgctgcgatgcgcgatctcgcacgagaggaaagcgagagcgctggtctcacgcaagagagatgcgagagccctggggccggcgactgcaacccaagcagtctcacgctacaggaacacgagagcggtaattagtgattaattaccataattagtgattatttaatgattattaatgatcaattagttgctaatcaaggtgattaacacattaatcactggccctgtggcagccatgccgtgcggtctcgcacattgtttgtgcgacaccgtaggctctagcaccgatacgtcacattgccttcggtctcacaaaaccaacgtgcgagactgcgggcccccatgcgcaacatcgcactcccactttgcgataccacagctgcctgatctcccagcaaaaaaattccgtggggcccactccacaaccgcctttgcgataccacggctg

SEQ ID NO: 51812 - DNA, 1240 bp, Oryza sativa
catgactcgatggagggattggaggcgccagcatggcaaccagctcattcacaagagaggggcagctcctgctcagctgctcgaagccgtcgccggcgaggacagcactcaggttcgctggtgagccgagaaaatgtaagcacgccttcttcagcccgtcgcagtggtgctgaccagccagcgtgaggatgttcaccaccgtgccaacgccgacgtgcttgcacaatctgtcctcgcagatcagcttgagcctctccaggttgtaccgatccgccgcgacgagcagatgctggcacatggtgtcttcctcctcctccatctccggcaatgagtcggtgtacatgaagcggagcaacgccttgaacacctgcgcctccatgtcgtcgatgcggacaacgcctgccctgtcgctatccttcatcggaccaaagagctccgcgctgaacaccggcgactgcgcagcgagcacgcaccggtgcgcggcgaacgtctcgcctccgaccccgaaaaccacatccgcacccttctcggtgtccagaagtttgccgagcttctggttcaggtcagacgcggaggcacggtgacgaaggtttcggtggcgatctccgtcgtcctctcggtgcggatctcgccgacgacggctatgtcgcaccgaatggtgaaagaatcgtccctgagatcgtcggacttctcaaattcgtcccttttgatcaacttcacatgaccccaagtcaagcactcgtcaccaaaagttcttactggtctagatgacagcactcgtcaccaaaagttcttactcgtcaccaaaactattttaacagctcgagtggacgtccacctgagtattagaatctctctccgtacctgatcggcgaaacaaatctgaaactgggctttaaccttcacacccttcgtgctggtggcattttcatctagcatgaggtgaaatgatatgtaatcggcgaacatggcgatgtccccgttggggtagtatctgatgcgccaacggtggccgccgacgacgaactggtcggacgtgagggctgcaccgttgggagtgcccttggttcgcgagtagccgtcgatcttgaggaggtggtacccggtcaccgcgtcggccacaatggaggaggcggtgccgcggctgacggcagtagccatggcaggcaggcaggcaaggttaaccgcctgctcgagacgaacgagatgaaagacacaggatttggttgggaatatgctg

SEQ ID NO: 51813 - DNA, 2015 bp, Oryza sativa
tgttcaaccgtcaggcagatccaactttgttgacgggttgaatagcagtgaagaagagacatcaagaaaggcaaggttgggatgtagcgaggcctaggaggtcagatctggtggccacgggcactgcgagcgatggatccggtggcagcaggcctcgagagctccagtagcagttgatgccgtgacgacggtgggcttgggtgcatagatcttcccttttttccaccacgattgtatatgtgagtttgcgatctgattttatatacgtatgaaccaaaaattgttgaactagatccaaattattgaattgaatttgtgtaacgggatccaaactgttgtgtgtttgaattgaattaaagttgttgaattatattttttagcaattggtaattgcgatggaactattttcttgctaaaatcatttccagaataagccacccatccctcaaaagtaatttgtgcagacggacggctttaggccggaccgcacataaaaattgatttttccctaacggttccttaggtggacggcatgtaaaaattggacttttacagctgaactgcctttgaaaatcaacattcccacattgtttacgtatagtggtaaaaccgcattcacaaatcatagaaagctcttttgtagtatgaaaaggaactagagttaccgatcaacgtgagaggagttgtttaacaaaaaaaaagaaaaaacccggaaagctgagaggagttttttaataaacaaaagggggaaacctgagagttgtgatacgatgcgtggacacactggacagtggatatcgaaaaacttttgctgtcgtgaatccgtcgtctcgtctctctcgttgcgtctccttccaccttaatttgcaacattagttccttcttatctccagcgcttaaccatatacgcgaatccagcagctatagcgtcaagcagcaaagcaagcaatagacgacgagcccaccttgccgtccatgggtcaatgcgccatgtctcacacgcgctctaccaccgccggcgccgccggcggtaagccgccgatcgcgccgccgccgacgtcctccgcctccgccattgtcgccgacacggccagcgggtaccacctcttcaagatcaacgactactcgcgtaccagggacatcttccccaccggcagtgccctcaagtcccgcgcgttcaccattggcggccaccaatggcgcatccattactaccccaacggcaacacggaggagtgcggcgagtacatctccctgtttcttcatctcgacgagattgtcaccgacaagaacgtgtacgcgcagcacgggttccgtttattcgacgagtttgccggtgataatgatgacgatgatgaactgcagccttcctccatcgctgacctcgggcaggtcagtacctttggtggcaacaacattgggttgggacgactgaggtttatcaaaagggaagagttggagaaatcgaagtatctgaagaacgactccttcaccgtcagatgcgatgtcgtcgtcaccaagcggatccgctcggaggagacgccattggtggtgaggacctctccaaagccaaaggtggcgaggctcgtcaccgtgccgccgtccgatctgcaccggcatcttcaggacctcctctgcgccgagaagggcgccgacgtggtgttcgaggccggtggcgagacttttaccgctcaccggtgcgtgctcgcggcccggtcaccggtcttcagcgcggagctgtttggatcaatgaaggagagcgacaccacggtggtcatccgcatcgacgacatggaggcacaagtgtttagggccttgctccgcttcgcgtacaccgactcgttgccggagatgaaggagaaagacgaaggcgccatgtgccagcacctgctcgtcgcggcggacaggtacgccatggagaggctcaagctggtgtgcgaggagaagctatgcgagcgcatcgatgtgagctcggtggcgaccgtcctggcgctagctgagcagcaccattgtga

SEQ ID NO: 51814 - DNA, 1454 bp, Oryza sativa
tttaatcatcattaggattttattttgtcggttgctgattgtattgtttcttaatagttatatattgtgttgacaattttattgatgcctggtatttatatgagaatatttaaatcaccatagtccatagaaattagggtgacataatgtgcaacgaatacaaattgactgttttttactcctactgtcaacttttatctttacgaattgtatcagtgtcatgctgttgtgctgtagccatgtctaaacataatctgacatggaaaagtgagtctacctttgtaaataatggactaacgtacttgtccgtttctaatacgtgtgtccgtttcttatatgtcaaacttattacaagtttccaaaacttttcaagtactattaaatcttaaccgtttaaatctagatcaaacacaatctaatggttaatattttttgttttccttcgattaacgtgagaatttctagcctcaacagtgaatgtggtgcctcctttcaagttgtcttaataatataatagatagataaatagattcctgttcagtagaagtattaagaaattctctgttttcttttcatggcatatctacaactatcccaattaatcgagaataatgacttgtttttgtcaaaaataaatcaggaataatgactttattgttactcataatatagctatattagttagcggctggcttttgtgtattctcatagatatactgccaacatatttgcgtaaataatttataatcctacaataatacaatcaaacgattactatgatagcagttggacacaaagctctattccctgcgctttgctgcagaaattactgtagacccccgattttgaaaatcggaaatcttctgtgtttatccgtaccaatccctggatcagtagttggtacacacatacatagttggatcacaacatatcacgaatgaatttaggctaaaagagttaaacacttacattagggccaggtaggccaacaactatcagagaacaatagcggaagacaaaataatataagggcccggttaacatgccacaggcagtcgactggggaacgagacctagaacaagaccgcactccgatcatcttgtgggatacgcaagcgtaccgacaagggcttctcttcaacactctcctaaaagatatataagtaacaagggtgagtaccaaccgtactcagcaaccacaacaacaatgcatatgatagagggtattcaaggaatggtttcaggttcttttgcataaagctaatttttacaattcttttcacaagcctaaaacctagcatagactgatcaaattttagtaccagtgttcactttaaacaacgacagttctgtccaccatccattgtgatcccaaggatagcttcccgccattgaatcgtcatggttttctgaggatgtccaccttccctcctctcgggatgtggctccatcag

SEQ ID NO: 51815 - DNA, 833 bp, Oryza sativa
ggggcctcgggccaccgttcggctcgggggcctcttctccctgctctctcccgggtcgagtcgacacagggtggggatgcgcggagtgagggctgtcctcgtcgcgctccacgaccaatgccgcgctgaccacctgcggggttgccgccaggtagagtagcaacggctcatctggctccggggcgactaggaccgggggagaactgaggtacgccttcaactgagtgagggcccgctcagcctcctccgtccaggtaaacggcccgaagcgtttgaggagcttaaataggggtagcgccttctctcccagcctcgatatgaaccgacttagggcggccatgcagccggtgacgcattgcacatccctaagcttgctggggggcgcatccgctctatagctcgtatcttctcggggttggcctcgatgcctcgggcagagaccaagaacccgagaagcttgcccgcaggcacgccgaacacgcacttgtcggggttcagctttatgcgagcggagcggagactttcgaaagtttccgctagatccgagagtaaggtctcttggttgcgcgtcttcacaaccaagtcatcaacataggcctcaacattacgtcctatttggctacccaaagaaattcgagtagtacgttgaaaagtaggacctgcattctttaacccgaaaggcattgtcgtataacaataagttcctatgggggtaataaatgcagttttttcctcatcctccctagccatgcgaatctgatgataaccagagtatgcatctagaaaacacaaaaggtcgcaccccgcggtggagtcgacaatgtgatctatgc

SEQ ID NO: 51816 - DNA, 1783 bp, Oryza sativa
tcatgcgcacagagatcagaacatggtacaaagacactgaaaaaaacaagataattgatgatcaaatagtggcatttctagatcaactgtacgatgaacttaaagttgcataacaacaatcaaatcttggatgtgttcgccgaaaaacaaaacaaaagaaaacaaatattgcagaagtagagcgagtacagtaccgtgttcctccaaggcacggtgaagcagaggcgcgacgcgcgggatgaagtcgtggggccggtccatgggcacgggcttggagcgggccgccgtgacgagccgcaggtcctcggtgaggtcgccatggaggaagcggtactgggtgcccctcaggccctgggccctgagggcccgttccatccgccgcggggccagccaggcccactccagcatctgcgcggcccagaccagcagcagcgcggccaccgcgccgccgagcaggctccacggcgaggcctcgccgaatggtagcgccgcgccggtgccggtgccgatgccgatgccgatgccgatgccgatgccgatgcccattgcttctttttctctctgcatgtaccgagcaaagcaaatgtgttgttgaagcaaacgggacggagagatcagtacgtgtgtgcagagtgcagtgcagatatactaaccaattactaacaaagtaacaatcaatgattgccttctcctgttctccaacactaaaaagaaaatgatatcctaaaaccaaaaccggaaattagtgaccatcctgtcccacagaataactccgaaatcctatctgatactactgacgtcactgattacggtagtgaatcactccacgtgacggcgccacgtagccggaggtgaggtgaggtcacagcgcgacctccgccgcattgccacggtggaggaattcagcaagacacgtgtgtgcagtatgcatgcagatgcagtacctggtaccttgtacgcgggcgaggcgtcgccggcgtcggcgtggtcgacggtgctcaggttggagatcaacgaagggggaggccgagaccggccgaacgagcaggcggggaggctgggggctgccagccggtgagcgtttgggagaaaaggcgaatggcgccggcgccgccggagagatgggaagaaattaagatggggggaggatttggaaggatctcaaacagaaaagacgtggctaacataggtgtatctcttgcaggagcgggacaacgacatggggagcatgggcgccgctgcgcatgtcgacgcgacgcaagcgggggttcacgcatcttggcgtggttctacgtgcctcgggcggtggtacacgactggcgctttgaatggaggagaggatgtatggttgcaaatcccggagataccgcaccgcgcgatagggccggaggaaggagaagctgatccaaagacagaccccccaaaatgttcagtcatcagtgggcctggaacggaaaacatcttccggcccatcaaacaccccatgttgatgcacacaggctataaccaacgaggcccatggatgcgtaaggtttagctgaagttttgatttctgggctaaaccttctgcttcagacgttctgatttctcaagctgacgctcgaacattgtgtttttttcttttaagaaaagaacatttgtgtcattttacttttttttaaaaaaaatacatacagagatgggcatgtcgcctacgtggcaccgtcccaccaccattacactgtcctccacctcactcattgcactcacagtcgtcgtccatctgacccttccctccaaaaaa

SEQ ID NO: 51817 - DNA, 1557 bp, Oryza sativa
catgctaacagagacaatagcatctagacatatgtttaacaccagagtgaggagaacatacccgcagaacgctctggattcagaggttgtggtgttgatgttgtcgttcccgattgagccgttgccgttccctccattgctattcctgtcgcagttgtcgttgacgtcgttttcgatactgatcgacatgatccggaggttgatgtagaggaagcatatatgacttgatgccgaggaagtagtgctgatgtgaagcagaggaagaagtagagcagtcgcgcgaagaacacgctcccaaaaattttatcgcccacctaaccgtgcatgtactctggtggacggaattctggaggtctactcgtcccaaatacccgtatgcgcaagtactcagaactaggaaacaaccataggagcacataagcagaggaggtgtctacacaagaagaaccaaaaactgaggtagatagaaccgagagagagctctctatctacctagaggtggaagataacgcaagagaaacattactacgttaatctcgattgattgcactataggcctcgtctgttaccggagtaatgaatcatgccggttatgcttttactcataaaaacaaaacggctgaaaacgagcagcccgtccgaacccgccgctttgacgccctggctggcttggcttggctcgagcgcacgcgtgtgacattcccaccaccatctcaaccgctcagtaggtattctctagtagtctatttaagttaagatcatttttcattggtttttaatgtggtattaatctcttaacattaattgtgagcccttgaaattacaagaattaatttgggcctatcccatttaattctaatagataagacggagatacataaataaagaaaaaacaatttatatgtaaaacattttatatgtgtattatcagtttaaaagtcaaggctaaaaactataatatggtgaaaataattcaaaaatcctattgtagaattgtgttttatattaaatatttagttgtgtccgataagtaaggcttagattggatgtgcaaaaattatatgcgtagatttatcttgaatagtacttttatggtgctataaattatatgtagattttaaatagtttgtaataataatatgtggtgaaagttttattttaaataccatggaatgtttattctttcatgaacggatggagcaactggctagataatatttttatataagtatcaaaaaaggagttgaaaaatgtgtggtaaggctcatgctcgtaacttggctagataactgttccaagtgtttgatactttgattgctcctagtattaatctaatacactcctcaccacctgcaaaatacagtcaaaacgctagtgatgatctcctaatggcccgattagtcgtcacaggtcaaccatttggtaccttattatgtaacaagcatagtggcccgcgcagattgcgcggctagcatcattatattttctctcatataatagcatatatgttttctcattatattattcaaatatattaaaatgacaacataattttaa

SEQ ID NO: 51818 - DNA, 1030 bp, Oryza sativa
agggggtacactttacccacacgacattactaacccggatcacctagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccctgacaccaccccggcgaatccacatgtctctcggcatcaaggctcccctgataagctagttactcagccaggggtgttccattccacccatgtggtcgtacttgtcttatgtttggatgaaattccaaggaaacggtccttaagtgcaagagcgggaaaccgtacacccgatacgttccccggtccgctgttttggaaattcatttagttcgcaagcaccgacccaggtgtcgggttttccaagtctttcgtaaaacccaagttttacccaagaagttttttagattttaagtttgaaggcgtccgtcgatactcgcacagggtgcacgaatatcaagacgcaactagatggttacaaggggacacgatataacaattatcaaaggaaggatcaaatgcaacaaattaggtaggtccgccaatctgccttgcaggcgagacaacagattaagtgcgatcctatcaatgcataatatttttaaaaaaacataattaatttcaaatataggctcaagatgttcaaaggtggcttgccttgctcgagatctggagcttgatcctcgaaatcctcgcactgcgggtcttcgggctccgaaactacacgcgaaacgggagaactcaacaaacggcgaaaataaagccctattaatgacctctaagcatgccattagatagatctcgagatttgaggaattttggaagttgaacggagtcaaacggatttacggttgggaagatattgaatttctaagattattgaatttttggtctaaaggaaaaggatttcattaaatcctttttgaaaaagaaaagaaaagaaaagagg

SEQ ID NO: 51819 - DNA, 1029 bp, Oryza sativa
tttcctatccctacccatgtcctacagtctacagatagactcttttggccaccgtattcttattggtaagtgacttaccgctagttgtttccaagatatcgtgtggctgtatttgacatgagagaaaagagaagattgagaaaatatgcaaaataaggtgactcattagcgtatgattaaatgggtatatattaactattttaaatttaaaaaataggttaatatgatttttaagcaactttcctatataattttcttttttgcaaaacacaccatttagtacttcgggaagcatgtgtgcggagaataagagaaatcttttctcaatcaccagctaccgaacacagagtgctgtctcattccttcttacgctataatatcctcttgaactatttaatgtacgttgatcagacatcgtcttatgtgcaagctagttattctcgcaagttattctcttagacttttttttgttccttttattaattttctatttttgagactccactcaatcctaatttcttatcctgtggactcatcattttctttttatgagttctccgaatctgattcatcatatattagctttttttccaccatttttttctcctctttcaattttgatgactgcaaggaatgtaaacgagagcttgtcgggggcgtgtgatctcagcatcgacatcagcatggtagagacccctcgcgggcaataaccggtcggccgacggtttgaccatggtcgagaaaactgaggagaaccgtatgaaaccgtcacggcacacgacacggtcgcgcggaccattgaacggtaggagacgagacccgtagcaagtgggtgtgcaaccgtgctgtgcctatccaacgcgaccccatgccgattcgtctctccaagttcctctctccgaaagcgaccgcgatctgttgaggaggaggaggatcacgggattttcaccggcctcacgggagatttgccgtgttgaacgtacggcagctgtggaatatcaatcggtcgaagagaagatacgcggtagt

SEQ ID NO: 51820 - DNA, 1032 bp, Oryza sativa
aatctaattgctctgagggcaaaccaccaccattgccatgattccggacaagcgaccagaagattattgatagtctcgttgcattgatcacaaaagacacatcgatcaaggtgtggcaagccgcgattgtggagctgatcggccatccaacatctattgagatccaccaaccacatgaagtaacgacatcgaggaggcgccaacgacctccaaatcggcttgtcctagaactgcaccctttccagttcccacaaacagagacaggtaggcggaatatgacgagtattcccctgaagactcccaccaccagatgagggaatcgggctccttggagaggtcatccaaggagtggattgcaggccacagattgagatattcgaggattgcctagacccctaaggcactggtgatgtccttgatccatcttctatcttgtagtggcaaatcattttctggtaggtttgggagtgttgtcttgcctgaatggaatactaaatagcctaataattcgaggtacaaacaaatgtattaagtaaaagaatggtttaaatgtaatattttaaataacttatatgtaacttttaaaaaaaatcacaccaatagagaacatgtatattcttattctattttattctcggggaaagaacacaccttaacagtttaggatttaagaagaccagctgaatacccgtgatatggagtacggatactcatacacttcaactatgcaaggaactgcagcagcggttgtcagcaaatagtgttctgctttcatatcagagattgagatttcagagtgccggatgcccggaacatggagcttccagtgtttatcagcaaatgtgttctgctttgatatcagagattcagaatgccggatgcacggatctatacagacgatttcatttcatttcatctttttttctttccctaacccgacgtcagagtcgccgcaccctaaccggaacgccgtgctgcgggtgcagcgtcagcacggtgtagggcgcgtgcgcgtacgtgatgaactgctgt

SEQ ID NO: 51821 - DNA, 2035 bp, Oryza sativa
gagccccaatcatgtgcttgtcctagcatgacagcaacttggccggccttttgcacaatcacattgtgtagttgtagttctgcaggtttgcaacgcattaataaacggcgtttggcccattgtttaactcaaacctaacctgccactttgctgataaattgttgttcatccatcatcctagtgcctcgtgagcactggattggttcagagcagcagctccagatccagagatgccgcccatttgagttgtccttctcctttgtttggtcacttgggcagcatcaacttgtggattgtcttgtccccgcaagaacagtgctaatgcacagatcacacacttaacccactgcaaacaccacatgagaaagagagtgaggaaaaaaagaggacagatgaacaggagtccattggtgttgagattatggcccataatttttttgtgcaatgctgaatactcctttatttgttctatatataatttgatgatcattgcctgaggagtgcttggtgtatgcaactctctgcatccagcagttcactgcacattttctttgggtcatgcgtttggcatctgttggctaatgagaatatttagggcccctttgaatcgcagggtagaaaaaacggaggaataggaaaaacataggattctgacaggaattaaagtgtaaaacagaggattgcaaaacacaggaaaaacacaggaatggtcgtttgattcgagcgcaggaaaaacgcaggaatcggatgagagagatagactcaaaggaaattttccaagaggttggagctcttgctaaatttcctccaaaatctacatgcaatgtgtcattccataggaatttcataggatttggaaagcttcaatcctttgaatcaaagggccaaataggaaaatttcctataggatttgaatcctatgaaattcctacataaatcctttgattcaaaggggcccttagagtagaaaagcttcagtcaggtatgagtttccatcaaacagacagaaatgtcaagctaatgagattagatcttgccaacttaaatgctagtcatgccagggaaatgtagttggctagaagatgaataatggtcttttgcaagaactgaaaatccctttcttgtcccaacaagacatttgatgtttattacgatcactcataaactgtttcaagaattgtcggtgatttttttaatttaattcatctcaagttttggaaatgaacgagcaaaatcagtcaccagtcacaactgacaactaggttcgatctaatcagcaaagcctaaggacaaatcaagagtataacttcttccagaactatttcatgatgtgtacgagataacgagatatttattctattatcaagaaaatctagtgatgtacgagaaatcactgactaatttactgcgagagtaaatccggtattttccaaaagtataagtcatggttcagattacagaatatgttcttgcaaaccatctttcacaaatacaaagccactttgcttttcctttttcctataaagcaatatactttgctgatgttttgacaaaagatgcgcttacagcgttccatcaagagctttgacatttgcagtagatgattcccagtacaaaacatcagatagagagaaggcaatgagggtgaatagcttttctgggatttagtggagcacttcacttctatgaggccttcatatttcatacaacatgtggacactctgttcatgtaatcttggatatttaggaacatgacactactactacttcaatcagaaaagttgatgtgacagaaaaaataaataaaaccaaggtgttgacacaccataaagtaagcctataaatccaatcttatcactgttcacaagcttggatgattgcaaagccctactactgccataggcccacattggaggaagtagttagcagttaaacttgtgcttgatcgttctataatcatcagaggaaaaaggtttcctgaccaaactagtagtgattaaaaagctttccaagtccagcagccatatgcagttgt

SEQ ID NO: 51822 - DNA, 1001 bp, Oryza sativa
tattgctaagattggagccactgaactggtagaaatagggaaaagtcagcagttaaaaaaaagaatcaactttgtgccatcatttctctcctttgccaagcataatgcgtctgaaaaaagctataatttacgtcgtgtttgacaagagctaagacaggatcatcattgacaaccctgaaagaacactgcaagagaagatgtgtggaccatggatgcagttcccaaatatggctctcaacatagaaccacaaatgcaggtttaggtaaacacaatgcaaaagcaaacgcaatggaaatggattcagaggagggtgtaaccagaagaagaaccccccaggttttcagtattaaagccacaagtaatcttgagttcttgacatgaactgtctcctgattacaagtctcttgtctgaacctgaattattaccccagtggtaaactggtaatagctctgttcatgtaaatagtagtagaggcagtaataaagtttacacatatgaaaacgctgtaccaaatggcgtatagcccttgcagctttctgcttgggtgaatcaatcacagtccccctcattactactcctgcgtttgaaacagcccaagctttgcgctttcttccacatcagtctcattcaatcccgtggccggatcgcagcttgttgcgagcatatgagatattgagatccgcattcctcccagatctgaagaaactaaaatgttctttcgttttcttaagccggagtggcaatagtagccaattatttgacaagatgtttcagagatggcaaagggcaagaggagatccatctatagcctcaaatgtaccatcaccaaaaaaagctcagttcagcctcggatgatcagaaagaaaaaaaaatatcagtcgagatctcctgattttaagcacaaaaatttcggacatcttgctttgacaatgagtggctgcatctctcactttcagagaaacctatcaccctttttttttctttggccaaagaatggac

SEQ ID NO: 51823 - DNA, 721 bp, Oryza sativa
ctgcaatccataaaccacagtaggctggcacgtgggccatccacctatttattttctcggtttttattttctaatggaaatcatgctgtgtcattgacaagtggggccgacccttttgattaggggtaaaccgctccctttaatcaccgatgggtcccgcttgtcattgacagtaaacataatattgattttaattatattttctaatcatccggacccacgcgtcatagaatcggctaatcatcattagggagaggattactgtgcgctaactactatgtgggtcccacatggtttctctctctctcgttcttttctttcttccccgtcgtcttctacctctcgctcgcgacggagcagaggagcggcgtccgtgcggcgcggcggcccgagccggaacgactcggcgcacggtggggcgagcggcgcatcaccagatacccgccggcggcggcggcgaagcgcggcgactgcccggcgcgcggcgcgacggcgcgcagcggcgccgagatcccaaaagcggcggcggcacaatggaggccaatatgagcgcaaccaatgacgatttaaccatctagggtcctcatggagtatgtagaagcaaaaacctagcctaagttacattagaacgaggcccctccacgatgagctcggccatggtgcggtggcggccggagtcggcacggctacggcggcgcacaccccaaatcgagggggccgc

SEQ ID NO: 51824 - DNA, 4075 bp, Oryza sativa
aaagctgaaatgcatattgccgcaagcagaacgcaacctgatagtgtagctcaagtgctcaactgaatcgattagagatgctccaagcctccaactcagcaacatatgtaagcaactaagcactaagtataataaaccatcaagaatgcaaaatcaataagttacaacacacgtcttaaataattaaatatggtcatgtcatatggcagggcgaggtgttccgataaatcaattgaataaatctatatactctgatgtacccactaaattccgcttgttgggataagcctactgttcaatgctcatccttctaatgtgcctatctatctttgactaagatcacaatttcactttaacactggaacatctacataactctctacaggccaccatgctactcaacaaattttcttggttccatcatcggatggaaaatctttattgctttcttcatcagatggaggtggcacaccaaatacccagtcaaggacattcaggtacttggaccgaaaaacttctctttcttgagcatagcagtgcatgatgatcgacgtagccatactgaataccaccacgtcggctcgttttatctgcagaattggagggcaaagtcctgcatcggtcatgcatgtgaaaaaactctcaatagctctcgcgaagcagtacagggctatctcgattcgcctgctcttcttctcaattagcagtgccagacctgtgggaaactgttgaaagagaatggttcaatagtccaaagctgattattatatactgaattcatgcgtctgcatttgcttaccgtggcaagtacaacgagtggagtattgcagctctggaagattctgaaaagcaggcacgtccatgccctgaaacagagaaggaaacatccagaattgtcatcccaagagaaaattgtactatctagatgtctactctaagaagataaactcaccatgcagaggcacagtacactgagaggaacaggcttgatctcgctgttcctagaagattcttccctattattgggtaaggcctgcatgttatgaggaatatagcacatttagagaaatcgggcctgttgcaaaaactagactaggcagcatgatagcttgcatagatagacagagtttacactatcaagggtactctttctaaacaggtcaaacttatctgacactgttattcttacatgcaccgcaattacccttgagatatcaagctcaattgatgaagtgtacttgtaagaccaaataccttttcaataaatcctgtcgatgaactacaagtgcaggaactaaatagaccggaacatagacaggtactgctcttccatatgcttgaaacaagaatgtaataaaatgccctgcacatgattgatttccatgcacaatctggattaaagagagaatacattagatcatggaaattttcaggttaacagacaggatgatgcgcgtgcacacacaaaaaacaaaaagaatttttttacataaaattgatgtatggattatatgcgtgaatgttgatacatgtaaaatatgatatgaacatgattcaaccataaggaacaacatgatactaagacatttgattatttgttgcacttaccgagcaagggactttcatatttggatctaactttaggtcaacacccacagacttgtagtacttctcaatacccgctaggttagagaaagcagtgtgattgactacttctttcacaccttgcagaatagtaagatccttcccaccatgcttatttagaaatgctttataagttgatggcaaactttcttgacttaaaatataggcagatctacataagaaaaaaatattaggcaaaagttaccctcacacactaccaaacatgcaccacaaaatggtgaacagcatatatacatggtactgaccgaaacccatgtgactcatgttatatttgataatataacagatcaattaataaattgtcatagcaagataataaggaattactaatgatcaagaaatcctagcgaattcttcattatataacagtctcaaataatgcattctttatatccatattaaaaaaatccagactaaaggattttagaccatttaaaaaacaaactacattctgttatcacatttcgtacagatgctatactaatttcaagctttgtactatgtactgtatatgagtatctcgtccaaggctccaagcaactccatccaatggatagctgtcagtacattgagttattgacaataggatctaagcaaaatccaaacatacgacatgcacaactactaccttctacagcctagatattcatagcaaatatgagagaacttacaaaatttgtgcagatgaaaggcacataaggaagatgtcaccatgcgaccaagtcaaaggcttgcaaatatttccaaatcttttgctctttattccacaacgggatgcaaggacagctgcacgcataagaatgtatattgccaagctagtatgttgtgtgcctggccctgtcaagagcatcgaaggaccagcaattaacccagccaataatgatctccaccttgctgttctgaagtagcaagagtatccagttatacattttcaattaaatactgaatggaaaaacaggggtagtacagtataatggaacagcacacattctgaggtgtaatgctgaattaagaagaaaaatacagccattcagcagtttgctgaatttgtattcagtgaaggctgacagaacgccaagcaacactggaacattttaaccaaaggcaaagccaatgtcccgttataatatatttgctcaaattatcgcagatttggtaacccatcatctgatctagatactagtagatgctatcatgcaaatttggcagcacagttcaccaccggccatcaccaaagctctcatgtttcctagcgaataacaaggagaggcagaggagtactaatttcaagcaactgcagggcttcagccagctgacctcttacggccccagatgccggcgatgcactcgtcgacggagacgtagcttccggcgaaggtccccaggaacaagccgtacctcaccgtctccttcagcgctagcaccaccgcctcctcgttggtcatggcgcccaccttcctgcacgcaccgcgccacaggaaaccgtaagtcacataagcagccacttcagctggggacagcggcaaagcgaaagcgaacgccgacctcgatctgggggaccggcgccggctgcggaggcggacgagcacggagaagagcgcgaggccgcccttgaggcccgcgccgatggtgaagcccttcgccgccgcctccacgcaccgccgcagccaccggagctcgccctccaccgccgccggcacggcggggaggtagtggccggcgcgcggggtgccccccggcgaggccgcggcgcacccgccgttggcagcgcatttgagttcctccggcgaggtgggggccatgagttcgccggagatgggatccccctccgcggagtaaagaggaagatgcctgcctctgcaactgcaactgcaacgctatgtggcccctgggcgcaagtcgcgagcgcaacgtgtggagaattcgccgaaatagtagtggctgctttgtgggccccaccaccctaactggacgtttacctctcaatctaacgctgcaggctgcagccacgagtccatgaccatgactgtcttgttcaacttcagcctgctaatttagtattttcttttcttgtttttcttaatattattttgagaattttattttccttgatgtaagttatatatatatatatatatatatatatatatatatatatatatatatatatatatatatatatatgatatatataggatatcttcgttaaaagaactcaaaatgacatttctgttctatagagaaggatttcgagtagaagatactacgaggattatgaggtagcaccaccgatttagtgtatggtgctttctataatcaataatatatgatgttttagaaaaaaaatctataggtttgtttggtttaataccctaccaaaaaattggtagtgccaggcattattatcttt

SEQ ID NO: 51825 - DNA, 1037 bp, Oryza sativa
catcaactaaacactactacatttacatgttttacaaattagtttttatatattttttaatattatgtagtctaatattcgtttgaatcaagtaaataacatatatccaaataaatatgtacattttacttatagcaaagcatatgtatttttctagtaagttttaaaaacgtcatctaccggagggagtatgattttactcccatacctcctaaaaacttgttgggcactgttcatatcatagtgttaacctctcttattttagcagtagcttataaatattaaaaaaatacttatactgtcagagtatgttgcgcgtgcttaagtatagccatacgatttcgtttgaaaaattgataattaaaaaactaataagagttaaaattaaaaatcttatgggtagggaaaggaacatctgggagaagctagaagctgtctggagtgctggactgttagtcaatgcgcaagatgattgatcagttcagaataacccaattttagttgaatcaatcgatcgtgcccatgctgtcatcaacgaaagattgatgcacgcgacaagcaggcgacacgcccctcgcgagcgagttccatagttatacgtcaatgtcggatccattaaaaggtggcaaaaatgagcaggcgtaagctgatggacgcgtgccgatacattccccagtgatgatctgggaaagaaaaccgaacaaccacggagaattcatgccattcatttggcatttttctatacaaatctgtgggctgagtgtgattagcgatcgctgtcatgcagagacgtgaatagctcttcaaaatacagtactcgttgttctatacgtactgtgcttgtttggacaatttgttagctcaacggcttatctaccagactaccaccaaagtttgtaatgatctgcttttaatgcttttattatacgtccatgtcggatacattacaaggtgtggcgaagtttgatagtttttttgaccgttttgacctaggcgcaaaaacactgacgaagtgacaacatgtttcgcttagtaaa

SEQ ID NO: 51826 - DNA, 3757 bp, Oryza sativa
ctgttatgctgtcctcagttttctgcatatgctccaatatatagaagttttacaaaaatcatgtatctgaacatttagtttatcacatccacatgtatcttgaatagcatgggattacatccactacgcatgttttccaccactaccattagtacactatgtatatttcttgaactaattaccatctattaatagtgatgtccaagatagtagatagcagagttatgcacattgtagcaccagagcggtatgtggccttgaaagcagccttgagatttgagaatggtttaacaattcaaaaaagataaacacctcttagagtggatcttctcttccatttgtactctggagcaatgcatcttagagtggagcttctgtcaagttcatccatttggactttggagcaatgcccaaaagtctgtgtggggcagttccctttaacctgaggcctattgcttgtttagaattttacagttttatagaagtgattaaattatattccacaaaataaaaagaaaaaaataaagaggaaacgactgcactggagtacactaagagctgtgtgcatgatgtactgtaacaaaaataattatttgtgacctttgctcatgcagatcagcaaccagaagaagaaaacaggtgttatcgctcctaagcgtttcatacaacgactgaagaaacaaaatgagatttttcgcagctatatgcaccaggtaacattttttgaatggtgcatttgccaatgtttattctgtggttttaagcaaaaatgtgatcacgctatgatctcttgctctggcccttaggattaagtcagttggccccaggcggatttctgcacaatttgttgttgtgacttgtgaacaactctgtggtctgtgcatttcttcttgatgttttgtaggatagatgtgtagcattaaatccattgtatctatattaattatttacaataagcagcttactctagattgacagaacctaaaaataagtaggagggatacctactacaagcctatcttaggtgcttctacaaacttctttttaccgggcccggctgaatgaggtgctcctacaaactgagaatatgaatgttggatgtgatatgtatgcagtagactttacatgtactttaggttctggatgaatgaacatattccattaaccccctcgcatactgagaggtcatgtgtaagtgtaagggataacaccgccttgagtctatctaaatctggtattccccaaaaaagagtatatctaaatctgaccatcttgatatccctcatagaccacatgtgaatttgcaagatagcacttaagatgtatctacataaggatgagatactataaatggcaaactgttaatggtgtagaattggcttggtcccagtccttttattcagagtccatctttattttgtttagttgtcaatagcatcctgagttgtttggctaacttaagcattgtagaatacctataatatatgtgtatttatgccaattctatggtactttactatttttgtggatattatctttttgatctatatactcgggagctcaccatggactgaaaatactatttgtattttacaggatgcacatgaatttctgaattttttgcttaatgagctagttgacatcctagagaaagaatctaaagttgttgcagaaccttgtgaaaattcctctttgaaaaagaattcaaacgggcctataaatgttcaactcaatggtactaaaaaagaaccagttcctactttggtccacaaatgcttccaggtgagtttctatccgtttctgccaatatgtttttttgcatgtgcaagtgcactccaattttagtgcttgctacagtattggagatgagccctcttgttcttttcttttttggtagggcatattgactaatgaaacaagatgtctaagatgtgagactgtgactgatagagatgaaacgttttttgacctaagtctggatattgaacagaatagttcaattaccagctgtcttaaaaacttcagctcgactgagactctgaatgctgaggataagttcttctgtgacaaatgctgcaggtatgtcagtccctttgattttgtgttgctttctcatgtggtatcaatgtcatctagttgattcaattcagctgcatctgaactctaatcgtcagttattatctcttcctattttgcttgacaaaccaaacactagcacctgaagcgtctgggttaggaaatgtagcatgacttgaatgttaacgaaaactatgcgttttcctatcgtttgtcatattgactgtgatggaaattgttcgtaatttcagtttgcaagaagcacagaaaagaatgaagataaagaaaccaccaaacattcttgtaattcatctcaagcgcttcaagtatattgaacagcttggtcgctacaaaaagctatcatatcgagttgttttccctctggagcttaaacttatcaatactgttgacaactcagacttggaatattccctttttgctgtgctagttcatgttggaagtggaccaaatcatggccactatatcagcttagtgaagagccacaaccactggttgttcttcgacgacgagaatgttgagatgactgatgagtccatggtacagacattctttggctcagcacaagagttcagtggtaacactgataacggctacatactcttctatgaaagccttgctgaaaaaagttgatgtctctctcacatttttcgatagttatacagttatcattttattaccacactgcctgcacctgataatatagaagattcagtaattagaataagttgaatgaaagaccattcaactttagatattatatggtggaatctgcggtaggcaataaaagaaaatgacgagttttgtggaaggtgctatagcggcataaatccacaggtttcttgttttctgtttatttttctgttctttggtttatgcgtacaggttgtaccaatcctgggataatgtttatttaaagtttaccatgtataaaaatatgcttgtactggaagccgtttggctctgagtatttttttttttgtttagaaacataaagctgatatgcatggtattctccgtcatctttcttttctgactgcttttgcatattcgtttaccgttgtactgctttactccttcctctgtatttggccctcaccataagttttttgaagtctaaattcggagcagtttcatttttttaaaggaataagttcactttatatttcttaatttgtcgttgtctgaaatcattacatgaactgcaataccaaatataatgtgtacctaaactctggtgtatccgaggtcctagaaagtataatattggttttggttgacatggcaagtgaactcatgtgggcccacatatcagctggcaactcttatttataggagagtggtggggagaagggtggccactgatttggagaggggcggcaaccgacgggagggcgcaagcgagtggccactgatttgtagaggggcggcaaccgacgggagggcgcaagcggggtgtagcggggagaaggacaatcgtcgacttggagagaggcggagtcacggaggagccatcagacccggctcttcgtcactcactatcgcccagctcctctctcgccggccgctcgaggagccatgagaacaaggcttgtgtcgcctattgtcgcgtaactcctctctcgccggctaccagccttctccccgtcggtcgccgcgttga

SEQ ID NO: 51827 - DNA, 7874 bp, Oryza sativa
atgtagctcctccacttgtgctctgttcttccatttcagataacaaagtttcaggaaacgcttggattggagtgcgcaccaaataaacgaggatgattgtgcattatttgatcctacacatggcgcatggcagtttcaaagattaagcacatcacatttgaaattttcctccaattcagtagagcatcatatgcctaattgcctagcaaattgcttcacttccttgcaaggctgaagccctggtgaggcctgctcttggacctgctcctgctgcccctatggctgccgctcccattatccctcccccggttcttcaccgacgagccggggctctggctcagccgccgcgacgacggcgtcggccgcctgcgcgagctccaccctccgttcccgagcgccgccttggcgacgctgtccttggccgcctcccgcgcgcgctgcggcctcacgggctgcttgttcaggtactcgagccgcgacaggaggcccgacgccgacttgcggagcgcgtcgtcgccgatgtttgtctgcaccgggttgccgacgaggttgagagccctcagcgagctgtagttggcgacgagctgccccagcgccttcgtcgtggtgatcttgttgaagctcaggtccaccaccgccagcttcagcagccggtgcagcccctccacgtcgctgatcttgttcccggcgaggtacagctccctgatcgccccacagttcgacagccctgaacgaatcgaaaccacaaattgttcacttcttttgattcaattcacacgaatagtataattaactgcagggtacactgtcatgtctcatgtgatactagctcgcatggtgcatggaaacaagctaagcagtgcgtaggatggaccagagcggaccgatgtggcatccagtcacgctcgcgcacagcggtttcttttcttttctagggacgagcaaacctgcgggacatccactcgattcccaaggttctgaagaagttggccgaaaggagcatggtacacggtcacgagtatcgtctatcagaatgtacgaattgtactatccgaaaggtaagaatgtgatatgcctagattggatatctgatgggtgtcagcatgcggcgccctgtgtatgtactcgtttctgcttatcaatctggagtcgccggtaaataaggtgaagcacatgaaccttgtatcgatcccttcagtgtcacagtgtgtgtgccagcattagtttcagagcatgacatgacgcatcgttactgtgcactactaaagtctgtaccatggaccatcctagtacttagcccggcccaatgtctatcgactgccaccgatccagaagtgcacacgagcattgcacaatgaacaagatccacgcaaagcctggctttcaccagtagcaataaacttactgaaagaaacagctgtgatatctgacgaaatgcttaccgtgaccaatccgtgaaatcttgttgtagctgaggttgagcacgcgcaacctcgtcagttcgcgcagcccctcgatgacagatatcttgttcctcgacagatcgagtgagtgcaatcccttaggcaatgatccagatgatatttgaactgcagaacgaatggattgatcagccaagaacgagaaacatgaagattaaattgccgcacgtaaaatgaaaaaaaaaattagcacataattaattaagttttaattattataaacttgataaatgaatatatttgatattttaaagcaacttctacataaaaaattttcgaacggattgtaccgtttagtagtttgaaaagtatgctaacgaaaatcgatataaaatatgtatcttaacgagaaaagaacgtgataatttaccgatgaggttgccggacagattgactgcccggaggctggagaacggcgagatcaccgggatgacagtgagccccatccccgatatgtgcgccacggacgaggacgtggtgagcgtttgtatgatgctgttcgccttgatggcctcgccggccatgcgccgccgcgcttgggcggggaacttgccgccgaacgacgagggctccccgatctccgtgcaatgcgggcgagccgtgtcgtcgtcatcgtcgtcgtgctccacgatgcattcctcgttggctttgaacgggttgtccacgaggctgttcacccacgcgctgacccggtccagcgacgtggcctccgacgagaacgccatccattggttcgggatgggctcgtggcctacggcgatccccttgttcttgacgtcggccgtggcggcgcccgcgtcgagcgtgtcggacgcgtacccgtcgtgccgctgctccgccgacggcaccgctgctggtacggtcgccgccggccggtgcaggttccggtggcttcgcaggagcagcctccaccacagcttccggctccgggacgggagcacctggctggacgaacacttcttcagcatgacgtggtcggcgctgcacgtcgtcttcacggacgcggctgggctgtcgtcgggcgcgccgactggggtggctgtggctgagccaccggcaggcaaggccatgaggtcgccgtaggagagcgacttcgccggaagttcgaacgctttcgagccacgcctcgccgtctcgatgttggagcacgagcgttccagcctcgatgccatggccggcaccatgaggccaaccccgggctcgctagcgtccggtgctgcggcggcgctgctagcatccttgtcggcggcgtcgctattgtagccggaagagtctgcgtcgccgccggcgacgaggtcgacgtcagatgtgtccctcttcaccgagacccatgtcatcgtccttgtcgcggccttcacaagccaactcagcggcgttgaaagcggcaacctttgtgtcacatgccaggacaatgtcaccaccgcctttcacgatgtcgacggtgtccgtcccctccatgaactccaacggtttcaccttctggaactcattgccaccagacttcttgccgtaaccaatcttgctcgtaacctgccatgttcagagctgataagaacaaaaacttaaaccaaaattcatcaaagaactgggtctcctaagaatataatccaccaacctttgataacttcctcttgccggcgagaagagcagagaagcagctgatcttggacatcttccccagccacagcactactaattctcttttacacctgagaaatctcacctatttcccttgtaaaattaacagaaaaactactcccgaaagaagcagccttgtaattcttagccgttgtctatgggagagcccttcttccagaggagaaaagcggcgaaaggaagggtgcctgcatcctcctgcggccgcacgacggtcggggcgccgcgcggcggtgcggcggagaaggccagatcgatcgagcggcaggctgggtagtgtactgtgcacaaaacacgggggaaagtgcaaacgcgctcgcgtgggcgtgggcgtgggcgtgggcgtggcggaggcagaaataggcagcggacgcgagaatcacagccctcgactcggatggtcatatcccttggcatttttatacggtatatcagcggcgtacgagagttggtgctggaaaagcgcggacgccagcctacttggccaacaactacccgcgagggcggtgggtgccgtgtgccacgcgcgggcgcgcgacgacgagacgagggtggcgcctggcgcgcgcggggcagcttccgacgtcaccgcggcccgaaacagcctcgcgccgctggagaagttgctcgggtttttttttggggcgggcgctttcgagtggcgacctcgggtcggtcgggtcttgcacgtacgcctgctttacgtcgtaccgtgatacaattgtgttgtattttgggtttgactttgggagagggatcggagacggagttctttttggccccgagcgtgtctgcgtgtaatttaactctactttggccgcgcttcggtcacggaggatgacgttttgcgtgggtgttcgcctgttcggtgttgtctggttcagtttacacgttgttcggcgcggtaggcctacataatcgacccccacccatgtcgaaattcacccctcgccacgggccagggtaggcctgacgccctgaacctgattaaattatcggtccagctgcaaacagggatactcatgcaccacacgagggaaagtatataaaaaaattcataaaatttgataagataaattatgataatacaagacaccgtataaacgtgcaaatctaaattcgatttacacaggaagaaaaaaataacaaatttatgcttcactgacttatttcattatttttctttctctagttatagatctaatatagtcttgcatgtttgtgcatacacttataattattatatttttttattctctctataattagttaagtcatgtataaatgatttgtaccatggtaactaggtatataaaatacttatcccacacgacatgctaatgacaaaaagataagtcaatgatgcctacgtcgatttcatctggggacttggcagattcgagcctcacaaaagcgaatggttcaccgtttcgtccgtctcgatcccgcgcgcgtgtgtaggccggcgtgctccggcacgtacgcgcgcggccgccacctcccccagctgggacagccgctagcatccgaccagagaatacgctgcatttggcttgtattttacgccgattcgtcagcctaatccgtgcaccgcactattatctgctctagttaaatctttcattggccgtcctcgtacgtgcagtgttactcccgtccctttcgttcgctcatcttactggatcttactgtttgttaattacactgtgaggtactcgccgagcgagttgagacttcttctccgagtttgacgagagcattgtataatatcattggatatgcagagatctaagagatgcaccctggtccctgcgccggttttgacaatgtcatgtatttgaagaacggtgcacgcctgcacggccactttgcataattgcatttgttcctggatgccgttttcattgcatctcggtggagataaaattgacagcatgtattgtacttatcagtaactgtttcttctactacatttgaacaatcggttggacatctaaaaggtgatgcctgtactgaggaataagttgcataagcagcaaatacgtactcgctgctaatagatatgactggttcgattcgctgactttcatgtcattcccccaagaggagagatttatcaactacaactttacatctcgtgccgctgccaccaccgttgaaaattgaatgtatgcaaaatggaaggcaagaaaaccacaatcaagagtcgccatcgatcatggcccgcccgctttgatttgagtggtttcttcgattcaacgatttctacggctagtcctttcactggtaataaaagccacaaacccagggaatataatctttttcagggagtcgtgttattatcgaacgctctcgtctgaagattgtgaggcgggtaacaagtcttcgcgtacgatttcaaggttctgatttctcgctatctcgttcagtcgtttaattgcgatgcgcacgatgcgggcagtttgcttgcgagttgcgagtaatgaataacaagtgcacgggcgcgagtggattgtctgtcatcttctaaagatttcaacctcgtccggtcaaattggggcacattccattatgatttggtttgtctttgatcggtcgcatgcactgtcgtcacgtgccttaatttctttagtacgagtacactgtacacgcatatttatttttgaatgtatcggcccctccaaagtagaccaagggcatcaggtgcctgccttatactgttcaaacaaaattcaacctacagttcgagcaactgaagtttcaaccacgtgcacaactcacaaaccaactctcacgatcacatcgaatggaggcaaaagaagcaaatatttcctcggctattccgctgatataaacgagtgtgcaacactgtagtagctggataatttgcctttgctagtttggctccacctgcagcatccttcgtcttgcttggaaacgggcaaacctggtgctcccgtctgcgtcaactcgctcgcgcgccacgtttttttcttcagaatgtcgcggcgggcaagtggggggcaagtgcgggcggacgggatcgcgcgggaatgcgcgaccgcgagacggcgccatgactttcccggtcgagtttgctacagctagctgatagtaacacagcgctttcatcagcatggatggagcaagtcgcatccatccgtagttttctctgaaaattctgtctgttatgcggaagcatcaggaaatcgaacgcatgctgaagagacgacgagatcatagcgcaacaaggcgcgcggcttccaatggggactagagatggaacatggaagacgatgaccggaaactgccgaggacggcggactactggacggaggaaagggcggcgccgtatctggtcaggtggctcagatgagatttctccggtgaggatagaggagtactggagcagtggtcggggaaaggagaatggagaaaataagtttcagcctactgggcttgatggctcgttggtgctacaggcctattaggccataaactgcaacccagctcactttggacccagctacagacgttccaacttggaataagttcactatttgaccctcaaaagtgatcgaaatctaatccatgaccctaaaccacaaaaccggatatctcgacctccgaactcttaaaaccggtgcaatttgactccatagacggttttgaagggcggtttcgttgacgtggcgcctacgtggcagtattgactcggtcttctttccacgcggtgttaacgtggcgcttaagtggcattagaaataaaaaatatgtatgggacccatttgtcattctcacacaaaaattaattgtggggcccacatgtcatcctctctctctttctcttcccttcacaagcgacggcggtcaagggaggccggcagtcgacattcaggcaagcatcggcggcaggcaggtggcactagggtggcgacaacggcggtcggggcggcggcggaaccagatcttcctcctccctctctctccctcatatctttctcccccgtttctcttcacgggagcaacgacaacggatgggggtcgggtttgcgccagcggcggtgcccactgggacctactaggagactgccacgaagcacgtcgcagagcggcggcggtggtagctgcgacagcaacgtggcagggggcagcggagcttgagagagtagggcgtgaccactcctcgtcgccgcaccacgtggagaaggaaggacagggagagagatggggtcgctaccgccggcgccggcaacgacgctgcgggaggggcggaggaggctgtggatgggattggaggaggcgtcggccaccgccgccgccgaagatccggcccctgctccggtgtagacctccgtttttataacaagaatcactcgtgtcactagtaccatttccctggattaagtagtgtggtactcacgattacatagctgaaatatcaagtgcgcatacaaggattgtctagcgcgaattattacatcataggcccgctggcatagactggaacataggaccgaatggtccataatacatgcaaaagcagaaatagataaggcagcggaattcaggcagcggccatgccattgccacaggcaacgaccgtaactaagacctacgaagcgccgtcatcctccgcatcctcctgaagataagcatagggatcctcctcgacttcattgccatccactgattaaaatttgtaatagcaagagtgagtaccaaccgtactccgca

SEQ ID NO: 51828 - DNA, 3828 bp, Oryza sativa
gtggcaactagcaatgaccctgttctaaaaaatataaaaaaataaatagcaatgactctgtccctagcgagattttttttaattttttattaaaatatttacagaaatatttttttaaaaaaacgcacttctagaaggtgagagtcgagtagatttgtaaatttccggaacagtaaaaattgtctttaaaatattttactaaaaaaatgtaaaaataaaaaaaaatctccctagcgaaccctgttgagaattgaactggacgacggttttgccgtggaataagttcactttgggtccctttatttgtcacccattccgattttcgttgcttgaccgcaaaaccggatacgatccgtcccccaacttatgaaaaccgggcaaacgattttccctcggcggttttggctgacgtggcgcctacgtggcttatttgactaggtcttcgttacacgtggcattgacgtggcgcttacgtggcaattctacctaaaaaataataaaaaccatgggcccacatgtcagctgcacacaaaaataattttaaaatagtggggcccacgtgagccccacatgtcagtctcactccactcttcttccctctcccttctctcttcatcctcacttctctcttcttcccctctctctctcttcttcgcgggcagcggacggcgcaggtgggcggtggagcaggcgagcgaggcaggtgggcgagctccggcggcggcggctcggcgtgcgccgcggcggggatgaggaggccggcggcggggtggccttggccgggtgccttggtggacttggcgggtggcgcggtggccggacctggggtggtgggcgccgcggcgggggccggggtggagggggtggtcggcgcggcggcgagcgtcttcttggaggagaccggcggcgtggtggtcgccgccgccgcgggggtgggcggagatggcggatttgggcgggaggtcgccggcccgactcactccccgccctccacgacgcgctcgccaccacccacaaggagcgtcgcaagctcaggcccgatttgggcgggaggtcgccggcgacggtgaggtcaatggaggaggcggtggcatgttcaacgtcgtgccggggctcgacgggaagcccggctccgtctcgctcgagctcgggagcaagcctgggtgcttcttggtcgccggcgccggcgcgaaggtgcaggttggttgcaggagccgcggcagcgacgggttaattaattctttgatcctttctatgctcaatttagtaattagcatggcaaatagcagttgaatgggaaaatgagtttggtttacatgtacactctgcctctcagtgtttactggagtagcagtgttgttactctgcaatgtcggctctttatcttgccattcttttcttagaaagagtatatacctcttgatgcagttgagtatactggaggagaccggcgacggcgaggtcaatggaggaggcggtggcatgggcaccgacgcctagctcatctccgccgagcgccgcagccagggccacagccgccggagccgtgccaccgtcgctagagaggagaggggagagagagtcgaagagagggagatggggagagagagaggaggaagaagagatggctgagaatgacatgtggggcccatgtgggtcttaccattttttttattaatttctatgtaaacctgacatgtgggtcctaggaggtttattattttttggaattgaattgccacgtaagcgccacgtcaatgccacatcagatgaagaccaagtcaaattagccacgtaggcgtcatgtcagtcaaaaccgccgttaaaaccgccgagggatctcatctgcactggttttgacagttgagggacgtgttgtatctggttttccggttgaaggacgaaaatcggattcgttgacaagttaaggaatatatgatgaacttatttcttttgccgttcggttcgattgattgggtcaggcccatcatctgggcttatggataggccgcgttggcgttggcgtacgtacttccggcccatcaccgaatcgatctcatgcacggctgggccatatccatccattaagtagccccgacactgatatatcgatcaatcttgaggcatttgtaaatttaccactatttttttaattttgtaaagagattattcgaattacagttccagtgtcatttcataattttctctagtggtagtcttataataataatttaaagcagtggcaaatttataattgttctcatcgatctcttgatctctcgagtttatcctgagaacatgtcctacttgtgagttgtgactgagtcaaatactcaaatcccattttagacggataaacaacacgaaatatcacatcttatagcaggtacagtaacaggctataaatcagctgtaaacatattttaaacagataaatgaggagagagaagagtagcgggctatagatttatagccagttgtagcacggactctaagacaccggatgtgtataacaggtgggaccagatattaatagtgtagtatataactattatataaataagctattagattgactataaataaattaaagttagtagttgactgtactattaaacttgctcttatgcacgtaacactcggtaactgatgacgaagagtcttgtctgacgcgagttttcgtcattgaaaaataatatcttcgacgctactaaacgtctaccactacaccaattagaccagaaacacacgctaattaatccaatcttatctcaatgatgatcaaactacacactttgtccccgagcagaatcgggatccagtagatcacgcacgaacgcaggcagcatactcagtgtgcattgacagtcctgcccttgcccggtcaaagacgagcttttcggtcaaagcaactccccgtgcgtgctctccatatttaaaaagctagaaagcgaccggagtttaaacaaagcgcgcaagattacggcttcacatagccactaagagcaagtttaatagtatagaccactattagcttcaaattatttatagtcaatttatacaatagttgtatactatactattaatatctggtcacatatattatacatacattatgtcttcgatttcgtactgtgcttttctatctctttgtttatctctttaaaatatatttatagctggcttatagcctactgctctaaacccccacccacctcgtaatctcttgggacttgtctttacgtacgccaacctcctcctctcgtcgcgtcgtcccctttgggaacacatatttttattcccatggagctagctatggttgcagttgccgattattccatagattaagattgctttgctttgcttgcttctgtgctcttctgccgcttttcacttcactctttgcttcggcccgtggtccagccagtgcggtgatggattctgtggtcgtacggtcccgtgttgctgctgtgattgccctcctgtgtgtgtgagatactgtgatctggggccatgaaccttctgatgtttgcttttgtacttaaaaaagttcattaaggagtgattgccatgtgtgtgtgacggaattggaaagctatataccaacgctagggcgatacgtggctggatctgaaaatgatcacgacccatgcagaactgaacatgtgaatttaaacactactactatcgatcaatcacaaagataaatccaggtgggcagtacaaatccatgacaattcctagtcacaaacagaccgacatatggcacgcaagtgcaaaaggttcagctgaaatatccacggcatgagtcagctgatggctccctca

SEQ ID NO: 51829 - DNA, 6573 bp, Oryza sativa
ctccctccctctatctctagagttaagggtattttgatcttaaaactctttaaagtggtattttattcggaagacattgtaccgaatggtattttatcctgtgtattatagtaagtggcatttcattaaaatcctacaaatgaagtggcacatgatctatttgctaatggagttgacaccttgccaagtgaggattcgcccatgattatttgtattgaaattatctggatatatacctgaaagcaacagtagttaagaaaaaaaaagaagtggtaaactcatttgaaaaaggtgataataagataactatcgaacaattggtaactcgtacattaattgttgaaactgatttttttaaaaaaatcattggattttctaaaaagatattaaactttttttaaaacacattgatctgttggctgtcaggttcgcaatgtcaagattcatggatatattgaaaaagataaaatcgttaaggccggtagatatattattggattaatttgtaactacaggtaaattaattgataaaacttagtatattttctgtaatttcatcagatttgctaaaaactgttaatttttttaaaacaatcgatttgtggaccaccataaagatttgtggtgcaaaatatggaaacaaaccttgttggttattgtgcggtgtgcctccactggtagccaacttagtaacactgtgtgtattcttttatacattagttgtatgctgatgacattacgatttcttttttaaaaaataacatcagaagttatatagttagtctcattttcattaagctaagttagacggataaatcaaaccaaagtttcatattaagaaaagaataaaaatatgatgaaacagggttctgtgtaagaattccttagagttcatgcatacgcatcctgcattagccactactaaaaatccgagaatgagtcatgattgatagcaccatcatcatcggacataacaaatacactttcttctcccatcctttccgctctactttgctatgccaactactcttctctcctccttgtgattgctttgctcatccctcttcgctgccccactataaggtatagggtgtccgttttgaatcaagtttttaattatttttatatgaagccagggatttaggtcgtactacttcatttttatggccctaaaagcataatataaattcatattagtcagttatactagggtttggtgtttccaatcagcattgtcgttttttctattaacatcagtatgcttctgctccgataggtttgctttagacactagcataatttaatagggcaagaattgccgttttccgattgatatcgacatgtctctgttttcatagttctatttatgatattataacagagagctactattgtatttcttttatgtctgtctgatttcattctatttcatggtaggttaggtcccgtttagttacctaaaagtatttctcaaaaacatcacatcgaatttttaccatatgtatggagcattaaatatagattaaaagaaaaactaattgcacagttatggaggaagatgaatcttttgagtctaattagtccatgattagccataagtgctacagtaatccacatgtgctaataacggattaattaggctcaaaaaatcgtctcgcgatttctaggcgagttataagattagttttttcattcgtgtccaaaaacttctttcaacattcggtcaaacatccgatacgatataaaaaaatttttcattttgcgaacttaacatctcaatcgatttcgaccaatctagccgctatgtgcactccttttcctctgctggttgcccacgagagcctatcgcctattcgcctcctccgctcctcaaatcccaatccccactcccacctcactccccccctctcttcgcctccctctctctctcctccgccatggcatggacaagtccagcctcccgccccgccgccgcctcccgcctcttccgcttccgccgccgcgcctcttccgccctcaaagccctgaacaagtcatcctacaagatctccaagcagacctcctcgtcatctctggcttcgatgaaggcatcccaatcgccaccgccgccgccgccgcatcctcgccgcccttctcctcctccgctcccgccgccgccggctcctccttcgtccgcccccgccgcggttgaccacccgccgccgcaaccgcctgtgtacaacatcgacaagtccgacttccgggacgtcgtccagaagctcaccggctccccctgccacctcctcccgcctcaggctcagccgccggcccccgccgccgccgtctccatgctccctccccagcccccgcctcctaccatcatggcgcctccgcccccacccccgccgtcggccattccgacccgcctccaccgcatccggccgccgccgctggctccgccccgcccgccgcccatcctgcagccggcaccgcccgcgctctctccgcttccgccgctgccggccgtctgcatgacggcggagtcccccatctcggcctacatgcgccgcctccgcgggatgccgtcgccgatccacgtgcccacctcgccgctcgggttcgggtgcctgccctctccacggacgccgccatcgcccggtgtacccatgccggccaccagcccccgcgtccgcgacccgtgaccgagaaccagccatgggtgctcctgctgctgctgctgctgcttccaatgtgtagatatggccggtgtaggagagatctggcgaggcggcggcgacgacgaaaggaggaaggagcaatacaattacaatgtgttagcttcaccttaaaatcttagctcaattttttttagcatgttctacctaccttataatattttgttggtgtatatggcgatgaattgatcatgtttggctaattttgtaacaagcttatgcaatatgtagtagcaaaactcaaatctttatatgcaaaatttatttagaagaatttcatggaagatgattgttcatgatctgatttcttaaggtgttggtgaatcatgatcctacatgccttgtactggaaatgttttgaactactccgtaggttaatttgtttgtgtttgtgaagtacagattacacctcagaagctgatcaaatctaagctcggtgcagatgccaccagatgtttgagcttggtctttgatgagtgattggtatttggatcattgttcatgacagattttgttctgtaggcgattgcaattatgcttcgatttctggtgtgatatcgacattttttgttttgttttctggtgtgcaatgtggccatctaattatggctacatgtggtgtaaagcatatgtttggtgatacatcgccgttcagctttgccttttctcctgttaatgatggatttcatttgtttatcgtgagtatcagagcctttgcaggttgcacgctctagaaattgtatgaatcattatatcagcagcggcaagtttcctatcgccagtgaggtaaatgatacaaagtttatttacttgatcacattgacatcttgtaatatggaaatgtgtgaaagaaaattttaacactctagctgatgcttcaataagcacttaatcaattggtgactgacaagtattaagtggaaaatatcacatttttctattctcgattttcactttcagaagcttttgacttcagtgaattagtggtgaagtgtcgagctgtcgacattgcaaaagtggtcaaggactcatgggtgaacacggagggaacatattcgaggtacaagtatatggcctgagcacacttgcttatcttgagctcaaacggaggtgagcttgtgagatattcaacttaagggaattttactgtgtgtcaagttgattgaaaagcaacagccgaaaatcacaggtgtccatttctgccatcacatgaaatccattttaaagagatgatgaaaagatacaggtgtatatggtctgcgatgcaacatctgttctgttatttggtccctttgaattttcgttcttccccgctagcctgtgcttttgttgccacaatatatttcttcctgacattattcgttgtttttgtccatttgttagcttgacgccacccttccgatgttttgctatccaagttacgtggtttcggcaaatcatgcgaacctgcgtaaggtttgaacagcatgggaaacacttgcagctgtatacaattgtttagttcaaagagtctcatttctctgtaggcgttcgtttgtgccaatgactacaggtttgcatccaaattgtatgtcagatctgaagtaacctgtttttagaattaaggaattcatgagtttaaaaacagagaaaaaaaatcatgaaccaactcatctcccacccataaactcagaaaatctgtaaaagtaatatcacaaatcactagccaggaaactagaagtgttaaaggcacatgcgaaactgcccagatgagtggtgtactaccaaatagctgttggtgcttgggaggaagaagtaatggtagaacatgacatgtcctatctgtcccggcatgaaaatcaattcacactgggagcctcatgtgcaacggcaatctttactgcgatgggaagaaatgcatagctgggctttttttctcatggagataaatgactgggattctgtagccaacaactcaagtacctctccattcattccggtttcaggcaatttaccatcctctacactctccactgccttggctggcagtgcttccaaacctgtgcttctttctctgattcgctctgcctacccaatctagctgccaaatggctgcacaattgcactgccattgcactcgtcgttcaagcttgctctggaaccaaacagctactggaggtactcagtctgaaactgcaagacggcggtctgctctgggtcttcacaaggatgtcaaggttggtcgtctgtcagaccagtgtgccatttctagccaagactaaaccagaagccagtgccatcccaaacagagcatgtagccgaacacagtaatactttgccatgaaaatcttgctgttgtcctgaaattgtaatgtcaaccttataaggtgataccgaaatggggacagttttttttaaaaaaaaataaatgggagagtggtatgagagacttacttcatggtttttcagcacatagtccacaacccatttgcccacagggagtgtcaaggcacaaaggacctgaaatacaatagaagtaatggttgagtttagaaagtaagaactggtttgggatcggtatctcaacatgaagcagtaaggaacattggctcacagtgcaagctgatggaagagatttgctcatgccaaaagcagccaaaagaacataaagcgtgacaaccccaagagtcactaatcttgatcctgttttggtgccaattcttacctgtttgtaggttcaaacatacgagaggtaaacgattttttttttcaaagctgcacaagtgaaatgctaaagctaactttaggcgttggtcataatcataaatagagaaaattaccaggggagacattttcccaacagcacgatctccatcaatctacaaaatatcagactccatcactgacaacaacaataatattcatagtcatcacagcacattgctaaattatgccaaaggaattatacctgatgaaaatggctgcagaagagtatcagggtagtcgtcagcccaactagaatggatgaagcaatgactgttttactgagagggagaagagctgttccgctgtaattgaagcatctcaagacaaataatgtaggtgcaaatggccattatatccccttggaagtgaaagtaatagtgggaaccttcttgctttagaggatacctggaaatgtttctgctgctgtttgagaagtagaaagctgtggttgccaatggaccaaatgcagcaaaacataatggttcacctagtcccctgtaacttagtcggaatggtgggcactacacaaagagaaaatacaaaagaagaaatgtctgagatattgaagaaatcgaggtgaaacatagtgaactgctaaaatgcttcagctttagctgttagtagagatagcttcttgcaaaatggcacattttttatgtgctagagttcatgatgattcctccgaaaaagggtagaaaaatttacctgataaacatagccacagatgattgcacaggttaccgataaaatgaacctggcatccccagcttgggcaaaggcccaaaatagccccataaatccgaacaggagagaaatatttgcagcatattgcgtcatcgttcgactgcagagtgcattacgatgtaacatgttttcacttctaaaacaatggttgcaaactatttttaaaaaacaaaagcttgcatagtagttgcattattgcttggtattagcagtacctgccaacgatgttaacaacagattccttcttgttcttatcagccccagtatctgaatcgtaaacatcattgctgcaatgaaatcaaactctcaggaacaagtgagcatgataaaacgtaacaatggatcaatagtgattcccatgttagctttt

SEQ ID NO: 51830 - DNA, 951 bp, Oryza sativa
agagctcaacgtcgtctcatgcgccttcaccgtacgcggcagtagcggtagcggagcactgaaccgcgcgcggcctccttctcacggcggcggcggcggcggaagcaacgctgctacggcgatgatgtggaggcgcgaggtgggagacgaagagaggcgcgagggcgatgccggcgaagcggcatcgggcaccgggcgcaggaaagcgagggggctcaggtcagacgcggcgttccatggagcgtgccgccgtgtcgcggccaggcgccgacgcttcggtttggtctgcatggataaggctcggtcatcggttggtagatttaggtcggctgggccgctgggatgtgaggcggtgggcagcccgcagccgcagggtcgggtcggcctccatgtcacctggcctccataccacctgtctcaattatagccggagtccaaatttcgtccttcagttggtaaaagagattcattccctaacaatttatatcagtgctggttattttggctccctaacaatttcgacggtggtttcattccaacaccgtccatagaggtcgagacgattcacgattgtcccacactcccactcctattgaaacagtacatatactgtgggagtagtagtgcctcccaatacgccattctttacccatacaggcatactctcgtgtgcatgctatgccttgctactctggctagcactcgcgtgccgaagagtaacaccgagccgacacaccagtttgagttgaggtatgtgagttctgccgcggcagtatggcaacgccggcgccgagccgacgcgcacgcgcccgtgctgcttatccttttgcgggcgctgctgggttccgtgattggttgtctccgtggtctttcataaactgctacagttttctcatgtcctgatccagtgagctaaatattgggccttctgtacatcagtacgtccagttc

SEQ ID NO: 51831 - DNA, 5637 bp, Oryza sativa
aaaagttggtggcagtaagttcagaaaagtgacagtcacagacaggaacgactccgatatggtgtggaaaagtataatagagactaaaaatacatgaaaactcctcggtagataagatggagaagagaagagagcatgagtcacctatcggtaagagatcatctctactcattccgtaccaaaaaaacccaattctaaatttaaatctagacaaatgattagattttttttcagagtgagtgcacaaattctaattttattttaaaaaaatagatcaataaattaagagcaaacaaataaaataaaataaaaattatatatgatggtgtattaggatataaaagtgctagaagcctagaagtaatgtataaatgtgttgtatatattgacttttaattaatgagatgatgtgttaaaacttgaagctatcacactatctcattctcttgtctgagaaaagaggttcagctatgtttccattcgttttaactttacggcaccatgcataatgcgttagttggtttctcaatgatatcccagcaggtgctgaaaacgtattccatttccaccaactgcgagacatcgactagcagctagctgatccatcattcagttattccatcaaagtgttccgcttttgtgtgaacgttatctctcgaggtcgccgatggttcaggtaattaggatttgagatttgcaggggaaggcacaggcacgcgtgctaagtcttgaaggggattattagtaggtggtaagtgtgtagtaattaacagcgactatctcgtatgaatgttattagctcataagaaagtcgatagtcaatagtcaccgtatgaatcatgcatgagatctgcgcgcggagacatataagctctctgtcagtttcatggatcttgtttgtcagaagttgaagtgcatatcacctccacgggaaaagaccaaaggattgtgcatgttgagagctcggataactgttttttctttttctttgtttcaagaaaaaaaatccccaggttccttgggtgcgtactgcacgcagtcgagtagacaacatgcttactatatatgttcaatctagttagcatctactccgtagtaggtataacttatttaggacagcaagctggaaattgtcatactaatataatcagatgtatttccctcaaaacatataaataatcagcgaaagtttatataacctagtggttacaatagcctcagtagcatcttagatcctgggtttgactccaagatagatttgctagcccagtcttcgaagatgctcaaatgggttgggtttacgtgcgtgtgttcataggggtgattatgcgtatgttgtgagtgtctgcgttgtactgtgtaatttaaataaaataaataaataaataatcagatgtgagtacggagacgtacgtgccaccttggtcgatcaatcaaataaaggtcaaactgaaacccaactaatccgtgagaccgtgaccattattcttctgatcgcagccgcgctttgcaggtcgcttggaacctgcatgtctaacaatctgcatgcgtgttccgattaactaactaacccaacattaatccatcaggcgaatcgaacgggcgcacctactcccagcttcctagttgacaccgtggaaagggtcaagttgacacacgacggtgcagagaatgcagctgaattctctgtcttaaaagtcttggggttaggggactgctatttagcgtagctacgttttcatcaacgcatatttttcttgaaacaattatctgaaagcttttatttgtaaaactttcatctgcaaaaaaaaaatcatctgaaaaaaattacctgaaaattttcattcgaaaacttctcatatgaaactttgacgtgaaatttgtggaccaaaagtgtgagacgcagctgcgctaattggccatcctgttcggccttgtgatcggcctcgctcaggccggcagcccactcctccttcggccgtgtggcctggtaactgagagattgaacccaccaaggcccatctcgctcaacttggacgagtcctatttccatctggcccagtacaaaaaacagggccggcctcttgtgtttgcacgtctactctgggctggcgttttcgtgcgaggagcagatcacttcagttcggttttgtgtcggcgagagaatcacatattcacaggccatacagtgataataatcagttaatcactcaaacctgtacgaaaattccaaaaccattgcatacagctaccggtttgtctgccatccatggagacaacaggcaccgatccaaaattcccctctcgatcgccgcaccacgacgagggcatcacgtcctgcctgggcttcatgtgcgtaacataaacagatccatgcattattaacatgattatatgatttacatccacatataatgtatgtatcctgcgacactacgagagggaacacatgtcgctacacatcgaggcgtgaaccacgactcgttaagttttgccgtgaccatcgcgtcgcaactcacaaccacatgcatcatggtgccaagagctacgtcgctattaatcgtagccaagagctgtatcctttactatgccagtattgattaacaacagtttgatcgatcagctgcatcctttgctacttcgtcggccatgaacatgatcggcagacgaacgcagccacgggcccatggataagatcgaacttaatagtactccctctatcccacaatataagggattttaagtttttgtttacaacgtttgaccacacgtcttatttaatttttttttttgcaaatataaaaaacgaaaaattgtgcttaaagtgtagataataaagtaagtcacaaataaaataaataataatttcaaaaatttttgaataagacgagtggtcaaacattgcaagtaaaatctcaaaatcccttatattatggacggagggagtactatacaatcatatgcatgcatcatctcatcagaaagaaaatgaaaataaaaataaaatggcatgcatctatccatgtcgaacaggcgaagagctatagctttgcttgttccaaagacggggtccggaagacgtgggcaatgacgaacgcaacgagtggtgtgatgctacaatgttatgggtgggcgatggagaagcagcaatgccaacgacccgtttgctgtgcaaaatggaaaactgaactttgtttgtggctgtccatcgcgtccatacctcagaacgatagtgacccgttggaaattaatttggacattctatctactggagtactccgtagtaaacaatccggagttgcaatcagtttgacagtttgctctcgctttcttaaccctgattacctacccattcaagggcgtttacttgtgttcttttttcggtttgcctccctcattggcaagcccagttttgagcttatacggaggtggccgcccccaacaaattgggtgcttatatatgcgtgtgaatctcttgaagatgtgagcaaaagtaggcacccatatgtcaccagcggttgtgtgccatcatgataccagtaactcgtctgatttttattttcttatttttttatttttttttgacgcaaaaggtagagagactctaccttgttaccattgtattaatggtggtcatttttattttttattttgtggttagttggcaatgtacaccaatcgatttctagatacacattattgtcgatggcttgggagtatctgtgtcctctacggcagtacgcatgacccacagcgtagctagcgcgcgtcaatattcactataactgatcgatgcctcctggtattatatactccgtatgtccattttgtttcggttcgggtcaggttttattgtatacagacttggcagaaaacaaagggctcgtgcgcatttttttttagttagtagtcttattcatgggccccatccgacgtcatcatcacccgaacttccaaagcaagtgatccccccaaccccagttttttgacgagattcatgagaagatagcaagcaacaaacgcgattttaaagtgcaagtttagagagccaacgcatacgttgatgcatatgcatgtatagccacaaatctgccgacgtgtacggatacggactagtaatctctccgtgtgccgcaacagctgcctgcggtatatcaaaccactgcacaagtgcagagacgaccggttttgggagcccgggcaggtaacgatcgatcgatctgcgacatgcattgcatgagccatgatggactcaaagagtgagttggtaattggtttggtcaacagcacagctagcttctccgtacgtagtcctccccaatattcacaatcacgatcaacgtataagaatcttgtgttgacacggccgcagatctcacacgcggtacaggcgcctaaaatatatacaccaacatctcacttaacaatctcatttaatattcccatcagtcgtacgtgcacaccagttccaacacacagtggattcgcgcgtgttcggactaggaggactcgatcgcgaactcgagggttgttcgcgcgcgatctgtgcacgcgtcacgtacgcgccagatttgatcgagccgatcgtttccggaaaggcaggagagaacacgggaaagccgtgcgccgcagcatgatccgatccgtctccacggacacgggagctaacgcgaggttagttggcaccaaacaccacagcgcgcgcgcgcgcgcggcagatttgcccaacagcgacgtcgtcccgtgcgccgccctatacgtgcgccacgaaacgcaaggcagacgtccgcgctttcgtcgccctctcgtgcgtgcctagctgtagcttggactcgccaacaccaccacggaactcctctcctattaaaaggcgttccacctgcctctgctcgctcggtcgctcgttccatttgggtttgacacctcattgacatcgggggaaaacacaagaggaggaatcgaagaattaatcgaagcagaggaggttggattgttcgttcgttcggacgacacggtcggcggcgatgggtgacgggcgaggggatgaggaggagtgcagggtggcgctgctgaatggcggcggcgcggcgaaggagggctggcaggtggtgtccggcggcgacggcaagctgaggaggagggtgtgggaggagtcgaggaagctgtgggtcatcgtggcgccggccatcttcagccgcgtcgtcacctacagcatgaacgtcatcacgcaggcgttcgccggccacctcggcgacctcgagctcgccgccatctccatcgccaacaccgtcgtcgtcggcttcaacttcggcctcatggtaggccgattgaacacgtccttttttgctggttaattaattcgtcgtgctagctcgtacgtgctatctttgggtgctatctcctcaatatggttggcaacttaggattggttttaattatcccagcaaggaaaaaaaacataaacattaagcagtaaatatttcgaacaaaatgtgctgtgaattactgcatttcagattataagatgttctgactttagtcaaaatcaaaccgcttcaaatttaactagatttatagataaatataataatatttatattaccaaattagttttattaaattcataattaaatatat

SEQ ID NO: 51832 - DNA, 21350 bp, Oryza sativa
  unsure (1)..(21350): unsure at all n locations
aagtagtttgattttataacctttaacggatggagtagactgcaagagcagctagctagcgccaagcatgcaagaacgctacgcttctggagttcgatcactgcaaagctgccatgacccatgatcgtaaagtccatttatgcatggtgctagtgtggacaggtgtgacgtgttaattggcatgcatatcgcagcatttgtggggtatccttttgttacacttgctcctatccatgcatgcgtgcccaatgttttttttccttttttgaaaaaaattgaaacgtaaatgtggatggatttgttcaattcagcggccaaaatcctcgtgcaaccctgtacatatcgcagacagcccacctgaagagttcaactaggaatttgtgaagacaaaccgaatcgtgagtagtcaagtggatgtgtatttctttgactgcgatatgactgtttttcctcgcgtcagagttacgacttacgacatgagagcggaatctctcttgccttttcgtgaattcatgcgaagttgaaaggctgatcgtgaaatttaaggccgcattacttcgtctatgtttataagctaaaattatttaaatttaacttcaaagctaattttactattcttaaaaaatactagaatcgtcgtactttctagtgtaaaacttgataacttaagtactagatttctcgagtcattaaaattttcagtgtaaaatttaggtaacttaaaattctttctcaatgacaataaaacttctctaattttgaagtttgattttatgtttttcattatattttattttatatatttttaaattaataaaaacacatatatataaacattttattggtaaattattttatttactattcgagggatcattttacggtacatgagaagcaaccatatatttttattgtataatttattgactttcaatactttcgatgtcagaggtaccaaaattttattttaaaaaacatttcggtacttcttgaggccagtataatttctgtttgtttttatataaaaagatgcacgtgtccggaatattttttttaatttcgtttgtgaaaaatggaaaatcataaatgcaataatccagaatgcaacggctggcgcttctgtgcccgcaaacacttgggttttatctggtgtccacgttttcttatcatcagtatacagagaaggcggtgtcaaaaaaaaaagtatacagagaaggcaccggaaggagctgggcctcttgagtgaattcttcatttcttctagtacttctgagaagcttcatctcttttgttcctgaagcttcgaataaattcctcgcttccgctgttccacctgtcgattttatcaaccaaagcacacatacatgtggcatctattcatctccagcatatattccgacttatttgccgtgcttgcaatttcttttcagcaaaattgatgtcacttgtcacctgcaacgttaaccttctcctgttatcccccgaaaaaaaaaaacttctcctgttatcaaataaactagcatggtggcccgcacaattttcggctagcatcattatattttctcatataatagcatatatgttttctcattatattcaaatatattaaaatgacaacataatttaaaattttgcaataactttacaaaactactaatgtgtaatattcatattatattttatatacgtgctatttattaattatttttaatattaaattttagttatttgtaaattatatatatttctatagggactctagactcgtcttttaatattttttttaattctgaattttctgtaaattgtatttctatatagactctatgctcttcttccgatatatatatttttatttctgagttttcatattatattttatatatgtgttagttattaattatttttaatatcaaattttagttatttgtaaattatatatattcctatatagattctagactcgtcttttaatatttttttaaattccgaattttctgtaaattgtatttctatatagactctatgctcttcttccaatattatttatttttatttctgaatttttattatttctaattgtatttctatgtggactctaaactcatgtttcaatattctttaattttttcattttgaatttaagttacttctacattgtattcctatattgaccttaaactcttcttcctatgtttttcttaatttcgaattttagttatttgtaaattgaatttttatacagattttaaactctacttttaattttattgtgtttattctaaattttagttagttttaaattcctatatggactctataccctacttctagtattccttatttttaaattccgaatttctattttttttcttaattatatttctatatggactctatactctacttctaatattccttatttttaatttcaaatttctattatttcctaattatatttctatatggtctctatactctacttctaatattccttctttttaattccgaatttcagttatttccttattgtacttctatatggactctatactatacttctaatattccttatttttaattccgaattttagttatttcctaattgtatttctatatggactctagtcttctcttgtaatattccttattttttttaattccgaatttcagttatttcctaattgtatttctgtatggactctagtatcctcttctaatattccttattttttaattccgaatttgaaagggtcaattaggcctagaggggggtgaataggctaatttaaaacttaagaaatgcgaaagcagtaattttcggagctaggctaggaattttcggaacttctgaaaatgcacagagcagcgcacacaaaatgaaaactctagatctataagactataacagggaatacaaggcacaatcagcaactagaccaatagcagtacaagcaagcaaagctagaggagagggaagaaatatcaccaagatgtagctcccaaagttgttccccagagttcaaatccttgaggggattctactctccgttgaggagctcactaagagccgggtcttaactaacactttcctcaagaagttgcactaagcactccttctttcactaaaaaggatttttttccttggcggaggcgaaaaccggccttcacaaaactttccccggccaaccacaggaaattcgggggcttcggaagtgacaccctacctcgtctaggaatcctcaccctccaaaagtaaaaaataatccaaaaaactcccggaaataaggcaggtcctcacaaatcttaacaaaaaccccaaaaggcccccacacagcttcaaatccccacttttaccccccccccaattcaaattcaaccccggtggagaaaataaattcaaggaacaagtcttcaatgaacttaaaagagagaagcaacccagggccccaattattggaatggaaccagcaaccctcacaagtgaggggaggtgggtatttatacccacagcacaaatctgcccgttggagtgcaataaaagggattttcggaacttccgaaaattccagatctgaggaaaatcgaagtcaacgcaattttcggaacttccgaaaaatattttcggaactttcgaaaatttccagaacgcttctgtgtattttcggaacttccgaaaattattttcggaacttccgaaaatttccagaacgcccaaacacggttcggtgtattttcggaacttccgaaaatttccagaacgctccaaaagagaaatgcttcgaagtaaaattgattttgagcacacgcatcactccttatatgtctatgcatcatcccccttaatagtatggctttcctacgacacaatgcgaggaaaaagatacaatataccatttgatcattgccgcattgcatcacgatgtcgcattcacgggatatgcattgtattacaacacgttgaggacttaacaaccttcacatttgcttgaataaaaatgttagtcctctctaatcgcattgtaatcaatcatcaaaatcattaggggtctagatgcactttcagaatttcaactattttttttcttaattgtatttctatttagactctatactctacttctaatatttcttatttttaattccgaatttatgttatttcctaattgtaattctatatggactctaatcttctcttctaatattccttattttttaattccgaattttagttattttctaattgtatttctatatggactctagtctcctcttctaatattccttattttttaattccaaatttcagttatttcctaattgtatttctatatggactctagtctcctattctaatattccttattttttaattccgaatttcaactatttttttcttaattgtatttctatttggactctatactctacctctaatatttcttatttttaattccaaatttatgttatttcctaattgtatttctatatggactctatactctacttctaatattccttatttttaattccgaattttagttatttcctaattgtatttctatatggactctagtatcctcttctaatattccttattttttaattccgaattttagttattttctaattgtatttctatatggactctagtcccctcttctaatattccttattttttaattccgaatttcaactatttctaaattgtatttctatatggactctagtctcctattctaatattccttattttttaatccgaatttcagctatttctaaattgtatttctatatggaatctgatttttctttttctctgattaatatgagaatttctagatcatgagagtgaacgtggtggctcctttttctatccctttaataatataatagattccggtcggcttctctttgccggtcaaaaaaatgtcaccgatccctttccaaatacgagtacttatcactatttattatatttgtttttttaattttgattactcgtagcaatgtaacgttctttaattatgaatcaatcatttaaaaattattaatgattaaagttgaaataccgataattaatagtgacaagtaaatgagtacgacgacaacaatagacagatgatggggcattcttgaaagtccctcctccttattctagttgagaacatccttataaggcaacattatacacatgttcatgttatctagcaaccccatcgttggcttattcgagaaataagtcaaacaatatatttgcaaatgaaaataatttataaataaattttttatatatgttcttaacgatctaaaagtaaagactgaaaaataaactacgataaaaatgccccaaaatcaattctaaatttaaggctaaaaatttaaattttggctgataaacataagtataagcgaaaagatgtggcagtttggtcgtgtgcattttttattagtgtagagattggacagtttttgttgtttaatgaaatctttcactatactttaaacaagtaaatgggcgcagagggatcatagcataaaaccgatttgcctttagtgatttttctcactgtatgatagtcccgactacctgagcagtgacttcttgctgtagtatggtttgtacgataggggctgttaagattatagataaaataagggagtagctatacaacattcgacagttttttaaatagaaaactttcaattgtaactactatgtaattataatgtaattacattgtaactactgtgtaactacaatataagtcatctgtaactaaagaaataactctgaaaaaattgatggagcaattggttagttgaacgagcattcaagctgcaagtctcaggttcgatcgatagcaaatccgtaaaataaaccttatcaaaatttgatatttgctaaaattttagtaagtttgtaatattgtcaagttttgataggatttcttatgtatttatgaaagtttggtaataaaactaaatgtatgcatcgttggcaactttaaaaaattgacaagatttgaaatggcatcagtttgaaaaaccactgaattattatgctgtactgaatcctgttcaaaaaaaattatgctgtactgaatcaattggtactactgattctcttactgtataattgtacctggctacctgagcagtgatgacttctttatactactgttgtatactagtttgtacgattgctgcttctgaattaaggccgagtttaattccaaacactgaaccaaaaaacgtcacatcgaacttttctacacatataaatttttagcttttccgttaaatcgttctaattccaatcaaaattccaatttagcgtggaactaaacacaccctaactgtacggaaatactgaatcacaattactgattcactgaattaattggccgtgtggaacgcagcttggcatggcgagcgcgctggagacgctgtgcgggcaggcgttcggcgcgaagaagtaccacatgatgggggtgtacatgcagcgttcgtggatcgtgctgctggcgtgcgcggtgctgctgctgcccatgtacatctacgccgaggacgtgctgctcctgacgggtcagccgccggagctgtcggcgatggccggccgcgtctccgtctggttcatcccgctgcacctctccttcgccttcctcttcccgctgcagcgattcctgcagtgccagatgaagaacttcgccagcgccgcggcgtccggcgtcgcgctgtgcgtccacgtcgccatcagctggctcctcgtctcccgcttccggttcggcctcgtcggcatcgcgctcaccctcaacttctcgtggtgggccaccgccgccatgctcttcgcctacgtcgcctgcggcggatgcccggagacgtggaacggcctctccctcgaggcgttcgcggggtgtcatgctatggtacgtacgcgacgtgaaaccgagaacgttcaattctcgtgtgatttggtttctgtttgatttcacgtttcgtacgttttttgcagttgctgacagaatttgtgtgcttaatttgcagcttggagaactggtactacagaatcctcatcttgctgaccggtaacctcaagaacgcggctattgcggtcgacgcgctctccatctggtaagtcagtaccaagttcctgaatcaatctgacatgcgtctgattgtagctaacctttatgtcttctcgtggacagcatgacgatcaatgcatgggagctgatgattcccctggcattcttcgctggaaccgggtacgtacgcacgcactgccttcttctcagttctcactcgatttgcttacgaaactcgaatataccgaactaaagcagagcacgtgtggcggcgtacgtgtttttgttgtggtttgcagggtgcgggtggcgaacgagctgggcgccggcaacgggaagggcgcgaggttcgcgacgatcgtgtcgtcggtgacgtcgctggtgatcgggctcttcttctgggtgctcatcgtgggcctccacgacaagttcgcgctcatcttcacctccagcgacgtcgtgctcgacgccgtcgacaacctctccgtcctcctcgccttcaccatcctcctcaacagcatccagcccgttctctcaggtaaagtacacacacacctgggccgttgggccttccttttctacatgggccttcagttcccagctgaactggtcataaatgggccggtcatatacgtgcaggtgtggctgttgggtctgggtggcaatccatggtggcctacgtcaacattggcacctactacctcatcggcatccccatgggcattctcctcggatggctcttcaaacttggcgtcctggtacctatgccactatgctacttgatttctgaccagttcaagttaaaccgtgaaaatgttagccatctccggcctgaccatttctttcgtgaaacctttaatttgcagggaatttgggcgggtatgatcggcggaaccgcagtgcagacgctaattctggccatcataaccatccgctgtgactgggacaaggaggtgaacaaaacgatcaatccctccacacagcccaagaaaacgatcaaatgccgtagcgacttgaaattttgacattttttggctgtgttattttgcaggccatgatcgcaagcacacgcatggacaagtggtcgcaagtccggtgatgggagaggacgcacacgttcctgagctaatatgctcgtcaccagattctgccatacgagaggacaagatggtcgcgacgagtgagctgattaactgcataggtgaacagtggacaagacgattcttcatcacctgctcttgttggtctctagtattggcttcgttgcgtccaaatttatggtattggtcttctggctaccgaagagaatttaccatttcggctggccgagtgaagtaacgtatgtatggcaaatggtgacatgtgaagattgaatcgatcttatctaaagtgatttcaccaaccgtattccttctacaatcttcatcttggatttttaccctgcatgctcgccgtattggtggacgtagctgccctgaaaaagaaaattttcaactaccgttggtattcaagacgaattgccatgtaggacgccatcatcctactggtatctctaaggataatgtcagcatgagagttgacattgaagaacgggatagaaaggtgcatacgaacaatcgcgtgcgtacgtattctttgactggatacattctctgtcactgacattcacggagtgcatcggccggtgtatcatatcacttcttcgtttattccatttttgcaactggcaagcctagcacacagtggagcagcatttctggcaagtgaccagcataattaatcactaatcagtactaattatccccattaatctgagaggtactgttaaggatatcctaaaatgttcatgatctaccggaatattaaacctttgtacccgataaactcaaacaagaatcgacgatctagagtagtagagtacttgtttgctaatagaaaattgtgcaaggtagtttatcgttaatttgtattactacaccgctgcacaattagaacgaagcacaagaaaaaaaaagaagaggagaaaacaaaattcaaactcggtttaacgcgtcagaatcggagttctccttgctcccatcggagccggacccgctgggtgtctcgtcctgagctccggcgaccgggtgaacccttttgctgccgccgtgctcctctccggcgtcccagtccgcccggctctgcctctgccacgacaccgatcgccagagcgacgtcagccacctcggcgtcctctccacgctgtccgggtacccggcgaggctcgcggcgcgccggtgcctgcggtcggcggcgagctccttcatgacgtgctccggtagcctcagcgtgtgccggtccggcgcggcgtccatggccgactgcgtcctccggtagtgagggtaccctgctctgtcgaattcatggtcgtgcgtcgcgccgaagtcgatgacggattccggcgtgaaggtggccatcagggacgcctcgtcgagctcctccgactcttcctcctgcaccgcctcctccggcgccgtcaggtcggagctctcggcggcggcgagcgacaccggtggcgccgtgaggttggcgcggcagagcgggcacgtgacggcggcggcgagccaggggtcgatgcagtccgggtggaacacgtgacagcacgccgggagcacccgtagctcgtcgctgtccgcgaactcggcgaggcacacggcgcactacgagcggccccgacttcgccgccatgcgcgccttcacgtcgccgtagaccgccgtggggaacgcctccacgacctccttgtcgaggccacgcgaggcgcgggacgcggcggcggcgccgccgacgggctgatgggacgccgtgctgcggaacgcccggcgcgggggagcgcgcgcctgggcgcagcggttgatgaggacggagaacacggtgaggaggacgaaggcggtgatgagagccacgagcacgacgacggtggtcggcgtgaacccgccggccgtggcgctccggtggtgtttgctcgtgtcgtcgttgctctgttgcgccaggcaagggcggaacgccgacaagagcagcgtcacgaggacggcgagcgcgatccggcggtgagccattgccgccgtctccggccaaggtggggtggatggatgagccgctcgccggcggccggagagggggaggtttcgagttttcttttggaaggaatggagtaacggaggtgttaactacgacgcggatggtgtaacgcgcggacgtcagggatggctgcgtggcgagtgggccccaccagtcagtgactgcggggacgagcgggcggtgccgctgactccctcactggctgttgccggtggaaatcagctggaagcatttttcgtgtcaccgtttcacgcgtgcctggattttggtcagagttccatctgaacaaacaaacaacaaacctcttggttacagaatcaacacgtcgttaatgtactaatccatatgcacaacttacatgtacggtgatcatgaatgatctgatggctccgaaaattcctagccaacaagaacttactgtgggttcagtacatcgagtagcaatgccgctgtcttttgcacgcaacgttttgtgcccccgacccatcacaaagacgacgggaaagtgcccaaaagtcgccaatatgcagcgattggacggcgcctggtgtggctgggtattcttcactttccgacctatcctgccgcccatgtcaagcatgtagcatgcactcgcgttacaatccctacatgtcagcttcgggattactgacgccatgcttggattagggatgcatttagttaaaaaaatagattagggatgcattattatgaccagttcattctacttgtcggttctaggaacaagctttgaaactgtgtattttgtgagttttgatgactcatgtggactaacgactttgtatgtgtacgaactcaaatcttcttttttttacaacttgtacaaactgaatctaattccgatatttgcaaccaccactgaggtcgtcgccgaaagttttctttttataattttataaagcttgacgtggtcatatgaaatttgtagcagtcaacttttaaccgaacaataatgcgcagttgtttactattatgaatcatcaatcacgtggacatgtggtggttgccttggatcaattctttgtctatatgtcacgtaagttacgtacgctagatcaattagaataacctcttcgcgttgtttcgtcactgctgctgcacaattagcaaaagtaacaaataggcatgcttgtaaaaagaatgctagtcattgacattgaatccttgagttaatgtgaatatggctggcatgaatctgaaaagaaagaaaagcagacatcagttggaacaatagcgcactgaatttgttacctgttttatgggcttcataatgggctgattctgtttcagttaggcttggaaatatggaataagtacagtttgactccctgaaatgaacacggaatctaaatcgtataccttatccgcaatactagaaatcttgacctccgaactgtctaaaccgatacaatttgactcccttgatgattttggagggcggtttcactgacgtggcgcacacgtgacaatgttgacctggtcttcgtaccacgcggcattgacgtggcgcttatgtagcattaaatttttaaaaatatgcgggagccattcacacaaaaaaaaattatgggacccactgacatgtgcgtcccacatgtcatcctctatttatcctttcttcttcctccctctcctcccttctctatctctccctctttctcttcgtgcgtgtggagcggcgtctgatcggcgtcggcaacggtggcaggcgatggacggagcggcatcggcgagcgggcggccgctggagttgcggacccagaggccagatccgcccctcgcttgcttcctcctcccaatagactgcgccatggccggcgccactgcgccgccgatcgtcaccgatgacctcttcgaccatgtgcggcaagcgggtgcgagagcggcggcgctggcggcggtggcttgtcgcggtggaccacgatggtggtggtgccgtcgacggcatcgtgcagccatgcatgaggagctcaggagggaaaggctatagagagaaagagagatgggagagaggaggaagaaaaaagggtagtgagagagaagataacatgtgggacccataattttttttgtgtgaatgacaaatgggccccgcatgtattttttaattttaatgccacaaaagcgccacatcaatgccacgtgggacgaagaccaagacaacactgccacgtgtgcgtcacgttagtgaaaccgtcctacaaaaccactaagggagtcaaattataccggttttgacagtttgtgggtctggtactgcggatgagggatacaatttagttttccgtgttcatttcagggagttatagtgaacttattcctggaaatatcgagtgtccggcctgctttataccatcaggttacagaagtaggagaagtttagcagtaatgggcctctgtattgactggcgcaaatatttagatgaagtaaaggcccacgcattctgtgcacattatgacaactccttcggcctgagcataaaaactgttaacaaaagaacagggaataacctattttttgccaagtttttttttctaaaaaaactatttggcctccctcatattttgctcttgattgaatcgtcttcctcatcttagcaaaccgttgcaaatcgacttttttgatgtttaggaagtggtttttaacgatgtgacacgttgaccatcgttgacccgctaagtaagcatgtagacccgcacgtctaggactctcaagtctcatctctccttttttttcatctctccctgagggcggtagggaaagtattctatcccatccgctgccttgcttctccttcatagcagcttgggttgctccgtcaccgatctgctgccatcacagtagctcatagccagattgtcggtgacctcggcctgggccctcgggcgtagggacgatgcgggatagaggatttgtgccaccagccttaggggatagatggaaaagaaaaaagagaaaggaaggatagatagaagagtcgctaacatgtaggtcctacttgctggttcagtgaaaagccagttcctaaactactgaaggagttagtttacaccggtttttgaagatgacaaatgcgttatacccgattttgtagttaagatagatgattaaaatgggtgcaagagatagaagcaaaatagatttattccaaataacaattattccattatctaaaaaaattccaaataacagtagggatattgccgcgtgtgagttgtgacagccatatttaactgctaggtggaaaccaatcgctgctaataaatctgatcaagctgatgcttactatgcagagttcaccgggcaaatgggcctaaacttgtaacgccatcacgccgtgtacctccttgaatgcctagcatttctaaccggagaacaagccgctgcgttccaaattgtgtccaatgatcaagttcgtttctgactttatagtgatagagatcttgatgcatgtatatatgaaacatagtggaacacgccacgaaatgccgattggtttcgtgccataacagaataaccttactgcgagaaaccacgaatatgcagtgtaaatgcgtttcacgagtccactgcacataagcactttcgcagaacacaagaaaggatcaccacggtcgcgctgtgtatgagagcaatatccctgcacgaatcatgtatgtatgtgcgacctactagttgcattgcgtgcatagccatggaccatgatgggatcgatcacagttcacacagagctcagctagccatgccgggacgaacaatcatcgaacgacgcggctctgtcgtgtcctaggtagcacaagtggtgtgatataaggccaatgcctgatgtttgaagcgacgggcacgacgacctgcgtactcctacgtcgtacagattatgacacgaatcattccaaggtggaaactgacccgaaacgttggtgcgttccctgtgtcttttttactactccattgcacccatcgcatgattgacgacggcgaccacgacatacgatcgatcgatcgcttgcatgacgcgacgtaccggtcggcgcctcacacacacacacaccggctcgatcgcgttcattattcaattcagtaaccctcatgattcggctggctcgaataacctgacgctgccagtgccacgctgcataacctgcaactcgatctgcatctggctccatatcggtgtggaagttgtagcggacacttctccgtccagaccagagggtccttaattgacaccggccacgcatccactctcctgtagtagtctgtagaccgatccaaaaccaagtttccgatcgatgctctgcgcccggcacgctgggccgcgcgcgcaggagctgaggcgcagctgcaaaccgcggacacgaaacaggaggtcgggaaagtggtattcgcggcgtaatatagcccatggcatgtgcggaagccgcccgcagcagcaggacgatgcgatgagccaagccgccgtataaaaccgcgcgatcccgcgtgtcgtgtgatgaggcgcgcgcctaggcatagcgaccgaccacgcacacgcccacgcacacgcccgcgcggccgcagagaggccaggccccaaggccgcgtacgtaggggcccccgcgtgcgcgtggcagcgcgaggacgtgttgtgcggtaaccaaattacggtcgatgccggagagcgattcgtttctcgcgcgagtcgcgagtcgcgagcaggtttcacttatcgcacgataatcacgcgattatcgcggttatcgtgcttattgtggggtacggtaggagaaatcgacgatatggtttggatgaattttgactaaatttaaaatcccggaaaaaataaaaaaaattgaaaaaaattaaaaaaaaaatcatgtaagtagttcttgatttgtaattatcaatggtgaagaatttttttgaacagagtaagctatattcaaatttgagggcaaaccgagaatagtttacaaattggaaaaggaaagagaatattgggccttaagtatcctacatattcttccaattattctcaatttctagttttctacatatattcaaccgtattttttatttttttcccctatttattttgcatttatatgatttcagttacatagcccgcgataaccgtgcgaataccgcagttatcgcggtaaaccgtgcgattatcgtggtgaaaccgcgaaaccaccgagttttgagttcgaatttttggatgtgatttttgtgcgattttagacgattatcacgcgattatcgtggttatcgcactaccgcggggtggtggtaatctcggcccaaacgataaggtaaaccctggtcgccagtgctccactgctccttgtacggcggggtcagcggaactctgtgggcgtcactgttcgtcacgttggctagattccggcagagaggcagggtccttttgctctgccattttgtgaccggtgtgtgtccgaacgctgcacgaaattacacatcagaaagagtagtatatctgtgactctgttgtgacgacgcgagtatctgacgaccacgtacgtactccgtacacgaaccgagctttaaatcacagccgtcgagatttgcacaaggcataaaaaaaaacacgggctcgccagtagaaaaataccactgcccggtcaattggcgccatgctgacataacggagactgtaccatgcattgccagccacacattggaggtagcaggagacaaacatgcgcacacacatgcatgatcgaacactattggttctattttagtaccatactttacaaggttcgaagtgttaggagcttgactaggggtaagaataagatagattccctgatgtaccaactcaatcctccatggccaagacaaattctctagtagcatttggttttatgcatgcctgcaggccgagctatagattatggtatgattcccgtgccgacatcggttgcagttaacaaaccaatcttctgtagttagatggccttaataatctgctacttctgctatatctactggattatcatttagtgaactagcttagttagcttgtctgttgcatgacttctaattagatgattcagatttggttgcttagctgcagctggcctgtgatggcagcattcccagcctatagcactgcctgatccaagcgagaagagtcgtattaacatcttacagcctcttcattgtcaccgtaaacaacagaatgcatgcagacccaccagtagattaatttatgtccagttatattttttaaataaggtgagaggatgtgtaacatactacatgaatggttgaggattgttcacttgttctaccaaccactttgtgacactatcttggtcagtttgttgtatgtatatttgtactttgtaactgggcatactttttcaagaatccggtgtcgatcttggaatttggcacaacactatgcccggggtcctccgggcgaaagctataggaagaatctttgaaatgtgcaagtacatcgaaagcatttacctgaccaagtgaccaagttgcaaataaacttaagtctctgaacgaaaaaggttgcaattaacaaacttgctagggacttcccaaaggaagcgttgcaaaatccatttattttaagggcagagaggaccccgggagtacgtaggacgctgacccgagacggcagcggttagcaatgcttccaaacttcgcaattcacacttgcaaaaaagaccatcaccaaaccaaatcctcggttacctacttgtccgtccaaattaatcccccacaccggatctctccaagatttgcactgattaacaatattgttcgagcatgtcgtcgtgctgcgtctggtaatgcggcgcatactgcagcaggtatatggttttcttcctcacctttgaactggagaaatgatgctatatgtcaagagagctcagctaacacagctgttttgcctttgtttcgagagaacggtatggtttggtgcataatagggcatgggcagaatggaacaagattgccgaggattacgttaaggatatagtattaattagcgcctacctatncgtagagctgcacgacgaattacattttggtaaccaatggcttaaaccaacccaaacctaggnagtgttcgcacgatttttctggaacattgcatgaacaattagatacacaaaaaagatttgggtatatcttcgtttcattagataattggcaatagttaagtatatctgagatcgtttgtgtaaagataagaattcgtaaaaccatgtgtgtgcatagaggttttacgtacaggttcgtgcctcccgcaagataatatccatatattttgtttgtatgcatatacctaaactatatccagattatatgaagtacaatgtgtatatagaaaactctaatctagatctagccgatcataacttttacggtataatatactagtaccggtatatactagcagtataaattaataaaggcaatgttgaaaatttgatagaaaattttatacgataatttttgtaatttgcggttcagatttaatctaattgtaaatgcccagtcctagttctctcgtgtattaatataaccatatgaaagtattttgtgacaactgtattaattaattctattttcacatattacatccttgagatgcacttgataatttactaatcattatattaataaattattattttaccactcataaaactggtgtataataccggataatcactcttccagattttgtctatggactactatacacatcagaaaattttgagaagatatagtatgtcaagtcgagtagtacgatggtggtttgtttaattttagcaccatttatttgatatgttatcgtatagtagtaacactcgatcggtcagaaatggcttcattctagatgactatgtgaaatataattttgtactacagccacttggacgctctgatttattgacacggattcgtatcttttcaccaatcataatttctagttttatactacgtaaaaggagaccattgatgttacgttcagaaccaaagacgaccaggtaaattacgcgtaggaatgttcttatcaccagctgtagtatgagattttatccgagaaatgttaagctgtcactgaataacattttgggtctttatcctactctgaaactctgatagacataggagagtgcttgccagttattgctagccagccagctttatcagcattggcagcaatcaaattcatgcaaaaagaacaaagcattggcgtcatatagtttcatcaaggaaaactgaagcaaaagaaaatgcctggttgccgtacggttgcgtcattgtaagcatttcagtctcgatctgagcagattctcccggggaaagcatccaggctaagctttcagcatctccagggcacaccacgtacccgagagataatggagttcttttagcatcgccacaactgcatccagaaactgatgtgaattgaacaaattgttttaggtacttataattaagaaaggtctcattacattccaagcgtgacacagcagaaataataatgcttcagtgcagtatacctgaagaacagaacaaaatgctttcttcaggccaatccggtgttctgcccctggtttgaactagcttccggcaatatatttggagagcggtttcagttctttcatgggcttgatctaacgtgtccatgaggtcaataatttacaaattgcaagggaacatttgttcttattctccagcatctgtgataaacagtctaaagtacttgtcgtcgtccatagactgatcaactatgtgattagtatatgcactgccaactgttctttttcaatcttgttggggattccaatggaacctgtgtgccgtacgtctttctactgtcttttggaaacaggttaacacgttcttcctggaaaaacaaaaatactacttacagagaagtacgtgttactgaatttttatatgcaaaacacccgtcccaaaaagatgccaacggttgttcagctttgtgcatgaaactgtggcataccacagaggttatggtcctcaagttctccctgcctagctgccgttagacaaaagttagaaacgaacagatcgaaaatgataccgaataagaaaaactttgtgcatgaatgcatctttcgctttcgtttttactgttgctgatgcggctatttttgttggggttagacatgatggggcgcaagttgagccatgctttggcgaacaccatcacgaactgtgcctagatcgatgaatgtgagctccctagcgtacgtggcatggaccccaacacttcaacgagagtatatctgtacatcacaagcgtacatagaagttgaaacttatcgtgccgaatcctcatcctcacggctaactatctagtcataatgtctcatctttcagtacaaccctgataataatatatgattattaggaaaatgtctatactatcggttagaatacgtaatacgtgttgaatatactaattatatttagttacagttggagtacttgaagttagaatatgtgataggggtaaatgtgaatagtacgatcctgagtcatatatttgttatttttgttccccttatataggttgaatttaaacctatatgtttaaggtgtgacatgtcgcatatgatctatcatactccctctgtttcaaattataagtcgttttgttaaagtcaaattgctttaagtttgactaagttttttaaaaaaagtaacaacattttctacccaacacaaatatattatgaaaatatattcaattatagatttaacaaaactaatttagtgttgtaaacattaatatatttatctaaaaatttggtttaatttgaagtaatttgactttgacttaaatcaaaacgatttataatctaaaatggagggagtattaaatttaatgtgccaagatttagcattagtgccttaatctttgttacgttgtgtaatttcctacgtcggactcaggatgatcccatctcacagattttatgcgccaatcagctgtaaaataatcacactacacaaatttgtactacttgtagtacacctaaacatattcctttagagaagtgacatatcatagccgattcttttttttactcagtgaagcttctttccaaggaaagcgacgggtgatacagacaagtagacatacttgtacaagagggtaatcgtaaatttgatgccgattgaaacatacaagacagtagatcaagccagatcacctttgtaggcggatgaaagccacatgcatgcaaacactgtagtgaaagacgatcacaagcagaattctccaattacgagtccaacaatcaagcagaaatgtacgaaatatatgtgaacagtaaaaatcaacggacgcagtgagtaatcagaaaattcagatcgactcatggctgcacaagatgacctgtacgtgtcgcttgtttgccacgccccctccgatcaccgtgcagcgcagaatgccagaatctctcgatctgagcaaccggcccgccgttccaattcgcgcctgtgcgacgtacgcctctcccgaccgggtgcgcgcgccgcgccgcgcgttcttcgccaagttgccacccctcttgcaggccgcgttaccgcatcaaacaagccgcgccacccgatcgatcgcccgcgcgcccgcgtgccgagccccgtccccacggctccgcagcaagcaagcagatcgcgccccgcccgcgtgcgtgcccgtgcccccgcgcgcgcgcgtcatcttgctttgcttccgctctccgtgtaaatcattgcgttttcccttcccgtccccctcgcgcaaaaggccgcctcgcccctcgcgcgtagcgtacgtggcccccctccccccgcgcgcaatgcatgcgtgcaccactgcaacttgccccgcaccgcgcgcgcgcgcgcctctctcggccacacacctcgcgcgtccccttataaaaacggcggcgcccctcgcgtcgctgggcaactcactctttaattcgcctcccctgaatcgtgtgcgtatcgtatcgtggcgtcgtcagttcgcgaaaaaaaacgcccgttcgttttgccgggtgcgtgcaggatggcgttagaggccgtggtgtttccgcagggccatttcggctac

SEQ ID NO: 51833 - DNA, 4243 bp, Oryza sativa
tacaacactaactacgcatgcttcaattaatcgcttttacgcatactgttatgattcgttaatcatcattaaatcgaatccattttcgctcagggtgatcaagcatcgatcgtcggaggagcaatcaactacgtgaaggagctggagcagctactgcagtcgctggaagtccaaaagagcctcaagaaccgcagcggcgccatggacgccgccggcgattcccctttcgccggcttcttcagcttcccacagtactccacgtcgcctcgcactggctgcagcgccgccgccagcgccgggagctccggcagtgcgagcagcgtcgtcatggacgacacggcgggctccgcggagagcggccggcagtcggcggccatcgccgacatcgaggtgaccatggtggaagggcacgcgagcctcaaggtgctcgcgcggcggcgaccgaagcagctgctgaagctggtcgtcgggctgcagcagctgcgcatcccgccgctgcatctcaacgtgaccaccgtcgacgccatggtcctctactccttcagcctcaaggtaaaaaccaatcgacaatttgcacctattttactaccacgactgcatgcttagttagtttaggctagcagcacagacaaattaagcgattggaacgtcgcgggtgagcgaagattcgctcccatttttctacaacgccgatgataatgtcatcgctttcgtttggatgttaggtggaggatgattccaagctgggctctgtggaagacattgccaccgctgtgcatcagatcctgggcagcattcagcagcaggaggccgtcctctccatcagctgacgccgcgatcgatggagacgacaaccgagacggccgccatgtgaagcctctgcctcgtccgtcctggaaatggaaccatggcgcctcgatcgatagcttgttagcttgtaatgtgtgaatgtgattgtaccctagccaacagagtgctgcatgcatgcagtatctccggcgaccttaatgagaaatctataccaacattttgagctcttgtaaacgtacgtacgatgaccacttttgtcttgatggaggtgttgtgcactagtacctcttgcttaactgctaccttcttttttaaaatatattacgtcattgattttttaacaaatatttgattacttgtctttttttacaaatataaaaaatctaagttatggttaaagaatatttgatgattataaatcaagtcacaataaaataaatgataattatatatatatttttaaataagacgaatggttaaacgtattttaaaaaatcaatgacgttatatattaaaaaagggagtactacttgccatttgcataaaaggagggtgactctaaaaccttacgccttctttgaaatggagggacttcaagggtttttcataggctatacactaatgatatatcgaaatttttgtgttctgaaggagcccttgggcgatggtgttcttaactgatgagggtaaaaccattaacacataattaattgagttttaattattataaataaaaaaataggtttatttgatattttaaagtaactattatatagaaagttttaacacaaaacgtctcgtttaacggttttgaaaatcatgctaacaaaaactaaggtagaatctagatcttaattagaaacgaaaatatcatgaaaatagttatgagaaatccagaaggcaaaattgacagcattagtgcaatacctaaagtcatgaattttcaagtgtaaatctgaatctactcattcacaaaaggggaaaaaatcacatacgctaccaatagccgattgctttattcaacgtatagattgattttggatttaatttctttgagatatatcacgtacatttttttctaagtttcttgaaactaattggttacaaatcttgaactgtcctttatgatgtaccaagagatactatattttctagcgtagaggtactataaaataacatcgaaaattgtgataactcttgataaaaaaagaaccgtgcaatcactcatttgattagcatttgaggtatacggctttgtgtcctaaaaagacctgtggcccatttgcatgcatccatctctgtttcggttcacatgaactctgctttctctgctttagagtgcatctgtcaggagctatatatgactggtcgaacagcgtggcatccatgcagtgcagaggccgaatgattgcccgatgatgtgatgagctgcttcttttctcgtgataaacagtaaataatcctcatgtgtgtttggttctgcggtttggtcgcaggagtacataatgctcttcagacaatcttgctctcagggtgcactagcctacagagacaacatgagtgatctgcggcagagactagagattccattgacccgaaggacataagttctgttactaccgtataatctaggactccatgaattcttgatgtccaatgggcgtttgatcggacttgttactaactggctgttcccatgtacgtggatttcagaaaaagaatgaaccattttttcttcctctcgtaatacttgagtaagtttcagactgtcagtgagcctcctattatgcaccccacgtttctcctcacaatataagtactgctacgtactctctccgtcccacgtaatgtaaatgtaaaatgaaataagacacatcctaatactaattaactaatactatgaacctggataaatatctatccaaatttgtttttagatagagggagtacatcttatttctccggtacaccaatcggacaaaattctgagcaaaatccttcgactggtaattcatatcaaccttctattgacgatatagatctaccgaaatatactgtctattaacaatgcaatgactggttctgctcaagtacgttggaaaactcggatgcagtatattcagagtagcttcaataaggcactcgagaaggatgaggattaagtagtcgtatcaaacttgactgcgaggtgctagctgtacgtggccacgtcagtgtcgtgtgtaagctgttgagaaagatgaggattaagccgtgcgatgccccgttttagccagcaggtcgttgccggaacctggggcctaacagctgatgggagtactcagacaagtggcccggcagcttaccgatgattggctttgtagtttgtgtagatcagctcttgcgcacctgtacaactatgtcttgatctagccaagtagcagcaaaacggcatcaagctgttcaagcacaggtgcactgcatcacacggccaagttgtggttgtttccacatcagattagtaagcagctcactttcaccgcggagaagcgaggccaggaaacaatttgattcacctggaaattaaactttccagctattttcacatcacagtaatacagtgtaccggctagcttaattggcacccacaacttgtgagaactttcgtgctgagctgatgcatcgatgccttgaaagctaaccctgctttgtttctatcgatcagtctgaaggggaggaggttccttgcgaacattatatgtgctccccccgtcaagcaaattgctgggatggagtggaagaagtggctggcaaaattccaaattttacactgtgctataatgacggcatgtgaaccatctggagtagacaagttgattgattgattgtgtgcgtcagtgttcttaaaaaagaaaaaaaaaagaatgaatgatttcgcttgttaaggggagcaaatcttttgcgtatactaagagttggaagtttacgttttgactacatttattctacgatgatagttaccatatttgagaacgaagggtgtattgttcaggtaatattccatgcatcagcgctaatttgctgatattgacatgttgcaagttactcgtatgtcaaacctcaaaccaaaccaaaagaaaaaaataaataaaaagtgaaacaagcggtttacttctaggcctggattgaacttgaattggatcttccgtcctggcccatacaaactcctcgtgttctaccctcatcttttcccggcccagtactacttagttgggcctctttaaactcaaacgaactttagactgtccacactcaaccacccgtttcccccaactctctcttcttgacgcagtgacgttctcagactctctcagtgtctcacacggcaccatctcgtctggtgttcaacttgcagcgtttccgtatagcgagccatccaaatttggttaaggta

SEQ ID NO: 51834 - DNA, 969 bp, Oryza sativa
tttttttatattttttagaacagggtcattgctagttgccacactgccagaatctgattggggcatatcatatcaccacgccacatgcgttacacgcctacacgagagtgggaccaaatcacgcatgacatttcccctcttttaagggtgtgtttaattcgcgaaaaggaaatcgttaggtatcacatcaaacgtttaatcggatatcgaaaggaatttttagacacgaatgaaaaaactaatttcataactcgcttggaaacaacgagacgaatttattaagcctaatgaatccgtcattagcatatgtggattattgtagcactttatggcaaatcatggactaattagattcaaaagatccgtctcgcaatttccatacaaactgtgtaattggttttttatctatatatttaatgctctatgcatatgttcaaagattcgatgtgacgtttttggacaatttttttaaactaaacaaggcctaatttatataagaaaacatacatacatacatacatacatacatacatacatacatacatacatacatacatacatacatacatacatatatatatatatatatatatatatatatatatatatatatatatatatatatatatatatatatatatatcatacatattctcagtcatatgaatgattacatgctcttatctttacgagtatttctgaaaagttagaccaacatattttgtaattaatgtagccatcacgaatacctcattatcgacggatatacctcgcttattcatacgtacaaacagactccatctttatcgctgcagatgtgaccatgaatgcactgcagatatgacaaataatgcagatgttgatatgatactagcagacacaaatgctagtagtacgtagtagtagataagttaaatataataaagatgtgaaaactgaaaactgatcataaaccttctgcccggtcgg

SEQ ID NO: 51835 - DNA, 3498 bp, Oryza sativa
cagaggcaattatatcccactaatttgccaaatacaattatatccctataatttgacaaatataattcactcctggtataagaaaaactacttcagcccgaggggctatatcggccagtgaggttgttttcttttctcactctccaaatgagatagtagcgtgaatgcatgatatacctaacgtcggtccaaaagagagaaattgctcatttgaccatatttatagacctaactactaattttatctcatattttctagtttgtttatttgacccaacttattcaaatcgacaccatctaatgcctgctgcgcctggaggatgtagtgattatggtggcggctgctgctgttggtgtgattgatgttggatgtgaatgttaattggatttggagaatgcctggagaatgtgcttttgcttcatttaatgtaatttgagatgaacaagacatagaaaatgatgttaaaattttgtatgtctgccataattatgccattttttagaaatagaagtaagaattgtcaaatttaagccaaatttatcaaattttaagcccaaattgttgaaattgtctaaaatatatcaagctatgccatattcgttacaaatatgtttaaaatgtccaaacaaaaataaaatttgatacaaccgggtgaaatgagtaagggtaaaaaagataattagtcccttagttaacaccgttatcttatctttgcgagtaaggtcagcctccattttcgattttgaaaaacatgatcaaatgagaaaacctaaaaaaataggatctaatttatagttacgctttaaaatagaatcaaataagcaattttctgaaaaaaaaaagatatcatctgctcggggtcggttgaagctgcttcactcttgctctgcttaggtatagtcgtgtttcagagttgcaggttcatgaagtggatcaaataattgacttactcttattttacactactttgttagggaaaatgagttgttttattcatcagggtgacaacaattttgtctaaacttccattggagctttattcggtggtagcaatccgttgcttacataatacgagtaactagcatttaggatcagatcacattacccgatgtcaaaattaagggggtacctgggcatttaccttactaccatgatttactagggtatgccaaaaccaaatccgccagggtaaggacaggttagaaacataggttgagatcagcatcaacatgtgcatgtagtcgtatattgccaatggcattataggggtggggcaaggatagagatggaggttgaaaatatccacatgtgtatatacctgtagtttggcggtattatatgaacaggatagatggaggttgaatgcatctatacgtgcatgtactaccaaattctagaaaactggaacacacaaggcgatcatcactttggccgtacatataagaaaagaatagagagacatggaggttgaatgcatctatatgtgtatgtactaccaaattttagaaaagtggaacaagaaaatgcgatcatccatatgtcagatatagcatttgaacacgggtgtggacaacttccaccgcaaagatcctggctagctgacctacactatatctcccaaaaataaagcctgagtttagttacaaattttttcttcaaactttcaacttttccatcacatcaaaacttttctacacacataaacttctaactttttcatcacattgttttaatttcaaccaaccttttatttttaaggtgacttaaacacaccttaaaagaaagaaaggttagcataaaagtccgagaaaacgacgtgagtgaacaggttgctaaacagtagtggtttgtatggagtgttttgatttctacttttatttggaagatgcatgagttctactactacctccattttttactatatgacatcattaactttttaatcaatatttaaacatttatcttatttaaaattattgtggaaatataaaataaattaagtcatacttgaaaaacatttgataataaatcaagttacaataaaataaataatatttatgtatttttaataaaacaaataattaaacgtataaaaaaattaacagcgttatatattagaaaacggagggagtactgtttcattaagcggaatagagagttttttttttgaaaacaacaaggtcctaatcaggaccagttcaccatgtggaggccaggcaaagcaaaagctagcggactccactacagagttttattcatgttttgttttctatcgcatgtattgactaaggataggaaatcaaacctaccacatatgggtgaaatcgattattcgttccatcatgattggggtaggttagttagggatctatttatagccacagaacattgccctggagaatacactgctgcagtgctgcttaagctcgccatccagccgcaatggaagatcagagcctgaagcccatccgttgcaaaggtacacaattcacttacagagatcagatctgcatagctccttggtactactactactactactcaattcctcacgcatgatatatgattgatacatatcgacgacgaccatgcagcggcggtctgtagagcggccagtgagccactgatcgtcgaggagatcgtcgtcgatcctccgaaagcctacgagatccgcatcaagatcatctgcacctccctgtgccacaccgatgtcaccctctggcacaaggtatacgtacgttcccccatctgatcaaaccatgtgaaagaatcacgtataatttgcttttataatttcataataggtagaccctgcctttccaagaatcttgggccacgaggcctacgggtatgttcgttcttccctgatgctttaattgtcctcttcgccaatccgaaaattcgaattcgagaatctctaactatatctgtttgttttttttaagggtggtggagagcgtgggggagaacgtggaggggctcgcggcgggggacacggtggtgccgacgttcatggggcagtgcgactcgtgcgccagctgcgcggcggagtggacgaaccagtgcaccgccgtgccgttcaccatgggccccgggatgcggcgcgacggcacaaccaggttctgggacggcgaagggaagccgctcagcgacacggtggccgtcaccagcttcagccagtacaccgtcgtcgacgtcaaccaggtcgtcaaggtcgaccccgccgtgccgcccaaaatcgcctgcctcctcggctgctgcggcggcaccggtgagcctgagattcgcagatatattgaacctgcttggtagagccaaatcaatcaaaacagtttcaacttcacctaaaatgggtacggagttggatggaacgtctttcacaaaatgaactagatatacgaagcttggtttaaactatgagatttgctccggtcagtaaaaagtatctcgaggtactagtatctcacggtactaaatcgtttccgatcatttgatct

SEQ ID NO: 51836 - DNA, 1645 bp, Oryza sativa
agcctgagcctgaaatgccatttgcctgattgccttacctctgaactgtgcactgacattcattgcatcattgaatgtcgatcaggggtaggagcagcatggaggttggccaaagtgcaacccggttcgtcggtggttgtcttcgggctgggatccgtcggattggcggtaagctagaggtgaagcagtgtaatttcttactcggatacatgatgagttgacgaccgctgcaaatattttgacttttttttccaggtagtgcaaggggcaaaaatgtgtggagcaacgaagattatcggtgttgatttgaatcctaacaaagaggaagttggcaagtccaaattatttttcctgtgtataacacgcagtgaagaagaatctttgcattttctcacaactgaagaaacctctactttttgcaggaaaagagttcggtgtgactgatttcgtcaatccatcccaactcggcgacaaatccgtcagtgaggtgaggaaacacgccatttggcaccaccctacagaaatcatctgctaatggatccaaactcgtcagtgcacgttgttaattctgttctatcctaggtgatcaatgcgatgacagacggtggcgctgactacagcttcgagtgcatcggtatctcgtcggtgatgactgaggcagtcagaagcaccaaatcagttctgatctcaccacactgattcagacattcagtgatctaataatcgcgtgttaataattcagaggagaatatttgcagcgggaattaataatcgtgtgttaatgcagggacggggcaagacgatcattctgggggtcgagaaggacagccagccgttgtgcctgccgtccttcgagtttctgttcggcaagtgcgtcatgggatcgctcttcggtggggccaaacccaaaactgacatcccaatcctcgccgagaaatgcatgaacaaggttgcgtttttataaattcagttcgcggtttcagtttcagacgaaactagactcttcctaattgtaatgcatgtgctttgtgtgtgttgtgcaaatgcaaatgcaggagctggaactggagaagctggtcactcatgaggtaggcctgacggagataaacacagccttcgatttgcttctgcagggaaagagcctgagatgcatcatatggatggacaagtgatggccacaacttggggtggggatgcttttcctgttcaggttctgaatttggttgattgatgtgttcaataagtatgctgtttatttcgctggtgttgctgaaacaaggagtaatacactaatacgtccatcagccatcacgaataactgatgtacacttaatttcatgggcggttagcagcatcctcctttctgaatcaatgcagaatattttcattccaaaagaaaaggattatctttcttatggagtatgttcagatttgcgtgtaaagaactggattagtccaatcttgtttcttcttttttttttgatctcagtccaatcttgtttctgaaactgaacggtgaggtcgcactctccgggtctcctgtttcttaagcgggtaattttaccatttttaaggaagtgaggtactatatttttctagtgtaaaatttgatacctccagatactaactactaattatcttaagg

SEQ ID NO: 51837 - DNA, 8180 bp, Oryza sativa
cctgtctttcgcatatcaaaatcctgcccacaaaccacttctatgaaattatctcaggtcggatgaatttgtttctaattttgtgcgcagacaccatcttaggcgagtttagttgcaaactttttcttcaaactttcaacttttccatcacatataaaaactttcctaccacaacggtaaaaactttgtgcccccaaaaaaccccccttttccgtcacatcgttccattttaaccaagcttctaattttagcgtgaactaaacacacccttaacatcaaatgctattttccttgtttctttagagattatctcaggtcgatgaatttgtttctaattttgtgtgcagacacaatcttaacatcaaatgctattttccttgtttctttatgagccagttttggcgcggcggctggcggttacacgagtaaccgggcgatcaaaaaagagtgcaagagatgtcgtaatagattgaaataagacgtgtctacaacgagatcgttctctatatggtcataaccagctacctcaatctcatatctagttgctactagtatactcaaaagtgcatgtatttttttcttcttatgaaattttctcttagattatctatccgatttacgatccgattacaccattgtgttcataacaattaaatatttataacaagatctcacatgactatatttttatgaaaaaaatagaaattacttttataatatatctaaattacttttagattttattaaattacttcttagtcataaaagtaatttaataaaacttgaaagtaatttacctatactatagaagttacttaaaacaaaagtgaagtaacttgttacggcattaaaagaaatctatacattcatgttgtgagttgtttattttataatcatttttagtcaatgatgtaatttatgctgattaaatttaatttctatatagactcatgtttttacctccataacatatttacttttaatgtcgtgataaagttactttttttttctaagttacttctataatatatgtatattatttttaggctttattgaatttacttttatgggtctaagaagtaatttagtgaaatctaaaagtaatttagatatattataaaagtaatttctaatttttcatcaaaatataatcatgtgagatcttattataaagattcaattcttacgaacacaccagtgtaatcggatcgtaaatcggatgattaatttaagagaaaatcatttttgaagccggtgtagcgtagagcatcacatggctcctctagataatgccatgtccgtgaatcacgaggccatgtacatacgcaccagcgcttgggatcagacgaccgatgagcgtgtcgtgcgataagacaaaacagagagcacgcgcgaattagattttgccattgaaatacgaaccaaatacaggcatacagcctcgcatccgcttccataatttctgcaacaaatatgcatatgaatttgtttgtctttacgtcaacaaacataaaagagagtagcaaggcaaattgactaaacttagtataagatgagatatacatgcctacttcatccatcttaaaataaataaatttagtataagatgagatatgaatctgaacataagttatatcccagatttgtattagtagcatgtgacatgtcccctggtttatatatagtaatatgtgctacatctcctactcctactagttttgtttattttaaaaataatagactagacagctacaccatccatcagcccacgtcaacggtagaagaaactgaaagctctcataaaacaaaatacaagtaccatttgattagaagctctcggcctgcacacaaatgccttcaacctcactccctccctttatatatttcagacattcactaccgagctacatcgtcccttccaagtagagcgccgcgccaacagaaacctctttactatctcctctctctcgcgtccatggcgggtcagatcccccaacccatccgttgcaaaggtaagaagaatccggctaaaattcttcatcttctcctcgaaaaccaaagcccgtttttcctcgtctctttgcttccggtttgattccaccaccatggatgccctgaccgtgcttcgttgccgccgccgccgccgccgccgcgatgacgagcagcggccgtgtgcagggccgctggcgagccgctggccgtcgaggagatcgtcgtggacccgcccaaggcgcacgaggtccggatcaagatcgtctgcacctcgctctgccacagcgacgtcacgttctggcgtatgcaggtcagtccgatcccctgccgctgatctgtcgacgaccgatcggacggcccagaacgtcccgtgtgtggaccccatgtgtagtacggtatttttgtggagatttataaccgttatacaggactatcttagttcgcgaaaataatttttttgggcgtcacatcggatcagatgtttgtccggatattgaaagacgtttacggacacgaatataaaaactaatttcataactcgcctagaaaccgcgagacgaatcttttaagcctaattaatccatcattagcacatgcgagttactgtagcacttatgttcaatcatggactaattatgcttaaaagattcgtctcacgatttcctccataattgtgaaattatttttttaatttatatttaattctctatgcatgtgttaaagattcgatgtgatgtttttgtaaaataaatttagggaactaaagcaggccacagccttttgctctgaaaacgtgtgagccttttgctctgaaaacttgtgacacgagaacctttgctgccacattgcaggatttccccggcgttttcccgaggatttttgggcacgaagccttcgggtcagttcatttcaactcctgtttactgtttttatgtttttttagatggcccacattgaaaaatcggcccaagcgagtggcgtggaaataattggaattacacggctagaaagctgctctgctgtccctataggccgtcgatttttaacgagtcaaacaatacactaaagatggaaacatatgtatgatgttgaatgtcatgagcgtatatggatgcagtatgtttggcttgttcccgtgttctgataagaacgacgtaagatagctgcattttctggatgggttctatgcttctacgaatgagctaggagtaggaaagggacgatgctttcctgaatgtcaaaaaggccataataaactaagaaatcggaaaatgacattcggatcgtgttggtgtagaaaattgttgatataaacgggtcgcaacctttcagcaatatgacttatccggcctgtgtctgatgtctcttgagcgtgtgttaaaaatgacctactcatggtcatggatgtgtacgtatgtgtatgataatgtatatgcacgtggtaaaatagtaaatttctctttaaaaaggtatattcgtgccggttttgattttatggtcctcctggtctcttggcaaccgtggaaggagcggaactccaaagtttttgactctgcgttgtcctcggtctcagaggtccttgagtccatcctctctaagggtcatctatgatctttagctgacattgctaattttggggttctcttgggagggtagtggctctaaccccttcccgctatttaaagttgtgtttagccgtcgcagtagtcttctcttctcctttttatttggtctttttgttttctccctttcttggcataagtcggtctaaccgattgcgtcgtgtaacaaaaactctattcttctaatatattgacgtgcaatccttttacgcgttcaataaaaaatatattgtgaaaagggaatgaatggagatagaagagtagaaaaggcaccacaaatattcttcaacgttaccggctattgatccgtgatattttattggaaataatagaaatggctagctctacatcagaacagtattaaatctcgaaataaagattcaccatcttaagaaaatcaattatatataggaactgatgattttgttgagatgttcattcaacattttgtattcgtcgaatcaaactgaacaaaatgtgcggaccacataccatctactaacctgccttaacacgttggctaaataaattcaacgtcaatgctcccaatggactatattacgagttacgactagtttaatactccaacctatcgatataatcagttcaaacctgtcctttcagttaataattaaataggtttgatgttctatggcacaagcatcgattatttagcagttagtactaattagcacctactgctaacttaaaacttaaagagtctgacattcaagtaagttacttataactattcttcgcgccgccgatttcccgtctgagtacaataacattcttgtgattaggccaccaatgtacttattgagatgagattagaccactgatcaagacctatgacctactgccagtacattgcaccaagatagaatacgagttgcccaaatgtttgaatatttctagaataactaggaacataacccgcgcagtcacgtaggcttgcatattattttgtttcggaaatagttttaacaaaataagttgaaattaaagtaaggaatttttcctttttaattcaattctcattgtttattttttccacaaaaagtctcaagaaacttttattgctagtaatttttttttaccaacgtgcttagccctctttttaattgatcaaatatgcatatcttatttaaggcttctctgtaatatgtgagactctatggtattttaaagaaaagacctagtcaatatgaatcttaaaataataatttattaggaaaaagtatagattttaatcatattattataagaaaaactactgattttgaaaccgcattagaggcttatacatgaaggttgtggagaaacccatggagctactttgaaggataggaatttactgaattttgttgatttattattgacctttgtctcttggattgcttaatatgacttgtatgaagacaaatataaaaaaattgaaagaataaaatatcattatgttgtaaaatgagctatgttttactataacgaaaggagtatattgattcaatactatcttatgggttaagtgctccattaaaatagttttatgtgtaaaagcttcaatgctaattgctggttaagcaccccataaaatagttatgtgtaaaaggattgcaaaagttattttcaaagatgaaccttgagtttgaggcaagatgcttggcatataggaggctgcacatttgagtcacatgtgaaaagaatgctcgcaagaaccatttgtgtagtagtgtgatgaaaataattatttatacaattaaaaggttggaaatccctatgtgaaaataatggtacttgtgcctatattattgtttgccaacaaccgatagaagttgatagttttttttttttgagaactcatgcactttattaaaagaaagcgttttagaaacacaaagcatgagttacattaactgctccattaggagtgaaggaaagagctcttttagtaggacaaacatctctggaacaaatgtgagaaatattagagcaatcaaaagctaagcagctgttagtctgagcttgtcttgctgactttgcaaggccatctgcaactttgttgagctctctagagatccaaatgattcgaacttgttgatcctgcagaaaatttttaattcttgaaataattggtctcagagaccaatgtccggggttttgtatgtagtcctcgttctgcacagcattcactatctcactgttatctgagagaaaaatagggtcttgcagctgaagatgacgagcaatttgcatagctaaaaataatccttcagcttctgctagcaaaggagttcctgcattgagactttgagctttgatgacaatagcattgtgattgctagggttgtggatgaagatccctactcctgttttctcttccttccaagaggcatccacataaactcttgttcctgcaggaattttaacaacagaatttcttatattattctcctcagcccgattgaagtcttggcaactgtcttcttccatttgatgaacactttcatatgtctttgccattgcctgcgcagcattgcacacttgttgtggctcccaaatctttgttttgaagttgatatcattccttgctttccaaacctgccaaagcataattaaaagattgtatatattgatgccattagctgaaagataggcaataatatcttgaacagagcctagagaagaaagattatcagctttgagattaaagtcagagacgaaccaacataaacgactgaaattacagagaaagaagagatgcaagtcatcctccctttgaccacaggtctgacaattgggactaacggttttgatcctgtggtgcattctttgagcagttgggagagcattactcagcagcctccatccaaaagttttgactctgggaggcatgtacctgtgtttccagattaatttcaaaagattttttgttaaattactgacctgattttgattggggtacatttcattgtaaattgtcttgtaagcactcttggctgaacagactcctgagggtgtgtacttccagcaaagcctatcttcctcctctccctgcataatctgaacctgcataattgaatgttgagctgcactatcaaaaatttgagttattttctgagcatcccaattcttattctcatcccaaagatcagaaaccttatcaggcatgtgaaaaggaagattatcaagattaagttgatagttctttttgttatgtagtctaattggctagatattttagaacttattattgtatcgcgtagctgagatgtatctgctaatatttctctatatgctgcattttctcattgtttattaatgcatgccttggtgcatgtgacacaataagtattccaaatgaaaaaagtctagtcgagtcaaattgattttggattgtgggaaacagttcattgtttcatgtagagtgcgtgggacttcaaatagactacgaatataattttatagataaaaataaatctgcaagcataattattattgtagtgtggacttttcatgattgccgtcatgatttaaaaatttttactctaaaatttataattcaaggaatttatatactcgaaacaatcactctttgtaactttcttttagctaacatgcattaggcatttagtattacacacatacgtgtaaagtattactttaaatttatagccgtataataaaaaggataaaaattttgacagtctaaggagtataaatgtataaattttgagagtctaaaagtacaaacaataatttttctacaatttttagtgagatatgtgtgtgtatgtgtgtgttagttggtttgcaccgtgtgttcacgcagcttgtgcataatcttcaatgcgaagcctgcaatacctaccctattttatcttcattctttgaaacaattaggcatttaaacaatcatggtagtttattatgtccatagctataagatggcataggtacactggaagtaaaagttttactcgtgatgatagtttttaggtttgcaatatacgtggtttatactccatatttttccttataattaaacctccgtttatatgcatcgtgccaccctcggtcccggtggtgcacatgtaaaattgtttgcttgaactctccagaaaacaaattcactccaagttgtttgttgcttatgtatggtattatatatatctatggcctgtgtttatgagtatgcttaagtatatatatcaatcgacgttagtttgttctagccaacgaacaatttagcacaatacagtatgaatcgggacatatccatcttcataaagttggagttgtgttgtatacaatataaagtgtagctcatcaaacaaacttgacaccgtgacagcgatctcctgcaatcattggagatgtcgtagaatttttttacaccatgcatcgcatgcactgggtaggtgacgtgggcttgaccgcttgaggctctgattagttagatcattctaatctaacggtggatgccctggttgttctctttcgataatataaatccagtttcatcaatttaagtaaaaatcaaggatgatatgtttttgcttttta

SEQ ID NO: 51838 - DNA, 7788 bp, Oryza sativa
attagtgtagagaaaaacacaacccatggtgcttaattattctcttgtcgcatcacacctttaattttctttttatgtcatttacaaaattaatcatctccatatatgatttgatacgtggcaaagcggtagcgctataacggttgtgttcaccttagatgtctcagacattatgctttgtaatacgtgcgaaaggcaaaggtgcagacgtgcaatgtgcagcgggcaaaaagagaattttggacgctttatttattagcaaacaatagatttgatgattataataataggtccaccagttctagtgtaagtgtaaattagttaatatagattttaaattgttaatttaatgggtacataatataatggtgtataccttattttagaatagtgcattacttgagaataatagaccagtgtaataaaatgtagatccgataatttatataatggacccataaatttaagtgcacatataaattagttaatatataaatattgtttatttgataggtacacgatataattgtgtaaaatttattttaaaatagtgtattatttgaaaataatagtacaaagtaaagagtacaccggcttaagttatatgatggtagattctttgtttgtaaaattatgattatttaaaaaatatatccattatatatatatatggaaaaaagaagaaaaaaggaaaaagggggaggaagcgtacgtatttggcacgggaggagagaataggtgggacccatggtttttagtttgttttaagatcagtttcatctaacggtgtataatattggacccaccaatttaagtgaaaatcaaaggatatatgttttgtttttttcttagaaaatcaaaggaagcgtacgtttagcagtttaaaaagcgcatcacgagcatcctaaatttcttccaactcttgttggagaaacgaacacagatgtctatatgatcggtgcgccaagcccaacaatccaccattcctacataatggtgtcggctacctcgttgtttgtcttactagtgacctcgaaaactcgcgcattgagctccttccagataatccagcataacagggaaaaagccgcatcaaacgccttcttgccaagcttgtcaagccctgcgcgtgcatccaagaatccaacaaccaacatacaagatcgatggcatcaggtgcttgagaaggtaggcacacgtaagtccagccaccagccacccgctttcaaaaaccaccagttttcataatttcattagaaaaaaaaggtagaaaaaactaaagttgtaaattatattccttcaaaaactgaacctcataatcatccatatcaacataaaaccattttttcatattcttttagatccccttacaaagcacgagtatgacacttgtctacgtaaatcctcgattttacatattatgtaaccatctaaaatttcaaaaccaattggttaacatttcaaccatattatttcgttgaatatttttttgaaattataatgttgaaggtttttttttaagaaatatacaagattacggatttgtacgaatagatcgtatttcttagaaatatacgagattacggatttgcatgaatagaccgtcgttacggttcaatagtgcgaaatcgcagcgaaattgtaaaaccccaaagtgcgatagcgatgatggcatgatgacgcaagcgctctcgcaagtgagaatacgagaccgctcggtcttcgctggtagccgttgcaagaaggcctcggtttcgcttgttccttgagcgacaccggccagaatgacactaatggcacaattaatagtcttattgagtgattaattaattactaatgatgctagttaaataattaataattaattaacggttaatgatgccgcccgagaccgtgtgacctcgcacttccattctacgataatgttatatttctgctattcctttatacacgtgtatatttatgtaaaatcggtgaaaaaatggtatatttttattttttccccttatttcgttttgccaaaatatacgaagatgtatgaaaattgcaaggtgatcgatctcggagtgacaaactgcagggtggtggagagcgtaggggagcatgtggaagggttcgccgccggcgacccggtggtgcccacgttcctgggccagtgcaccgagtgcgtggactgcgcctcggagcggagcaacgtgtgctccacgtaccggttcgcggtgcgccccgggatgccgcgcgacggcaccgcccgcttccgcgaccgccacggcgccccgatccaccacttcctcggcgtctccagcttcagcgagtacaccgtcgtggacgccaaccaggtcgtccgcgtcgaccccgccgtgccgcccgccacggcctccctcctcagctgcggcgccaccaccggttcgtcctactagtctactgctggcacgtacactggcagagatgcaggcatacctgccgttctctcacgatcgctcgcgtgcatgcgttgcaggggtcggagcagcgtggaagctggctaaagtcgagccggggtcttcggttgctatctttggcctcggcgccgtaggattagcggtaattaattttcgattatctggtgtacaatattgaagtgtacgtatgttatagtgaagtatttttgttgtcaggtagctgaaggggccaggatttgcggtgcgtcaacgatcatcggcgtggatttgaaccctgagaaacatgaacttggcaagcccttctgctcatgaaactgttctgaatgttgattacaattcagacctttggtcgatgtcctagtttatactagtagttagtaacaccttttgttgattttcaggaaagaagttcggtgtgacgcacttcatcaatccacaagaacttggggacaaacctgtcagccaagcgatcatcgagatgactgacggtggcgcggactactgcttcgagtgcatcgggctggcgtcggtgatgagcgatgcatttcggagctcccgagaggtatgcacattacagttgtactcgaacatcctagtgtacgttggatgagctgatccacctgtgtctgaagatactaactgtttactgctgcagggatggggcaagacgatcattcttggcgtcgaaatgcacggtgcccctttgtccattccttcgttggagatcctcaacggcaaatgcgtaatgggatcactcttcggaggggtgaaacccaagcaggacattcccatcctggccgacaagtatctgaacaaggtaaacctttcacttacagacaccctcaaaactgattaactgttcatagtgtcacaatattttaacatcaagattgttgatacgaacgcaatgcaggagctggagttggacaagttcataactcacgaggttcccctgaaggacatcaacacggcatttgaccttctgttgcaggggaagagtctcagatgcaccatttggatggacaagtgatgtggctaagtgaaattgcaattgagcaaaccagttgtctacttaagtttgctgcccacttcagtaggttacaatacaattatacaaataactggtttgactgctgccccaagaagatttgtgtgtataatgactagtgaattttaacatcgtgtgtcaaatcatgtgcgttcagactttattgatatacaaaatcactctctgaaattcatctgtgtattctcagtcatctgaattctgcctgtaacagctttctcaaaaaatggatctccaggtgaataaatgattgctttctttagcaaccagaattctgatacatatcatgattatgcaataattcagggaaatgtcacgtttaaaagaacagggcaagatcacaagttacatatagtaacactcaacactccaaatataggtaacaatctaattcagaatttcagatgaaccctggccttaaacttgtcattacccacaattttaggttctcatctgccaccacatatttagcaaaacatgaggatgcacgcctggatcatccatttttatcctcttcttcctccacatgcctcgaagtttagcccatccccgatcgccgcaccatcatggtccaagaattcttgctcatatcgccgtgcaacgtctgaagaggtgttcaatccggacgaacaagatgcagcagagccggcaggacgtggacgagcatgtcgccgagctccgcggcgagctgcgcaaggcgcgcgaggagcgagaccgcgcgtaccgcgtcctggaggtgagcgagtggaaggcgctggcgtcggccaacgaccgcaccaccatagagacgctcgaggcggagctcgacgcgtccagggagtccgagaagcggatgctcgagtccctggcgatgcagacgaagcagctcgagatgaccaagatcgagctcgaggaggccaggctggagaacgcgtcgctgcgtgagaccatccagaggctcgaggccatagcggtgcccgtcgcgacgacgccgagaggaaggtacgatcgcgactaccagagggttcacggcgagctgcggatggcgctggtggcggaggacaagaacaagaaggcgatggaggagctggtgctggcactcaaggaggtgaacggggagctgcacacgacgcggcagctgctggcgcggtcgcagcacgaggccgagacggcgcggctggagtcggaccggctgcacgtctcgctcaagcgcaaggacgacaagctccgcgcgctgtcggaggaggtggccaggctgcgcgccgacgccgaggagtcgttcgcggcgtggcggggcaaggagcccgggttcacgtcgtgcatgaagtccaccgagtccgagctcgccgagacgcggcgcgagaacgcgcgcctcctggagtcgcagcggtccgggcgggacgagatcgccaagctgcgcgacatcctgaggcaggccgtcaaggacaccaaggtcgtgaaggaggcgctggaggaggcgaggggcgagaacgccgcgctcaaggagatgctcggcgacaaggacaccgccatcaagtgcaccaagcaggagctcgagtgcctccgggtgacggaggcggcggcgcgcgacagcgtcaaggagctgcagagcctgctcgtcgccacgtcgtcgagccccacggccgccggcatgaagctatccgcgtcgccgagccccacagcttccgggataaagctggacatggaggattcctcgtcgtcgcacgggtcgagagaactgcacgggctgatcaagtgccactcggaggcgagggtgaagccgccggcggggctcaccctaccgcggcggaggtcggataacttcgaaggatcggtgtacgacatattcgggtcgatggaagatcagaagagcgagctaagcgcgttctcgacaatgccgaggtcgttgcccgcacggcggcgggtgatgatgcgcaaggttggcagcttgttccggtttaagagcttcagtatcaagtagtagctgctactgccgagattcggggcctgtcttctcttctcactacctgtttgggcgtgtcagttttgattgatcggtgctttctgtgtactactactgggtttaccttcctttcgcctgatcatatcatcagatcatgagctggtaaagtgtatacgagtacatcatttcatactcgaactgctagcgcttgttctgtgcgcgtaggaaattcagttctaacgcgaccgaaaccttgggccgatgcacgccgctaggctcaaaaggctgtaaaattttgctcgccctaaaaaggccttcttatggtcggcccatcttcccacgtcgccactttcgccatcttccgcccagcaatccccaactgctcaacggaaggtaaaagtacactttgactcccttaattataggtcgaatctactttatatcccttgattgcaaaatagggtgtctggacctctccaactattaaaaccggtgcaaaataactctagcggtaatattgagggtgatttcactaaatgatgtctacatgtcgcattgacttagtattcgtgatctaacgtggcattacaagaaaaaaaaataaaaataaggcgagggacccatgggtcagtgacagttttctctttactctctctccctctctctctctctctccacctctccgctctcagtttgtagccgggacgacgatgagaaccggtaagacctatgggcgcccgacgaaagaagagccggatgcggcagctaccttgtcacggtggtagaggcagtgaccacacgcggctgaaaatcaaccaggcaaggaggcaggagaggatggcagtgataacacctacgccaatgagcttgagcaggggagggcggtcaacggctttgaaggtctagaagctgggcaccgagcaacagcgatggttgaggaggccactaattccacttgggtgcatgcgaggcagtggggttccccaaatatggacaaggacaagtcgacatatcctacaagagcaatagcgcgggggacgttgaatgcgcctcgttggccttgtagcggtggtcagagccatcggagaccacaccggtgaccatagccgatgaggccatcactctagctggggcccactgtcgcgatccttcacaaggttgagctgccgcccccgattccgatgcaccccggtgggagctcgccatcagctgccgctgtcactaccctcatcctctcactgtcacaagcctccataaaatcgagctgtcgccgtcctccttggctctacgatcccagcccatggctccgctgcgtcccagtgggagctcgtcaccagccgccgctgctcctctcatcctcccgttgccaccgccaccgtgaaggggaaggggagagaccgagagagataaggtgggaagagagagagagaggggggtgtagaatggacttatttccccaacggaagcacgctgattcgtccagtacggcccaattggaatcccaccagcttggcccggctcccatcgatacaggcacaaccgctccgcacgactgaaccccaacttttcgctgtgcgcggaggcagattcgcagtcgcatggtagcaccggggaaaaaacgaccgcgctcccgtgcggtacacctgtacgtgcggtgccgcacttgcacggttgcgcacatgcgcccaaaaagccgtgcgctttcgaggggatgggcgcccgtgcgctgctgggctctctcctctcccccacctccacgtcaacgaaaggaatcgccgcgccgggtcgctaccaggtaagcatccaccgcgtcccaccggccacgccacgcctcgcctccgcccgtggataacttgttcactaagcatccaacggtagcccatgcctaccacaaatcaccaccatgtatagtgctacttcgatcgagctggacgataaggatattccacttatcagacccgatcgtacttggggggttttgatatctggttcggtcaacgattgttttctttgatctgttccttccttctctaatctctctagttagagccttccacgacgggttgcgtttcgctctccaaaacgtacgatatggtattattgtattgcctgtttgtttgacctactggcggttttgtttaggtcacacgcctgcatagccgtggacgcagcgttccgcatgtattgaccatggctatctacagactacagatttcaagaactactacatcattttattctcttgtaaacaagagataaaagaatactaattaagaaacaacttggtatcaaattaatagaaaaataaatatataaatcatttatctctgctcacacct

SEQ ID NO: 51839 - DNA, 6871 bp, Oryza sativa
  unsure (1)..(6871): unsure at all n locations
agctttctccgctgctcgatcgatcgctcttcctgcgtgttggcttgctagggtttatgcgtctgtgtttggagacagcgcgcgcgtggcggtggtggtgaactggtgatcgcgttgtggtggcagcacgggagcagggcgggtaggaggagatgataagaggagcgaggagagcaaaggaaaggaaaaggaagaggaaagtttggcttgtaacttgctgcagaaggagtccggggcccgtgttctattgcgccagtataatttaatttagtaccatctgttttgttgtaatgtttgataagcatagatttggcttttttcttctttattaaaacctttgatctgttcaaccttttttaaaaaatagcaatatctatgtttcatattataagccgtttaactttttttcctagctaaatattgttaaatttaattaaacttatagaaaaaatttagcaacatttaaaatatcaaattagtttcattaaatctaatattgaatatatttttaataatatacctgttttatgttaaatttgcttaaacttaaataagtttgcctaggaaaaaatcaaactaatcgtttttgttattattttgatggaacaatgatgagtgcaatatcaatatgtgctgccgaaaaaaacaacttacttcgacgcttggaaagtagatacgttaaaaaagcctaacaactagtattacgtacgtaggacttgtttagattcaaaaaattttcgtcaaacttttgacttttctatcacatcaaatatttggacacatgcatatagcattaaatgtgaacaaaaaataaaacagttgcacagtttgcatgtaaattataagacgaatcttttgagcctaattacgctatgatttaacaatgtgatgctacagtaaacatttgctaattatggattaattagaattaatagattcgtctcgcagtttacaggcgaaatctgtaatttgtcatgatattagtctatgttaaatacttcaaatgtgtgtccgtatacataaaaaaaattagtacacaaactaaacacagtataaaagcatttcatgcgaaaatgatgaaagtaaacaccaacagtgaactctgttacagggtcatactgtcatggatcaggatcaggtactctgtctctgagtctctcggcctgggcgctactgtttcgtatcagactagtttcaaggtgcccattatttatttcttttcaccaccacaccagcctctgaaacacagattctaataattccaacctacaacaatggcgacagaaacaaaaaaaaaagaatgtttcgatacaacgaaagattagattagagctgccaacgcattcactgatccaaggtggtcaaaagaagcctgatttctttaactccacatctgctagagtgggatttggtcgtgactgccttcagactttgtgcaccccaagtgtaattatattatttcccccacatcgaaaagaagtaaaaaaaaaaagtcagtagaaagaaaaggtgaaaaggattagtgccacgccgcgtcggcctcttgtgggaggcactagtggcgatggcccgcgacagcgatgacgggcgggcccacgcgcagtggacaggagatgctggtagacgattgacgacgacgacgacgacggcgagagtgaacgggtggtgcgcgtcgcgggtgggaggagcagtcaacgatgtgctacgtactcctacgtgtgcctccattacgccggggcgtggggcgtccacgtccgcgcgcacgcgtgtcgcaccgcgtgtggctctcgcacgcgggcgttcgttttcgcgcgtgcttcgtacgttttcaggacgtgagctgagcccggtcgatcgtcctcgtgccacgcatgggttcagactttcagactccggccgcgacgtcgggatgggggcgtcgctgtggccgtgtgggacgcgctcgttagctctcgccgttttcttgcatgtgcagctgatgatgatcttctcccgtcgcgtcggccgtcggtgacggtgagctgtgagctctgctgatccgcgttgcctcgcagagcaaacctgcttgccgatgatgcagtgcagaagtggaggctgtcctccatccgctgatccgcctcctactcctagcttctcaaacgtaggcaggcatcgatacgtcagacaaaacattcaccatctagaggattggatcggtccagattctgagctgagaaatacatgggccgagatttgaaagccctgtcaagagattaggttaggaataagtatacccttactccctcaaatatagctccaagctaattcatatctctcaaccacaatatcaaatattttggtcgtctaactattgaaactagtgtaatttaacttccacagcggttttcgttgatatggctcgttgacctggttcaaccaattgagtcagcatgcgggtcccatatatcagtgttacctcctctttcttctcatcttcttttctattcctttgtcccctctcttttcccacacggcacacaacgatgacactgtcgagctagagcgggaggagggtggagcagcagctagtgtggaggagaaggtatggtagaaagaagggaagcggccccttgcatggctggctacgccgagccaccgccgccgccatcgtcctagtactagtactgccctttctcggcctttcgccgtcctaccggtaggtgagtggatctagtccacacttggtggggctttgatgagttcctctaccactccgcctcgagaccacgccattctacctcgaggttgcgacctctcttcaccttgaggacgatgagccatatatccgcctcaaggacgcttcatcgccacttcgtctcgaggctcgccatcgcagcacatcaaggccgccgcttttcctcgctcacaaagcacaccaagggatgggcctgctgcgtgagctcacgaagctcgctgggtggagtcccatcacggaggtcactaaaagatccacgctgtagtcatctaggcagtgccaaaccaagcactgccggctgccgccaccactacatccccctcctctcttatgccaccatgatcatgggagagctcagacttggcgtagcggtatccatccatgccgaggtggatcctgggcatcgttgagccaaagctgaaggagatgaggcgatccctaacactagcaaaccactctcgaaaccatttagggagatcacaccggtttcaatagttggagagtcaatatatctgatattgcggttgaggaatacgaattagattgcacttatgtttttaagggacctaaaatgtacctatttcggttaggttaagcagtaaaggctgaaaaagaattttcactgacgggccgacagcccaacacaaccgaaatgtcgaagcatatgtcatttgacggtccgccgttaagtgttgtaattaatgggcttctcgtcgtcgtcgaccagcggtaacaaagggcccgatccagcggccgacacggtcgcggtcgccggagacgtcagccgaggccggacgaacgtgtccgctggagtacgtttggagcttagcggccggagataggacataggtaccccgggggacaagaagatgtcacgcgtccgcatcttcagtgcggtcaacacgacacatccattcaatcgagacgtacgtactcctcagcgatagctacacgtacaattttgtcgtggttgcgcatgcatggcaagatcctgtgcaccatactgcgcgttgcacaggattttcatggcaaaatcgatcttctactccaaatttcagcgaactttcagcctttgcaaggttcttgcgatgtccaggcctgtggtttgagagcactgccaagaccaaagatgctcttcctcttctttttttttctttccgatcatactgcaccaggttttattattaagacaaagaaagattactccgtataaaattagccacatggctcggggtgtattatatctgtctctttcttctttatttcatgacgtctcaccttgtgtgacatatcaccactggtacttaatatgattctttacttacttgcgatgcctgtgccctacaagcgaaaaggacgcttaccaaacattggaataaaattgatggccatcttggagacgtgttgacacgattgaaaaccactataccactttgtgttaattgggactgcagcgtttttctttcttgcggacggaacctgtctgtagataagaggattttcttctcatgttttcccaaaatggtaaaagcatgcatcctttgcaggctcagctttgcaatctactactagcacaatactgtcagttatttttggaagagcactgaacactttccaagctccctcttgatgccaaacaattcttgatggtatctgatcacatctgcaatctcgactgcggctgtcactctgtaccttggcttacacacaagagtttagacgatgacccaacatggttgcatgatacaggggtacttccgtggacttgattacgtacctacttgacccaacatggtttaaactctgtgtgatttagagtaatttttttagaaaaacttaatatatagtttaaaacgagttatttgaacagtaaaaaaatctaggaaaatatatttttccaaagcgtgaagtaaaacgatctgtttcatgaatcaataagctaaaaagaatatgggcttaacccttgtgtgtaagccaattaacatggctttataaaatgtccttgaaggagagtcatctacttatctttgatggctacttttttacatcactttggaggacctgcttttatacacccataacatctttccttttctctatctttttttaagacgatgtgcttcatgtcttcatcccttcatttgtttggtggcaggggaacaagccatcatgctggccagtcagtagtgtttggtgctttagctggcttgcgttatctttcaaaatttatcagctgccaaaacatgcgatggatcctccgtagctttctgtaaaaacgctacagatagtattttgggggaaatgtttgatttagcctgtaaaatgtcctatccgatttaccctcaacttatgtaccagacaaaccggagtgcacaaaagatgtttagaggaggctgagacttataggttcggccaaatttctaaatttaattcgataaattttggatgaaaggtataagcaaaattgatcgataatcttacccactatagattgccacatcgccaaaatgctgccacgtatgtgccaaacatgatcgaaagcatactagttgtgttcagaggtaaaaaaaacgctaaggtattttcgtaaggtgaaacacaatatttggttagtagtttattttttatcctgtagtcacatattctcaaaatttagataaaaatctgaatactttgaggagtaggagattttcaattagtcgtagctgtgagaagctcccgaattgtactatgttctttagagtatgtctaacggtctaccaaatcaaactctccaaacatctatacagccaacactgagacccatatgtcagcctctactaccatttcttctttctcttttttcctctcttcctcttctcccgttgggccatccntcaagctcctccatagcactctccctctttcgggtgataatgtctgtgcgacagcgacagttggatccgtgagcgcatgaggcgtggtggccgacgccagctanagaaaggccgtcgatgggcgcggtgggcaggtgcgatgcctatgctgtggtggtgcctgtttggcaagtgagggaatgagtttgaccaaccagacggagagactgttgggtgtgatttttgttcacaattattaaattttaacttgaaaaatgggatggagagacttttgaagatgatattggaccttgccagtgtgcgattgcatgtagcagcttggagggtcagtagggagttgagaccttgactcagacatgttgtattgctgtgagtgctgttgctgcttactgcttggggctcctgtgcacctctgttttcactaattctgctatgaagatttggttactgaactaaatgatttagttattttgactcgctatttacttttgggctatcatcattcgaggtacggagcaacaaatctcgatacttaggctgcgttcagggatgccacatgatactttggttacgttcgcatagacatcatgtggcattatgtctttttttttctattatgtaatgctttataatatactagtatgatatatataccacaggtagtaaaacgcagacagctatgctttgctgtcctgtgctatccttcttcgaccccttggcggcttaaaatttacatccttgatccttcgttaattaccctatatcaatttcgtcctctaggctcgttccacttcttgctactttgctacagtactagcagtaagcacgccaggtagccaaaggcggtagtaaatgagtacagtaaaaaaactaaaagtacgtgctccatccaagcatgcaatgcgccaatgcggttatgcacagtgctactaaccctgccattttttacactaaccgtggagatcaaaatctcattcccaaccctcgttaccactcgcgcaccaaccgaagttgaggttggaggcgtgctcgtcggagaagaagccggcggcgtcgttgccggccatctcgccggagcaggcagcgagccattcctccgtgaagccatagacgccgcctttgcacgagtcgtcggagtacggaccgtgccatttggactcgagcgcggggagcgacgacgagcagcccacggttgccgccgacgcgtcgtcgaccaataacgacgggccgaatccaatgaaggccgcgccggagtacggcg

SEQ ID NO: 51840 - DNA, 872 bp, Oryza sativa
tattattcttgcttcaattacactggatcgaaacatattactaccgcaaatgcagatggattgtacagtttgcacttgtatttaagcttcaaacagatttgcagccatgacgcactccacaagtagtctacacaaacgaaaaagatctcgcagcaaacacaccttgttttttggattttcggctgctgctggtgggcctcttcattatttacaaaactgaaggaggattggaaatggagatgatcctacgagtggagggttgcaaggagtgttgaaacttgaaagaagcggcagctagcaaccagaggacagaaattgcatgcagatgtgtgtaccccttcaacttttgttggtcggtggcaatggcctcccctgcttcgagaatcgagcagtgatcgtggagatgaactgggcagagtgccgattcgtcctttggaggacggaggtgagaggcggagagcagagagagaggtcagtggacggggcaaacagctgatgcaagaagccatggatcgcgtattaataaaaggacgcaggaggaggagctgaggtgggccgggaactctggttttggacggtttccaagatgtcctgtggcagaaatctttgtatgattcatgtgtcttcaaggcatgtttgatttgttgaagatgaacatatcaattttttgtaatgcaaaaaaaatgatattaacaaaattttataagttaaacacatgagaaatctcatgcatttggttgtgtacatcctttgaatatatagatgttgagttttaattcattattaaaacaaacactggactaataaaatgaccgctaatatctccaatcaagttcgactgcataaatctttttttaagggacaccggggca

SEQ ID NO: 51841 - DNA, 14043 bp, Oryza sativa
tagtaggagtaacgtacttataattttatatggttcatgatgcggtactgttagggcaatcacagtgcatgcactataggtgtccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccgtgaaggcaggccgccagcccgccagcctgtagtgcacagtgttttttttttaaaaaaaagcaaaggaaatgtataaggaaaaaaaaaattaaaaatggaaataaaatgtttaaaaaaaagtaatgatttactaatgttaaaaaatgaaaaaatggtatttaaaaaatggaaataaaagtttttttaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctctttaaaaactttgtcatgtaaaaactcataggggaaaatgagaaaaccatgacaaagaaaagagtacagctcaaaggtcagaactacttctaacaaaattctactggggttggtctggatccaggtagagttgctcgaactgggcagccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgtgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcatcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccatcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaactgcgagctcttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccgcgcctgacgggccgccggcgtgccgtgccgtgccgtgccgcgggccgtgccgtgccggcccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgcctcgggccgcccgtttggcccggcccatttggccacctctagcatgcaccggtagaggggtgttacttgttagcctaaaaagttggcacaaacactcaatcccacagtgcaaggaacctaatttgggtgatctaaatagataaatggatggagatactgttgaaggcccacaacgcacgggggagcggaggaaaatcaattcctcacctacccttcgatttttctcctcccacccactccgccgcacctcgccacaagcgaacgggtgaaaaaccgaggaggtcgtcgtcgtccttattgtctactcccttgctcctccatcccgccgccatcccgctccaccaccgcagcccacccctatccttgtcgtctccacgggagcacgcgcacacaccgagcagcgccgccgccttcgccgagaagatcgccgccttgaccttctccgacctccctcctccccaatcggagcagaagcaggcgcaagcgctgctcggccatagccgcctctccgacctccctcctttttccctgaatctcgccgagaagattgctgctcggccacagctgtggcatcccggcccagggcttaatagaattaatagaatactcatatcaacaagttgcaacttcttttccggaagccagtctcgaaagaactctgaggttaagcgtccttggtgaatttcccgggtgcgcacgagtgaggacaaagtgtgcagaaaagacatgtgttggtctgtgagggcagtctatgacctatgaaagctatcagatgtaagcgggcccggcctaggagaggcgggacgttacaaagtggtatcagagctgactctcgcggtttcacgggcacgtgtgtcgcagttgcgcaggcatggtgcgcatggctggtgtggacctggagtggtcacacagcatggcacatgcgctggcactagacacacggacgtggccaagaggggacgttcctggcctgaggttgatcgacgaggacgttgatctttcttaagggggtgaggatgtggcatcccggcccagggcttaataggattaatagaatactcatatcaacaagttggaacttttttctggaagccgatctcgaaagaactctgaggttaagcgtgcttggcctggagcaatttcgagatgggtgaccgatcgggaaattctttccgggtgcgtacgagtgaggacaaagtgtgcagaaaagacatgtgttggtttgcggcggtgttggcggcggagctcgacgtcgaccctgccaaggtggtggtcgggagggcgcgaacgacggagccgcaggagggcaattttggatgacgaatccggaattcctcgtcccgttcgccggcgagggcacgacgcgtctaggtcacgcgctccacggcgcacagaaccttgccgcgcgtggactcactgcgagtaagaatcgcgcggctctgctaaggggcgaggagctcaattggagcgcgcgaccttgctccatgcaagcgcaaagccgagccggcgatgcgaagtaacgctccacgtcaccggactgtgagaggccttattcacctctctgtaagtacatctacgcaacctctttaattagcactaaactatagaacgtgaggttttgctgcatttgtttaccatttccttgggtggccaaacgtggcagcaaatgtgttgaggaaacagcagcgaagctgatacagtatctaaacacatgacaaaaagtcaggaaaaaaaaaaccatacgcgaggtcgcaaagtgtggctagcggacgccgtagctcgccaaatggctagcagcacccagtttgaaaggccagattcgtgcaacagcagcatgtgtcacccggtccaaaaacgatatattatcccctttctctcgacgtgctgtgatgtttgctggaacagagccatgccaaagatatatcatgaaagaggtgaacggtgacaggtcatcttttgatctgattccatttcgcctaaaatcttctctggtcatggccattatttgcttgtgcatgcagcacagaactacaaaaacgatctctgttccaccaccagtgagatcaacatcacgacgcatgtgcggcgtgctgaaactactagcagcagctattatagataaatcagcttcatacgcaacgccgctggcgttgacgcgttgatgtacgtaggctgtttttagttccacgttaaaattaaaagtttaaagcaattagaacgatgtaaggaaaagtaaaaaatttacgtgtgtaggaaaattcgatgggatagaaaagttaaaagtttaaaaaaaaaagttaaaatctaaacaggacgtatgtgacttctatatgaacttgcgaaggatcgaccatgtcatcttacggatttagggatatgtccattgtccgtgtaaattaaatcgggctcgggcgagacgaccgtgtctgcacgcgtgaatcacgacaaggaccctgctttacgggcaccaacggagctctgctttgcatcttttgtagccttcgtcctcacgcgcaaatggtattacctccatcccaaaataagtatagccgtggatatccgtgtctaacgtttgaccgtccgtcttatttaaaaaatttgtaaaaaatttaaaaatatttagtcacacataaaatactatttatgttttatcatctaatagcaataaaaatactaatcataaaaaatttcaaataaaatgaatggtcaaacgttgaacgtgaatagcgcaaaactgcacttattttatggaggagggagtatatgccaagctattatataatgccgacgtgtcgtgttaagggtctaggatattgttcacttggacaatcacaaacgtgccgtatgctgctattagcctataccacgtaggcaatgtatcctatataaaaaaaagagtactattagaagataacgacaatgcagaattgcagagccccatcgcttgatgagagtgttaatacgttctagattaatgagggtcgataatgggtgtcgtacatctgctagtttccttttttttttttcaacacttgtgctagtttgctcaagttccgcagaacctatcgatttaccgaaatatccaatcatgctatcagctatggatgtataaacgccaaaacacggcgagcactagggggtgaaaacggtacggaaactttctgaattccggacctatttttgaaaacggaatatgtcggtcggaatttttcggaaacggaatcaaattcgaaaatattttctcggaaacggaatcataaatgataaggacagtttccgtcggagctcgaaatcggtcggaaactttccgaaaattttctcggaattaccagaaattttgtgacggaaataccctgcattctctttttaagcactgaatagtaaataccatggtgtttgtctgttattttaaaaaaataatatttgttatgtaaatctaaaattacataagaatattttttttgtcatgcattgggatttatcaacaacataaatcttttaaatatagataatttattcaattggatttatcagtttgagggattttttattccgataaattttcgttaccgtattcgcgccggttcgttttcgctccattttcggtttcgataatattcgattccgttttcgtatctgaggtttccaattccgaacccgaaaagaatatgaaaacaaaaacgataaagatagtttccgcctgtttccgtaccgttttcacccctagcgagcacaggtcgtgcgcccaagcactatactaatagtactggtactatgcagccatggtaggatgtagtactgtatagtataaattgagccaaaccttacgggaaactgttttaaatactcaagtggacgtccacctgtttcttgtatgtcatctaaatggttataaaaaaattgacatgatagattaatatataatatatcacttcaaaaacatgcaagttcaaattcgatttctacaagttgtaacaaaaataacaaatttaactgtgaatattagagtttaatttgttatttttgttataatttatagaagctgaatttgaacttgcatatttgtgaggtggtatattacacattaatctatcttcttgttttttttttgaaaattttttataattatttacttgacatgcaagaaaacgattagacgtccatccaaaatattaaaattcatcttccaaaccttacacgtatacaagaccacaagtcgcgcaagcaaaaaaagtcaggcgcgacctaaccacatttttttttccagccgggaatctgttctccggtggcctgaaaagcagcccccgataagcaaccttcctttgcccagaaagtcgcgggccgcatagcccgattgattgattgatggccgcatcaacaatccaacccaaccaataaagcggtagcctgccacacgcacgcactagcgcatggaccatactactgtagtacgggtcgccggaagacgacgccgacgtccggtccggctcggcctcgcgtttcttccacgtcttacgagttagtactccctccgtcatttttacttgcaatgtttgaccactcttcttatttaaaaatttttaaaattattatttattttatttatgacttactttattatctacataattttaagcacaacttttcgttttttatatttacaaaaaaaaattaaataagacaagtggtcaaacgttgcaagcaaaaactcaaaatcccttatattgtgagacggagggagtacttcattggtcccatacaaaattaaccgataatcagatatgatatattctaatattatatatctaaacatataggagcacacatttaaattatagtgttatgatatgttctaatatttgaagtcatctacctataaatataagatatgtaatatacttatattttgatatgtgaagtcatctacctttttcgttttaaaatattgctatctaggataggagagtaacattttgggacggagaaagtagctaacaggatctgtttccatccggacccatcagtccatcacaccattgatcatccgattccgtccacccaggacgggagtaggagaaatagcggaaagcgaggcagcgcgccaggaaaaatacggccaaattgatcccagcttctgttcccacagagaaaacaggcagggggtgacgggtgaccagtgacttaacgaacagttttgttctttgttgtatcaacatgagtatagtagtactccttatcaacagtctgctgggctaaaaactcgcaagaattgtcctctacaacgtgttttgtttttgtcgagtgtattggaagtgcagtgaaatcaaggcggtctgaagtgcaggagtggtactctgtggtactgacaggagcctactaggacatggtccgtcctatattaaattaatctaatacgagataaaacaaactccatataatagtgttataaatctaaacaaacatctattcatatttatagtactaacatatacattatgttccacattaagttaatctactaagtgatgtaacgtattgtattactataaatctaaaagacatatgtgtactagtaaggtatattatatcctacaatagattaatttaactcgcaacgaagaaagtacttccttcgtgaaaaaaaaaactaagattagatgtagacatattctagtagactagtacaataaatctagacaaaatctcaacgaattcggataaaatcctagtacaatgaatatgaataaaatgggagctaggatatttcacatctaattctagatttgttttagtatatcacatttagtcttaagtttgttttatgagtaaatttcataaaactacatatactttgcacaatctatcgcaaaactatagattttagaactagtttcacaaaactacagatttaatgtctttgtttatcacaaaactacatgtactttaaacaatatatcacaaaactacatatttaataacttatttcacaaaactacatgtttaatatcttcatttatcacaaaactacagatttagtgtctccattctcacaaaactacacattttaacaatgctaaaacatgtagttttgtgagaatggagaaactaaatctgtacttttgtgataaatgaaaatactaaatgtgtagcactgtgataaacgaatacactaaatctatatttttgtgaaacaagttcttaaatctgtagttttgtgatagattgtacaaagtacatgtagttttgtgataaacgaagatactaaatctgtagttttgtaaaacagaatattaaatctatagttttatgataaattgtacaaaatacatgtagtttatgaaatttactcttgttttattaatggagggagtaggagcgaactcaagtcttctcacatctattgtatccggtcgacgattataaatgttggagtctagcggtaggtgcactatgcactgtgcactgtgctgcgatggttgggccgcggtgcactgttctgcacaatgttaagcgtcaaatctggtcccggctccacctttatcgagcaaacagagcaaggacagctcaagtcacaacaactcaacaaagcgtcgactgtgcgagtccaccagcgatactcctagtcgatagatacagcggtacaacctcagctttgtttggccgagctctagtgccacagtagtactggcggtgtgctggctcgtcagtgtgaccaaacatcgatatgctcttcaaaccgctacttcttccgttctaaaatattataatttttagataaatagaacatatcataatactataaatttaaatagaagatctcatgttctattcagattctaatactataaatttaaatagaagatctcccattctattcagattcgaatttagatagaagatctctcgtttcgttctattcagattcgtagtgctatgatattttatatttaactaaaagttattatattttgagatggtgtattcaccagcgtcgtcgtaccatcagcccacgtgacgctattctttgatagtgtgacgcattcagagatgcgagatgggcagtgcagcagcatggcatacacatgaaaatccacactggtcaggacgagccgacgaccagatgcactggcatgcaacgcatgcactcgtgcgatcgtgccagtgtgtagtaagatgaatctaaggcgtaatttttcacgtgccgaaaacggctgaacagctcgtgctgccggcattggcgaaccatagagttactatacttgtagtagtacagctcacactttccgatcgatcgaccagagcgaatgaacctcgtcgatcacgggctcacggcacccacggccacgtcttttccttgctgataagcgaggtctcgttgcaatgtctcgtgatctcgtcgctatcgccgcaaccccaacgtcggattgggtttcggttgcaccgctgaacaactgctactcccatgtttttttcttctcttctctgcttttaattgagggtacgacgagttcaaaatccctgtagctggcaataacgtcgtaggctaacaaccctattagacgagtttaaagaagggttcagacttttcaaatcgatggaaactttggaggctagtgtaggccgtaggtgctacgggtgtgtcatgttcgtcaagtgtggtcctcatgatacagtaccccgatagtgcaatcaaaatgtttctttttttaagatgacaatcaatgagttcctttatctacagattgcagatgccctttagggtctgtttatttggtgaaataaaaatttttgagtattacattggacgtttgactggatattgcaaggggttttcggacacgaatgaaaaaactaatttcataactcgtctggaaaccgcgagacgaatattcttagtctaattaagccatcattagcacatgttagttactgtaacacttatagttaatcatggactaattaggctcaaaagatccatctcgtgatttatatgtaatctgggcaattgattttttttatttatatttaatattacatacgtgtgttgaaagatttgatgtaatgtttttgtgaaaagttgttaggaactaaacaggtacagggctacttgagttcagaaaacaaactgttttattgtaggagtacagggtgatgaactagatcaattccgacttcggtgtagccgtagatttatgcgcttgccaggagtattcactttttctggcattgttgaattcgcaacagttgttttggttgcctcatgccgatctcagatgacctcatggtaaaattcggtgctatttaggcacgcacactcagaaaggaaaaaaaaaagaggccatcgccacagtgggcctatattatgagatggactgaaaaggagtctgtaattgggccttatttaccacattggctcggcctcagtagcgagtttaccaatgggccttttgtcatgagtaggccttaacatggactcactggaccttaatagtgagtttcctgtgctcgatttcggaatttgcgctgggctgtgcgccgaatagtagagagcttaccgttttcagcttttggcacctgcttagcttgtgcgtttgcatctgcctgtacttcgttgatctatctgttcatttcatttgtattgtcgtgccgtgccagccagctagtttttgcatttccgggaagctgataatggcatccatcgacgcgcatactcctcctgggcatccagacggattagagtaaacaaacagacgcgcaaaatagcgcgttaccaggagacagctgctttcttttctctttaattgagatgcgcgccagtccgttcttctttgtgtactgtcaaccagccggatccaagtgtccacactccatcctcgcgcaggcacagctcatgccaacctcacagcgtcacatgtcctgctttccaggcaagctggtagccaaccaagccagaccgttttccccggttcattttttaataataagttcatctattaaatgtgatttaggctctgtttagttgctctaaaatagcgaaagttttgttgttgtttagcactttttgtcaaaatggaactaaacactagtagcaaaaattggtaatttgacatttgtcattttgaagtctagagtagcaaattttgcaaaaaatatattgggagccatgctctctctataggcctgtttactttgatgaaaaaaaacctcaccaaattatggcttattggcaacttgccaaaattttggtaggatttcttatatagttaccaaaatttagcagcaaactaaatgtagccactatttttagcaactttaccaaaatttattaagattgaaaatgacatcaaagtgaacaggccctatctttactagtaaaacgcaaaactttaatatacatctaaataccaactagaaaaactttaatgccaaatcttttgccaccaaattttttgcaaaaaaaattgccacggtaaattgatctaaacataaccatattttaaagataaggaagtagaaaaatctccgaccacaccgaccatactttttcttcgccatccgtaattccggtttcttctgcgcaacaccaatgcgagaagagtacggcgatagaagcaaaatggcactgttccaatacctgcaccgagtaattcttccaacaaaacgcatttatgtttctccattgaaagagagcctgcagatttttctactcgtacgcgggtttgaaggatcgatcacatggcggatggcgggagtacggcacaacacttgttcgccggcccggccgtcacggctcgcaacgcgggccatctgtcagcacagcacgggactgttcaatttgatgaaaaaaaaattattaatttttggcattgacaaaattttggtaacttcctaaaatttttggtaggatttttttatagttagtaaaatttgacagtaaactaaatgtagctttttttttataactttactattttggtaagattaaaaatagcatattagcaccacgtctcgcccgttgtaaacaactccaaaaccgacctccgcaacggctagtagccggacggcccagcacgtcgcccgagggccgcattttatcgtgatccatcacacacgtccatggacaatccgacggcgaggcactcgtccacctgtccatcttggaactagtcgttggatgattacctggtaaaacaaccgcttctccctcccggcgacgcggtgccgctgcacgaagggtcaacatagccggcgccgctctcgcgacgaaggtggtcggtgccagccggacccaacccactgacgtgttggtcccactcgacgtggcccccacgtgtcggcgaccgttgccgttgcgacttcgtcacgacttcaataggctacagctgttgcttaaccgacatggtggtatactagcctttc

SEQ ID NO: 51842 - DNA, 1074 bp, Oryza sativa
taatctgtgaccctaaaccataaaaccggatatctcgaccccctaactcttaaaaccggtgcaatttgacaccctcggcggttttggagggcggtttcgctaacgtggcgcctacatggcagtattgactcggtcttctttccatgtggcgttgacgtggcgcttaaggtggcattacaaataaaaaaatatgtgtgggacccatttgtcattctcacacaaaaataaattgtgggacccactgacatgtgaggcctacatgtcatcctctctatcttcttcatcctccccctatctctctttttctctctgcgagcgtgggacgggggccattggcggcggcggacgggcgggagcttacggtagcggcgggagggtgggcgggcgagggccggatgtaacatcctaaaaatccttaataataatcactaaaattttgaactcttaaaaaaaaacttttgcatcatgctggtgttattcgtttctctgttgtaaaatgtattatttaagttaaatattgtgagaagacaaatatattgatatgacaagacaaatactaaaaccttaaatatgggaaaatagaaacatatgttggaattagaaaaattaattattaatatatggtgcaataaatcacaagattggaagtgttgaaatataggtaactatctaaaaaaaaggagattaaaccatctaaaaattattcacacaaaaaggtctaggaaaagccctaattgtgatttttctcgggccgctactgttcattgcgcgccaggtgttcgatttgtgtctaacctgaccaaacgcctgacgacgccctctccaaccgctgctgtgccgcgcgcctgccttcccgacccgtgcgccgcaccgggtcgcgccacgccgcgtgggcctgccgccgttcgagccgtcaaaaacccgccccaaagctgcgccgccacgagtgcccgcgtcatcccgtcccctcgcgcgttgaattcgggattgagtgataatggccgccacgacgaccccgcgtcaccctagggcatagtcctgcgccttccctatcgtaggccgttatcactgtcc

SEQ ID NO: 51843 - DNA, 3992 bp, Oryza sativa
aggcgcagaagatgcgcgagcgcgagcagaaggtggcgctggcacagaagaccgcagacgtggagtcagcggcgccttagtttacaatgggattgtacgtgtctacttgggtgggtcgtatacatatttacgggtgtagtgaacatgtttctcagtgtagttttacagtacagtggcatgcataaattttgtacgagattgtttcaaattctgtatgacattgtttcattatatggtactagcacgcagaaaaagcaagtgctatagttgtatcaacaaagagaatactagcatatacattcacaagttcttcacttcatgacttcttcccagtgctggtaaaacctttatactactagctagtctacaagataacaagacagaagggaagattgtaagccgccatgaaggggttgcatattaaaatgccatttcacttcatatagagcacacagttgcttggcaacatgcatgcctgtgcagaaggagcatgtgctgatatgcacacctggagcagaaaagagggatgggactacggaagcacaagcatgcatgcaagaaacgacagggataaaatagtttcatagtataaaactagtaaaaaacaaaacaaactaatccctccaactccatgtctccatgcatgctgggcagtgcatcttggcatgtggcgacggtcgccggcgtcgtggtggccgacaggccgccatccggtccaacggcccagcaatgacttacaagaccaaagagggcatgggcccacaagaccgtcacgcacgcatgctacggcactggatgatggaccaacaaggtgatcgctgtcgtcgcctgcaccaacaccaagttgaatccgaatccactgcaatttttggaggctgtgcgctcatccagtcaccctgagcatagatgacaaaaacgaacacaccaaaagaaaaacaaatatgggcccaaacatcatggaatatattcacattgtcatggaatatggaattcttgtacaagatacaggggaatgacactttttttcaccaactatcaacttattctgccgtagtactgtaacatgaacctaaaacacagtgtctgccaactgccattgacggaggtaccaactaacattttactcgatctctcccttttgtcaggtcttggtgcttcatcatctcctagagaacttggacacgaggtacactagaaagaagcagacgagagcgaagaggattacatgaaaaagatggttcgaaccattctgtatgattttcttgtttattctcctcatgttattcttgacgcctgcctgggcctttgtcagagtcatttgctgcaaacaagtgcaatatgcacattagagaccgagcacaaagcgtatttcaagttttcaacacaaactagtgtacatcttattgcagattctagtctacacatgttctcgacaaacagagaaaggaatatgccagacaagtaattttggatgatctagggcattttatagagtaaagcctcatttcgatggaccttaatctgggtccatcaaattcctggcctataggtgtgctaacatggaaacttctcatgtatatgtggcctagtccccttttctttttccaaaaactatcgaccaacaagatgacaatggagagaagatcagaatgtgattccatttaggcacgaacatcctgctaagccctgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggctgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagatgaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagtattgcggcattctggctacacaataacaagggaagacttactcgtggctgcaaccctactagctcaaaatttattcacacatggttacgctttggggaaattatgaggggatctctcagtgctaagcctgaatgatggttatagtgtacttttagagttctcgtacaaaggtttcagattttaaaacgagcagacatcaaattccaaataatcaattatgattaaatgtacgattctacaagcacttcacttccagaaactactattttatgaaattttaacatgatgccgctacagatagactagacaaagctcacaatgtaagtaatacccaggataccaacatacaaggccgaattcatggtaacttttagacatgcgttagtgcataatgaatcaactacagtgcatgggatgggatgactgaacatgactggttaagtgacaagagattgaggatcagcagattgtgtttgaagaaacattacactaggaaccttgcgatcagtgataatctatctgctaaaaaatgtccatgtgaggtacaataggcgtgccatatcaacattccgataactcaatctaaatgctattcaggatttggcccaaactgtctcgcagacaagttacttaccagctgagagatgaaatcattttggtacttggcctctgtttggatctcttgggcaacctgcagcaccaaattaatggcttgtttagaatcgattgaaagaatatgaaaaaagcttatgaacataagtagatcatggttcaattactcccacatagcatcacgcaatttcacaacaactctagctcgccacaccggtttcatttagacaccaaattttgactaccttccacaacagagtttgctcatacagattcataacaatacttacccctcttagcttacggacttgcccacgaagtccgacaatatggtcatccaaatcagcggtaattgggtcgatctggagcgaaatctcgctggagcttgatgatgcagccggcctggccgtcagcccttccctgcagaaccgaacattaggatcaggataaccgagacaaaattggaaagtccaagagggaaaacg

SEQ ID NO: 51844 - DNA, 7061 bp, Oryza sativa
ctcgccattgcgagatcagaagagggagaccacgaagcattgagcccgagagatggagaccgatgctgctttcctcctccggatccgcgtcttcccgggcggagatcgaggctgcaaatttcccagcgacgcggcttggattggaacggagaggagaggacgaaggagagaggaagggaagcggagtagaggggggaaagtccgaggacgtggcagatcggacggcccacggttcacggatgacgcgttgtcgaagcagcggtgccagcgtgcagcgaacagcggttgcttctctgtcaggaaatcaggttaatcctgctttagtgactgttttgggagtttaaaattctgaaaaacagcgggtgagaagttagccgataagaattcgaagaaactatgtttttttagcttcagacttctaatttattttctagattcttaaaatctaggtgaaaatctaagtgttttgaaagtttctgacagctacagcttataggatgtcataagctccccaaacatgcccacatggttttacctgctgcttcgtgcatatgatgatgcttttttataaacttgtatagcacaaagaggataggttttccattccatcaggattttcctattaacgcttttttttataaattgttaaatagtgtgtttcgtataaaaacttttataagttactttaaaatattaaataaatttatttttaagtttataataattagaacttaattaattatgtgtcaatagctttctcactctacgtaccttatttaatcttaagagtatgttcaatggtagagacgattatagtctcttaaataataaaagattatttagagaccgcgtctttacaatagttgagacgacaaaggctctaatcattaactcaaaaaaatattcattttgttaacattcgttccatttttctaccctcatacaaccatatttccatattatagtgattaagagtcgttgttatccataacaaggatgttttgtctctcctctttctctttcttccatatcaacaaatattcctaattaacaacgctaagagaccactgtggataaatattcctaattaacaacgctaagggaccactgttgacaatcattgtacatgccctaatatttatctacctcaaactgacccttacttccttacttaattacttaatcttaatcttcatctattcaggtgccgctactggatggtcagacaatgcagcagtaaagggagaatataaatgagcaaaactcatggttcaaccaactcaatcatgtagaagaaagttatttcatcataggcgtcactttgtaaacacttcaaaattggtttttaatgcgaatttctttctatcagcctggcactattatcgaacgtcagaacagacactcgtttgatattgcaggaagccaaatgaaatccagtcggacaacaacagagagtaactatcgagagatcatgatgtcacatatcaaaaaccgtttcaagtcggtacacattgcaagaaatgccaacacctatccaacaaaatacagacgactgccaatttgatgaaacacagagtatatcacaaactgtaatatgttgggcttgctatccccaatctatggacatcactaagctcgtagattctgagcctcctgaagtgcttcctgcagattctttacggcgctgtcatagtacacgaagcccatgaaccagaactcatgattatcaacggaaaccacctggatgtatttctcagatgcatttgttctgctcgttgaaggattcactgatctcagttgggtgtggggaatgacaacctgttgtttcagacagaacaatgataagttatgcacttctataaaatgattcacgcaaatggagaaataacagcaggctaatggaagagaaagaaatctgcgactagtttcatgaagaaaagtaaaaggaaagcacataaaccaattcactactttgctttctacacagtacattatggtaagatatcttgcttcaggagaaatttgtcacactgattatcaccagcggttgtattgtgaagcagactcggtatgatctcaatatatgatgaaaaacacatacaggtaatcagaataccttatagtagctccactcatctttgtctccaaccttgtaagcaagtggattatcgctacagaatgccagctttttattggacaggtatagcacacccatgacaggaccagcagaggttgacagataacatgcatatggtttcttcagtttctcgtcagggaggacatcaaatgtttgatggaagattttatcatatccaccttctgctatgactttggtgatctgggaaaccctgcccattgctgcatctgtaatgcttggtccagttttcactgtttcaaggcaaattaagattcgtgttatgactatattatctcacgctgctcgaattcaatttaagaaacttataccatatcatttcaagggatcaacagtacaatgagcatgtgaacaaagaaggctcaatgcatgaatacaacaccaaatcagtgcaactagaaaataagggagaggtagcacaatgagacatctatctggaatgatcagcattataaaacactgcaagaatttaaaacatctttttactctctacattgttaagacatatggtttacctaacaaattaatatgcatgagctattcactgcaaataaattgtgttatgactgatagaatatacccagcatttctccgttgtcatcaacaacgccaactccacataaatccaattacatagcctaatagcaacagcaccacccataatccatatgcgctggaccaattcaaagtttcaaacagaccaaagaagccaatagatagtgaaccttcttcattcagcattactataacccacagatctcaccagacagcacaaatacccaatcaagcactactgtaattcacaattctcaccaggccgccttttttttttcgaactcatcaacacgaattatcgtcaaattccattagcgctaactaccgatataatacccagttcccccacttaatttaattacatgctactcataactccaaaacgaagataatatgcagaaaaaccaagcattggtaaactgatacagaacaaaaaccaataacttcagaattgaagcttacagtgttgccagaagttgccggtgagggtctccgtcttgcgagccgcctctccaaacctcttccccatcttgccgagaacatccttcaccgtatccattgtatctgcaaaaggggaaatccgaaacagttaaaaaaaaaaaaccccgcaagttatcctgccaacaacggagggcagattcggctgcaggaacgcactcttggaggcgggcgcgacgccgccggcgggtgaggagacgtaggggttgcccgagtagggcggcgcggaggaggcggcagcgtggtaggacggaggggggggcggggccacgtcctccggcgagagcctcgggtagtgcgcgtagtccgacgctgttgctgcggctgcgccggtcgcgggggccggcgccgccgtggcgtggtctcctccggcggcggccggcgggtgcatgtcgacggcggggaggtggggcctactggtcagacggtacagctgggcgccgcgtcgtgctcgacgtaattcctggacccaacggacgcttcaggtggttgccttttttttcttttctcccctttttttcttttcgaggatatcgtgactgcctgtctccgaagctgatgcggtatatatacataatcgaaatattgaattttccattgcttcaaaaaaaaatgccacacttaaataacacgatgaggtcatcgctaaggatttcgagtcttcggcgaacttgtaccaacaaatgcttagccacgaaggtgctttcatagcccgctctgatctgtcgtgtaacgcccgaggtctctcggtcagcgacgcgttaatatttagcggcccacatgtcagtcctgtataggtgagaatgagatcggatccaaccaagtgttgctcctcctccttccaacccgttaattccgctgcttcgcgtagtactacagcagcaacggttcatttctgcctttcggaccccaaactctcccaaggcccacctcacgtgagccctgtcgctccaccgcccaacgaacggcccagcctgcgtttcgactcgcgcgggtgcagcactgcagccgcgtctctccgctcggcgcgttgcactccgcagcgagcggcgagcgaaaaaaactgggcggattacggggagaatccggggaatcgcacgcgcgcacgaggagcgcaccgtgcgtgcgcccacggccacggggcccgggtggaaaaaacgcccccgtgtgctgggccgtccatccgaacgcgtacaccaccgcgcgcgcgcggcacgatgggccgccgatcctctcgcccgcctcgcgtagacgcgtacgtatacggcggcccaagcacttgggggggatcttggggaatactggaaattggaaaagaaatggagatacggggctacggatacctacctactactagtgcctagtggagtagtaccgttttttgcacctgaaagctgagagccccaggctgaactcgcaacctgccactagcgggaaagaccagcaggggggccacctttggagatgcacgaggggcattgcccaaaagttggccactaattgggttctttttttttcctctcataaacgactagcttagcactgctttattagactaaccgtggatctttttatgaccattactatatatctatttgcttcatggtctcttgttcggttttcaaaaggcaccgtgctttctctttgtgtgagaaatagagggaaaggaacctcctttctcttcattaatttttgctcatacgaattgaaatgatttcccttttgtccttaacaaatgggaattttccttatcattgattttcagctaatgttgttactcttgttagcttagacctgatcaatgatcccacgaatatagtatttactgtataagattgattctagctcaacacaaaactgggaaattcacttctgagtttggtctgaacaaaacaacaaccagtcatggaccaggatatggagttatctctttacaatcttaaaaagaagcggataccttaaagaagactattcttaggttttgtgcttggccccggatatcaaatcaaacgtcattgtagctcctctcctctgatcctctcccctgttgtgtcgaataataatagacagaggcctgaatgggaggaagctgaaccttatagataagactttaccttttttgcttctcccttatctccatctccttagtttttatatactacctccgtcctacaatataagagattttaagtttttgtttggaacgtttgaccactcgtcttattcaaattatttaaaaaaaagaaaaattgtacttaaaataatatagataataaattaagtcacaaataaaataaataataattttaaaaaaatttgaataatacgagtggtcaaacgttacaagcaaaaacttaaaattccttatattatgggacggagacggaggaagtacttattatggggatataatgactgtaaatatgtgggagaaatatagcttaaaacacacgtggctgacatgcatacaacggtaaatcacatgatgaagcatgtaaatttggggatcacaagagcacaggtaaagatggtatcattatgcctagttagttagcatgaaggatctctggacaaactggtagatggtttgattccagctcttgtaaacaaatgatagaaaagtacagtgtttggtcagcactacataaataacaattaacatgggacagatcaaaatgtattccaccatgaaataaaataatttatcataaggaagtactcagaaaataatatgccttgctgaacagaagttgatatggagtcacatggcacagtgcaagccagttctttttccctgaaaacaattatttgcagcaactatcacacgaagaagagaatttattggacaaaattaggaatggacaactgtattttttttcttttgtaaaagaagataaatcactggcaatatcgtgaggccagggtgcagtaagtgcttgagtggacaatctgagttgtctttatcatcatcatctctttctttctttctttcttttttttgaaacaaactttagtaccatctttcttgaaagaaattgactttcctgcttgtacagatggatcaatatcagaaacgaatattgcatcatgtacctgtcaaaagatcgagaggaagcagaatacttacgttttcattgcatgcatacagcccttgaaacaaggtaagaactagtgctcaagatttagcaagaagccactattagataaaaatacaatgaatgaggattgatgaacaatgtagttgtgtagatgcacagttgtatgtgaaggtccacaagtcctttcctctgagagtttttgagtcgtaaatgatcagttcaaccaaagaaaaaggagaatcgagatgtgcaggaagtccactgagaaagttggccacttttgcctctagtttttatttctccgtgcaggtaaatggattatgttattgcaggtcaaataatagtgcatggcttttggtgttaggagatgtacagctcatctgcaaatcaccaaaaaacaaaacgcagttactctgaagtcgtaacagcacaatcaacgacctggcctttttgaaatctcgtgctaattaattaagcaaggatgtgagagctagcagcacgtaaagtaaaactgcactaatcgttaaaaaaatgttattacaagtaaactaacccaacaccccaccggccaagcgtgatgtgacaaattaaaagcatgttgtgaaaaactgttatctgaataagtcgtagtaccacgtcacactaattggaaaaagggtcatcaaataccaatcagttttgttaacattgtaaaagattgtgttttgcatgcgtggctgttgcctgttctctgaaagaatgtccaattattatgt

SEQ ID NO: 51845 - DNA, 4984 bp, Oryza sativa
agctcgatttggatcttagaaaggtattaactgatcagacacagtaacagaaccaaccagcttcaatcacactcacaatggtatcatgcatggttaatccatgtcatgtacttgggcttagggttctctcctcctccaaggtcttatcatataaaccaactggccaaattttgaatacaaggcgcctgcatagatcgatcaaattcggagaatataaaaattgggacagtatgagctgtgtttcttgttttctaaaactaaagaaataattctttcgaaaaaaaatacattggaattaaagaactgggaggggggtaaacaagggtgtgcgtaaactactgtctgcactaagaatcccaatgccttgactgacagcaatccctgcctgaaaggccgaccaagcacaataaaagatgtggaaggaaacaaaaacaaagaacctttccttggcctatctctcgcctctttactgttgcgtttctaaacaaagtcccttgtgcatgtggactggggcaagggtgaaggatttgttttttcggatcattttcaaatgcctttccggatgggcaagggggctcatcatctgtgagcatatgacaagttcaaaggttagtaatgaccaccatgctcctacaccacatcaccaactaaaagaacgaacacgatatttgtttaaattagattgattgaaattaaggacctttcaaggactttctcccattcagatgaacggttttggtcgctattctttgtatccaatatataaggaagtagtagttgagagttgagactagacagaagttattctgtagctagaaagtcttttgtttgtcatgtatgcgagtgtgaaaacactttcatatctggaataatttaaccaattcctcagaagctatttccaatcattattcagctccagaccatccttaggggggttttaacttgaaataccatcatcgcttcaatagagaagacaactagatatccgagttgttaatactataagagtaaaatcttgtgctaacaagaaactgaacaatttctttctttacataagttagatcacacattttgatcttatgaatcgctttaatgtctacacatatatatgtcctccacttttcgtcttttcatggctaatgtcacttccacactaccactcatctcatatccattctctctcgccatagtcgcaagccatactatcctgtttgcgtgcctcatcctatatctcaggtatagatctcaaaggctagtgtgatcgaacaattgtttcaccatcgcggttggtccattctttcaaaatgcataactccacgttcttccgtctctacgttgctacttgtatttacacgtatcttcctcctcagctagtagctatcagtgacactttttagtacatattactcaaatctatatagatgataggacatatgtgacaaccgaagacactaaaatttgattttgataataaactgtaattgaaataaccatcttcactaccagaacaaagcattcaaatagctttcaacgaatcaaaacatgcctagctggaagagagaaattcaggtgtccaaaactccccccgtgcatacaatctctttcacgctttcatcacaccatctgaaaaaagcacaaaggccgagtttagttccaaattttttcttcaaacttcaaacttttacatcacatcaaaactttcctacacacataaactttcaactttttcatcacatcgttccaattttattttgacatgaactaaccacacctaagcaaataatgagagatgtttacatctatcccagcttccctctctttgcctttgccagtcccacggggggggcgggcactgtggtggtgccgccgtggtgtgtgccgttctgtagagcactgcggctcccggcccaaccgcagcagcagcagcaaacatacaacacaacaacaagtacacgcctccctcccacacaccacggcggctccgcgctggatctcgctcacgcacgacgcacctcccccgtccccgcgcgcctccgccgcggcgcgtctccactccactccactcctcgccggccaccaaccaaccacgcgagtggtgggggggtgggtggggcccacatgtccgaggaggaccacgaccagccgccgccgctgccggcgcagaagcggcctcgcgcgtcgccgccggcagaccaggtgctcgacaacgtcctcgacacggtgctccagttcctcgactcggcgcgggaccggtgcgcggcgtcgctggtgtgccgctcgtggagccgggccgagtccgccacccgcgcctccgtcgccgtccgcaacctcctcgccgcgtccccggcgcgcgtcgcgcgacgcttcccggccgcgcggcgcgtcctcctcaagggccgcccgcgcttcgccgacttcaacctcctcccgccaggctgggccggcgccgacttccgcccctgggcagccgccgtcgccgccgccgcgttccccgcgctcgcctccctcttcctcaagcgcatcaccgtcaccgacgacgacctggacctcgtctcccgctccctccccgcctccttccgcgacctctcgctcctcctctgcgacggcttctcctccgctggcctcgcatccatcgcttcccattgcaggtaatgcatctctccatggaactttccaacttccaacttactagtagtagttgttgttcttgttgttgtctagtcgtccgtggtaatggcggattcgatgcggtttgctctcgctctgtttcttgcagggggctgcgagtgctcgatgtggttgactgcgagatgaacgacgacgacgacgaggtggtggactgggtggcggcgttcccgccggggacgaccgacctcgaatcgctctccttcgagtgctacgtccggccggtgtccttcgccgcgctcgaggcgctcgtggcgcgctcgccgcgcctcacccgcctgggcgtcaacgagcacgtgtcgctggggcagctgcgccggctcatggcgaacacgcctcgcctgacgcacctcggcaccggagcgttccggccgggggacggccccgaggatgtggggctcgacatcgagcagatggcgtccgcgttcgcgtccgctggccggacgaacacgctggtttcgctgtctggcttccgcgagttcgagccggagtacctgcccaccattgccgccgtgtccggcaacctaacgaacctcgacttcagctattgcccggtcactcccgatcaattcctgcccttcatcgggcaatgccacaaccttgagagactatatgtaatgcctggattgcttcatcagcttggtttcgactgaactgcgcgattctgcttttctgacgatgatttgtttgccaggtgcttgattcggtgcgtgacgaggggctccaggccacggcgaggacttgcaagaagctccaggttctccatgtgcttccattgaacgcacttgaggatgccgatgagctggtgtcggaggtcgggcttactgccattgctgagggctgccgagggctccgttcgacgctttacttctgccagagtatgaccaacgctgcggtgatcgccatttctcaaaattgcgtggaccttaaggtattccggttatgcataatgggacgtcaccagcctgaccatgtgactggggagcccatggatgaagggtttggtgccattgttaggaactgcagcaagcttactaggctctccacatctggacacctgactgatcgagctttcgagtacattggcaagtatgccaagtcgctccggacgctctctgttgcgttcgctggagacagcaatctggcgttgcaacacatcctccaggggtgctcgaagctggagaagctggagataagggattgcccatttggggatgctggcctcctctccggaatgcaccatttctataacatgcggttcctctggatgtcaggttgcaaccttacgctgcaaggttgcaaggaggtcgcacggaggctaccaagattggtggtggagctgataaatagccagcctgagaacgaaaggaccgacagcgtggacatcttatacatgtatcggtcgcttgaagggccaagagaggatgtaccaccattcgtgaagatcctataagctgcttctgcagagtggcacttgatacgctgaatgcggcctaagcaacaagggaaggtaagatagctggagtcaggcgtatgatcattttttgtatgcttgaagttggaaggagttctaaagccatctatcagagctgcaaatggttaaattgttgtactactagtagggggggcatcggtatatgcaaaattttctaccgcaagatcataagtgcatcagagcaggcttcttcgagggggcttcatcccctcagttttgtttgctgctctgatggccttctgtttgaggggggcaatctatctatgccggcacaaccaccatggttcctctaatttttttcccaactgaagcttgtcatcagattaaattcattaacacatttcctgtttcttgcctttataattccttctgttttcgcattcgtatgttggaactcagaaaaacagaaaccctgctgaattgagcttatgtttaaattcctactactatgtgctcaaattttgggtgatctctggttcaggcttgaaaaaaaagtctttgaacttgtcttttcgttatctcctctgaatcctgcactttgtctgttgatatcattacctggaggtcctactcctcacaacctgaaagctctatccatgggttccttattgggaggtcagcaaaagttaggccctagtccatcaagtgattattgcttgacagcccccagtttccggcctacgtgttctccttccacgccagtgaaaacgacggccggcagctgcctccgtctccggtgatccaccaccattttttttgcccatcagaaacatatctcatgctgatactgttggagaaaatagt

SEQ ID NO: 51846 - DNA, 3967 bp, Oryza sativa
ggaactcattgttttcatccattgctgcagaaacagaaaaatgaaaaaagaagagcgagagagaaagcattcagttaccaagatatgaaagcctggtttcaaattcatatacaagttgacaacttaaatgattgaaagggttggaactgaagccaatgttacctgtagtattgtggttcgtctcttttacctgaagatcgctgtacgttgagtcagaaaagaggacagtctccagactagatgatgatgatgatggtactgatatagggagctacaaaaataaacgatagtttgaataatccatatggttccatagcttttaagaaatggaaacaatctgtacgcagatggcacgaatataacagaaagccagttatgattatcatctaagccttttttactaatatagcatatcctgtacgaacactcgtatctctaggcactggtagctttatgacagtgaggagggacctgacattcaaaagctgatttctagaattagtaaaattaagaattatattcgtggaaaaatcacagttaaggagcataggttagtaattgccaatcccagtgactgaccggtatgatttcctaacttcagtccatgttgttagagtatacagtttcataatttatattacaagcgttcgcaaaaaaataatttatattacaaaagaagatactggctttgaacaacttcaatacgttgcctcatgatgtccaaatatagctttgatggaacaaaggttatcttagtagtaacttttcatcagccctttaagtttgacaatgtggataatatgcaaagaacacgaaatcttctctgacagataacaatatgataatgtgaacctacgctgcccctatatccgtcggatacaacactggagcggagctgtcatggttaagcccctttggttggtccctaatgcatgtaagactagccacctcatttatcaaaacaggttcacattgttttatttctatgtttgttgtaacctacacaactaatcaaagcatttgcttctgaaaaacagaagaaatctgaatatctgatgacagaggatattgagaaaatattagcaagtatcaggaacagaaataattcatcaggcaatttataatggaaataaaaaaagttaatcaccatagatctagagccacaggacaaaaatgatggtggcagtacaccggtggtttctgcatcatattcatcctgtaaaaaactgacttcagcgattccaaagtttccccctgatacttcagaagtagagcaaactgcaaacgaataactaattaaaattgaacatgtaaatttgatggtgttgagaagaaaaaaatactgatatatctactaactaatgaatagtattaacatgataaactgtgtttgtgctgaacatgcccgtatctccaactgtttatgaaggggcagttctatgttctacatacataataaaactggaattatgaaaaaataaactgtagcacattcggccttgaaaaactacaatgcatttgcttgtattaaacttattttgtttctgaagcacacagtaattcaataaacttgatatttttttattcggtaagatctaatttttgtgctcagcagtcagcacaaaacaataaccaacaggatattctctaataatttcatttacagataagttctgtttgtaccttgcaataagtgttaagcaaacacagcataacagggctaaaattcttatttatgtgagtaaactgcatctgagagcataccagtgtattaaataaactcaaggtgttgtgttcaggtcggcattaaccctatgcactatataattcaagggataagtagccaggtatgcatctttcactggctatttctggtgtgctcacaatacaaactagttaaatcaacatcgccacacttcttgttttagtaacatggccagcacagaggattgatggactcatgcatcccaggaagcggatgcacttggagagtcactggtgctaaaagcatagaattaaaaacagcttttgcagtgcggcaggttcaggtgtatgctgagcagaaattcttcaaaatcagccagagcaaacaaaatcaagaatagtataaatacggactttaccattttgatgacttagaagtgttgaccccaccgctgttctatcgagtgcaatctcttgagactgtgagtcttccaatatttcggtggtcttgcaaaatgaatgaagctcctgcgtccctaaatagtcggtgcttaacattttattcatccttaatgcaggcatttgcaaaaagcatgttgaaagtactgcagttccagtaggaaaagtccaactgttgaaacatttgatatcactaaagacattagtggagaaaagtgaagctggtaaaatatctacagactaatgatctactggaagaacatactttacccatatgttctcaataaattagagccagccaccattttttttctccaaaatctaccactaaaataaaacactcactccagtgaattcaccaatcgaacaaccctttcaaaatctttaaaccctcctagcaagcaacaactttaacaccaactaaaatcccttccttgctttcccctcccttttttatactttcccatgaaacaaattttcgttcgaacttgtcaggacagtaattaagatcagaaactaagctacagcaggaacgcagcctacagaattccccaaacacatgccacatcccaaaagctcgctactccttttccaccgagcagcccgaaaaccttcacacaaacacaattcctctctatacctcggcccaaattttgagcttacaagtatttctcacgggtacaaaaagctcaaccacccaacaactagctgaaacatactcaagcagccaaacatgtaccaccctacacagagcgaagcatccccccagatcaaattacacaaaacccacaagaatcacagagagtcgagcccgagcaggaaatcgagctccggaaatcccccgtccaaagcagagctcgagcgacgcgaggagagagagagagaggaggcacgtacccgagatgcacccagctcctcgccgccgttccctcgcggagcacgatctctcctcccctctcgctcagcctcaagtctcgcacaaacgcacccactgggagagagaggaagatggagagggagagcacaggtaggggacagctcgatcgcttgctaatcccgtaccacatatactaatctacgcgaccggtccgcgtctgcggagtcaaggtctccccacacgttccaccgcggtcactgacgtgtgggcccaagaggatccggccccgcgagggcgtagcagcgggtagcagtttacgtagctttcgcatttttgcgggtgggttgcggctgctttgcctatcgcccaccattcgttccgctaacccgtccgtccccgcgtagcaagttgatcgctcactgacaggtgggtccgcgaacatgtggcccccggggtcagttggatgggttaatcggaggacggttggtgcggggcatcaggggccgaggtgtacacgtggacggcgaggatgggtagctcatcatgccaccagcggagtccacctgttaagtttaatattggcgattagtccccactttatctaatcgggctactaatcgtactcgtcgttctggttagtcactggcaaggttgggccggtagattccgggcccggctgtaagcgacgtcggatcggtgacgacctggaggccctgggaattcatggagttggtggggtacacgtggacggcgcttgatcttttgctcctcctttgcggctgcgtccactggctacccgacgcgtggaacgggaagccgggggccggagcgcgtgcggccatcgcgcgccaggtttgcggctctgcgcggagagagagggggagcagcggcgccggcgcggcgcgcacgtgcggcggagcaaagaaa

SEQ ID NO: 51847 - DNA, 3695 bp, Oryza sativa
agcccatgccgcatggggggctaatgcgcgatcgatcgatcgccagggctgatcgccctgcgatcggatcccaccccccgctcccctataggctactcccacttctcccctttctccccctttcttctctactactactacagtacaccacaaaaaagtttttaaaaaacaaaaaatttagaaaattttatgtataaaaattttgaattcaaattcaaatttgcatcgggtatgtaaacttttaacttataaattttggatctataaactttaggtgtataaactttagatgtatagaaatactatatatagaaaatatttgaattcaaattcaaatttgaatcggatataattcaaattcaaatttgaatcgggtatataaactttaggtccataaactttaggtgtacaaactttagatgtatagaaatactatatatgaaaaatatttgaattcaaattcaaatttgaatcagatattggaattcaaattcaaatttgaatcggatatataatctttaggtctataaagtttaggtgtatacactttatatgtatagaaatactatatataaaaaatatttaaattcaaattcaaatttgaatcggatatatatacttttgatttataaacttttggtctctaaactttatatgtgtaaacttgaggtgtataaactttaggtgcataaatttactaaaatagaaaagtaatacggtgccaaaaaaggaaaccaggtggagggagggggggtgggaaagggcgagtgaggatcgctcgcccgcccagtagcatttccgcatgccgcatggtggatgtgaaagaaatagaggaaatatatcccatgctactttgattttttttatgctgttactttggttttgaaatgcagggaggggatatgagatttgggggtgaagagtagatcagaaggttgcaagctccacgctatatgcaataggaaaaaaatacgaattacctcccgaactatcacggtcaacctaattacccctctaaaccataaaaccagacattttatacctcaaacttttcaaaccagacgaataaccccctagtggaatccagagtggttttgatcctacgtggcatacacgtggtggtctagtcagtgaaaaattaattaaaaataagtgggctccaccggtcagctcctctttctcttctcccacctcatttcccttccatctctatctctctctcgctctctccctctcacggaaagccaaaacagaggacgaggcggtggaccggtgtcacggcggcagtaggggcaacagggcgttgggggagatagcggcagcagcggcggcatgagtgaaggccgtcaggtcggggtggcgggcggcgacactgctgcatgcgtcccctgggttccatcgccgtactctttgcccagggagagtggacggcgccagtgcggtcgtcgaggccggatctcagccagtggggcagaaagagtgctagcgtggggctggaacgacctcgacggcgagggccctagaggtcgcgatcgaagctcgcgtgaaggcagcgatgagcccaccgccgtctcgagcttggtgagggcgttggaggcaacgaccagcagtggagctcaatgttgcttagggaggtcggcggagcaagaggttgcgtggaggcagctgcagtggcggcggagacggagctcgcgagaaggaagcgacgagcctgtcgcagtcttgagctccctcgaggacgagcggcgcaccggcagctacgagcctcctcgcggtggaggccgaggatgagacgcgcgccagcggtggccggcccatcaagctcaccattcaggccccgttatgatgcgcgccagtggcggccggcgtcggatttgcgcgagaaggtggcaatggtggggaatactatggtgggggagaggtgtggcacagtcgacgaccgtggaggcgagcccgttgaccagtgtgactacggatgcagatgccgacaccgacccggccgcgctagcgcggcggcgcgaggcggacggggaggaggcggaagataggcgaaagccggaggaggcggtagcagaggaggaggccgttctcgcattcgccgctcgccatttcctccgcccccagattctgtccctgcggcctcccgccgcagcgccgtgccttgccatagcctcccggccactcgccacactcgcctcgtccacctagccatgcctgccactgctcgccatcgaccggagcccaattcagagtgagcaatgtctggttttcgggtccaggggagtattcggtcgaccgagatagttcgtgggagggggtggggggtaatttatactttttcccatgcaataagcatatggattactaccaagtactctttcatttcttattatagatggcttgttaatttctatcatgacgtttgatcatttatattattctaaaatttataatgttctattattaaagaaactttaagtataacttatactttgcatatttacactattttttttaataaaacgaatgtctaaacattatttcaaaaatcaatgacgttatttattaaaaaacataggtaatatgttccctcacaatttccattctaattctttatgaaatctttccaacctccaaatttgactaggactcataatcctactaggatttcctcacatgacacttccagttcgttcttcaaaattttcagatttggactcttttcatgattgactaggacttctactaggattctcttacattcatatcttccggtctgttcttcaaacttttgaaatttcgactccctctaaatttgacttattttccatacacgcaccatactgaatccgaagaacattctcttccctctacgcccacacctctcccagtcccatccttatccagttatcctaaccttcaacactctaggtgggatctgtgagctcgccggaattcgttggaactagagaaggatgtggagcatatcaatcggtggagtgggtggagtaagattttttatcaaatgtatcatttagcaaattcgctttttattttacgcctacagtaacattttttccatgccacattctttttttaggaacggtttaatataagtgaatcataatagaggaatttacgccaaactaactagtactacaagaccactccacaagaaaacttctcatgcaaaaaaacgacagtatcctactcacactcgtcatacaaatgcaacgtttcccaatggccgatcgaatgctcgaattcaccaacacctgcctagtagtctccagtgatcgatccaatcagctgcagcgaggaggcagccgtagcttcatcgtcatgcccttctgaaccgcctcaagacaaggccgagcaggctgccgtacacgacgacgcagtagcctacgaagaacctctccccctgcgctatccccgccgccacctgcgacgccgtcctgctcctggccgccgcgtcccccgcagccggctccgccatcgtggccgccgaactctgaggtaccttcaggatctcctccttagtgccgccgccgccgccgcagcgggctgtgctggcgagctttcgccggctgcagttgtgctccgccgacgaccgggcgctccgagcgacgagccttgccacgctctgcatgatttgtttcctggcttcacgggtttgggttcggttgtgaatt

SEQ ID NO: 51848 - DNA, 7632 bp, Oryza sativa
cctccacgcgctttcctttttcgcatctgcgcgcttcctcctgtttccggtttccctttcgcgcttcctccacgcgggccggttgttgggccttgcagtttatattcatgggccttctcccgtttcactttcgcgcgcgattccctttcgggacgcgggccgacggtccaacatcctccgttgggccttccagttttagcccatcaaattacatatttttccctattatctttctgggatgtggtaagtagggataagtatagggtggggagatcaatgaaagtaacttttaaatgataaaaactgtagctttcttcgtcaattatactgattttctgggatgtggtaagtagggataagtatagggtggggagatcgatgaaagtaactttcaaatgataaaaactgtagctttcttcatcaattatactaactttctgggatgtggtacgtagggataagtggagggtggggagatcaatgaaagtaactttcaaatgataaaaattgtagctttcttcgtcaattatactgattttctgggatgtggtaagtagggataagtatagggtggggagatcaattaaagtaactttgaaatgacaaaagctgtagctttcttaatcatttgtactgaattgaaaaaaaaacaatgcaagatataaaaaacatatagttaaagtaaaatgtgacacgctagatttcaggtttgcactatggagttgatcagctcgtcatttttgtatatggcaaattgacaggttgaaaaaatgttgataaaaatagttgaattgcacaataaaaacatgatgcgggaaaaaaagagaacattgtgtttcttttttaaaaaaaaggagattgccaagttgcacttcactagcagaacattaggatcgttgaaaatggcattgaactcaaacctgtgatgagaaaaaaaaataaaattgttacaacttaaatgagagaaaaaagttgggcaaaagcaacatgataagttgtgagatgtagaaatattcaatttaatactactgagttttgtggaaacaaagagccattccagcacatgaatatatgacagttgtgatgtacataaagttgctaaaattgggtcacatgaaatccatgatgaacaaaacataacaaaaaaaaaaaggggaagaaatgacaatgtgcgacttaggcatcgttcgtttaggggtgataggggagattggctctcgttttccgcgcgtacgcttttcaaactactaaacggtgcgttttttgcaaaaaatttctatatgaaagttgctttaaaaaatcatattaatccatttttaaaatttaaaatagttaatactcaattaatcatgagctaatggctcacctcgttttgcgtatcttaccaatctcctcaatccccttctcctcaaacactcccttagtgatccgaaactacactacatagaaaagttcatacatgggaagaacagcctagcagtttaaaacaaatgctacatggatatagcaatctaacagttctagtagtctaaaagtgtaatgacatggaagcatataaaagaagtaatggagcaaaaaaaaaatggtgttaaaaagaggaaataaaaaggaaatctggaacagtaccatttcccttgtgaataaaaattatattgtcacaccctacatatgaaaagaaagagagagaatgtcaaacctaaaagtagtaaccaaaaaaaagttatatataaaaatatagaaagaaaaaagaacttcattttgcaagaactcacatattttttccgatggttctaattttagggttgtgcttttcatgatgatcattagccaccaggaattatgtgagcttctcacggagtgttttagcatcatcctgttttgatgatcttatgttttaaaatatcaaataaatgaatgagtgcattaattagtttgttcatcatgctgctttaaacactttatacttcgaaaatattataaacacaagaaattagcgggggatgaaaacaaagacatgtgtattccaaaaaaaacctatcggacgaatagtaagtttatacacctaaagtttgtgcacctcgggtttacacatctgaagtttatacacctaaagtttgtacacctaaagtttatagacctaaagtttatatacccgatttaaattacaattcggattcaaatatttttttatatagaaactttatacttgtaaactttacactaataaaaaattcaaaatccaaaagtttatagttgcagaaactttatgctaataaccattatgcctatgaactttatacttataaagtttatagttgcagaaactagaaactttatacttacaaacatgctgctttaaacactttatacttcgaaaatattataagcacaagaaattagcgggagatgaaaacaaagacatgtgtattccaaaaaaaaccatatcgggcgaacagtaagtttatacaccttgagtttacacatctgaagtttatacatctaaagtttgtagacctaaagtttataagtcaaaagtttatatacccgattcaaattacaattcggattcaaatattttttatatagaaactttatacttgtaaactttacactaataaaaaattcaacatccaaaagtttataattgcagaaactttatacttacaaacattctgctttaaacactttatacttcgaaacattataaacacaagaaattagcaggggatggaaacaaaacatgttaattaaaaaaaaaacctatcgggcgattagtaagtttatacaccttgcttggtttaattgatccatggtatcggatagaataccagttaaagagaaacagggaaatagactagtaaaatcattatcacaaaaaaaagtataccttcattttgtttattgcagaatctgaagactgttgtacttcaactctgttactttcagattctgccgagctgttatctttgcctgcagagtgctcaccagtggcatccttgcttggaacataatttgaaattgaacaatttgccttgctacagtccgaatcttcacgagaactaataccatgttcctcaaaatcatccatactgcccgagtcacgtaatggaattttttatctgcgcaacagttacatagacaccttgagctcctgaccaactgatttattagaaatcattgatacaagcagatagtggcaaaggaaatcaaaaaggttatgcaaaaaagcgaaacaatggaattcagaaaagcgcaaaaaaaagatactattcatccaggagattttattctgtccaagatgtctgttctctatgtgatgaaggtactctctctaccccttggttttcagacacatgtatgagcatttttggtgacttggtgtactgagaattttttatatgttgtatattatcaaagacatagtagcaaaaacactagatcaaaaaaattgtttatatgtatggactagtcatgttagtcaccatgtcaagcaccccctgctatgtacttaccacgcatcacatatactttaatactttatatttaccagcacacagtttagccaaatcacccattgtcccataaaaaacagagcaaaatcctgaaacttaattgaacatctaatcctataaatatgagagcaaaattagttgatgaggacaccagtcactactagtcacaaaatatgagaatcaactgaaatgtgagtcaaaatcagttgatccaagaatcaactgaaattgaatcagaaaaataaaattcactagcagtcactaccggttcccccaaaaaattatctagaacaaagaaaaatctgcctaagttgattgcttatgagtgctcatgaggtggcaaacatatgcatatccacaataacaaaaaaaaaatagttaagctaacatgaacccacaaaatggcaaatagtgagggcgtatatgacaataagccatgtcagttataactgcatttgtattgatgttactggcctgatagatgggaatggtagactacaaccaaaactaaggcaaaaagattaccatttagtgctagtggccagaaatgccaaaaagtgcagatgggccagtcaatcacaaatatatatgctcatgaaaattttaacaaaaaatcatcaaaacttcgtgactaactacaaccagactgaacttaactcagtataagaggattatgagttgatgactgcaggaatacaaacttagaaatgcagaggtgtataaatctgcagtatataattaaacacaacacaagcggctgctaggttttctcagttctggatggttcgtttatatttaccagcacacagtttagacaaaaagtgcacccattgcactataaaaaacagagcgaaacactgaaactttactgaatatctaatcctacaaatacaagaacaaaatcagttgatgaggacacctagaatcaactgaaaaaatcgagtctaaaacaaaattcaaaaccagcccctatttgtgttctcccaaaaatttgtctagaacaaagcaaatctgtgcacaatcgtttcaggggaaaaaaactaactgcatagggaggaacgcaaaatagtacatttctgacaaaaaaaactcagtacaccaagttaatgcacaaagatgtttttgctcctattaaatcctttgtagttttttctctgaaaatctgactcaagtatgaatgttattagaaagcaacaactatatgatgacacctacaaaatcagattgcagctatccatgcatcatgtgaaagcctcatgataataccaggtcaagcagggcatggagatagaaaaatttctccgtgaataacttgaatcatgctagcaaaatttgctgaaagatggcaaaatatactcaagctggcaaaataacttgagatatgtagtatttcaggagccaaatatgctccaagattgcagctggatattgcactggattgaaaatcacattgcaaaaaatgcagtcatcaattgtgcagcaatatgtagtcaaaaatagcattcatttacagcaatctgcccaaatattctagctatatcaatgcattgattcagcaatatgcagcaatctacccaaattgtccattcactccaggatacacatggaaaatatccagcaatatgcagccacaaatattcccatttgcaatactcctgcttacagtagttcattgcaatactagagcttacaagattcaagcaatggcgttttgggtttagatccatgattttgctagggttagaccctaaccctagcagcgacgggcggcggtgaaggtgtcggcggcggcagcgtcaaccgcggcggcgacggcgtctacagtgtggtgcatgtgtaatccatggtgttttccctttcagtttaacggcatgattttgtgacggagaaacccaaaactccatggatctaaacccaaaaaaccaaggaactaaaacaaaaaatcgccaatcaaatcaagctagctcgagggaacagaaaatcacttccaaaaattaaaccctaactacaataaccgagaaataacaggaggaatcgcttccaaggatgctcgaggagatcaggagacgcaccacgttgcgttggagaaaaatcgtcggagaatcacaagagaaatcgaaatcgccaggagaggaagaagagggtactgttcaaaattgcaacggcatccgcttccgcttctcataagggcgataaaaaaaaaaagccaaaaacgatgccgtgctgcggatgggctctcgtgggccaagcccaataggaaagaggctgagaaagccagaaaaggcaagtggcggacgcacgtgtttggactagaaagaaaagggaaatcgatcgccactcctgtagcccagcgattgatcgcccattaggagtttcggctttgtcccgcgttgtgaggtgtgcgggtgagtggggtcgctcggtctcttgctccgatatatgtacacggatcgggagaattttggtgtcctgctcggattcggagccactaatccgtacgggaaacgaagccgaatcgttcatcgttgtccatcgtattggcgcttccgcctacgtcggcagcggcagaaaacggtcgccgtgtgcaacaactgaatcgaaggcacagcagttgcagttcgtctcagcaactaatcctctccttttcttttcagttttccttttgtttttccccctacaacgctaccgtacatgtttcatttattcccttaaaatttccgatcggcatagttcccagttgatcacaacatcgtcgccttttctttcttcagactttatgagaacatcctaaacagtaaaacagaaaagcagaggctgcagcagatcgagccaggctccgctcaaccgccgacatgcttgataatctagtgctacttaaaatgatcagagtttagtaagcttaatctgtgccccatgctgtggctggagcgtggggattgggaacggtgcgtgcgtgtaggacggagacagcccgaacgagaaccgttgcaggatcatgctcagcgccatcttggcctccagcaacgcgaagttctggccgacacagatccgtggcccccaactgaagggaaccaacgccggtgagtccttggacgccctggagacgccctccgcgaacctctccggcttgaactcgccgacgtcttctccccacacgtctggatcgtggtggatgcccgcgatcggcaacgcgaatgtcacccccggtggatacgtgacccctccgagctcggtctcttcgtatgcctctcggccaagcagcaggatcggtggatacagcctaagaacctcgtgtaatatcatggtcacctgtgacagagaacgggaactaactaaaaacagaacctgaacattttcttcatcttggtatatatgttgcactcacgactttgagatggtttatgccctcgaaatctggactgttctttccgaaaacgcgcagcacctcctccctggcacggtcctgccactcggggtgcatgcttaggaggaccattgtccatgtgagcaacaccgcggttgtatccgatcctgcaaagtagagcagcttcagctcctcgatgatgtccttcgtggtcatggttggcttggagcttccagcttcttggctctccttgatgttggtctccaatagcaatccaagcagatcatcgttaaccgcatggccatccttcatcgcgctctccctcttggtgattatgcctttcagaagctctctgacctcgcgtgcgtttgctttcgtccttctgttgagctctgtaggcagaaaccttcccaataagcaaaaaaaacaataagcaaaaaaatcgcatctcagatgtaatcaagtaatacctaacctctttaattcgggtttaattttgctattagtcaatcacctgtaacctgggaaatacaaagcttttgccatcttcataacgtttcgtgcctgctctgactgcaactggaagatcctcctcccttcactgaagctgctgccgaacgccgaccgggagatgacatcccccgtgagattctggaactccggccagacatcgatctcctgcgcaccatcagctcccacagaatcctgccatctgcttatcagctcgctggaacatgctgcaaacgccggcaacat

SEQ ID NO: 51849 - DNA, 1640 bp, Oryza sativa
caaagccctagaggatgtaaacaaaaaatcggttatggacatgtggttgtgtcgtgtgtgcaggatgggggtgtctcaccttcagcttctcgagatggaaggcgtggttcattatcctccggtgagcgacccatttctcgccttggtggctcgtcagcccatctgccacaaattctggacccaaagaatggacttctgcttcccgaaccgcccgttcttgttcgctaaaatctctcggaaaagtttaggatcactcacgatcactcgcacctccgggccgaaccaagtcacgcaaacattgcctgcattccatgcaacttccgtttgatctctcacgtttgcaggggcgtgtgtgtaagctgctgattaaaaggagagagccagtactacgcaccgtgctgcttgatggcggcgagttcgaacggaagcgctcgcgaggcgacgtcgtgcgacagcggcggcatgggcgcggcgagggcggcggcgaccaaccgcgcgaactccttcaggtagccggacgggaagcggtagtcggtgccgcggaggccctgggaccgcagcgcccggcccagccgccgcgggcggagccagaaccggtcgagagcccgccacgcccaccacagcgccgccaatgcgccgagcgcgtagagcagcaagctccatggatgcaacggcggtgaagcgccatcgacaatctccatggtttcgatctcgtcgtatgtgtgtacatacctgcgtgttgacgtgatatactactaagtagcgtcaacaggaaatgcatggccaagaactatgttcggttgtccatgttcccaacccctcctcctcattttctacacgcatgcttttcaaactgctaaacggtgtgtttttttttgcaaaatgtttatatacgaaagttgtttaagaaatcatagtgatccattttaaaaaaaattagctaaaacttaattaatcgcatgctaaatgctgcttcgttttacgtgtaggggcactcccgaacacagccaaaagagactaagagtgaaacgtaacaaaaggagctttgtcacaagcgtccatggccaggcagatgcggtgatacaagttagctttgatttttctttggttgctgtatgcatgaagtacacaggtgtcgtttgtgtcattgctccaccgctcacatcgtcaaggaaaacaagagaactcttaactttaccgttgatttttctgcatctctatcggaggagttgctttggttggtctcccagtctcccagaccgtcacatcatctaagtcttggcctgggaacgacgccatacgcgactcgaaggctcaaaacaaggcacggctaaggattagatttagaatgcgctctcggcacggtaggagtgttgggttgttggcacattccgaccatggaagcatgatgggccgcacggactaaacatggtccaagaatcaccagcccaaagaaccttgtaccacagtggaattgtgaagttattctggagcaactcattagaacttagcggacatatacatttctctacagacatatagcaacggtgaggtggaagagaagcaggacaatagcaacgatgagcttctagatctgaaatcctcctttctccttccttcaacctcagatcctcctccct

SEQ ID NO: 51850 - DNA, 6374 bp, Oryza sativa
caaccaaacatggctggcctgcacccacgcatgcgggccaggcatggtgcgagcaaccaaacacacccacactagacacaagtacacaacattagttgtcatcttcttaaatgtacataggtccactcttcatgagagcacacgtgactgacacattttgtacaaccatccgagcgaatcaaaagcacttaacaaacatcacaaaaaactaaaataaaaaaaaagttcacaaccgctcctagttcaggtaatttgacttgttctgaacacattgtccatgcaccaattatgctgtacattcagactagaaaaaagatagaccgaccgagcacgcagttctcgtctaggacaggacccaggaggtgtttgtcatcagtttagcctcgtgagcctgacctgcgcgccgtgctccggctgaagcaggccgacggggaacggcgcgtgggtgtaggacggtgagaggtcgaaggagaagcgctgcaggatcatggagaggcccatcttggcctcgagcagcgcgaagttctggccgatgcagatcctcggcccccacccgaacgggaagaaggccggcgcctccctggacgccttggagatcccctccgcaaacctctccggcctgaactcgtcggcgtccgcgccccacacgtccttgtcgtggtgcacgcacagcagcggcagcgtcagcaccacgcccgccgggtacctcaccccgccgagctccatcggcttgtacgtcttcctctgcagcgccgtcagcggcgtgtacagccgcagcacctcgtacaacaccatggtcacctgcaaaacccaaaacccaaaacccaaattagacttttatatctttaatttcgtgaatcatcagttaatcgtgtcgaagtgcttacgattcttaggcggcttagcccgttcgtaatccggggcgcggctgccgaagacgtggaggacctcctcccgggcgcggtcctgccactccgggtgcatggagagcacgaccatcgtccaggtgagcagcaccgacgtggtctccatgccggcgaagtagaacagcttgcactccccgatcacgtcgtcgatcgagatgccggagctcgcggcgccgccgttgcccttgctgtggtccaggttggactccagcaggaggccgaggagatcgtcgtcgctgcttgcctcgccggccttcaaggcgctctctctcttcgcgatgatgcgtttcagcatcccttcgatctccgcagcgatctgcttcatcctccggttggatttggtcggcaggtgtctgcatcgcaaacacgtcagatcattcattttgtcgcgtggaattcattgcactaccgtttgctactatcagcaggaggaaaacatatgaactttgcaggggaaatgggccgaacgagagatgatgaaagtgagaagggagctcacatgtaaccagggatatgtatcttattcatggtggcgacgatgagctcgatctgctcaccctggagctggaaaatcctcttgccttcaaggtagctgctgccgaatgcggcgcgtgagatgacatcccctgtcaggctctgcatctccggccaaacatcaacttcgtacggctcatcacctcctttggctaaaccttcccacttgtccaccagctcggtgcaacatgcagcgaacgctggcaacatgcgctgattattgagaagaaaaaattagtccgaaacaacggcgcctaggcccgatcactgttgccatgtccgtgacagaaatatctctctcaccttgagcttctcgagatggaaggccgggttgatgatcctcctgtgcttggcccatttctcgccctcgtggctgcccaatccgttgtgcagcaacctctggaaacgtccaaacttgagcttctcgaagtggccgaacttgttggacagcacttctcgcaccagctcaggcttggtgatggtcaccctgggcactggcccgaaccaggtgatcgacactttacctgccaacaaatatcacataattacgacaagacttcattttcgctctgaatttgtgattacatggatcccttcattcaaatgtatcatcgctttcacaaatatcgtatgataagttgcagttattttagtttataattcatgattatatatgataattgaacatgcttattcaagaaaaataaaaacgatagttttcactaaaagaaaataaaaagatatttctcacaaaaataaaaaagaaatccttgcaaaaagaaaaaaaataaaatttgtagtaacgactaaaaatagggggaaagggagataaggaagcatatcactcctctatattattgacttaataagagacctcgagtgctcatatattagattgtggaggatagaaaattatgcgaaataatggtgcatcccaaatagccaaatgggcatgttggggttcaaatgatagaaatctattattgacaggtatgcgtgaactccaaggtgccacaagattaaatccatatgtaaatccttggccttaataaatcaactgcagataatctgtcaccatcatgcaggaaatctggtttcatctctacgtgtatacctttacataccatgtggtaggacttctccgtattggaaatgtcgttggactgatttgagagaagtaatatatattcccctgcctcaaaatataagggattttaggtggatatgacttactactgcaacaaatctaaacagaaaaagatttgttggactaaaaagtgtcacatccgttcaaaatcacttatattagggacggagggagtgcacacacacacacacacacacacacacatatatatatatatatatatatatatatatatatatatatatatatatatatatatatatacacacacacacacacacacacacacacacacacacacacacacacacacacacacacacactaggaaagagcccttagatgctaaatggaaattttctgctacactcttttaagtattagcaggttgtatacacaagttcatctctttaagacaggagcccttctacagaatctagtgaagtaagaggctacaataaatcctatattcatgtattttgccactaaaaattaaaaatatgatagatttggcagcctaagctgattcttatggagacatgcatgcaagccactttaatttccaaatatgtaatatgtgaaaccacactcaaatataatccagagcataacaagatttccactgttgcttttatttcaattgcggcgtttagcgtctacatattttagtgttatcaatcagattcaaatgttgtttgagattttacattcaaggtatgaaatataattggcatattgtattttaaatttgtatagagcaatatatgtggcatcattttactaattacgtactccactcaccttattaacagtgttaattctaatggtatattaaaaaaaccatttccttccttattatgaggtcttccctctaacaaggttaataggttatataaccaatggatcaaggtctaaaagctagattagtccataaaaacttggagcgccaaaaaagatccaatagttagcttctggacattcatttgttccagatctgttgtactgtatgaaaacaatgattaattatctcaacagtgcttcaaattttatagcttaaacaggtggagcctgaaactatttgccagtgaggcacgcctttttctttttttaaaaacgaaagcaagagcactaacagatcattgatagtaggaaagtagaaaggtcaagccatttacagttacagagatcaggtgttcggccatgtctcgccctgattaaaatctcaaaaatttatggctatgatcaaacgagagagagagagaggagagtagaacatgtcgtaccgtgctccttcatggcctggtggaacagcggcatcgcgcgcggcacgacgtcgtggcagccgagcggcatggtccgcgccctcgcctcggcgctgagctgcacgttgagcggcgcgtcgcccgccggggagcggtacggcgtgccgcggaggccctgggcacggagcgcccgctccaggcgccgcggcctccaccacgcccactccatcgcccgcacggcgcaccacgcgagcaccgcgcccgcgaccgccgcccacacaagcatcagcggccgctcgtcacctgcggcgaagacgaccatccccatcgatcgtcccactcgctagcttatcgcagcagctaccctcgctcgcagagcagcttacttcccgcaacagctataacaaggagtgcagcagtgcgcagcagaaagagaaggggggaattgatcggtggtatgctcacgaccggttgtctgctactctgcctctcggctcaccaccccgctgttatatatatatatataaatcctatgtacaaacacggcgcgtgcgtggtttgttccccggcccgtattattgtttattctgcctttggaacatatgctccggattgctacttccgcgacggttctacagtctatggctggcatgcatgtcgttcactggggaaacttggaaatgtggagcggtacggaaaggggaaaaaaaagaagaagcgaaaataagacttgtgttaattcgctgaccatcgatgttggtcgttgcatacacatctccgtccaattgggggtcaaatgatttaatttgtagcagctccctgggtctcgaagatcacacacacggtcagaagtcaaaggccagaacatgcccgcgaaccgtttcccctcgcccggtcttctcagaacggacgcccttttagattatgttgatatacatgttgtttctaaagtatattaataaagagattagcaaggagtcattggtaccgtaagacaccaatattgcattacatatggtggatccgctccaagcgatatgggtgcataatgatgattcggcagcctggtggggaagcccttatcttaacgagatactagccttttctttttttctaaaggactcattaacgagctactagctctccccgtaaaagctttatttttagctataaacttataaaaaaaacttgtctagatgcataagtataaataaaagtcttttccgagcaaacatagaaggtttttataaggactcattaacaactcaagtcgatttggcttattcatactaacaagttataaaacccacactctgctcgacgagttggcacgcttagctatttagcttgcttcaaaatatgtgtccaagaatagagcaaagatgtgatctctgagcgttagaagtggtcggatggtggataacagcatcaggtgacgctcatttcaaaagttatcaacaaagataatataatgcaattatgcaaatgaaaatgtcaagctctaggagccattccagccaaaaggttcgggagaatgggatgccaactaaaacatcaccagttggtagatctatgtatctaaatgtaacgtcccgcctcccccaggccgggcccacttacatctgatagctttcataggtcatagactgccctcacagaccaacacatgtcttcacgtccatgtgtccagtgccagttgcgctgtgtaaccactacactttgtcctcactcgtgtgcacccgggaagaatttcccggtcggtcacccatcccaaattgctctaggccaagcacgcttaaccctagagttctttggagattggcttccggaaaagaagttgcaacttgttgatatgagtattctattaatcctattaagccctaagccgggatattacactaaacctttcaatatgaaataaccacataagttcttacaaaaaaaggaggaagtcgacctgtggccacaataagggagaaggtgtggcatagctactgacggagcgtggggctcctcaccgggaggccgcgcaggcccccctttgccggttcggccggggccgctaggtgaggttctttgccctcgatctgtggaatattcacgagagagcaaatgcacaagacacgggcgatgtagacaggttcgggccgctgagaagcgtaataccctactcctgtgttctagtggatctgtgtgtgaaggaactacagaaagttggagagctaaagagttcaggtattctcagtgtcgcctgagagttcccctccttcggtgggcaaggtcctccttttatatctcaaggggataccacatgcaccacttctacctacttttcttttgggtggggacccaccctatcttgaccaaaacttggctcgcgccttcgcctggaagctaaatcacagcttgtccttgagtgaggcccagcgtcatcactcgcctgacacaggggatctccctgtcattccttcataaatgggtgaagaattgcaatggctgttgccc

SEQ ID NO: 51851 - DNA, 5207 bp, Oryza sativa
cgacccctcggggagacagagggaggggtggccacgtcaccctcgggcccgacccccccgagggggtcaggccatgtgggtgaccgcggctacccaagcctctagtcacgataccctcggccccatgtcaccgacagtagcccccggcgttacgccagggcgattgcccccttcgagggaagcgctcgggcgtgacgccactccttaggcccggtgacaggtggggccggtccctacaggcgggcagaaacccagcggtcgcaaatcgcgcgcatcggcaagggaaaaccgactgacaataatgagtggcctcttcgagaccgctacattactcgagcagcgcgcgaatcgggacgagccggttcatttcgcctgtagacatgatgatggcgcttttctcggtcggcgagcgtatttaacgcgcgctcgatctgtcccatctcaaccgccacggccgcacatctgccgcgcgcgccgcaaacgggcaagtggggttagtggaggcgcgggcgcaagaaacgagggggcgaggtagtgggcgcgggaaacgaggagccgggaatagcgttggcaagggtataaagacgccgaggaagagattcgtttccttcctctcgccattcttccccttgccttcgccacttgagctctaactcttcgtttcctgcgccctacccttgccgcactcactcgctctcaagctcctcctccgccggcgtcatggcacggggctccgctccgctcgacggtagcgtgctgccgccttcccgcatcgtgagcgagaggcaggccgggctgccgcgccgattcatgccggaatctgccaccggcgggaggtggttgcgcggggcgagggacgcccggcgccacactacccggggcggtccgtcttcttcctttctttcgcaatggcagggctggtcccgccattctctaatttcttcatggatattctggagttttatgatctccagatggcgcacctcacgcccaacgcggtaatgacgttggccatcttcgcgcatctgtgcgagatgttcatcggggtgcgcccatctctccggctgttccgatggttgttcaccgtacagccggtatcgccgccgtcggtagtcggtggctgctacttccagccgcgggggcaggtgctgcaccgctacattccctgcgtcctccataagaagtgggacgactggaagagcgattggttctacacccccctcaccgacgaagcgagcctccgacttccgagccagcccccagcacaggcctccagctggcgggcgacggtagatctgggagacgactacgacgccgttcttgaccgcctggcgggtctgcgatcccagggactcacgggggccatggtgttcggcgactacgttcgtcgccggatcgcgccgctccaacggcgcgcccggggcgcctgggagtacaccgggcccgaggactccatgaggacccaccaggggtgcacatgggactgggaccctgaggacttcaggatggtggtccaacgggtgctgaatctcagctccgtggaggcatccctcatcccccaaggtgttctccccctctgcagcgatccagatcgcgccaacatcctgaccatcatgcaggcggtcggggcgtcgggggagcgggccctccgaggccacgatggcgcgggcgggagccgcagaggggaacaatctaccccgggagggggtcgtgcttctgggccctgcgacgggggcccggggggcagccgccctgccgacgcccgggggaagaggaagcaggagggtaccccttccccatctcctccccgagggggcggggcggtgcgtgccagcagcaggcgcccggagggtgccgtgccgacatcgcagcccgagggggagcggaagaagaaacggctccgcaagatgggggggaccgagccatgtcgggggaacctcatctcgcccccgaggtggtcgtttagccgacctcctcgcaggttcgtctccgcgcccatcgcggccgtattcattcccccatctcccaaggcgagttttcactcacccgtttctttttgtcttctggtttttcttctgcctcagcgagatcccgtcgcgccccctccgccattccaagtccggccggtccgaggccgaggagacagcgaccgcgaaggcccggagacgggaagctgaccggcgagaagccgcggaccgcctccgggaagccgaggaagccgcccaggaggccgtccgggttcgccaggctgaggaagccgctcgggaggaggccagactccgccgggccgaggagtccgtccgggaggcggaggcagggcacgcacgccaggcggcctgccaagcccccgacctgactccgcccgaggcgacgacgacttccgaggccacccacgacgaggccgcgggcgcaccgctcgggcccgaccccttgggtgacgctcaggacgagccagcttcgggggacgcccccgagtccggcacgtcgatcagcgggccgagccgcgcggcaccctcaccgaggcggctctctcctctgccttccgctgccccaccgagcgcggagcccctcttgcaggccttggccgccgcgaacaccacggtgttggacgggttaagcgcccagatggaggtcctgcaggcagagcgggcggagctcgacgcggcgtgggcgcgcgtcgaagaggggcggcgctcggtggaggccatggtggaggcgggccgcaaggcacaccgctggcacacctcagagctcgaggcccatcgtagggacctggcggagatcgccagggaggtggaggaggagcgggagactgccctcatcgccaccgccgtgttcaacgcggcgcgggacgacctccgcctccaatacgggagccgggcggcggagctagagaagaagctcgacgccgcccggggaatccttgatgctgccgctgcccgggaacggcgggcggcggagatcgaggcggcgtcccggcagcgtgaagaggcccttgaggctcgcgccacggtgctggaggagcgcgcccgcgcgaaggagagggacctggcggaccgcgaggccgccgtcgccgtccaggaggcaacactggcggcgcacgaggccgcctgcgctgaagaggagtccgcactccgcctccgcgaggacgcgctcaccgagcgggaacgagctctcgaggaggccgaggccgcggcgcagcggctggcggacagcctgttcctccgcgaggcagcgcgggaggagcaggcgtgccgcaatctggaaggcgcccgcgccgagagggccgcactggatcagcgggccgctgagcttgaggcgcgggtgaaggagctggacgcgagagcgcatagcggcggggcggccgcgggcaacggcgacctagccgcccgtctcgcagccgccgaacacaccatcgccgagctgcagggcgcgctggactcgtccgccggggaggtcgaggccctccgcttggcgggcgaggtagggcccggcatgcttcgggacgccgtctcccgtctagaccgcgccgggcggtaggcgggcctctggggtgggcggaccgcgaagtacgccgccaaccaggggggcctcgcccagcgcctctcagagatggccgggaccctccagcggctccccgaggagctcgaggagacgatcaagtcatcctcgagggacctcgcccggggggcggtggagctcgtactggccagctacaaggccagggaccctgacttctctccgtgggcagcgctggacgagttccctcccggaaccgaggacggcgcgcgcgcgcaggttcgggacgccgccaaccacatcgtccacaacttcgagggtacagcccctcggctcgcgttcgccctcgactccgacgaggagggcggtgacggtggtgcggacgacagcgaggacgaggccggcgacccgggcgcgtcggagtgagcccccaggcccccgccaatcttaaatagcttttccttcttcttccgaggccttcgggcccccttcttgtatagactgatttaatctgtaatcaaataaaaaggaaatttctatgttaattctatttgttgtgtgtatgagacggggatggtctgtgccgcggtccttctgtgtcttggcttgaacaagggctcgtgcccaggtcccagcctcaaacggcgcgggtcggggctagtgcctggggagatccacgtgtcgagactggccaggccgggagcgtggtgaccgagggttatggatgacccgattgtgggcctttgccgattcccccccggagttcaccacgccccggggcacggctcggttctgggccccttttgtcgattttagccggcccgggccaccgagggcaggatcgagcacgagcgtgctaattcaagccaagattcttcaaaaggaaacaatggcacagacacagtccttaggaaatcgaaaatgcttttattgaaatacgtaagataaaaaagataagtatatgcatgtggtagcccccggccaaccctgcacgcccggggggggggtgcggggttggcccgagcccgagacctgacacccgacccccattaggggtagaagcgacgaaggtgttcgatgttccacgggttaggcagctctgtgccgtcgcccgtggccagccgaacggagcccggccgggggacaccgatcactcgatacagaccctcccacattagtgagagcttgctcagtccagcacgtgtttggacacggcgtaggacgaggtcgtcgacgcagagtgatcgggcccggacgtggcgctgatggtagcgccacaggctctgctggtagcgtgcggctcggagggccgcgcgcctccttcgctcttccaagtagtcgaggtcatctctgcgaagctgatcttgatcagcctcgcagtacatggtggcccgaggggacctcagggtgagctcagatgggaggaccgcctccgcgccgtagacgaggaagaaaggcgtttccccgattgctcggcttggcgtggttcagttcgcccagagcaccgctggcagctcctcgatccacgagtcgccgtgcttcttgaggatgttgaaggtcttggttttaaggcccttgaggatttccgcgttggcgcgctccacttagccattgcttctggggtgggcgggggaggcgaagcagagcttgatgcccatgtcttcgcagtagtcaccgaagagctcact

SEQ ID NO: 51852 - DNA, 11869 bp, Oryza sativa
tgcaaggtacgcctggatctcagcgatccaagcaatcaatctaagggagctgggaacgcttccctcgggtcccaaggcctggactccgacgggcctcgggggccgttcaggcgcgtccgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacctggcgcacgtaagcgtccatctgcgggtcagagcaccggtactccttacagacctggttaacgaccagctgggagtcgcctaataccaggaggcggcggatccccagtccagctgccaccctgagtcccgcaaggagtccctcgtactccgccatattattggtcgcccgaaagtcgaggcgaaccaggtatctgaggacgtctccgctcggcgaggtcaacgtgacccccgcaccggcgccctgaagagacagggagccgtcgaactgcatcacccagtaggcggtgtgaggcagctccgaggggcccgagctggcctcggggacggagacgggctcgggagctggggtccactctgccacaaagtcggcgagggcctggctcttgatcgcgtggcgtggttcaaagtgcaaatcgaattcagagagttcgattgcccatttcaccacccgtccagtaccctctcggttatgcaagatttggccgagggggtaagacgtaaccaccgtgacccgatgcgcctggaaataatagcgcaatttcctcgaggccatcagaatagcgtaaagcatcttctgggcctgagggtatcgggtcttggcgtcccggagggcctcgctaacaaagtagacgggccgctgcacctttcggcggggccgatcctcttcgctaggggccgcatctccagggcgctcttcgtccgagaggccgcgcggggcgcactcggcttctatgccgacgacctcggggtcagagggcgacaggcgcggccttcccgcagtggccccgaggccatcctgggggtcgagggcgcctggcaccgtcggacaagcgggcggagggccagctccggccgtcgggggcctcgggccaccgttcggctcgggggcctcttctccctgctctctcccgggtcgagtcgacacagggtggggatgcgcggagtgagggctgtcctcgtcgcgctccacgaccaatgccgcgctgaccacctgcggggttgccgccaggtagagtagcaacggctcatctggctccggggcgactaggaccgggggagaactgaggtacgccttcaactgagtgagggcccgctcagcctcctccgtccaggtaaacggcccgaagcgtttgaggagcttaaataggggtagcgccttctctcccagcctcgatatgaaccgacttagggcggccatgcagccggtgacgcattgcacatccctaagcttgctggggggcgcatccgctctatagctcgtatcttctcggggttggcctcgatgcctcgggcagagaccaagaacccgagaagcttgcccgcaggcacgccgaacacgcacttgtcggggttcagctttatgcgagcggagcggagactttcgaaagtttccgctagatccgagagtaaggtctcttggttgcgcgtcttcacaaccaagtcatcaacataggcctcaacattacgtcctatttggctacccaaagaaattcgagtagtacgttgaaaagtaggacctgcattctttaacccgaaaggcattgtcgtataacaataagttcctatgggggtaataaatgcagttttttcctcatcctccctagccatgcgaatctgatgataaccagagtatgcatctagaaaacacaaaaggtcgcaccccgcggtggagtcgacaatctgatctatgcgaggcagggggtaagggtccttaggacatgccttgttaaggtcggtgtagtcgatgcacatccgaagcttgccgttcgccttgggaacgacgaccgggttcgccagccactccggatggatgacctctcggatgaatccggcctccagaagtcgcgccacctcctcgcggatgaaggcttgacgttccagggcctgccgccgcactttctgccggactggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgacgcccagggcaacctccttgaccgggacctcgtcgcacgtgatcatccgctgcctcggggcggctgggacggaggtgctgagcctctcgtcgccacccgcgggcttggacgccgcggcgaggtggtccgcgcgctgctccatacaagcaagcgtgactttgaggtcgccatggatggtgatggggccaccggggcccggcatcttcatctggagataggcgtagtggaccgccgccatgaacttcaccaacgcgggcctccccaggaccacgttgtagggcagactgaggtccgccacatcgaagttcacccgctccgtgcggaagttggcggaaccatcgaaggtgaccgggaggtcgatatgacctagtggccaagtgtgccccggcgtcacaccgatgatcggctgggacggccggagcaccatccccggggccttgatgtcgtcaaaggctgcgggggaaaggatgttgagggctgcacccccgtctatgaggacacgccccaacttcacattgcaaacggtgggggaaaccaccatcgcgatctgtcccccccgggcaacgcacggcgggtgatcggtctggtcgaaggtgagggcaacctccgaccaccgcgcccgccgcgtcgcctcatgggtaggggccgcggccaaaagctctcgcttcatggccttgaggctccagcgagaagcgtgagcgcacgctcccccatcgacggtggcgatggtggcctcaggctcctggaaccccaggccatcgtcgccatcgtcgatgtcctcggcgggggccttctgcttggcctcacttcgccggttgccggcgggagccgccggggccttgccctcacggcgctcctacctcctctcctcccacttccttgtccgctcagccaaacttttgaccgcgcggcagtccgcgaggtcgtggagggaggtgttgtgcacggaacaccacttgccagtcgggcgctccctgctgggagcgccggcctccttctttttgtcgctcgcaggcctcccctttcgggtggcccgcgaagcgccctcgaccgcgaggacatgaccctcgtcgtcggaatgggccgacctcttcttcctcctcctgtcccgccgccctgaccgagcggcggacccgggggcggccgaagctgccacaccggaaccggaggagttccaggtccaggcctcctccttgcgagccacacggtccgcgagctgaaaaagctccgcggtggtctggggctccttggaggcgatcttctcgagcatgcggttgtgccgcacgccccccctgaacgcgtagatcaccgcgtgtgcggggatgcatggtatggtgttgcggacttgacagaaccgctgaatgtacgagcgaagagactcatcgtcccttcgctgtaccgcatgcaagtccgcttcttcacctgggcgcggatatgtgccctggaagttcatggtgaactgctggcacaaatcctcccaagagtggaccgacgcgggtggcaagttcattagccaaccccgcgcctgacctttcagggccatggggaagaaattcgccatgaccctgtcgtcacccccggcggcctcgatcccggtcgtgtagatctggagaaactcggcggggttgacgcttccgtcgtatttttcggtgatggtgggccggaaccttgggggccaacggacgttccgaaggctcgccacaaatgctcgacagccggcaccgccaaccggggacacggggggctggcccccgtgcccggaccaaagtggcgctccggacgaggaagcgccctctgttgcgtgggcagcacgacgaccattgcgccggcgctcgacattgaggcgggcatccggccccccacgcacgtcttcttgggttggaggcgttgacgagggaatggcggacgaacggcgggtaacggccgctgctcgccgcgctctccgcctcgacgatgcggagccggtggtagcagcgccagaggccttggtgacggaggaccgcctgccggcgcctaggcgctgctgtgctgtcatgaccaagtcggccacatcatccagccaacgtcgggctggagtctctggatcggggacgacgggcgggtgacgcaggaacgcgcccgcagcctggagcgcgccctggggcgtgctgccatcgccatagacgaggaggcgacgctccccgtctcgccgtccttctccatcgcccgcaagcggcgaagtcgcggatctttcgaccctctcgagcgcctcctcccgctcaagacttcggcgagagggggacggtggagtacgagcccgacggcgcgggttctgctccccgtcgtcaccgctagcactcggagagaggttatgcgccatcgcccgttcggccattgggctgagcgggtgaagcttggcgcacacgaaagaggacgagggcttagaaagacacacgcgccccctacctggcgcgccagatgatggagcgtggggctcctcaccgggaggccgcgcaggcccccctttgccggttcggccgggggcgctaggtgaggttctttaccctcgatctgtggaatgttcgcgagagagcaaatgcacaagacacgggcgatgtagacaggttcgggccgctgagaagcataataccctactcctgtgttctagtggatctgtgtgtgaaggaactacagaaagttggagagctaaagagttcaggtattctcagtgtcgcctgagagttcccctccttcggtgggcaaggtcctccttttatatctcaaggggataccacatgcaccacttctacctactcttcttttgggtggggacccaccctatcttgaccaaaacttggctcgcgccttcgcctggaagctaaatcacagcttgtccttgagtgaggcccagcgtcatcactcgcctgacacaggggatctccctgtcattccttcattaatgggtgaagatttgcaatggctgctgtccgaatgaccctccgatgggatgggtcatatctacctccactccgccggaagcagatgcaacgtgggagctcggttgtctgccgatgacgtgaccggcgtcagaccagtcacagaccggtcattcttgtccaccacgtgtcagtttagcacgccgcacgtctgcccttcttcatacaatgacttccttgcaatggttgcgatgaagcctggaatgtatctggccgggactgacgtgccaactccaggagttaacacgccggctccggctagggacgagagcatggaggctctcatcatttcgacgggacggggcgaggcgtgtgacaggccgcctgttgccacctaacccgcgatctgaccggtctgtgaccggtcacacactgcgaccggtcacgaaccggataagcgtgcgctgcgctgcatcaaatgcgtcgtggcgcgctcgtctaaaccgcaataaatgcggttaggtgagccccgctgtgctcacctaacctacacacgtggcgccaaaatcacagggggtcggggcgccccagccctcggggccgaaatgggagcggcccgacccctcggggagacagagggaggggtggccacgtcaccctcgggcccgacccccccgagggggtcaggccatgtgggtgaccgcggctacccaagcctctagtcacgataccctcggccccatgtcaccgacagctaccatcaagatggcaattatattgcacatgcagatatgtcatttgaattgcgcagacattataaaaactagttgagcggcccgcgcatttgcgtggctagcattaatttaaaattatctatttttaccacatgattttatttaaattatcattaccgtgattctaataattttatagtttttaaaagcaacgtcagtcgctacccttactcctttgtcacctttttatttgcttacttgatctaccattacttatatttattctctttagaaatttaaaaattagaccttatagtttttagatttcattgccttagtgggtttcgttttcataatttttagaagtattgtcaaacatgccaatttattattctacggcccatctgctgccacatctttttattgtcattgggattttaaaaatcgaacataattattgtttgtgttctttttttactttctataagtcttgtcaatcgttagtggcttcaccactatactcttctacagccagcccgctgcctccctccttggtgtcattggaattttaaaaatcaaacataattaccattggggtttatttttactctccataagtcccgcaaaccgttgtgactatgctgcttaacggtatggccatcgccactccttttaatcatcattgggattctattggggttttgtttatagttttcagatatcccatcaaccaccagcactctactcctttataggcctactgcttctcccctctttattatcatttgtcatcgctgtgttttagatggaattttttttttgaaaattgcatatttttcattccgataatttttattcataaattatattgagtaaattacacccatggtacaacaacttggcaggtgtgtgcgatatagtgaaaaacttgagaattgaacgtccgagtacaacaacttgacaagtaggtgcattctagtaaaaaaaacatgaaaaatactgataatttagtattttggtgcatcaacttggctaagcatatgctaggtgggttttgttcacgatgtcaatatgccattatagtattcctacggatattaccttatagtattgaatttaatctttaagaattatactacacttacaatttacatctaattacctttaatttttttttgttttcttcaccttctcaaatatcaaccgaaatataataatttctacatctagttttattgactttcagttattaattattaggatacaaatataaatatgcttatacaaatccacgctagtatattttcaaaataaatacttaaaaaatgaaattatataaaaaaaatgctccaaataattaagttgtcacataaatttttaatttagtgtatgaaaattgtgcctatcttgcaagttgttgtatttatacgatcactcttatactaaattacacattcttaccaagttgttctattataacgctcatttctgaagttattgtaccaaattgcactcacctaccaagttgttgcaccgtgggtgcaatttactcaattattatattcctacttgaactcttataattatttttatatttctaaaacttattttatgtgttatttaaaactttaattaatctcgttatgtgttctacattgtcccatatttcaatagtctttattttttattacacattttagttattaataaattttattctagttgagctgttatttgtatttgtctattttctgaatatattttattttttatttcgagttttaattagtctcgtattgtgttatatatcgactattttttaatatatttttttttcaaatttcaatttttcaaaattatactcctacttgaactacattttttattttttatgattttggattttatttgattttttgttttgaattttaattaatatcatactggtttcttatatggactcttctttcaatattgcttattttaaatttcgaattttagttattttcaaattgtattcctatgtgaacttttcttttatttctattctagttgtggattttattttatttttattctgaattttaattaatctcatattggcttcttatatgtactcttctatcaatatttcttgtttttaattccgaatttcagttacattcctataatagatagatagatttcattgtggtattgaaaatggtaaacgctaatttggttagttagtgtcacgccccgaactagtaccgaccggaactagcccgtgacgctccaaattaacctgttaatcgatactagtcccaggaaacagtgctggtatcacaggaagacagattatcacagcaacagaggtctctttattatagagtagaggtacagtcatattgggctacggacagaccccgagctcacaactgcattacaaaaggaaagcggaagccaggactaggaccaaacatcacaggcgcgacttgggaactaggccgaaaccctaaaactcatcgtaaccggcttgctcctggaagaactcctcatcagcgggatctgcttcgtcttcttcagcaactggggggggattatttatatagagcaagggtgagtacgggagtactcagcaagccatgggaaattaagtgtttaatgcaggcttcaaggagaggctgttgtttttgcagttgattttatttgaattcttttctaaaaacaactaagtgagtgcttctcaaacgacacggatgagacagtgcgtctcgtccggtcggagtatgtgcaatgtatcagtctttagaattgaatcaaggttggcacccggccaacagcttttcaaacggccacctgggccaacaactttcaaacggccacccgggcctagctgattccatcagctacatatttttcaaacatcgaacccctttccacaacagcaatttcataagcagtagtcaaacaaaactacgctaggaatcacctcacatccgcccatgactgtgggcacggctgttcgaacaatttgttaacctctgtagagggggtacactttacccacacgacattactaacccggatcacctagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccctgacaccaccccggcgaatccacatgtctctcggcatcaaggctcccctgataagctagttactcagccaggggtgttccattccacccatgtggtcgtacttgtcttatgtttggatgaaattccaaggaaacggtccttaagtgcaagagcgggaaaccgtacacccgatacgttccccggtccgctgttttggaaattcatttagttcgcaagcaccgacccaggtgtcgggttttccaagtctttcgtaaaacccaagttttacccaagaagttttttagattttaagtttgaaggcgtccgtcgatactcgcacagggtgcacgaatatcaagacgcaactagatggttacaaggggacacgatataacaattatcaaaggaaggatcaaatgcaacaaattaggtaggtccgccaatctgccttgcaggcgagacaacagattaagtgcgatcctatcaatgcataatatttttaaaaaaacataattaatttcaaatataggctcaagatgttcaaaggtggcttgccttgctcgagatctggagcttgatcctcgaaatcctcgcactgcgggtcttcgggctccgaaactacacgcgaaacgggagaactcaacaaacggcgaaaataaagccctattaatgacctctaagcatgccattagatagatctcgagatttgaggaattttggaagttgaacggagtcaaacggatttacggttgggaagatattgaatttctaagattattgaatttttggtctaaaggaaaaggatttcattaaatcctttttgaaaaagaaaagaaaagaaaagagggagggaaaatagacttttcctcgggcggctagtgcgcggcccgagagaaacggagcggttcggccggcccaaggcggcccaagcgcgcgcgcgggagggaggagagagagagccggtggaccgggctcaccacgcgtggtcccgggtgggacccgcttgtcggtgacacggttcaccgtgcggagcgagcacgcggcgcacgcgcgtgggcggggaagggatgcggtgcactcgcgtggttcgcggaggaacggatgcggcgggcccacgcgcagcctcacggctcgcggtggaacgcgcgcacgggaggggctgaccggggtcggcccgacccgatctcggccgagctggcgccgacgtggcgcctacgtggctgccacgcgggctggcgggaggaagacgaaggcgtcggccacgaatggacggcgggcggcggcggcttctccggggcgccttgcgacgatgaggggcgacggggcgtacaccgggatgacgagggagaatgagagggagcgagccaacggcttggattcgccggagggtgtccgtcggcggcggattgcggcggcagcacccggcggagagaaaagggggaaacggcgacgaggtcacgagggaccgattcccggcggcgagagcatctacgcggctacgggaatccgttgctagcgtcggattgggcggagctacgccgagcgaggctggcgacgagcgggtgctacggagctcgggcggcgacggcggcgagcacatggcgagcggcgacaacggtcggggcggcgccggctagctacggggaggctactcgtgctaccaccgaaaactaagggggggagatggagcgaggaggaagaacggagggaggcactaccgagatgaggtggggcgctgtgacgagaggccgacggcgcgggagtaatctctccggccttgggccggggaagaggaggaagacgagcgcccgtagtccccttccgcgtccacgaacgcaccggctctcccggcgcttggcgatgaacggcggaggcgagacagagctcggaaagcagcggcaacgatggagtggaggcgaatgggagaggaagggaaagggggaggcttgggttttaagggcggcaatgtcggtttggaaaccgactttgggcggtcaaggcgcgagctggcgctcggcgctcgcgtccaatcggcgacagggcggagggaggatgatgccggcgggaggaaaaagggaaaaggagggagagaaagggggctcgcccctttcttctttggaaaaaggaggaggggagcgggggcgtcgcggcagagggaggagggctctgcctccgtcccttggcgacttgagcgcggagtggcggggccgaggcgatgacgacggcgatgacggcggggcggtgtggagcggagcggcgacacgggcgacaggcgcgggcaggcgctgacgacggcggcgaccaggcggtcggccactcggcacgcgcgcgcggcttgcaacgggaggcgcggcagattgagtggcgcggctcgggcacgcgcgctggctgcggggccgagcggctgcaggcgcggcagagcagcggggccgggcggcgcagacgcgacgcgtgcgacgaccacgcgagcgcgcgcacgaacgacgcgcggggagcggcagcgagggagcgaagaggagggctcggctcggtgcgggcggctcatgcgcacgcacgcgcagcgcgcgggcggagcggaggggggagagggagagagagagcgcgccgggggaggggaggagaggggga

SEQ ID NO: 51853 - DNA, 5798 bp, Oryza sativa
ttccaagtccaagtccagttcagcattaagagacatcactgacttcaaacggacctagcgtcttcatgccaactctgatttgggtgatcttggacttcatggaaagattatctcgccacctttcaaatacatttggtctcatatccaaattcattccgagtcaacaggaatcatcaaaacaagacagtgttgttcctgaaaccgaatttgggccttgggctttgtaatagactaggcctatctcggaaatgtctccctccacctccacgaattaacactaaaccctagatctattttcctctttaaatgtctatgtacaccctctagaacaattgggttttgtttagttgaattttgccaagtgtcattcaccttgtctctaatcctcgctcgattagtcggtgactatagattcagagcccccaatagatggtgtgttgatttgccaggttgattagatctaccacttcaatcggaactattcatttgtacttaattacctattcgcattatttagattgcatcttatcttgttcttgcagtgttctctcgtttgcattgcagggatcatcaaccgcatgtcacggttggtacgacatcatttgtgctgtagcgattacacgacgtcctgggcttgttccggtaggtagccacatcgtaaacgtcgcactctatctaagcgagagttatcatctcaccagaagatcgagccacaagagagagtgtcatcatgtttaggtcctctttgaaataaacaaaaacatagtaattccaaaggatctataccctatgggaaataatcctatgaagccctttgaaatgatggatgatttctattaatttttctgaaattcctatggaatagagtattctataggaattatagagaaaaaaataagcatgggtcttacctcatgttttcttcttctcgtgtttacgtagggatggcaatttcccacatggggccggggacccgcaggggacctgcccctacgggggcgggggcgggggcgggtgtggattttaacccgcggggagtcaggtccggggccccggtcatgagcgggggcggggacgggtgaggacatccacccgcgggtccccggaggatgtatattggactatgaaatagtagcatattacgagcccaaaagacccatcaagtctaaccctaattcctcatctattcccttccctaaccttatcctcatttcccttcccaccccacctagccgtcacgcggatagcggaagacggcagcggcaccagccacacgcgggcagcgagccggtgacggcggccccgcgcgggcggcgacggcggccacgcgtggacagcggaagcagcagccatgcgcgggcggcgtcggcggcctcttgcgggcggcggcgtcgacgaccaggggcgcagccatctgcgtcggcgtcagcgacgcatccgcgacggcgacggcaagggctagcatcgcatccacggcggcggcggcggctagggagggcacatccgtggtggcggcggccagggaggcgcatccgcggcggtggcggcagtgacgcccagtccctagccacctgtctgtagctgtccctcgtcggcgtcgccgctgctatgcggctcctctcttgtcagtactcaatcgtcagtcgttagccgggtggtgtgggccccgctcacccatgggtcccctgcgggggcggggacgggtgatggttttcacccgaccatctctgcggggccggggtgtcgaagcccgaaactaatcaatgaattaatgtatcaatccctggatcagtaaatattgatacatacaatatacctggtttttcattgcatatgttaaagttttacaatactaagggttttacaataataggtactcatctaattgagtaactagaattaatacacagcggaagtttctatacattctgactagggaggtataacctttagaggttttctaaattatgggggtcatcgtagtaatagttataagggtcctcctcttgaccgaaatctgaaaaggggttataagagcaaggatgagtatttacaatgctcagcaagttatcatggaaatatgttatgcattagcatataggagggttctttgcaaaaagcaataataaacaatctggaagaattatatcaagaattcataaatatatagactttaaatttctaaccagggtaccatatgagtcccggtactcaactccatgagtacggctattcgaatagtttcaagatattttattgcagcagatgtacgctttacccgcagtccacgacttgctgataatcgtcggctttagtcatggcctagtattaagtcattaacaattgtggcacctgttccatgaacttatatccttatatgctctgaacgtattgttaacagcagcaagaggagttctggcgttccagagatatttaaggggaactgatcgtatgacaccacgtcatctcgatcagggtttagaaatataccatatagtttatactcgagtatcacaaaccatttacctgtacatggtaatggttaaagttgcccttcgcggctatagttgcctcttgcgcgaggacttaaaaataagaaccactatacagaggtgccatattgctaattaacataataactaggtttgtccccattctagaaactgcggtcgtacctgttcgttcgacataagtacctggtaaaacttatatcgatcgagacagtactagccacccggaaatcatccaaatcttacgtactgtgccaatctaagtataaggtattttaaccagattgtaagcaaagtaggcaatactaaaattatctgggtttctatgattgatttatgcatataaaatagaatattgaatagaaggctataaataaataatttgtaaaatataggtctaaatgatcaaaagttatatggtaacttgccttgctcgatgtcctgagattcattgatattatctattgagtcagaagaatcctcaagacctagggttagacatataaaaattcaaatttaaaagaaattcaaataaaatccaaaaataagaaaaatggagaaaatgaaataaaatgcaaaaatagaaaaaaggggctcaaaagatagagaatgattttagaagaatattcgtccaaatttcactggaattggatctatattttaaaagatatgggcttctaaagttttgaaaatcaaataaatgtgaaatagcactgtgtgcggatcccacctgtcagtctctctctctctctcttctcttcttctacctccggccattccccaaatcgggcgatggagggggaaagtggttgcggccgaggaggggagggagctagggttctccggcgacggcgagcggcggcggaggggttaatttggtttgtggttgagctaacggctaggacggcagtggcatagttaagccgtgaaggtgatcggggtgatgtgagtgagacatggctaggggagggctcctagagcatctacgaggtacttagatggattccagcagcttgccgatctttggcaaggtacggagaatacttgctgacgagcgcctccattggcagcggtcgtgctcacgtcggcagcccagagggcgacatgatagtgcaaagtgatgctaaaatagaatctagggagtatgtagatggttaaaacggaagaactcaccgagatcggttgaaacggaggattgcggccggaaaaacttctcgggggcgaagaacagagcagtgcgagggcggcggtgcttggcttggcgcggcgaggtaaaactcgacgcagggcttgggttagggtctaatatactataacatagttgatataaggtgttctaaggggtatttagggcggaagatggatggagggatgtggagtcgatcgcgcacaaggtgttcgaccgacgggcgattggtgaatcaaagcttcggggttgtggggctatggttgttgatgatcgatgatggacaaggaagggattggggtcctatttatagggctaggaggaacggatgagctcggacaccgtcatcgccatggatgagctcaaggattggatatggctggggcggcagaggctgtgagaggacgggcaagatcaatttgagtggcgggaggccacgtttgaatacttaccagcgaaggattggcttgaccgcgtgcgaaatcggctggcgacgtgttggcgccaatccgggcgcgatgcgcagtggcggcgagggtgaaaacggccgactcgggggtgaatggtttgaattgtgagaggggataccaccgtctatcttcaatccaaccgtgcggcaagaattggcgtgattcaccatgggtagaatcaaaatcggactcggcggcggctttggacgggcgcgcatggcgtcgagcggcgatttcttgcggctgtcgtcgtcctggctttgtcgtcgtcaagatttgtgcggcggcggcggtctgagggcgtcggacgggcgacgacgcgccaaggcggtcgggcacgcgcaagcggccccgaggccgatgcgcggcgacacggcgcgcggctaagtcggatgcccgggcggcgcgccaaggggaggagaaggccaactaaaccacagtttttgagtgggatgtgggccccaaggattcaacatagactttgcaaaggattggacagggattgggctgagttagttgggctaggcattctgccgaacaccttgaaggcaatgaacagtgaaattcagtaaatttgagtatttttttctagaaaagattgaatttgaactatgaatttggaagagttttactagggtttggagtgtagtgaatcctcactaatgttaaggtaaacttaaggaaataatctaaagtttgaaatttgagagaatttgctcaaatttactaaggtttggaataaagggaatatttagggtaaattagtagggttataaggaagtaacacttgaaccaattaagaaatcaaataaatttttaaacacactaatttaatcaaaagtcagcatgatgcagtcaaattttagtttaaaatttgaggatgttacacggggccgggaggagaagtcggggagcgggggcgggggcgttctggcccaacccgtacctgacccgccccgttgccaaccctatgtctacgtgagtgttcagtgcttcctttacggcccaattatggataatgggatatggtccatcattaatcatgttaactagttgggccgagatggaaaatgtgtctttggtctttcgtgggggataagtccactaaccatctctcatctttacgttatgtttaaccgacatacttaattgtaaaactagaaaggttcgttcaatcttggcaaaacagtctaaattagatctcatggaaatataaatagttggttttcattgatgtggcatcctagtaaaaaaagatagataaacaaagcatgtggggccacatgtcagtgtacaattctttcttctatctttttccccaactacacacgcagttcaagggtggcagctatggacgcagagacggtcggtgagcctgtcctagaaaagaagggaggtgaggggccgacaagcttatactcctcctctgcagtgcgcatagcgcgcaagcctgaccttagtgaccttgggtgtcactgtggcaccaacacgggagggccatgtcctgtgacacgcacagccgagaggaggatgccgaaaagtacgccaaggccaacgcccacccggcctcccgcatcagcgcccaaggtcaccaaagttgagctcgcatgccggctccctcgcctccctctt

SEQ ID NO: 51854 - DNA, 6435 bp, Oryza sativa
ttctccttgatgactaggatgccacatcaatgaaaccagccatccatattatcataggacgtaatttttgcaagttaggggatcaagatttctggtatacagtctaggcaacgattttaaactcgatgaaaatgagggacataaagtggacttgttccttctgtgggtagatttcattgttcaatgagtaaatacttgggccaatcaaaagcccatatctccttgaatttttatttccaacatccatacaagtgaagaaagcatcatttcatagggcatttcataggtacaccgtacgcaagtcacaagaaacaataagtatgttacgtgaccgaatatcacgaccagattagatcatcctaagcttcatctgcgcgccgtgcatgggatgcaacgtcatgacggtgtgcggtgcgtgggtgtaggacgcagcgagctcgaactcgaagcgctggaggatcatgcacaaggccatcttagcctcgagcagcgcgaagttctggccgatgcagacccgcggcccccagccaaacgggaggaacgcgccgcggtcgttggacgccctggagatcccctcggcgaacctctccggcctgaactcgtgcacgtctctgccccagatttcgcggtcgtggtggataaacagcacaggcagttcgaggatcacgcctctggggtacacgacgcccccgatctccatctccttgtacgtcttccggctgaagacgatcgccggcgggtacaaccgaagaacctcgtataaaaccatggtgacctgaaagcataaatgcagagaccgataaatcgatgtctgaattaattgtcgacactgacaacatgaaaggaaatacgatattcagtgtagtgttattgtttctccgagtacttaccgtcttgagtcggctgaggccttcgtactcaggtttgtccctcccaaacagaccaagaacctcctcccttgcacggtcttgccattccgggtgcatgctcagaacaaccatggtccatgtgagcagcactgacgttgtctccattcctgcgaagtagaacagcttgcactcctcgataacatcttcagttgtcatccctgggctggatcgtccattctcgtctgcgtgcctcatattggactcgagcagcaggcccagcagatcatcgttggtgctttcgccttccgcgatggcctgcatcctttttccaattattcctcgcagaatggattcaacctcactgttgatcctccgcatccttctgttctttttggtaggcaagtacctgcagtatagaaaatcattcaacttgacattaacaagttcgatttaagaagggaatagtcagtgaccaaaatgtagcctgctgtaacagcagagttaaacagagtatgcccgaggggaccatggaatttgttgctcacatgtaacccggaatgacgaacttctgaatggctcctatgaagagctcagcttgctcagtctgcagctggaagatcctccttccttcactgtagctgctgccgaatgccgtgcgagagatgacatctccggtgagactctgcatctccggccaaacatccagctcgcacgaaccgtcgggaccaagggaatccatccatttcccgacaagctcttcacagcacgtagaaaacgccggcagcatgagctacaaatcaacccataccgcattactatacaatcctacgatcaacctagcgtacgtacgtctgtacgagtgagacgctttcacgtgatgtaccttgagcttctcgagatggaacgcagggttcatgatcctcctgtgcttgacccacttctcaccgtcgtggctggtgaggccgtcggcgagaagcttggtaagtgccgggagcttgggcttctcgaagtggccgagcttgttggacagcacgtccctgacctgggcggggtcggtgatggtgacgctggggatggggccgaaccaggagaagcagcacggcctgccgttatcccgcacgttgcggtgcacgaacggggtgacccggggcacgatgtcgtggcagcccagcggcagcggcgccgacgaccacgcctcctcgttgagccggccgaactccctgaggtcgccgaggaggaaccggtacgcggtgccgcggagcccctgcgcgcgcagcgcgcgctccagccgccgcggccgccaccacagccggtcgagcaggcggccggcctgccacagaagcaccggcccgacgaggccgtacgccaggaggctccatggtggtggcagtgaggctcggctgaacaactctccaaaaaccattgctgtggactctgaatagcaagaagctgatgcaactggactagtacttaatttgaccggagaagtggggatggatgaggtacggatttcgcgccatgttatatagagttgtcactgggttgcattagtctcctgtgctaatttgtttatggtttcttggagtgtaaacaagactaacgaacatttgggccagctatgcccaaatgaacttggtggagaagaaattccaacccagaaatgccacgatcgggacgaccatgaggtgctgtgagcctgtgactactaataaaataaaagaactcatttacacacctcagaaatgttgaaattcagaaaaaaaatatttatgagttgaaaagaagatttgtatcagaactaaagtccatagcaccacaagaatgaaatttgaaataaaaaataacagaaatggaaacttcaattaatgggaactcagtccaattacgacggtatatttatttataagaaaaaaaataaaatgatcgatggggaaattataattgaatcagaatatactatattttttgaaaactcttttttcacatacaagttggtaactattattccgtatgaataattacattttaaaaaatattaattatataatagaaaaattgatttggacaaaaaaaatgtatttctgcttatataaattaaaaaaataactcaaataaatacatgtgtaaaactatgtattttaaagtgaaaattatgaaagaaaaactattagaataatctgttttttaaagctaaaacgattttggccaatacacatttaaaaatataaaagaacaataatgaaattttacgtgcttcttttaagatataaaagaagttcttgagcttgaattagattttttttttgttggacttaataagccgatcgaattggcttcttagttaggcttaacaagctaagccatctttgttgtcaaaacctaagcatgtattaggttcgtatagtttccgacaaaaataaacaattaataacctaattcttatgtattctcgacaaaaaggcctatcctatacaaataggattgtacaatcttttaccaactttgtatacaccagaataatctagactaatataaaaagcaccagttttctttttagtacacccacctattcttaatcgttagatcctctcatccaacgatccacatcgtgagttggattaacacaggaattagaactcaaactagaattagattaacgctcccacgcctcttcccgtcgcaaaatccccgcccacgtcgtcaaatcccacgccgcgcccttccctctcgctccaaaccgccaccgggcggcacccaccctcccgagtggccgactcccgacgcacctcctcgccggcgccccaccctcccgacgcccctccccgccgccgccgccgccgccgccagcggcgcctcccgctcggccccggccggcgagtcgcgtaggagggaagcgccaccggcggcggccggggcgagatgagcggcaggggaggtggcggcggcggggagcaggggacaacgccatcctctgctccacgactgagcaggggacgccgatgcccaatgccctcgcacgtcgctgacgaacgcccaaacttttaatctcctgctttcaacaggtaaacctgctaattaacaatgtggttcattaatatatgcatgcttgctatgtctttgacggaatgcttgcctaccagtctaccactgccaactttgaggtcaatttatgagccttgccatatgtatgctgtgctatctagatatcgtacattgaggttcccacgtgcagtgccaaataataattgttcttctaattcattaataatggttcttctaattcagtgcttaataggattcttataataatgttgcaaatttggaaggcaagaaatgatcttaaatttcagggggaaaaaatggagcctcctcaagtctgcatggcagctgaagctatgatcaacacttaaaataaaattctcttcttataattcaatacaagagaatttgcaggaagaacaaagggggaggggacctggaagactgccagacggaaccagatgttacatagatgcagcatgggaaaatggaatcacaggaatggaaattttctttcatatgccatctactcataatgccatttttcttaaagcctcctccgaggttccttgctcttccttgcaggctgagttaatggcgcttcaacttgctttggaggtgactgtcttcttaacattgaaggagtgactctcctctctgataattctaccattgtggaaacccttagaaaaggaagatttcaaacggagccaggtcattggagcttaagacctatttggagtcagatcgttgccacaattcctgaatctcttttgcaggtcatgtggattcctaggggcataaacaagttagctgaccaactagcaaaagaaaccaaatccagtgttaatacagcccctgtctatgtttgtcaaaatatatcgcatttggcttatcctaccagaagatgtcatgctaatgacattagagacaatttcaattccaggaactttgtaatccggcatgttctatgcttctaaataaagtgtttaaggttttttaaaaaaaaggatagattaaatcactttccttcacctgatttgcttataccatggccaactgaaagcactgctatttttcacctgatttgtactgaggtcacagcaaactagcaggcagcaggcttgttttgttggtaacattttgcttctatgaattatcatgtatgcatgaagtatttagatctaattatatgtttttgcctactgttattaatttattatgcttctgctgatgcggtttctgaggaggttgctctggcatccttcatgaattctccctgttgaattgtctgtacaatgcacatatgtattccacttttactaccgtgtattcccacaatttgtagcaaccttacgaaaataaagggcaaaaaagattaaatatggatgcagattttataaaagctaaatcatatctaaatattaatggccagttcgccaggccagcaagccatacatgcacagcaaactaaagcttttttataaagcaccatcactaatctctctcaatgcacagccaaaatgaaatctactcccttacagctagaataaactaagcattaatattttgttcatgacttaagtgttattccattcgatatatgcatttcctgaaggttttcatacagtaacatcactaatctttctcaatgtacggtcttttatacggtaacatcactaatctttctcaatgcacagccaacataaaatctactccattacaactggaataaacaaagcaccaatattttgttcatgacttagtgtcactccattcgatatatgtcgacatgtcttgcacctgcacgctaactagtacaataaaacagaggactgttatacatctcttatctgttgtccagttgatgtttgtgttcattaatccaaagatcagcagcgcagccactcatagcacttctgacccccccccccttttttttttgaaagtaatccaatgtgttaaaattcttatgctcgacaagaaatcatttataatagatagcttctagttttatttcaaaggtacaaatatcacaactcatatacaatagttgtactataatgaatacatgctgaaacgatcatacaactaccagaaaaaaactatcatatagctctaagcttaatctgtgcaccatgcgtagggcgcaaagttattatactttgtggtgcatgagtgtatgacagagcgagctcaagctccaagtgttgaagaatcatacacaacgccatcttggtctcaagcaatgcgaagttttggccaatacagattctcgggccccaactaaatggtaggaacgcgcctggatccttggatgccttggaaatcccctcagcgaacctctctggattaaacttgtgcacatcacttccccatatgtctgggtcactgtggatgagcagcaaggggagctcgatgatcacgccagcggggtaagtgacgcctccaatctcaatctgcttatatgtttgccgagtcaaggtcacggccggtggatacagccgaagaacctcgtagaggatca

SEQ ID NO: 51855 - DNA, 22507 bp, Oryza sativa
gtgttgtgtggttcaccttgagcttctcgagatggaaagccgggttgaggatcttcctgtgcttaacccacttctcgccctcgtggctggcgacgccgtcggagagcagcttcgtcagaccctggaacttgtgcttctccaagtgaccgaatttgttggacagcacgtccttggccaggtccgggttggcgatggtcaccttggggatcgggccgaaccatgagaagcacgccttgccatgctccctgacgctgctgtggaggaacggcgcgacgcgcggcgcgatgtcgtggcaccgcagcggcagcggcctcgcccaggcctccctgttcagccgcccgtgctccccgaggtcgccggtgaggaagcggtagcgcgtgccgcggaggccctgcgcgcgcagcgccagctccagccgccgcggccgccaccacagccggtgcagcagccggccgccctgccacaggagcaccaggcccaggagaccgtacgccagcgagctccatggcacggaggctggacacctcaacccggctccaagaaccattgctggggtcagtccacgagtgcaagtgtgcagatgagtggtgtgaaaagaagcttttgactactggagatggatatggtacggtgttgggcgaggttaacaaaaattttgacaatttggtcctttacaaaaactatttttataaataaaccaccgccaaaatttattttaaaaatgacccttctatttagtgtcacatcgtgtggcgctgaacttagacacctcagcgccaaatagcgtggcgctgaatgtgcgttgccacgctgacttagcctcccatttgcggtggcacggcattcagcgccaattgacgtggcgctgaggtgtctaaggtcagcgctagatgatttggcgtggaaaaaaaattatttttaaagtaagttttagcggcggttcatttataaaattagtttttccaaagggttaaattgtcaaaatttgtgttaaatagaggtgctacttggttgcattagtcacttgtgttgatctgttcaagccgatccgagttgctagcattggtaggtagtactccctccctctttatagggacattttaattgcactatttgaccatttatcttattaaaaaattttaaaattattatttattttatttgcaacttacttattttaaacgtaacttttccttttattatatttatataaatattttaaataaaatgagtggtaaaacattataagaaagtgaatatctcgggagacgaaggtaaggaacttcgtagagaagaaattccagcgggaactgatattctgattagtcaaagtgctcgcggatggtgatgagtgacgccccgatgctactccctcaggttgataacgtcgttttggataagggcacggtctccaaaaaaaataactttgactattattttctattataattcgtataaaagtgttaacaaatatatgatcttattaaagtattttttaagactaatctagataaatattttaaaaatgatttataatcaaagattctcaagtttaacctcacccttatcaaaacgacaagtattattagaccggagggagtatcattttaggattgtttcgcggctgcttcgttttgcacttttgcttgcttggttactattgtgaagaatatcagatgaattgggctgcatgaaaatgggccacgggccatgggccacatgcccatacaggtagtctaagcagaattttggagtccttgtcatactggctatattggagtattttgtaactgaactaattactcaccgagaaaattctcacaaaataaaaacaatactaccaatttttttaatcataacaaagagactatacacgcgtcgtctcacatagcattaagtgtcatattagaaaacgagcgtgcctgttagcacaccaacaaatttatagccctgtgtgtattactatgtgttttgctgttaaattattgatttctacctagcaattggttttggttttctagaatataagatatgaacatggtaatagtatttgtcttaactgtatttatctcaatattttcttaatattgtaggaaaattcttggggttacttgcataagtacttgtaattacgcttgattagtcttaattttcaattaagtctgtagtagattgtatttgttcaaatgataaatctgtaaggctgtaactcctttggtttcactatttaatttatgttttattttctattcatataggatgttactatcatggagttacttgcctgaattttgatttaacatgtattaattgcttttaaagaaaaaaaatcatgggttagaaatcctaatatttctcccgtttctctcctttttttaaacaaaaaatatgcagttttctcgatctctctagatgcaagcgagcactttcgcatgttattttgcatggagaccaattccatgaataaggacatgccacatggcttatctctccggcgcttaatttgcacatatttcatgttataagataagctaactccaaattttgcatgaaaggaatacaatgtgtcaaaaaaaagggaaaacgaggagaaattacaatggcgtcctgacccacctcagcaaaagcagcactactgtgactcgctgatttggaatttttagggcctgaaacatgttatagccaattgtttttgctgttctaatttcggatatatcacggctgacagataactacaccaaagagcgagtgcagtgatgtatctttgcgctacggttcccatcataccaccatgccggaggctcacacgggtcatgagaaatttgagcaaacgatggaagaaatcagtgaaaactgaaaactggaaggaagggggtaagttggaagagaaattgagtggtggttttttttttacctattgagttgtagagggagagtgaaaatacatgtgacttgtagagggttatttggacttttcccataaaaattaagcttaagaaattttattatagttaactccaaatttggttgtaaattacaaatatgccctcgtaaccaattgttgtactaaaacacatgaatctgaaataatcatatagctctaagcttaatctgcgcaccatgcatcgggcgtaaagttaccatactatatggtgcatgagtatacgacggcatgagctcaagcttgaagcactgtaagatcatacacaatgccatcttggcctcaagcaatgcgaagttttgacctatgcaaatacgtggcccccaaccgaatgggaggaacgcgcccggattcttggatgccttggagatcccctcaacgaacctatctggcttaaactcgtgggcatcactcccccagatgtttgggtcatggtgtatgagtaacaccgggagctcgacaatcacaccagccgggtaagtgacacctccgatctccatttgcttgtatgtctttcgagtgaaggttacggctggtgggtacaaccgaagaacctcatagaggatcattgtcacctacacaatgcacatataagtgagttttagtactacttctagctgcaaattgtttaagtcatctcatgagaacgaagtggtattgtcgaattctacaatatactcacgattttcaggcggctcaggccttcgtattcaggtttgtttttcccgaatagtccaaggatctcttcccttgcacggtcttgccactctgggtgcatgcttaggagcaggatagtccaggtgagtagcactgacgttgtctccattcccgcgaagtagaacaacttgcactcctcgatgacctcctcgattgtcaatccatggtttgattggccatcctcttccgtgtgtctcatgtttgactcaagcaacaaacccagtagatcatctttggtgcattcaccttctttcatagcttgcattcttttgtcaactagaccccgtaaaatcgaatcggtctctttctttatttgatgcatcttccggttgtttttagtaggcaaggacctgagatgaagaatatatcccaacacaatcataaacagggagaatcatcaaaaagaagatgaccaaactaaccctcaactcatactaaattattcggtatattaagtgctgaattctcacatgtaaccaggaatgacaatcttctgcatgcatttcaggagacgctcagtttgctcggcctgcagctggaagatccttcttccttcaagatagctacttccgaatgcagtgcgagaaatgacatctccggtgaggatctgcatctccggccagacatccacttcgtacgagccgtcagaaccaagggactccatccacttactgaccagctcctcacagcatgcagaaaatgccggaagcatgagctgcagagtatcattcgtacattatattccaatgcagagaggtgcagaaaaacagaaaaaataaatctatctaatactactagtaaaaatagtctgggtaggtaccttgagtttctcgagatggaaagccgggttaaggatcctcctgtgcttgacccacttctcgccttcgtggttggcgaggctatccgaaaacagcttcgtcagagtcgggaacttgggcttctcaaagtggccgaacttgttggacaggacgcccttggccaggtcggggtcggtgattgtcaccttcggcgtcgggccgaaccaggtgaagcacgcgctgccgtgctccctgacggcgttgtggaggaacggcgcgacgcgcggcgcgatgtcgtggcaccgcagcggcagcggcctcgcccaggcctccctgttcagccgcccgtgctccccgaggtcgccggtgaggaagcggtagcgcgtgccgcggaggccctgcgcgcgcagcgccagctccagacgccgcggccgccaccacaggctgtgcagcaggcggccggcctgccacaggagcaccaggcccaggacaccgtacgccaggaggctccatggcacggaggctggactcatcaaccaggctccaagaaccattgctggagtcagtctatgagtgcaagtgagtggagtgaaaaggagttgatgcaagtgtgctttgactactggaggtggatatggtatgtacggtgctgggggtgaggttaaatagaggtgtcacttgcttgacggggccaatcagcattgctagcatagcatcgatcctaggaggtaccttgctggtaaggaacttggttgagaagaaattccagggggaactgatactctgattggtcaaagtcctctcggatgggcgacgcactggacggctacccgccatgtgaggagtgcttcgcggctgcttcgttttgcttgatttttatttttcgagtggtcgttttgcttgattagtggttactgctacgcattggagaaaaactgaatatgcggtgaacagtgatcattcgaatagggatattttctcccaaatacgaatacgaatatgatatcagggtttccgacgggtacggatatccggtgcacagtgctatttagatatccgctaaagccataagatataccacatttctttataactctatgtctttcaatgtacatttttagaatttagtagtaacatatctcttaacactagtcaacactattaatattatttaaacttttaaatatgtttataattatactatattttatataaaacgagctaattatatatgatgatattcgtttatattagaagttgaggtggttttcgtgttttgataaaaaaatattgccatatccatatctgattatattcgatccttattcgtatttgagataatttgtatttgtttctgtatccaagccattcgtattcgtttttacacccggcaaaaaatatgaaagcgaatatggtatgataattgttcgtccatatctgctctgtttttatccctggttactattgtgaactgagtctaatatgacttgggccgcttgaaaatgggccacaggccatatgcaggtagtccaaccagaattttggagtccttggctactacctccatcgcataatggattaggttgttttagagaaagaaaaaaaaaggaaaagactattatgtccataattaaatgaggagtatttgaaaagtgggaggtaggttggggtaaagtgtggagaaatttgaatgagagttgttggagggaaaagtaatactacttagggaaaacatttggtaaagttgacaagtgttaagctatgggggttgttcactttgatgcttaaatcaatatttactaagtttttgtgaaaggaagattctagaattatcaaagtttaatagtggaggcaagtttttggtaatgtttggattgttaacttgtaaaattttggtaaagccaaaacttggtaaggtttattttggcaataaactaaacatcccctatgttttgtttcttttgtcatgtttttgaggaagattatagaattaccaaactttggtagtggaggtaagttttggcaatgtttggattgttaccttcctaaattttgagaaagctaaaacttggtatggttaattttggctataaagtgaacatacccttaatctcttacattttgtgacaaaaatttgaatttgaataccccaattctttatattatattatgaacggaggtagtatagtggagtaatgtgtatacctggactaattgctcgctgaggaaatgctcacataatcacattaggggaaaaaaacatacccgtccatctagcatatactccatctgtctcatacaataggacattttgacttttttaagtcgattttttaaaatttgatcaagtttaaggaaaaatataataacattctcaacatcaaacaaacatataatatcaaaatatatgttagattcaatgaaactaattaaatattgtagatgttgttaaacttttctataaacttaattagtcaaactaaaagaagtttgacaaggaaaaaatccaagtgtaaaacggagaggtatataccaagtcataatgaacggcagagatataaaatgtgagttccttgtaaactatcaagtagaataaaaattacaaattcacaacaggaacaaatagtagtaacttgccacctactttttcaaactccaatacaataattactctaaagttgaagtctttataagaaaaacgaattggataaagataaaattattttgagacaatggagtaccgaccaacttcagtaaatacaacaaaagttggaaggaaacatagaagattaaaacaatattttttgtgcaaattctaactacatatcgagtacaataggttgaatcattgaatgacaccacattaccacatcgatgatacttcacctaaattatctctaaatttgggtttagaataaaaggagaattgtttagaagttgtcaatcgaaaatcagttaggccataattgagaggttatgaaacaaacccttttttagattaatgttttatatgtcctgtcctggaatagatactaggaggtgtcacaaatgagtttgaaaaaagtttaagattgaaatatgtgatacaatctcagggattgcaaaataacccgagtgattaagtgtacgattgcataataaaacaaaagaaccaaaatttgcaaaaataaaataaaattttgttgtatatcctcaacaaacgtaaaaataagtggagtgattaagtgtacaatcgcaaacatatattcaattggctttctctagctctataaattttcacctcaccatattcaattatttgtttgctttatttttcacgctcatcagcacgtacaagttcccctgacatccacacatactataccgtgtcaacatacgtgcacctagttacatactaatgtatgtgattattgtgaaccatttttctgtgtcgatccatatattagcctatggaaaatcgaaaatgacatatatatatataagcggattcacgggtggccgctgctaccaaaaccagatgatcatagtcttgtgagtataatttgtgcaccatgctgcggatgtagcgtgacactggcgtaaggagcatgggtgtacgagggcgacaactgaaactcaaagttctgaagtatcacgcataacgccatcttggcctcaagcatcgcgaagttctggccaatgcagatcctcgggccccaaccgaacgggaagaacgcctgctgattggtcttggtcgccttggagatcccatccgcgaacctctctggcttaaactcatgggcatccttcccccacacatcggtgttgtggtgaatcaggattatgggcagctcaaggcccacaccagccgggtacgtgatgcccccaatctgaatctccttgaatgttcttcggctcaacgtgaccgccggcgggtacagcctgagcacctcatgcagtatcatcgtcacctgcaaaagataaacagagtatctaggcatcgtgagcaagttaacatgtgtactaccacttgtgatcaaatatggatgaagaaatatgttcaggttttgacaagcacttgccgttttcagtcggctcaagccgtcgaagttgggtttgtcgcggccgaacgcgctcaagacctcttccctggcgcggtgctgccattcggggtgcatggatagcacgacgagcgtccaggtgagcagcaccgacgtggtctccatgccggcgaagtagaacagcttgcactcctcgatcacgtcctccgtgctcatcctcaggttggacggctcaccgctgtccatgttggacttgagcatcagcccgagcaggtcgtcgccgctgagctcgccgttctcgacggcgcggctcctcttctcgatgatgcccctcaggagcccttctatctctcggctgttctccttcatcctcctgttgttttcagttggaaagtacctgcatgacacaggaacaggatagcaacaactaatgtcagagatacagacatacgtatactgtacgatgacaagtgacacacaggggacgggagcattggttaattaagctggttctcacaagtagcctgggatgtagatatactggatggtcttgatgattcgatcagcttgctcttcctgcagctggaagatccttcgcccttccatgaagctgctgccgaacgccgtccgggagatcacgtctccggtgaggttctgaaactcctgccagatgtctagctcgaacggtccatcagagccagctagtttactgtcccaacggtcgatcatctcgctgcagcacgtcgagaaagccggcaacatgtgctgaaaacatcaaattcagttcagtaagcatacacgcacacacacaggtattgaggtataaatcactccctgctagcttgtaacaactaacatatacagtatgtaccttgagcttttcgagatggaaagcagggttcaggatcctcctgtgcctcgcccatttctcgccttcgtagctcgcgagcccgagggcgatcaatttcccgagacttttgagggtgaatttctcgaagtggccaaacttgttggataggatgtccttcactagctctggctcagcgatgaccactctcggcgttgtgccgaaccaggtgatgcacacgttgcctacattcagttcagtgttctgtgccgtcagatagagctcgatgaacagcgtaaactgaacataacagcacgcgcatactttctgaagtatatatgaacttgtgttcactattcacgaaactggaaaagtcatagcaatagaggcatgcatggaggcatgtcaagatggattctaatagctcgagtggacgtccacccgtttattgcatgtcaactagatggctacgaaaagttttcaaaacaattgagaagatagatcaatatgtaatatatcaatccacaaacatgcaagttcaaatttaacttctacaaattataacaaaaataacaaaatgtagaagttgaattttaacttgcatgtttgtgaattgatatattacacattgatatatcttatttatatttttttaatttttttataactatttagatgatatgcaataaacgggtggacgtccactcgatctgttaaaacagtttcccttatgcatggagcttaccgtactccttgacgatgtcctgaaggagcggggccacccgggggacaatgtcgtggcacggcggcatgggcttagcccgcgcctccttgctgcgccgggcgttctccggtaggtcgccggcggggaaccggtacgcggtgccgcggagcccctgcccctggagcgcgccggcgacccgccgcggccccagccagcacctctccgccgcccggtagagcgcgcctagcacgagcagggccgggacgccgtagtagagcatgccccacggcgccgccgccggcttacctgcttccagtgagactcccacctccattcccgtggcctcctccattattaccggttccctagctagttggctgacttgttgagactgcgaccacagctgccaagagcgcgcagtgagtggtttctgttggtacgagtggcagacgcgcgagcgttttataggcatacgctttgcttggcgtcacatgtttttctccgtctttgtgaggtttcttggcggccacggtcatacatacgtgcctggattttttttcagctagcgcgattgcatcgacaaagtgtggcagatagccagtgtgtgatttgctagttagttgtttgctaacttgctgcagaagctgctagcattttggatttttggtgctgtaaagttagtaaataaatgtggatttgttgctttcgttcctctggagtaaataaaacggccggagagctcaaagatgttctgactctagctagagtgtacgacatcctgacgtgcgcagaaacgtaggcagtgccgggtaacggaccggggcccaacgtcccagtccattacttttttggcccatccggagtcctgtcctcctgcccctttaggcactggaataagttcatttgaggtcccttaatttgataacgagtttgattttcatccgtcaaccataataccagatacaacgggtccctcaagtgtcaaaaaggatacaaacaaggtctctcaatagtttggatagcggttttggctgccgtggcacctacgtggctggtttcacttagtcctcgtcctacgtggtggtaatgtggcattggaagcaaaatataaaaattaaaacaagaaatgtggggcatatatgtaagttagacaaaagataaaaaatagtgggacctctctctctccacggacgagcatgcacagaggcccagagagggtgaagggtggcggtcgatgtgccgaagccagccgagcgcgtggatagggaggaggcagggaggccaagcgagtgggcaggggagggaggaggttggcgaggggggggaggctgagagaggtaggagtaaccgccaccgcccttctcaacctggcgccgctttcttgagtggcacttgcaacccaatggcagcctcttcctcgagaggtttaacgcgatgccagagtcattggagtcatccttgatgctcccaccaatggcctgatgatgacccatgtgccccaccgcctgctcaccgagattgatggctggaggctgcggtcgtggaggagtccgacctcgctggccttcttcctcccctgccctctcgccgacctcccctcctcctccctctccacacacttggctagcttcggcttgccagcggagagagaaggacggcggtcggcggaggggcggcggccagcccttctcgctgttgaggtcgccccaagtgaaggggagcgggaagggcaagcacgcggcgaggtgtggaagggggcttaggtttcagtcctccggcggctagcgtcgccctcgtagcgaggtatgtcgcgacgcacgatggccgccacccccaccctctccggctctctgcgcgcgctcgcctgtggaggtagagaggagggtggaaccataggtaccactatttttttatattttgtttgactgacatgtgggcccctttgtttttaatttttatattttgcttctagtgctacatcatcgccacgtaggacgaggaccaactcaaaccagccacatagatgtcacgtcagctaaaatcgccatccacactaccgagggaccttgtctgcattggttttgacaattgaggggcccgttgtatttggtatttgcggtgcagtaacgaaaatcaaactcgttatcaagttaagggacctcagatgaacttatttctatgttgaacctttccgctggcccgtgaactgggaagtagataggcctactagactgtttcaccttaggtatgtattttagcccgacccatctctctgtttcacttactaattccagttcactgaggcattgcgtttgcatagcatagcatcagggagaacctgtatagtagaaaaaaaattgtcactgtagtatagattcacggcgatttgcaatttgatttgcattttatataaacataactgtgtttttatgcttacagttattatagtatgcttgttggggtatattggtaaataatcgcataaaaaactaaacttttaattctaagtcataagatccattgttttacccacgcatgaaataaacaaacaagtatatctttttttctctaatggagggacgaacagtatgtactagttacacatgttaatatagtggttacaaaaatgtttgacagataaaaataatcactcattcataaggcacgtacgtagatggtccgaagtcccaacttaacctctaattgtttttttcccagaggaaaacctttcctaattctattaccagaaatgacgtttataacaaagtcaacatatcccaacttacctttcaaaaaaaaaaatttatcccaactcatgatagttacatttaaagtgggcgagccccagacatattctgagctcacacaaacaataattcaacaccacatggtgggtgccccttccttgattttcttctccaccaagttccttctgatcaaggtttagaccgcccaaggctttgaccaataatacactatcagaggcaaccaagaaagctagcaagcaacttccttgattaacatcgataaccttaaacaaatgagcacacgaagaccaactgtcccagcgacactcctatataatcggattcgaatgcgctgaattcacatgtacacaacaccgtatactgtcccttccggtcaaagtacactgcccgctgacagtgaccagagattctactccagcttgctactcattttcgagggtgttgatcatggatccgacctcggtgccatggagctccatggtgtacggtctcctggggctcgcgcttctgtggcaggtccaccggctgctggtgcggctgtggtggcagccgcggcggctggagcgggcgctgcgggcgcagggcgtccgtggcacgtcctaccgcttcctcaccggcgacctcaaggactacggccggctgagcaaggaggcatgggcgaggccgctgccgctgcggtgccacgacatcgcgccgcgcgtggcgccgttcgtgcaccggaccatcgcggagcacggcaaggcgtgcctctcctggttcggccccatccccaaggtgaccatcgccgacgccgagatagccaaggacgtgctgtccaacaagatgggccacttcgagaagctcaagttccccgtgctgtcgaagctgctcgccgacggcgtggccaactacgagggcgagaagtgggccaagcaccggcggatcctcaaccctgccttccatctcgagaagctcaaggtacacgaattaaattacagtacagttttgtgatatctatatattacagcacaagtatttaccgtgatagactgtgtgactgtttccttgagtaatgtatcatgtatgcttctgcagctcatgctgccggcgttttctgcgtgctgcgaagaactggtcggcagatgggcggcgtctcttggttctgacggttcgaatgagatcgatgtttggccggagatgcagagcctcaccggagatgtcatttctcgcaccgcattcggcagcagctaccttgaaggaagaaggattttccagttgcaggctgagcaacaggagcttttcatgggtgccattcagaagatctccattccaggctacatgtgagtttgtttttctctgttcatcaacactgatttagtggtttatgctccacgcctctattgtaacactaaccagaccttacagttatacataatttctatcgaaattaaatgtttgttattcagtactcgtagttcctctctgtactgaaaatctgaagcggtgtgccctttcaggtccttgcctaccaaaaacaaccgaaggatgtatcaaattaagaacgaggttgaatcaattatacgagatctggtccagaaaaggatgcatgctatgaaagatggcgagagaaccaaagatgatttgctcgggatattactagagtcaagcacgaggcatgcagacgagaatggacattcaggcccggggatgaccatcgaagaagtgatggaagagtgcaaagtgttctattttgcagggatggagacgacagcgatactcctcacatggaccatggttgtgctaagcatgcacccagaatggcagcaccgtgcaagggaggaggtcctaagcctatttcagaaaaacaaacttgattatgaaggcctgagcaaactcaaaacgtgagtaataaatgttgaaattaagtaacttttttaggaaatccatgtttaagttatcttttagatgtagagatgatattgaaattactaaatcacatggcaactagaggtaattaacctttggtacatacaggtgacgatgatactttacgaggttctccgcttgtacccgccgggaattgggtttgtccggcaaacatacaaggagatggagatcggtggcgtcaagtaccctgcaggcgtgatgatcgagctaccgttgttgttcatccaccatgacccagacatctgggggagcgatgtgaacgagttcaaaccggagaggttcgccgaggggatctccagggcgtccaacgatcatggcgcgttcttcccgtttggctggggcccgaggatctgcatgggccagaacttcgcgctgctcgaggccaagatggcgctgtgtatgattctccagcgcttcgagttcgagctagcgccgtcttacactcacgctccccatattgtgttgatgctgcgtccgatgcatggggcaccaattaagcttagggcaatctgatcgtcgatcttgtgatgttcatatcatgcattgtaggctttttttttaaaaaaaatggcatgtttggtttataccaatcaaccatgccaccaaaaaataatttagccatatcaataaattaattctccatttagtttgtaaagaaaaggtattgtcaaatatttggtttgattgaatcgacactttaaaaatatagcaaaacgaatattttgcaacttcatcaaaattgtactacctccattccaggttataagactttctagcatatgtgaatgtgggcaataccagaaagtcttataatattaaacagatgaagtataaattttatagtaaactaataatagcgtgaccaatcttaataaaattccgaaaacaatcccaaataggggcggacccagagaggttcccggtatgcaccggcatacccaaaaatcgcaaaaaaaaaaaaatcagcaggtagtatatgcatcagtgggctgaaacttgcctccatgaaccaaggcccaagatgcccacttttactgaacttgcacagcccatcaaaagtgccagtgcgcgtgatgcgttgatggggaactctagtctaaatctaatcgattatctcttcaggatagaaatttctagtaaggtgagccatggttgatgacttggcttatcggttccgatttgtattgtcttgtattgacacctcaataggcttatgatggcttgccttggttaccctccctcctaggaagtgttgattctagggttgtcttgtccaaaaagaattagaggcccatttaggatattgtcttgagtagtcctaagctggcttttgagttagttgtgtatatccacttatggatatagatgctaaatttctatccactatcttaaaaaagtcggcttcgggttggaagtcttcttttcttgttggaaactccttcattatctgcttaagactatatccctattttggggctttttccatatagaacctagtatgcaatagtccaaatgagatattttcacacctttgaggtactcaatatttcgtacattaataggaacaatcatcacaatacatgaacaaagtcattaacatcccaactactcaaggaatagaatgaattcaactctaattccctatccattcctaactatatcaagttgagtctatgagaactatcatggtaaacaattgcgaggcacgagacaccctcacctatgttgagcggtgtcgcccttagctccacgttgcttgcacccgagcgtcacctccttcgcctccctaccacaccgacactggtacccaacgccttcctcgaccacctcaggtcccctcgttgtctgaacccctacgagtctctgatcgggttttagggacccagcggggccaaggcctatttttgccctttctcatttcagttctaggcggcagctccgttcttatccaactgtcatcggctccacctgttgccaatcccagttagcacagataaaaactaaataaacacattatcttctttcgtattccctccatctcaaaataaaacaacataagataatatgggacataatctagtataatgaatttaaacatatgcatatgtatgtctaaatttgttgtggtaggttatgtcctgttctattctagattattttattttaggatggagatagtataaggcccaaagatatcaatatcttgtattgcagaccatttagcccacggcttggacagcccattacctggcattgcttctagaacgtctaattacgcctagcttctagaatgtataattgcattattgtggggtaatccaaatcaatgcggttctccgatggagcagagccatacagtagttagcacgaatggcgtctcatgaatacgctccctaaaatgtaccagggtggcagggtgcccatccatgcgtcactccattgctgcacaagcgccgattccccgctgtccggcggctgcatgtctgcatgtgcgtagggatgaaaatggtttagaaagttttaacattccggacatattttcgaaaatggaaggtattggtcaaattttttcgaaaactttcagaaacaaaaacgaatttaaattttttttctcagaaacaaaaacgaatatgataaactactatcttcggaatctggaatccgttggaaatattctgaaaacgaattcggatcttttcggagtagtaaatgacagttgtttggcttcagccttctctgctctagtgtttacatttacatttatatatattgtgtattgaggtgtttagttaaatggagatatttttttagtccaatgctttagaatttttttgcctaatgaatatttttattaggtcatgacatactacttataattacaattatagataaatatatttctttttctccaaaaaattttctaagaaagtaaagtgtacaactaattgtattgctattaattgataaaaattagcaatattgatttattgttttagaaaaaaaaaaagagttgcatttcttcgttgatttgagaagttctgtttaaaggatttttatattttgttaccgtattcactcgttttcgtatttgatgatacagtatttgattatgttttcaaacttttggtttccaattctaatttcaattccaaaaaaagaatgtgaaaaagggaaacgatggagatgattttcgttcatttttgagccgttttcatcctagatgtgagcacgtgacaatgtacacggaaggagcctcttacgcaagcgcttgggtcatcctctcagcattgtggaacgcagacttggagccttccctacctgacgtaatgcatgacacaaaccgcccattaaagcggagtagtatatatgatgcaggcgagcgattcacttgttgacagggagtgattgtgtgaggctttcaacttgtgagattactgggtaattgaagctggcattattatatactccctccatttcaaaatgtttgacacagttgattttttaagcacatgtttgactgttcaccttattaaaaaaattgtgaaatatataaaactatatgtgtacatgaaagtatatttaacaataaatcaaatgatatgaaaagaataaataactacttaaatttttttttgaataagatgaatggtcaaagacgtactaaaaatcaacggtgtcaaacattttaaaacggagagactatttccttgattctttgcttgggcgaaaagaacacgagcatgccatcttctcttgaataaaacgggagaggacaagcacgactagcacacgtaccagctgcgacgctttcatttaatttaaagccctgacgatgtcatcgtccgttgatagttccatttagcaaatcagagatccacgttttcgaggggaaactggtagtagcctaggagaaatcttcgtgtggttggctcattggggtgcatcgctatcaggcatagcgcctggtgccctcgatcttgtagtagtatttttctccgatccacatctttacatgtctccgcgcgacttgcacgattgcgtccgattgagtctggaagaagcggccgcctgtatagtatacttagaaaatcagcgtgccagatggcacatcaacctatttatagccccatgtgtattacacttaaattaattatttctatccatttatttaattttctagaaacacatatgatatcaacatggtaattaataaaatatttgttttgattgcatatctagatatttaaacctccaagcaatgttcttgctactacttacttctgtattatttttcataaaaaaacgttatgcttgaaaaatactatcatgatgttacaaatttaaattgatgatgaaaattcgaaattctttctgtggtatatgacgtacccactgacagcaagttgactttattttttgtttgacattacaagttgacttcattaatcttcaaatatatcagctcatcgttttagaggtgctcataggaaggaataaagtgtatatatacgtgtgaccttaattagtaggggttagtgtggtgagtgcttgtgtgttgtaatgtgttttctaaagaaaaaattcaaaaagttttacaacaacttaatttaaatgtttgatatgtcattttttacatgtaggatgcacgcattctacagacacatcattgtgcgcgtgcatattttttttacacacggcaagaaagagatcagatataaccaagcttgtaattggacatgcacgcattagtcatgtacttccgtgctaatgtagggcatgttcattttgatgccaaaataaattttatcaaattttggcaatatttaagtacatttgctagatttttgtgagtgaaagattttagaattgtcgaactttaataggggagctaagttttgtcagattgttatcttgctaaattttagtcaagccaaaacatggttaggttaatttggtaatgaagtgaaaaaccctgtagaattagcgtttggtggaaactcttgtgcgcagcgagtatgatgttgcagctccatcacccgaaccagtgctcagtcacttaattagggtgtgttctatgctccatctccctatcttctcatcttatttttcatgtgacgtttcccaaactcatctcatactctcttatttttcacatgcacgtttcccgaactgttaaaccgtgcatttttttaaaaaaaagttctacagaaaagtagttgtaaaaagtattaatccattttaaagctttttagctaatgattaattaatcatatgctaataagttattccgtttctcgtgtatgtgtcactaacttgtggggtttatatcagtattaatatattttgtttacaatgacataatcaaattaaatttacaatgacataatcaaatgacaaaaagtttatactgtaatgtatttctaggagactgattcaatctatgaaaatctataaaattttagtcgacgagattcttggaaggaaatctaagcaattcaaaattcataattaatacaatgaagtgattaaaagagaacattttcctctattttagtttttctaaagaatctagaaacggctatattttgaaaaaaaaaggaccgtctctgttttttttaagtatataacatgattaactatttttatcaaacctcgactaacaacatttattaattacttatagttaaataaacataaaaacaccactagatttatcgtcaaaataatttaagcataactagtagcatgtttgtctatttcttgaagagatgaataaaaaaatcaactgcgtttctaataaacgcaatagtagtacagtagtagtagcagctctttttttcaccctgagaggaaaaaaggtttgtaagtacatacagcccggataagttttcaattatttttttacttttttaccttttattttaaaagcaaaacttctaaaatttattttcaaagtctgaaccttttggtggcgttagctagcttgacgtggtaaaataacactattacgtaaacatagcaacaactattatgtaaacatagcaacagttttatcctcccacaccagctaggatagcatggcaagacaacactaccatgccagcaagatcggctaataaaataacattatcacaccattctgacatacatgacaatgttgttttgtaaggcaacctagctagtgtgaccaaaaggttcagattttaaaaataagtctttaaaaagtttgttttaaaataaaaaaagacttaaaaaaagaaaaaaaaagttctgtggaccattagtttggctctccgtaaagctacggattataagttttaacaattttggatttttagttttgattttaaagagtaacttatcttttttactctctttgtctaaaagaataattttttaagcttatctaggtacatagttaaaaagtattatgtttaggtttagttaaagatactcttttaaacagcaaaagcaagataatgttggatgaaaagtggagtagataagaaaattacataatgaaggattgtaataggtaggaaagagtatattggtggagctgtttatattttaggacaaatcttaaaggtaaaaaatgttatattttgataataacttatactgatattgattactccctccatccctaaatataaaggattttaattagatgtgacacatcctagtacaacgtcatatctaacctaaatcttttatatttagagacggagggagtacaaaaatggtgttaatccttttctatgcacgaatgctttacttagagcctaagcatcttgatttcggctctatgcttgatactactacggagaaaacaacgcatgtttaaactagggtttgcaaaactgtaggattatcatgcggttatcaccgttattatatgtagtaaccttatcaacttctgaaaccatagtaaatctggcggtaaccgtgtagtctaaaacagtaaaacctggtgtagactctagtaccagatgtcgtgggagattttttttttcttgtgtaatcttggaacgtgtcatcccacctatcctacatatttaaaggccacacatcaccgtcgagatcatcaacaatatcggctatacggtttcgcggatcacctgtggtcctgtgcagccgtaccgtacgcctctgctttcctctcaccccaccgcgccaccggcgagcggcccgcgagggaggaggcgctgccgccgcctctgctgatgctgatgatgctaggggcggcctcccagtggatcctggccgccgccgcggcggcggccgtggcggcgctgctgtggctggccgtgtcgacgctggagtgggcctggtggacgccgcggcggctggagcgcgccctccgggcgcagggcatccggggcaaccggtaccgcctcttcaccggcgacgtgccggagaacgtccggctcaaccgggaggcccggaagaagccgctgccgctcggctgccacgacatcatcccgcgcgtgctgccgatgttcagcaaagccgttgaggagcacggtatagtcctctccctccagcgaatttccagttttaatacgaaacagtactgagctaacatctgatggtacataaaaggctaatcggagttgagatcgtgcttgcagattagcttcggattttacccttttaggaaacagtaaagttcttctaattttcaaaaagagatcttaccgcttcttgttccaatatactcccttcgtttcgaaatgtttgacac

SEQ ID NO: 51856 - DNA, 7222 bp, Oryza sativa
acgaacggtcaaacatatgataaaaagtcaacggcgtcaaacatttcgaaacggagggagtatgttcttaatattttgggggaaaaacatttgaagttgatgtaaaacaaaatgttgaggatgtatgttcatgtggaataatcatgtgcatatggttgacaagagctactgtctaattggaatgtgcgctttgattaagattgtcacctacacatgttgggtatagttttcagtctccttgcaccttttaatgggattgaaaacgtaactgcagggaaaccatcattcacttggtttggcccaacgccaagagtgatgatttcagaccctgaatcaataagggaagttatgtctaataagtttggccactatggcaaaccaaagcctacccgtctcggaaagttgctagcctccggagttgtaagctatgaaggcgagaaatgggcaaagcaccggagaattctgaatcctgcctttcaccacgagaaaataaaggtgaaattcattttatcacttttagattgcagcattccatatttcttattgggtaatgtaccaaagttggctaacaatgttgtctcgttcacagcggatgctgccagttttttctaactgctgcacggaaatggttacaagatgggagaattcaatgtctattgaaggaatgtcagaggtagatgtttggcctgagttccaaaatcttacaggagatgtcatatcaaagacagcattcggtagcagctatgaggaaggaaggagaatttttcagctgcaagcagagtcagccgaacgcataatacaagcctttcggacaatttttataccaggatattggtttgttctttcttcttacactataaaagaaatcatttggacatgcatatcaaatatcttacgaacaatcctatgagttatataatatctttatttagtacttatgtgatatattacagttgccgaaaaccgttgtcaaaaatgcccctctgaggattgtgaaattaaagtataaccttcagtcatgttttagatacaggggaaaacaataatatgctgaaaaatcattcagaatatggcagtcatgtgccagttgacatgtgagccaagagtcagacaaaaagatatattcgatctttggtttagaagaaaattttgcagtctgagcacatgcaagttttcagataatagaaaacacacactgatgagaacaaaatgcagtttttcatttcttttgtttgatgaattagttctttaacagtccttttataaatgtatcaatggtacgacaattatgacttggaatataccaaaatatggtacatcctctaagtacttcggtactacttcggaaggtagaactaataatacatatcagtgcaatttgaatgattgcaagaagagtctacgtatacatttttttagactaagctaaatttatacagtagcaattgagagtttactcttgcatgattgaaaattttacaggttcttaccaactaaaaacaacagaaggttgagagaaattgaaagagaggtcagcaaacttctacgaggaataattggaaagagagagcgggctattaaaaatggtgaaaccagtaatggtgacttgttgggcttattggtggagtcaaatatgagggagtcaaatgggaaagcagaactaggaatgactacggacgaaattattgaggaatgcaagctattttattttgcaggaatggagacaacatcagtattgctcacttggacattaattgtgctaagtatgcacccagagtggcaagagcgagcaagagaagaagtgctacaccactttggaagaaccacaccagactatgatagcttaagtcgtctgaagattgtaagtataagatgaacactgttctcttattttgccaaatatgcaaaatgcagtctattaattaagacactaagtttgtactggatttgttttgatcagttacttatataaaatctgaaaatattgcgttgaaatgataactatttgtcaccaaaagtaacaggagcttatgccatgtattttccatatgcttctagaatgttttttttttccatacagttcagatgatgttattttaaagctttatcagttatcaccggtaataaaattgaggggggttgaattgccaatatatgtaagtgaataaaagattctgattgttagattaagcaaggatttatttgaagcaaatgcgttttaatttcagattaattaacaacagtcatgatctctgttttgttactgcaggtaacaatgattctgtacgaggttcttaggttgtatccgccagtggtgttcttgaccagacgaacatacaaggaaatggagctcggcggcatcaaatatcccgctgaagtgacccttatgttgcccattttatttattcaccatgatcccgatatttggggaaaagatgcaggtgaattcaatccagggaggtttgctgatggcatctccaacgcaacgaagtatcagacctctttctttccatttggatggggtccccgaatctgcatcggccagaactttgcactattggaagccaagatggctatctgtacaatccttcagcggttctcctttgagctttcaccatcgtacatccacgcaccattcactgtgataactctccacccacagcatggtgcacaaattaagctgaagaaaatctaaccatgctgctcacttgctcggattggtcaaggagaaacaagtcagtttgataagttatatatctttctcttttgtaaacagaggtagtctacaggtttcgtattcgaactagaaagattttacttattgatatactagcttttatgcagataaaaacatggtgagtgaaataatattccgagtttttaatacaatacaagagtgatttttaggctcttgaggatgtatcatattttatagtgtaaaatttaatctctctaatacaatgacatatgaaaaatttgcattaaaaattttaataccttttgatacctctcgaaaacagtaaaatatatcacaacacaatcattacatagtgacaccagccattgtgaaaacagagcaggtcttctaggcaccggcaggtacgtcccacaggatttccaccaaatctgcggttcgcaagaacaaaaccccttctttgtgattgcttcaagtcttcaaccaactccgctgggcttcgacagacgactcaaaggtgcgagtgtttcggtctttcaaggtcatccaactaccgagactacgagctgatcattgttcgttacccattgtaatgacacagcttatcagctgtagggcaggctcctctcttatggccaataacatgaagagtttgcatctcgctggtgcattattgtacaccgttcccactcggggccatgaagaaaatggaataagtagatgaagcagagtaaagtccccttccctaacaacacaatccgttgtgccaccctaaaggcctaaagtacccttttgaattagtacttggcccttttgaattagtacttggcaaatcattttatatttttttggaatacgcaagcagcacatcattgtattaaaaagagtaaagtttatataaaaggaaaaccgaaaaaaaaaacaggaaggggacagggtacatgagatacaaagagattagggcctaatctccaatcagattctgcgagcgggggaacatgctaggcgtggttagttctgtcatcaccgcatttgttaggcgtcatagctcagcatcagcagccataccctttgccacttcgacccagggcttgtgatgctgattgaaaaccctgttattcctctccttccaaatcgtccaggcaaccagggctgcgatggtgtcgaatccccgtcggtgagccttgtcaaccttcatgcggttatcacaaagccacaagtggaaggatgcttcattgaatggcaggaaattgggcaatctaattgctctgagggcaaaccaccaccattgccatgattccggacaagcgaccagaagattattgatagtctcgttgcattgatcacaaaagacacatcgatcaaggtgtggcaagccgcgattgtggagctgatcggccatccaacatctattgagatccaccaaccacatgaagtaacgacatcgaggaggcgccaacgacctccaaatcggcttgtcctagaactgcaccctttccagttcccacaaacagagacaggtaggcggaatatgacgagtattcccctgaagactcccaccaccagatgagggaatcgggctccttggagaggtcatccaaggagtggattgcaggccacagattgagatattcgaggattgcctagacccctaaggcactggtgatgtccttgatccatcttctatcttgtagtggcaaatcattttctggtaggtttgggagtgttgtcttgcctgaatggaatactaaatagcctaataattcgaggtacaaacaaatgtattaagtaaaagaatggtttaatgtaatattttaaataacttatatgtaacttttaaaaaaaatcacaccaatagagaacatgtatattcttattctattttattctcggggaaagaacacaccttaacagtttaggatttaagaagaccagctgaatacccgtgatatggagtacggatactcatacacttcaactatgcaaggaactgcagcagcggttgtcagcaaatagtgttctgctttcatatcagagattgagatttcagagtgccggatgcccggaacatggagcttccagtgtttatcagcaaatgtgttctgctttgatatcagagattcagaatgccggatgcacggatctatacagacgatttcatttcatttcatctttttttctttccctaacccgacgatcagagtcggcgcagcctaaccggaacgccgtgctgcgggtgcagcgtcagcacggtgtagggcgcgtgcgcgtacgccggcgacagctcgaacgcgaagcgctgcaggatcatgccgagcgccaccttggcctccagcagcgcgaagttctggccgatgcagatgcgcgggccccagctgaacgggaagaacgcgccggcgccggggtccttgcacgccctgccacgccctccgcgaacctccccgggtcgaactcgccggcgtcgtgcccccacgcggcggcgtcgcggtggatgaacagcacgggcagcgacagcatcacgcccgccgggtacctgacgccgccgagctcgatctccttgtacgtgcggcggttcatcatcaccaccggcgggtacaggcgcagcacctcgtgcagcaccatggtcacctgccaaagatcggctccatcgatcatcaaatcgtgaacatcttttgcagaaaacggtgcaaaaattgcgttacggggcagagtgcacaactcacgactttcaggcggctaacgccattgatatcaggtttgtttcgcccaaagacctgcagaatctcctccctggcgcgatcctgccactccgggtgcatgctcagggcaaccattgtccaggtgagcaacacggcggttgtctccatcccggcgaagtagaacagcttgcattcgtcgatgatctcctcgacggtcatccccttgctggatttgccgtcctcgtcgctgtaataatccatgttggattgtaggagcaagccgagcagatcgtccttgctggcttcgccgttcttcgtggccttctgcctcttttctattatgcctcttagaatactctttatctctctgtctattgccttcatccttctgttgttttctgtcggtaaaagactggagggagagtattatgttagttctatcatctatggatgaaacgaataagtggatacaaaatgaatttagtttttttctctacataaaagttggatatattcccgaaacaatgaaagttggacacaaataatggcaaatgtaaggagcactttttggtctttggtggtccatccatgtttttctcacaactattatgttgtcctgtatgtacttaattttctcttgatattgataaattcggcaaaacaaaaacaaaacaaagaaagattaggagcactctgaactttaggtagtgttttaaatatatactatgcaggtaaaagttgatggatgatccactcgtttgtaaagataaactacatattatatattataaaactaacaaataacttagaataagtggtgtcaacaatgcagtaaaagaaagtttattaagagcatttttagaagtgtgaaacaaataatccagttataaattactacttctttcaggttataaggctttctagcattaacatctatatgaatgtgggcaatgctagaaagtcttatgtagtaatatgaaacggaggaagtataatccaacagatgagttgaaaaaagaaaacggggactgaaactaaagatgttgggacagtgatgagaaccatacgataagcctgggatgtaattactccggaaagattgaacaaggcgttcagcttgctcggcctgaagtaggaaaatttgtctgccttcgtggtgtctgacaccaaatgctgctcttgaaataacatctcctgataaattctgaaaatctggccaaatgtccagctcggcttttccaacagaagcagcaaccgcattctcccatctgccaattagttcgctacaagatgcggagaatgctggcaacatccgctgcaattagttccaagggaatatataagtcagggaaaggggaaaaataccaggaaagtaagtgtaaccaaattgatctccagttctaatatgtttagttcgacctgtttagtgactgcaaagaatgcaggcattcatcagattaatttaacttctgatcaaatagctaggctaaacgatcgtcttactaaatgataattcttacacatgaaatcctgaatactaaatacagtagtcaggtctcatattcacgaattctttcagtaaatcctagtaataatacctttagcttttctgcatgaaaggctggattcataatcctcctatgtttgacccatttttcaccatgaaggatcacaagcccaccaacgagtaacttagaaagccgagtggccagctttgtcttctcaaagtgaccaaatttgttcgatagaacttcacggaccaagtccggatcagtgattgtaacccttggcattggcccgaaccatgtaaaagaaaccctacctgtat

SEQ ID NO: 51857 - DNA, 17294 bp, Oryza sativa
  unsure (1)..(17294): unsure at all n locations
atcactccacgtgacggcgccacgtagccggaggtgaggtgaggtcacagcgcgacctccgccgcattgccacggtggaggaattcagcaagacacgtgtgtgcagtatgcatgcagatgcagtacctggtaccttgtacgcgggcgaggcgtcgccggcgtcggcgtggtcgacggtgctcaggttggagatcaacgaagggggaggccgagaccggccgaacgagcaggcggggaggctgggggctgccagccggtgagcgtttgggagaaaaggcgaatggcgccggcgccgccggagagatgggaagaaattaagatggggggaggatttggaaggatctcaaacagaaaagacgtggctaacataggtgtatctcttgcaggagcgggacaacgacatggggagcatgggcgccgctgcgcatgtcgacgcgacgcaagcgggggttcacgcatcttggcgtggttctacgtgcctcgggcggtggtacacgactggcgctttgaatggaggagaggatgtatggttgcaaatcccggagataccgcaccgcgcgatagggccggaggaaggagaagctgatccaaagacagaccccccaaaatgttcagtcatcagtgggcctggaacggaaaacatcttccggcccatcaaacaccccatgttgatgcacacaggctataaccaacgaggcccatggatgcgtaaggtttagctgaagttttgatttctgggctaaaccttctgcttcagacgttctgatttctcaagctgacgctcgaacattgtgtttttttcttttaagaaaagaacatttgtgtcattttacttttttttaaaaaaaatacatacagagatgggcatgtcgcctacgtggcaccgtcccaccaccattacactgtcctccacctcactcattgcactcacagtcgtcgtccatctgacccttccctccaaaaaaaggtcggctatgaccctatccaagagctactggtgccgtcctcgaaaagccaacaagagagtggaggtagcggcacccccaagaagagtgcatgaggaagacgaggctatgtcttttctaggagttcaccgcctatgcctattcataatcttgtgtctttggttgtttcttcaacttcatgcttaggttaatggatggatggggcaactggcagaggaggcacaatgtgtggggacaggaagaatatgacttgcttggttctatgcgataccttcatgtacattttttttgttggtaccagacttgatatgcaacaactggcctcgataccttgtgggtattaggtatgataccagtatcataggtaccaggtctggtacccaaagcatcaaatctgatacctcaggtatcaactttggctcctgacaagcgtggtgatcagatacggacatgcggtaggcatgagataatgcatggtaagaaatgcgaacacgtgggtgtgtaggggagcagttgatgggggtaaagactcgtcatgataatctatcccattaagaaacatgatatcaggggctagcactcttttttttaattgagaaacacagtttatatgagcacccatgaaagtctagacctacatattttgatattaataaagttatcatgagcgactcgctaccaacgtgtgcattacctacgactaaaacaataataaccgtaagtacacttgtggacattacttcacctttagaagacttgatgtttgtcggagtgcgaaactcctctagagngaaagcaggcctccccctatatgaattcgtctagatcaagttttgagctcgggtcctgatcacacgtgagaatgagcacaaacaagtatataggttcctagttcaaaaatcaacctcaggggcaaattcgatgcttttttaaacaaaaacaaatttaaaacagtaagttcgatcgaaatttcgttgaaatctcagttttcaacgtttcgcggggttccaaattaatcaatgatagcgtgaaccgatcagagcaccccaaagcatctttaccagtaatcaggcctccaaaacctattcacgcatatgctctccctgcagcctccaagggcgattgatatggatttatctggactgttaatcacaaaagtctgcatcatcagcatgcgcatcgcctatatacgcacctactgacctgacctgcaacctaggcatgcccgggcctcatttttctatccgcgacgaatcgcgcatgcgttccctgcagatgacagcgatctcccctctcctcctccttgacgaaaaaacaccgcggccgggggcgagaccgggagagggggggttttcagttcaccggagtcaaacaccggatcagcaaaggaaataaagtttggtgccatgtcgctctcggcaaaggaaacgcttgcctcctggaaggcacgcctgccacttcgagatcaatttttaaaaaaggtgttagactacgacttatacgctgtctacgcatgtcatgtatgaacaggttaatttttcttcatagaaattttacaacaaagtcgcctcgcgtactctcaccggtaaaagagaagaccagctctagcagggtaagcgtgttttctgtgttattaatggacttgctctagatcaatctcaactttaagaggacaaaaaaaagcatatggctgcggtaatatcatagtatcatataggagtattacatcatgcaggtgtcttagctttcttatttgttgttacatgaccttgcttatgtcgacacttcagtctgttatgtcgacactttggtctaaacacatcctgtgtactgtacagcggcgaccgtcctccccccttatatgtcaataacaccttaaataacagtacatgtgaaaaaagaaagtttacaacataaaagaaaagaaaaacaaatactccatttgtttgcaaatatttgtttgtttggactaaaaccagcattttttaagtttaagataaaaagtcggcaggaaaattaaaaggggtgagctcctatataacaaatgtatttttaactattatatttgaagtaaatagctttaaaagtatattgcagactattaagaaagtaattttggttacataattatataacctaaaaatttttgttgagtacagtaatcagtttaagtcaaactaaaaaaatatttacgaggaagggagtacaaatcaaaataaaatatgcagcaataaagatgaaagccccaaaaagaaagtcttgaaaaaatgtctcaaatcaaactttaaagctctgaacatcaatatcttataaacatctaggctatggtcagtgaaaatatggatgacaatgttagaaatctagttattatttagcatattttaatccaaaaattatagcataataaatatgacataataaatatgacatgtatgcaggcgagtgatccaaagctggtgctaacattaacatgctaacagagacaatagcatctagacatatgtttaacaccagagtgaggagaacatacccgcagaacgctctggattcagaggttgtggtgttgatgttgtcgttcccgattgagccgttgccgttccctccattgctattcctgtcgcagttgtcgttgacgtcgttttcgatactgatcgacatgatccggaggttgatgtagaggaagcatatatgacttgatgccgaggaagtagtgctgatgtgaagcagaggaagaagtagagcagtcgcgcgaagaacacgctcccaaaaattttatcgcccacctaaccgtgcatgtactctggtggacggaattctggaggtctactcgtcccaaatacccgtatgcgcaagtactcagaactaggaaacaaccataggagcacataagcagaggaggtgtctacacaagaagaaccaaaaactgaggtagatagaaccgagagagactctctatctacctagaggtggaagataacgcaagagaaacattactacgttaatctcgattgattgcactataggcctcgtctgttaccggagtaatgaatcatgccggttatgcttttactcataaaaacaaaacggctgaaaacgagcagcccgtccgaacccgccgctttgacgccctgctggcttggcttggctcgagcgcacgcgtgtgacattcccaccaccatctcaaccgctcagtaggtattctctagtagtctatttaagttaagatcatttttcattggtttttaatgtggtattaatctcttaacattaattgtgagcccttgaaattacaagaattaatttgggcctatcccatttaattctaatagataagacggagatacataaataaagaaaaaacaatttatatgtaaaacattttatatgtgtattatcagtttaaaagtcaaggctaaaaactataatatggtgaaaataattcaaaaatcctattgtagaattgtgttttatattaaatatttagttgtgtccgataagtaaggcttagattggatgtgcaaaaattatatgcgtagatttatcttgaatagtacttttatggtgctataaattatatgtagattttaaatagtttgtaataataatatgtggtgaaagttttattttaaataccatggaatgtttattctttcatgaacggatggagcaactggctagataatatttttatataagtatcaaaaaaggagttgaaaaatgtgtggtaaggctcatgctcgtaacttggctagataactgttccaagtgtttgatactttgattgctcctagtattaatctaatacactcctcaccacctgcaaaatacagtcaaaacgctagtgatgatctcctaatggcccgattagtcgtcacaggtcaaccatttggtaccttattatgtaacaagcatagtggcccgcgcagattgcgcggctagcatcattatattttctctcatataatagcatatatgttttctcattatattattcaaatatattaaaatgacaacataattttaaattttgcaataactttacaaaactactaatgtgtaatatttatattatattttatatacgtgttagttattaattatttttaatattaaattttagttatttgtaaattatatatattcctatatggactctagactcgtcttttaatatttctttttttaattccgaattttctgtaaattgtatttttatatagagtctatgctcttcttccaatattatttatttttatttatgaatttttattatttctaattgtatttctatgtggactctaaactcatctttcaatattctttaatttttaatttcgaatttcagttgcttctaaattatattccaatatttgtattcctatattgaccttaaattcttcttccaatgtttttcttaattttgaattttagttatttgtaaattgtatttttatacagactctaaactctacttttaattttattatgtttattccaaattttagttagtttgaaattcctatatggactctatactctacttctaatattccttatttttttaattccgaatttctatttttttttctaaattgtatttctatatatactctatactttacttctaatattccttatttttaattccgaatttatattatttcctaattgtatttctatatgtactctatattctacttctaatattccttatttttaattccgaatttcagttatttcctaattgtatttctatatgaactctatactctacttctaatatttcttttttttaattctgaatttcagttatttcctaattgtatttctatatggactctagtctcctcttctaatattcctttttttcattccgaatttcagttatttcctaattgtatttctatatagacagactctagtctcctcttctaatattcctttttttaattctgaatttcaactatttctaaattgtatttctatatggactctagtctcctcttctaatattccttattttttaattccgaatttcagctatatttaaattgtatttctatatggactctgtcttttctttttctccgattaatgtgagaatttctaggccatgagagcgaacttggaggttcctttttctattcctttaattatatatttaattccaaatttctttctaaattgtatttctatatggactctagtctcctcttctaatatttcttatttttaattccgaatttcagctatttttaaattgtatttctatatggactctgtattttctttttctccgattaatgtgagaatttctaggccatgagagcgaacgtggaggctcctttttctattccttaaattatatatttaattctgaatttctattttttcctaattgtatttctatatggactatatagtctacttctaatattccttatttttaattccgaatttcagttatttcctaattgtatttctatatggagtctatactctacttctaatatttcttatttttaattccgaatttcaggtattttctaattgtatttctatatggactctagtcccctcttctaatattccttattttttaattccgaatttcagctatttgtaaattgtatttctatatggactctagtcccctcttctaatattccttattttttaattccgaatttcagctatttgtaaattgtatttctatatggactctgctttttctttttctctgattaatgtgagaatttctaggccatgagagcgaacgtggaggctcctttttctattccttaaattatatatttaattccgaatttctattttttcctaattgtatttctatatggactctatagtctacttctaatattccttatttttaattccgaatttcagttatttcctaattgtatttttatatggactctagtcccctcttctaatattccttattttttaattccgaatttcagctatttgtaaattgtatttctatatggactctgttttttctttttctccgattaatgtgagaatttctaggccatgagagcgaacgtggaggctcctttttctattcctttaattatataatagatttccagatattcttttacccccaaattccaagtagtaacagagaaagaggggcaaagctagtacaaattacaaaagcaatagcacttgagagaaaaagaaggggagaaaaagtaaacacacatccacccagctagtgcttaaccccattgtgtgtatggattcagtgcagcagctgcaggccaagcaggcagcacagcactacacatacaaggcacacacatcccatgctactagtgctgttgcccttttgctcctgttgtcttctccgctcctgtcgtctcctctcctcccccccaaatccccctcctttttcttggtgctgctgctgctgcacgaagccacgagcgcctcgccacctcgggatcgcctccaagatccgattttgatctccccgccgccgacgaattcgtcgagacccgccctcgccgtacctgcccaacggtgctcgatttggttgtagccttctggttctggtacttggctccatggacctatctttgatcttattatgattcttattacggttttaatcttctatatatatcggttgtggcttgtaattgggggaatagggggatcgtattagaacagtgaaagtttggaaaaattttccatggtttgtgtgtgcttaccaatcaaggaggcagttggaggcaagcctgttgttttcttgattggacactaaaagccggttcttgcttttaactgtgttggagttttattaaggatgttttctgttggtatttaatgaagtcgatttggtattcaacagtaacttaaacactaatcacgatccacttatctaatctcgtgtagaactctgctccccggctctgggaattagttttcccacgagaacaaatatatagttgaaggtagcacgaatggattgggtctaccactaccaccaaacagatgacatgcttgaagttgtatatactagttagcactgtattttctctatccttctgttggtatttttacgtgttgataacaaattcacaatcagcaggattgcaggaatataacaaaacttaagcactgagcagcagtatgccttggacccctttgtactcgacttattacagcagccgaaagtctgttcaccttgctgtgtttttccgtgtgattgtgtatgtctcttgatctcctgaaacctttcatattcatgataatagaatctcataattctcactgaatttttaattttccatgcattgcaggtgaggcggtcacatttacaggagaatccttttcctttgtggttctttgttcttgacgacattgggtgtgtaaaaattgagaatgtatgttaaggttgaacttaagagattccgcattgtgaaggaggtgggaacaatagtaatgaatgttaggatctttgcttattaccagttgatgcaagtgtgccaggtgagatatttatttgttgacctaaagaatcctgtttccaaaatgattcatagctgttgctaaacaaaaaatgagaatcaggtgtcatttttcatggaaacattcttggtactttgtttgggattttcacaataatctcgtatagtgaaaagtaccacccatcaactatctacacctatgtaactgtttgagatctttctattatagcatagctaattaatttagttgggttttggaatgcatattgtataggtgatctggtcatgttctcattgttaacctgtaatcctggaccatgtagtgctattgcagatgaaatttaaaatgatgtggggtttcagtctcttcccttccctgtccctcccccagtgaccctgatattcttgagttatgctagaaagttttgattgatcaatcattatttcttttcatgaaattgaacggtgttatcgataaatgattatttgattaccataaatagatattttgttgttttgtcctcaagactttttacatgatttgctaatgcatacctgaatcaaataatacatatacttatcagttcactttattttttagtataaatttattaagttattcaggcatctttgtataccttattttactatgtgtctcttctgtattttaacaaaatattctaaattgcaggctgagtacttccgtcaattgcttaagcctgtcacgtagtccaaatacaggagtcgagattagtcactttatctgctatttatctttcgtctggtataaagtcgcaacaacaaaagcagtgcattcatgatggctaccttgtggtagggtgtttagtctcttgttgttgcgagtcgcaaacatattgtagaattctcgttgtttttgggtagtgtagctactacatcagatcaggtagaggtctgtacttaagtgcgttctgtccagtatcagccattgactcatgcagagggatccaacagcattcactggaaacccttcctttgcttatggacatgaagcagatggttatatcgcaaatggacccttgggtggtcagtgcaactacagggttcctgtttcacctgcctttggtgccccttcaggcatgaccagtcctcaactccgaacctcactcggtggatttgagtttcagccttccaaggtatgccccagaaacttcatcatctttgatcaaactgatgacaaagggcgcatcatgtgtcatcctgcattggtgagcaagctaaacccttcagccaccaatgctttcccttcctatcccgagccaatttgcagaagttccggccaagataacggaaacctggaagaagtttcctcatctttcaaggaggatacaagagagattgatgcactgctaagctctgatgaagaaagcgatgaagatgatgtcaagagtactgggcgtactccggactgcttcgagagtgattcccttgattcatcttcaccaccaaggtctaggaaaatgcatcattcttctagccagagttcagtcttccatggatccatggacactgttactcatgagaggatgagaaatatggtcacagttcttaggggaataatccctggtggagaccaattggatacagcctctgtcattgaagaagctgttagatacctgaagtttctcaagatggaggcgaagaaacttggcgtggaggtttcggataactagaactggcaactggtacagtggcgatactaaagctcacacataaataaaatctgaaggcatcaatgtgtgtatatatggtctttggtaaggcccttatcatcattgttacttgattgactttgtgtgggtgtggaaggtaaggcaggcagccagcttttgcttctttctgcaggcctcaaaagaggtattgtttgtgggattctgatgcttgatgtctggtagcatggtgttgctgcgctgtgagctttccctccctcatcatggtgtggcactatggttagatcgtcagacgaagttctggatgatgcattatgttttcaggcttacctttgccttttgtgacttaagcacctcagctctacctatcctatggtcagatcaccgtgctttgctctttttcaagctctgcttatatttgttgcactacttaaataatgtacatacttggcttgttaaattgtagtattgtgtaccgaacaagatcatgtcattgtgaactaaattacgatatgaaataatgtactttggatttatcatactatttgtcaagaggaatctgtctcattttatttgctttggaaatgatgatgatgatggttctcaccatcgaattaagcaaagggagatgattgtgatgatggtgtccaagagatagcacgacatttgtgcattcatttattccctgtgcttttttctgaaagctatgaaagcgaatcgggcattggcacaaacgtgcaatcttttgcaaaggccaattatgttgaactaaaggttggtgtttcccatgcttttgccttcagttggcttggctattgaagtggaagaagtttgttcaacattgccatgcagaaaatattcttatagtatatcagtatatgtatgcgtgttgtgtgtatgcatatatagtggcatatgttcagtaatcgaaaaaagaaagatgtgtgttcctaaaatagtggacatagcccctatcaagaaaaaaaagaagtggatatagctttcatatgaatgtcttcttttttcaattttgaactttttgtcgagtaagcgtgcataatattttttttccttaaaatgaggcttgaatttttgttaaggttatttatcatagaaggaagccattgttaccatataccagtggttctaattcaaagttttacaaactgagggatggactattagaaaagagaaaattccttatatatctctaaaatatttagccgatatattccagagttttgctcactcttgtatgcctttcacttttgactttattctttttcataccatttctatcaattaactattagttgaccgtttaatgtgtgaacaagttggttataccattggacatgaaggaacgtggaaatttattggcatccatcgttggaaatatttatggtaatttgttgtgtgactaatattctttaactttgttgtataacggattattatatgtggaaagaatattatgtattaaaaaaatgcatgtgtggcatttttcaatatgtaaacgtaacagttagtttctattcgaaaatatataataagtagaataataaatattgaaatttttttgccattatataaaagataaaaaaaacttgccactaataaaaccctacacaaaaacgcgaatattagggaataacctaatatccaataattagaaaaggtgagacttcaaacccaaatcgactagcgcaagagctgcctgaaggccctagatgtttctcaataaaaccccacacaacaaaatcataaatatagtagtctcatagaacaaactcctgcacacttccaataatatactttacagatttctatattcatttcataactatggacaaatttagccttttcatagctattacctagtcagctaatagacaactggtgaaatgggcataaagtagatcaaaaccaaattcgaggccataaagtgagcgagcaaaactcagaaatatataagagatcttctggaatttaggagccataaaagaaattttctcatcagaaaatgaggtcacaccatgttcttggtttgtacgccctgcttggagttccctgagaaacatgttccctttttcatcacttcctcatctttctttacccatttcatttcggtttattactatatctcacaagggcttaaggtcgctgcaaactcatgattgacgttgacatttgtaatcttgagttggtgtcgggcccagctggcctactcttcagcttcctatagacttctacacgacgagcaagcctaacatcctaattcgttttacagcttacaagcccgtttatcggcccacaagttttgtcacgttgcttactggcttaacctgccacatttaggaaaaagtacaccgaaggtccctcaacttatcatcgggataaaaaacgtcctcgaaccgcaaaacctgatatgcgaggtcccttaactatacaaaaccggtcacccgaggtccttcggcggttttgaccctagttttggtctacgtggcggcggaggcagtgtgggacccacgtgggccccacatttcaggtgtccacgtcacctctctctttcccctttcttttttctcttatttttttacttctcgttccttgctaatcacccgcccgcgcgctcgcccgcctgccaccaccgctgctccgcgcgctcgcacgccgccttcgccggccgccgctcgctcgttcgccgtgaccagcgcgaagctgatgtcaccgccaccgcgtacgcgcggccgcgccaccgtagcgtgttcccctcggccacgcacaccatcaccttctcgcataccaggttctccagacccggcgcccccgccgcggtcgggttcatctgggggtcatccgcgccgtccgccgcgtcggggcacacgaactcccatagccccttctgctccccatgtcgccgccttgccgccgatgggctccttgccccagaaccacgggtggatcatcacgatgccctttaggcggcacgagaggtgttggctggtcaggccgtggcacatgacaaggtgatggtagatgttgtcgctggcgctgtcgcccgcgaggaagacacgggagagggggccgtgcgcagcgagccacgggtcggcgacggagagcacccaggcgagtgctgcggtggagtcctcgtacgcggccgggagcgggtgctccagggtgaggcggtagcaacggagacggtgacggcagggcaggcggcggcaaggtcgttgaggcagcggcgatatccgggcgacgcagccgacccgatcacgaaccccccgccatggaagtagaccaccacggggagtctcttgtctccggcagcgggcggcgggaggtagagccgcacgaaggaggaggcggagaggtgcacgtccctggacaccatcactcttgcagcatgcaatccatatggctcgcgaggaggtgcttggcatggtggtcgagatccaggagcggcacgacgcgcctccacctccagatgtcgacgttgaccgccgcccgccgcctccattgcctctccacccgcggctctgccctcaccaccccacgtatcctcgctcacctcaccgccgccagagtccatgccggtgagctcgcaaaagcaccgccttcttcctttgcaccctcggtcggagcagccgccacagcaccggccatcgcaggcaaccggacctcctctcccgactcgccccaccggcctcctccgcacctgtcggtcgaccgtcggcctgctgagagtccctgacaagaaagtgttggagaggagaaagggagagaagatgggaaagagagagatgacatgaccagtctgacatgtggggcccacgtgggtcccacgttgactcagccgccacgtagactaaaaccggggtcgaaactaccgaaggacctcgggtgaccggttttgtatagttaagggacaccgtatatctagttttgcggttcgaggacgtttttatatcccgataacaaattgagggaccttcggtgtactttttccccacatttatggcctattttcgtatcagaaaagaagttcagaaagggccgcccggtccacattgaagagcatgaacttttaccaagaagaagaagaagaagaaggaggaggaggaggaggaggaggaggaggaaagctgcgtctacaaataggtttcctgtagtcaattagatcaaacattttgtgggtaacatttccctgtaattttctctctctggataaaaacacaccttggtcgctgggacacctttgcttggcgaaatagcagatattgaagaacatgcacctcgtctcgacgttggtagcttcttagcttctctagtccaaagtcaaggggatttaccaagaatttgtaagaacacagtgtgatgtagatggacttaaagcatgaggctgttatgacatgacgccaggatcatgttcgtgttacaatcaggaccatgatatcatccgtccggccacgccacaccatgttacatacagtatgtgtttgttcaaaacccctcaatatttagtagctcccaacatcaataaccaacgtacctttttattaatggagtgaaatacattacacgttacattatattatcatttagatctgtgaatgcaaaatacacatttaaattcattatcttgatttgatcaaagcgtatcgacttgcacctccacgttggcaaatgttttgcgtttggcccccttcacagctaaccatggcagaaaaaataaattcacacccttcctgctacagtttagcttttttccttctccttttcgctcattgttcctttcttttctttctcttttttttggtcttcttccactgtaacaaccgtcgtcgaggtcgtagtgtccactaccacgcactcgagaggaaagggacgctgacgaatggcttaggtcttcgccacctccttcgcaagaagggaataatgcctggtgttgccaaagcgtggacaacagaggcatatggacctggaggccactggagccacgctctaggaatacattcctactccacccgttgactgctttacccagtatctcgaccccattctagcacctccaacacacctgctctatttatttcgccacctcttctattgctcctcgaagtccagctggcaacgtgcttgcatagacccatatggaacgagccaacggcaggtattggtggtgatggggatttactgcatccgcgctgcggcttggcgaatgtttcgtaactaactagtggaggcttaaaaggtgagagaaggggtagtgtacagaagatgctcgataaaatgcgcaaaataactcaagcttggtatcgtgcgtattcaagcaacagtgccagggtgcctccatcgacagcgtggtcttctccttgaccttcggtgccacctcattgtcgcatcatgcctccgcaaccttcaacaccacagtatcccaaggctttacatgtgaaaggagctgcaggaggaggctaatcgccgtcaggattgagctcccccttcaccatcccctttgctccaccattgttgccgtcagggtcaagctccaccatccccataccgctctgctccaccaccaatgtgtgaaggggaagttgctgccggagttccatgacagtggtgagctcggtctaattgcaatgtcagtgtttgctacgcgttgagctctcccgcacctttatgaaggaattagagaaaataaaaggaatatcaaatagaagaaagaagaaaaggaatagggtgaaaaaaaaagaacgcaaaatacatttacttcccattgcactgtagtgggaagggggcaaatgcatttttttctgccacggtgtgttgtggagagggttgaacgtaaaatgcttgccaacatggagcgccatgtcgccaatcatatccggtcaactgagatttagacctattgtgatacattaaactaacataatagacctaaatgtgcattttgtagattcatgaacctaagtgacagcaccgtaacttgaatgaccttagaatatatacttgccttgcttgccttcctatcagtacctccgagagactgacgatagtattgattgaataattatagacaacttactgttgatcaacaacacattgtctaagattgaatgaaacactcgtggcttgctagctcgtttgacctcttgggatttgttgactagcaaagataaagttttaacctgttaagtagataccaaaatgaacgaaagaaagcagcccaaggagaagaaaaagacatctctaaccctaaaactcctctccctattccatggaaacgtctccccactccccagctcccctctcctctcgttgtctcgctctcgcacggctaacgggtattggccaagtcaaggagtcacgacactgccctaggccacagttggctaccccactcccagcctctatctcgccacttactactttccatccccttctccacatatttgccattaacaacaccagatactagcagtgtcacgggctcgcgacaaaagccctagctggacgcctactccgcctcagcctcaccaatcaccagtcactatcatcttcgttggtcgccacccatagaattatagtagcactagtcacttgctagatttgtgggctcatgacaccacccagcccactgccagtagtcagactccacactttaccttgctgtctctagtcgccatcccctacaacacttcactcaatattttattgctcttgctcacaagctaattgacctaaaaaatgagccaagcaagcttagcttgttaggataaacagtcaaaccgaggcagaccaagctaagctggctcgatatctaaccttatcattgtccgtcactaaatagttataaatctgagcatccacatgagtcaaagacttaactcgagcagacagattagaaatctaatcaacttatagctacaccaagtttgcctctttgcgatcttcatcttaccgagataaaatagtatcctagagttttcactcagtattggaaggttctataaatacccttgagttctatatatattgcctatccaaataaaaacagaaacgcaacagtttgaattataattgctacaacaaagttagtatagtacatatgt

SEQ ID NO: 51858 - DNA, 11062 bp, Oryza sativa
ctaatttccatcgctcgctactgctaccgtccaaagtccaaacacgatacatatacaccgaattctgaaagggaggtgcacctataaatgtgcaaaaccgttgctatcaaaaggagaaattcgcaaagcggtaactctcaaggagtcgcattctcgaaccacaatatccagcagggtaaatgtttggtaattggtactggtcacttcaagggattctagttaaccacatgtgcttaaatattgttgcagcttccaggaaacatcacgtccgaccacattatcctcaaaagtttggttcgcaagatcttgtcttccccctttttccgttcactgatcctgaaacagagcatgaaagtctacttcaggacctgcaaaaacacggttattcatttttctccctttaataagcacaaacagaaaaccatcttaaccaattatatttatatgtcccgaactgcccaaaacatcgaacagagttatcatggagatatgattattgaaccatatgtgatgaagctttaggctgagttctttctcgattattcgtcggacggactatttgctacattttttgatatatatatatatatatatatatatatatatatatgctaaagataatttgcttccacttaaatgcataggcaacttattttaagctatttgctactttatttcttaaataattaacttatctatataatatattagacaatccgtagcaacaatccgctcaataatctgtgattattcaggaaacagtagcaggtgtgttggcttgatttcttcttttttctaattttcatatggctattggttttactccttccggtccttccggttccatattaattgatattttagacaaggctaagatcaaacttttataactttgaccatcaataactttaaaaatatttagtttaaaggaactagagcaacatatatagatttgtcttttaaagcactataataaaaataaacatgtatttatttattatatatattataataaaaaaataaggtcaaagatatatctggtagactgtgtccattgtttaaaacgtcaattaaaataaaatcagagatagcagttacttttgtaaggtatatcggttatattaaaacctactgggaatttgcgagctgagtgcgcttcggagcggcgtgttcgcacgcggaggcatccacgtcgcccgcgagcgctgggaggcgggtggattccgcgccccctcgagcgtccgcgcgagcggctcccgcgccgtccgatccctcacagcaacggctgagatcgcacgtggttcctagcgtgggtggacatttttcaaaaagacccattcttaatagataatttgttttatatccctcaccgtacgatccaacgttccgatttcttacgtatatactctccaaaactaggaaaatcctatgcgacgaagagaaaaacacgaaataggattgcgctctaaaaaagaaaagtcaaggggcttttctgaaacaacataaatccctacccctttcggcccttcctccccgaaaccctagccgccaccactcccgtgacggtgcgtcgcttccccctcctcgcgccgcctctccccgccacaccgacaccctgcgcagttgcgccgccgctccatcctccagcacctaacctcgccccgacaccgccacatgcttcgccgcatgtcctccacttcctctctcttcttgctgccgatgccgctgggctcgagctagcgagtaggtcgatctggctttcaatcaggttaggtctccgtccttagcaccacctcgtcggcgatttaccttcgccacaatccaagccccacgctgccttcagatctggtggcatctaccttgcagcggccagatctggcgaagagaggaggagcgcatggcggagcgggcctgaagtgtgtagctggcaacgtccccggtgtggtggtggttcactggttcaggtggacaatgcctcgagcttgctagaaatggcgttggcatggagttctccaaggtgaggtggcgaggtatatgtctggcggtgcatggcttgattttcgagtgatgtgggtgctccataagcagtggcaaagctcctatttttttctggccaccagatggaggaggagttgtctcccatcgcctagccgttctctggatgcagcaagccatctcccattagtatctgatttttgccgttctctggatgcagcaagccatcttccattggtatctgattttcgtttgtattccccacaaaaatttgaggtgtttgttttgtgtggtgtcctgcctacaaggtgttcgttgttttccctacaagcatgggaatgtggcaatcttacatgacctgttagtgtgtaagcctgaatggtttgttgggctttagatttggatcctagcttccacttaatttgccctaaacatttgaacctaccttaatgttagcagttaaaatatctaatgaaatgcatcattgaaaatattcatttgtagttagctctgtagatgcatgcatttcatatagataatgattgctgataactgcttcttttgctagaatatttatgtgactacctaaatagctaacaaacttctccaattataatcagtcattgcttgtccctgtgattcataaatctgtatggttcttgtgattcctgattgagttttcaaggaaaatactaacattaggtggggaatactgtgcaaatgattctgtcacagctgaaagacactctaaaaaacctctcatgtatttcacatttgaatgcaccattcaggtgggaaggagattacacattggtgatggcacaaagccacgggcagaacaactctcttgcgtgctcgagaaaaaagccagcggcagaaatgccatctttgttcattttattttcctttttttagttagtttgattagattaaggtgcttaacgagctggatttgctgttaaattttaaatgatttaaacagcgggccatgggttcactatttgctagaggtgttcgcatcgtttaattcttacatgcattccttggggtcctacatctacaatcctggttgcctttctaatttgagataatacaaagcatgtacagcctatatggctctatcggttttctgatcacaaaatttgtctgtatacatctattagttttctgatcacaaaatttttgttacaacattgaaaatgctggtctatctatgattagaaactttgctggttatttctgtgtataactgcaatatgatgttatctatatttgcgatacaattctgcaaattgctgattacagaagttgtcttgcaagagttgaaaaggacatgtttatgtgcttagatgttattctggttgcttgatctggcatcctgtcataatttgtttctaacactatcagaacaaaaggatagaatatatgttgcctaaatgctgtaattttcatggaaagaagcttgatgatattgccacctcatcccacaactatcatgtaagctatattggttgtatagaaaaccaagcatttgagaattttttttattgtcaaagattcaaaagccttgccaacccttggtattgtttgtattttctgtatttggtctatttggtagttaagaaattccctacaagtctgatttgatactttataaattcattctcttgcagtcctggagcattgttctgcttgacgggtggacagggataagtgtggccttttgttctgtagctgaaaaagtggaagctatgtaaggaatgttagctagcatatgatcagagtgatctaaggtttcagtctgttggataggattgtgttggcttaatgtttaagcttttgggtataggtggagatctcttagtagctttcttttaagctggtaacccccaagccttttgtcttctgaaaacatctctatgaaaatatttacagtttgtagttcagtaaagcaattgatcaacatgagtattatattttgatatgcgaatgttgttctcacaaaagaaaagtgttaattttgtcgttctaattctatagttaaaacgactgcaattcatgaattaattggttgtacccaattactacacaaaattgatcttcgatagggcgcacaacgtgcgccaaaatgtctagtactatgtaactattccatggttgtatgcaaagacgagggacggtagcagaagcaccgatgatcaagatgacaatgggaaatccctcgccaaacaatacatccccgtcgccgccaactacagtgatggggaacttttttgttatccccgcctccacacggaaaattaatcaccgcagatcgcccatccccatttttaaaatcatttacatatcaatagcatattcttttaacatgaaaagtgtccgtccactgatcatgttacgattaaacctttggacatacataatttgcattggatttagacccttatacccgctaatcaggtcttcacagggaacggggacgacgagggacaaaggatcatccccaccgtacccctcgccacacccaacagggacaacccctagacccgacggggacatatttccaccattccgtgttctctaataagagaattccctacagaaaaaagggaagagagccccatttcgatacctatataccgacggtagtgtgatgaagttatatgggtataactatattcaccggggctcaaattctgatacctaccgatattacatacatacacatatacacacacgtaggtatactttcaatgggatcttagtgagctcggcgatttgccggccatttacatctatctatttgagctcgtgttagggagacacgttcgtaaatatgtaagtatggtatgtatgttatcttttacgtaataaaaaaagtccaatgaaggataaaagaaaagtaaatatattactagtcgtaaaaagtaattatcattcaaagatctgtaaaattatatacatatgtgcgcatgtgacaagctgcctttttttttgaatgtttcattactcagccacttcttataagagtgaggatatgacaattttggaatcaaaattagcttggttaataatttaaaatactgccaaagcagtgtaaaacctggcctcttaaccaattcatgtgaagtgaattagaggtctataagtgttacgtacttgctttgcaggagaaatatacaagtaaaacacaagaacttgctatagccaactgtcctttcagtctttcaccatgaaaatgagtgttcacccaatcacccatatattctctagtacatgtcattagttttttatatcttcagagggatcttcacggacacttaatgatgcggtgaggccactaatcttcaattagaagatccagtcatccaatgcatgcatgcttaatgcattccaagctaggtaagttctagcattcataccccgagccgcacgcaaatgtaagtaatataagacatctctaacccagaaactatcaaatagtttctatagttgtcatatcgatcgtataaacactatatatagagactatatatccaatgaattatatcttcaaaattaaattatcatcctatcacaactcttctctatccttttatctatatatccccttattttctttcttgcttcttgtgtagagatggttttcttacctgagaaatgttttcttcatctttttacctctttcctcattatttttcttgtcacatcagattttttttacttatgtggcaatgtattaaatgttatggacactagatgacatagggttgatgatggtctaatatgttgtcttatgatagaaaattaatgtgtcatttggtgtcaaaacaaaagtttcaattaaaatatttataattctaggacaatctatctatctattaacttattaaggtaatagaaaaaagcgcttccaaattcactctcatgacctaaaatttcttatagtaatcagaaaaaaaaggaaaaaaatagagtccatataaaatataatttaaaaatagattaaatttgggattttaaaaataatactcaatttattccaaaatataaggcacaaccacccttaactcaaagaccacgaaataattattatcatcttgtagtttggatcatcctcataaatataatgcatgcatccaatagaattagagataacataagagtggaggattttaaaaggttataatttaatgaagaagatgtcatagttaattgcatgcttgcttccatgccttatattatggaacatctaagaaaagtggttatgccttatattatggaatggagggagtaaaatattgaaagaggagactagagtccatacatatatacaattatagagctaattgaaatttggaatttaaaaaaaaaatagaaaattaaaactagatgttagagtccatacataagtacaaaatacctaaaattcgaaattaaaaaaataaagaatattggaaaaaaattatatagtccagaataaaatttagaaataactgaaattttgaattaaaaatatggatgatggaaagaagagtgttgaaattcggaattagaaaataagaaaattaaaagtagattttagagtagacaggagttttacgtgataataatagagataacatataagatagctaggtaacaaaactcagatttgacaattttcgtcctagagtctgcagtcaaaagcttaagttatagaggtgcatttgacaatttccgtccaacgaccaagtatcacaattcgatggctgactaaaaccgcgcgcgcttcctccacgaatcacgaccagcagtaatttctattgcagtaggccaccgtaccatgcacagcacatgtaggaattatagcgttttacttccacatatgcatgagacagactctcctctcagttcttggagaatcctcccacagtggctgcacgatcagaagatccaacttttctagaaaacgcccaaaattgcgtgcaaatggctacttgcaaccttttgttggtcctaggaagaacgtccttcttggtgcatgcgtgacaaaatgattgattgatttgttcacgcccacgtactggccgtagctactagagtagcagctagctagccgcggacctcccttttcacgaactaatttccttgtccttagagtcggcaagaaatcgatcagatcatccacactagctgggcggtaatgagaatctcatcgatcgcacgttcagccagcaccaaggccttgtaggttgtagccactcaagttaattagctgaaacggagcagagtcaaaatttgactctctggctcgtgtagcttttgataaggaggttttactttctaattccaagccttgatcatcagttcatcacaaccataaaatgagtgaacgcttatatggctgctatttatggtatactaatgaaagataagcccttctgcgtgtgcccgcagtgttatgttgtgtaaccgaattgctttcttctaattgaatgatgtgcaattgttctgtgtgttcgaaaaaaataatcaaaggtaatggcagaaggaagacggaacaataacaccacatatgaacatctaatagtgtgccgcctaaaaaatataatttacacggaaggccatctaagatacgtccccatgtaaatatagatatttttctagtcggcacttcaatgaaaccgtctgcgtgcgggtggctgcttaaggtagccgctcgggtaaattgaaacaatcttcacgtgcggcggttgtcagtggtcacccgcgtttttatgtttacacgaatggctctctgaccctttgacacaagagatatcatcattcgtaaccataaaacatgcattttgtattttcatccacttgggaaattaatcgtgagggacctgcaaaaacttttttttgaagtagtgggagctagcacactggtgttgagaggtgtcctaggagaaactggagctcgagctagtaacaatcaacaagcctatgttagatatgaatataatcaaaactgaattacggaataatcaaaaccgaattgaaagtcgattatatggagatttgagatagatatatatttgcaaacatcgaaaaaggcaagatactaaagcactttcaatatctaagaacctgaaagatgaagctatccctgaagtgacctgaaagatgaacatgaaagacgaattacctccttgacaaataaaaaatagaggggtccacttgttagttctatctcttctttcggtcaccatatggcagttcaatcagcactaaaaaaagtacaaaaaggtagagcccacatgtggtgattgagagaagaggcagaactaacaagtgggcccccactattttttattttgttgactaccacgtgtgtgctacatagaatcaaaaccgttctggattcggtcaaggggtaattcgtccggtatgaaaagttaagagtgaagaatatctatttttaaattgagggggataatacgtactgttacaatagtttgagaggtagagagaggggtaattcagatttgtttttttcccttaattaatctctacatttaatttgtgacttgtcattcctggatcaagttctagagttacaatgttccatgaagatattataggcttaagggaaaattaacatgtactcccttcgtcccaaaatatagtaacctaggatgggatgaaatctatcctaggacaacgaatctggatatgtcttatcccattctaggttgttatatttttaggacggagagagcaacaaggtatttgtacttctatatcttgtattgcactttattatgtattagtgtgccactatcgaggagtttgaggataacaactggacttgaccagggcttgagaaaatactaggtccgttaacgcagacatacacaaaggctgatagctacttaaggccatttacaacccaataactaggatggtgtccataacattaaataagctgccacctaggatgaaaaatgatgtggcaagtgaataaatgaggaaagagaaggaaactatatcttgcatgagacatgacttctacacaatatccaaaacatcatgtgagataagtagcattaaatttaaatataggataattatgtttacattggaagagtagtgtctagtaggagtagtagtttcttaatgatgtggagtttatgaaaactatgtctagtgtcttgggttgagaatggccttagtgatcctgtccttgctatatattataggattggcaataattaacagccattctttttcctctcttcttcttttagatattttctttttttatttcaagaacgttagttgagctagcatgcgtcctttttttaaaaaaaaataatcaagatcttctctcttgcatgctgtccttaattaagagaagaaaataattgagcatatgaattgacttgttagttttaatttacttgattctccaaagctacctaccaattctatttctacacctgaccgtcaacagtattgatagtcgtcagcaactaactactaatttgccccatatatatatatttatatatatgcttgcacgagggataaccggaaaagaagagtttggtcaaatatgacggcagagggaataaaaatgatggcactagactgtcaaaactaaggaattattcagctatatcgagaggaaaccgagacatgctcgtatctgcaatccgtttaaaaggtgcaacttttgcgtggcaaagatacaaaatacatgtgtgtgctgaaggagatcgagcctttttatcattccatgcatgcatgcgtgaaaggattagaaaatacaccatctgtgcactcccaaagcatgtcgtgagggcaagtattttgcacgtctccttcacattttgtgcagataaaatttcgtaaataaacttataatcaaagtggattcactcataaagagaaaacgtatgcacgctagtaaagactaatcttgaagaagtatttatgcttgccctccgtcctgtaactgaaaacttactggtactccggcacttgcaatattaattaatactagtatatatgcggatttatcgtgtacatctaaaaacttgcggtcacaaccatatccatcagaccaccgtacgtacacatatattatctcagttttataatatatgatgtcgttcatttttttaactaacatttaatcattaatcgttttaatcaaaatttttgtgtaaatataaaaaaattaagtcatacatacgtaaagaatttttaacgataaatcaagtcaaagtaaaataaataatagttatatattttttaataagataaatgatcaagcatacgttaaaaaaattcaacggcaccatatcttagaaaaacgaagggggtacatcttggggaattaatatatcgatcatgatcattcatagaacatataaggccagataaaacatcagattcaacacatgttttgattagataccatacaagaatgtgaaaaaagaagaaataataaatgtgttatgttgaactgaataacaaatagctagcgatagacatagatctaacgcaaaaccggcctgctgcaggtactagctagctaatcgaatatgagaacaacagtattaattatcatttacttattcttgtgtcaaaatcccaatattacggccatctgctaccaaacaaaacaagcaaaccatgcatcatgataaggctatcttatggacactaccacaagaaaccggccagttcagtgtatcaatgtccaaagcaatcagaactctctcttttgcaccgtcattgtgtattaattccagatttatacatatatgtaggcacaaaagaaactacacacccgtcattaatttgtacaatctaacaaccaaaagcgggtcgatcatgtataataagttggcatcttctttgattgtcaaaagcgaaaatgtgagacgaaatattaattaatttgctctctccgaaaatgagtcaatgaggtacacatgatatacactagtacatgcatgtacaataagtctagaggtgcagaacagtaaagggctatgctgaagaatcaagtggaatgcagccgttctacgtt

SEQ ID NO: 51859 - DNA, 1016 bp, Oryza sativa
aatgtggcttctctattgatatccttgagtgtttgaattatgatgtcacccctgatcataggatcttcgactttagctggaaacatctttgtacaagcttcaacatcacgctccacaagttgattgttcaaatagcagaactccaataatctccatccgaaactgacagttctccttgacagcatccttataccaagaactatgtcactcagtataatgtcagatgcagtctctccattgctttgggaactggacataacttgaaacccatgaagcaaagatggcaacaatgagtcatacaatcttggaagagtgttcagtagttcctcaactccatagctgcaaattaagtggtagataagcatcattgcctattaagggaacagcgaacaaatattgtgttggatgagtagaagcgcacctcgtctcaaaagaggtacaaaataataaagcagcaggttgataagcatcgacaaaggcatccagagtgacaattgcatcgtttacaaaatccaacacctgaaggaagttggatttacaacaatatagaaaaatcagatgaaaggacagcagacatatcataaactatgcagtataggtaaaacttgcctctgagaaatctttctgaagttgggtatatccactatcattcggtccagatgaagtgagcgcctaaaatgaatttattatggttaagttctttttatgcatagttctccaagatcttctgtaaactactaaactgtcatcagatcaggaaggtgtgaaactacaagatcaagtttatatcaatatcataggtcctcaacttttaatcgtggtgagaaaacatacttcaatctcaatttaggataaaaaagaaacagagacaaattaatagtaaacatcataatcgtcactttctatctaacctaccaagcaatgtatcatggttgttgaaaggaactgggaagaaagtatttgaaacaataacagatataacaagtaataacaagtatattcgtcaatagcacaaa

SEQ ID NO: 51860 - DNA, 1195 bp, Oryza sativa
caccaagtaatcaaatactcaagcatcaaactactttcctcaatgagcgcaagtatgtaaatcccctccaatccattacacccacatatacaactaaaatattactacttcaaagggtaggttatcatggcaccaccattcgaaatggacccatcaagccttctttttcccattgcccattgcttccctatgttgcagaatggcatgcttcctttgttttctctcccagatgtagagcctctgttcatctgcagacaagaatacgagagggactcatcaaagtcgatcatgagtcctggaatcattctcacgagaagaggggaaaaatggtcagatggatactttctccgtagctatgctggatggatgctgacccacattgctttctttacctctacgcaaagatggcatgctcgattcatcacttattatctactatctcctgtacattgcagagcaaaggccgtgacagcgacgaagaaggctgggcgctggcgatggagcagattatgatggtcgctttgctggcagttattattcactcgactgctactttacatccatcacaaacatagtgatggtttactttttcttttttacctttgctttgctagaagatatctggaaggatggccattgcagcccatgttatgcagtacttgtgatgttgatgtaaggcattcatccagtgagtattgtggaaaaatgagagagatttgctattgtcacaggctcccagcatatggccaacaaatctgaaagagggcagtgcagagaaggcctgaatataagttgcttcattgtcctcagccttcaacagattatggccacagtgttaatattaccatatgcgaacggtatacggcagatagatgatagttggcgaattagatgaatataattattacataagaagattgcagttatctcgcaagcgattgcaagatagtactgcagtgagactcttttctcagcctgctgattgcaaattactcaacaaaaagagctttgttataattattattcttttgtacaaaagaatccacatgatccaagtgtataaacccctgatctctcctaaacatggtgttccccacggtacacatgtgcttcctttgtcatcgtcattgtagcagcactgtaccatttgctgcatctgctataagctgtaaaagtttgtgcgtctatgttcatt

SEQ ID NO: 51861 - DNA, 1001 bp, Oryza sativa
aggcctgtcccagatgtttctccacataatgttgctgatgaagttccctttccttccaacaggagttctcttcatcagttcatcgtttggaggttcagttgccaatgccagtgctcctagtgtgtccatgatcatgttaacccagagcagttggacagcagtaagaggagcactccctgaatgccaagcagaagtacaaagaacagtcaagagtaagttatgaaacaaactaggaaattcttgattttccacattaataaattttatgttagtttatttttttaagttttagcacatctcttctgccactcatttgaaatctaacgaaaaatttctgctgcactaacactaaacagtatttgaacttagaaacagtaggcagcagactaggaacagtggtgaaggagaagtataaaagatgaacatgtatcagcagtgcagttattacaagaaaccaacatcaaaggttattttaatcggaacgaaactatcaattctatacagtagaatgaggtaaaaaacatcaacatttagctgtacctgtcaagcaagctgaggagaagttcactatcagagcgaccacattgactgtcagctgaaactgcacaaacttctgaatattaatgtacactgaccgaccccatttagcaacagtgactatagtggagaagttgtcgtcaagaataatcacgtcagcactttcttttgccacctgcaaacagatagcacagtgagaaagtttgggagtgaaaaagtgcatagaactatgagggcatgaaatggatggtagtacaactcaagacaactaaattagcggctaaattgccacaaaaatacacttctaaaaaaatcgaagtgatgcaattcattaattatattgttcatgcaaggggaacactatcaactatctttgaggaaaatcacctcagttccagcaatgcccattgcaagtccaatatcagcttcatgagagcaggagcatcatttgtgccatcaccagt

SEQ ID NO: 51862 - DNA, 724 bp, Oryza sativa
ccaggtgcccgccgatggcttgttcctgtccggattctcgctgctcatcaacgagtcgagcctgaccggggagagcgagcccgtcgccgtcaatgccgagaacccgttcctcctgtcggggaccaaggtgcaggatggttcttgcaagatgctcgtcacgacggtcgggatgaggacgcagtggggtaagctgatggccacgctgagcgagggcggcgacgatgagacgccgttgcaggtgaagctcaacggcgtcgccaccatcatcggcaagatcggcctcatcttcgcagtcgtcacgttcgccgtgctcaccgagggcctcttccggcgcaagatcatggacgcctcgtacctgagctggaccggagacgacgcgatggagctgctcgagttcttcgccatcgccgtcaccatcgtcgtcgtggccgtccccgaaggcctcccgctcgccgtgacgctcagcctcgcgttcgccatgaagaagatgatgaacgacaaggcgctcgtccggcacctcgccgcctgcgagaccatgggctcggcgaccaccatctgcagcgacaagaccggcacgctcacgaccaaccacatgaccgtcgtcaaggcctgcatctgcggcaagatcaaagacgtggagagcgcctcggacaccaagagcttgttctccgagctgccggagtccgccatgacgctgctctcgcagtccatcttcaacaacacc

SEQ ID NO: 51863 - DNA, 1548 bp, Oryza sativa
aaggtttcatgactgcacatattaactaattcagcaaggaattgatccttaaattcactttgtactggcccatacaccagaactaaagcccacttaaacttatcaactttattacataaatgaaacttaatgtagaaatctccctcatcaatcaaaccaatatcaacattaattaaattgatgcccaaaagcaaaccaccggacctacctctatgaggcttgcaatgccacaaaaattatttgccagcacacagatttttaagaacagccggactaaaatctttcttaatagtctctgacaaagcaataaaatcaaggtgatgttcctttgttaaatcagaaataaacttatgttttttcgggaccttaaacccatcacaattccagaacaaccctttcatttaaaaatattctttttttttctttccccttttagtctttttcttactattaggagaggtatctaaagaatataaagtggtctaagaataattatcatccacaccactaaaatccatcacctcctccattaattcaccacacaaatgttgaagtagagaattatcatccacctgatcatccaatatctcgctatcaacatttgaagtatgtacctgattaacagaagaactaacatattcacttaacatcttttcctctatactctttaaatcatttataacatcatctaatatgtctacaacgtttgctgcaaaaattcccttaacgctgataatcaaacgctacattacagacactaacagcgacgttcttagcttgtcaaaactctcaactacgagtaatattaattgcagtggcatctctggttgggattgtgaagtcaaaaaaaaataaaacaaaacgataagagaaaaaaaaacttctcctgagaaaaaaaaatccagagaattataggtgcctcactgcctctcctttttatctgctgtggattggataattggacatggagacaaaacccaaacacccccctaaataactgaagcaatcacacaccttctctgcaaaaatcccaatctaccaccgcacccaacgaacttaagacagtggaataaagcagagagagaaatcaaagcaagaaagagagagaagaagcgaggcaagagtcaagaccatctcccatggccagtggtgatcgtagtagtagtagtagtatataaaaggggagcgcgccacggcttgccaatccgccgcgctggtgtgatgctgcgatcgacgcatccgccgcccagtagcccgagcagcagcagcagcggcggcggcgggggcggggggtcgtcggcgtcgtcgagctcggagaagacgatggtgggcggcgggggaggagggggaggagggagcgggtcggcggcgccgagcggggcgaagctgctgcagatcctgaacgtgcgggtggtggggagcggcgagcgggtggtggtgctgtcgcatggcttcgggacggaccagtcggcgtggagccgcgtgctgccgtacctcacccgcgaccaccgcgtcgtgctctacgacctcgtctgcgccggcagcgtc

SEQ ID NO: 51864 - DNA, 1117 bp, Oryza sativa
gtggcccagtagggggacacgcatccctctactgtttttttttttttaccgcgtcggattttactgcatttttaccctcctcttctcaggcctagaaaatatttcggcgcgacctgccaagaccgagagtgtactgtagcattagtgctcgatttttacctaccttactctattggaaaaaaaattacattactggagtgcttcgtgcatacaattatttttctttgtattttttcactcgccgattggtgatggtctgattgatggacgacgccgtgggccttctcacggcgagtgttcgcgacggcgcacacgggttcgtttgtttgtttcttcttcctccttgtcccggcttgacgtcttgtcgtttcatttgtcaatatctagccgcagtattttttcttcgtagtactaatatgttcaattaatttaaatcgtatcattatttgttattaacaaatatataacgatatttactttgttatatagagatttagcaacatcatatttaatttatcctatcaaaacttaataatgttgtcaatttatcaaatttttgataatataaatttttgaaaatgtttatttaggcagtaatttctactgctgctgtagaaattacccttcattttttgtacggttaaaacgtctcaaggaatcgtcggttgtgggagcggtagcagctaagcgatggcaaatcattgtcaacgacatgcatggcccatcttatcgccatttatatcgccgataaggaggttgaccctgccatctaaccgcagcctacggccccccagagaaatcacaagtcgccacgtgtaccaacctgattagtcaccagtagctttgtctgccccagttggccactactctctcggtcttaaaaaaatccaatctaatataaggacggacataatctagcacaacaaatctagatagtcttttgccaagatctagatagtcttttgccaagattcgttatgttaggttacgttacatctcaatcctagcacaacaaatctagatagtcttctgccaagattcgttatgttaggttacgttacatctcaatcctatgttagttttttttggtacggtccatacgaggaagtatgttctt

SEQ ID NO: 51865 - DNA, 742 bp, Oryza sativa
aggtattacaatccacaaacaacagaggacaaacttcgcatcatggattgccacttgaagccactacaatactagtataatttgtgttaatagaattgcaggcatacgtgagataagtgtgaataccccaaaatcccaagtagtatgggcaagctctcgtccgttccattgtacactgctaactcttccttggtccacaacctctgccgagtataacacaggaagaagagaaaatagtgctcactatacgatcaaattttactattcacaatatcaaaaggaacatagccaaaagcctaaaacagatactccttccgtcctaaaatataagcatttttagctatgaatctggataactgtgtgtccagattcatagtaaaaaattattatattttgggacgaaggtagtagtaaatctaaatatgtagcagcagtaaagtccagcatacaccatacagttacagccttacggggcatatcattaatttcaccagaaatctgcgaagttgcaactgggaacatctagtactaatagcaactagcaaccagctgattttgcgggcgatttcggatccagaattccggatcagttgcaagcacaaaggcagcttccacacattagataacaaaaaacacgcaatatctaacctcaaactcacaggtaagccagtggaaaatttcgggagaagtagaagtagagaacgcaccggcttcctgaggcggtagagctggaggacgacgg

SEQ ID NO: 51866 - DNA, 1362 bp, Oryza sativa
tttcctgtgttaccaggcccaacatctttggttctttgccctttagccctaccacgaccagaggaggttctctctttcttcttgctggtattactagtactgggactatcatgatcaagttcatctgtctctagaaagcttttccctgtaatacccttgatagctttcttaatccttttgctacgaatttttgcaaatctctcattgaatgagtaaaacgcctccatgcgtagttgagtctgcatgtgtgtgacacatgaaactgtaaaatttaaataacccaattttgcagactttggattgctgacattccggttaaatcactcttagttaaatgaaatccaagcagaaaagcatgcctattctattttcaaaaggcagcgatttcctaaatgaaaataacttaaagacaatgaaacgaattgtcaaaaacttgctttttacagatgcctaaaatgcaaatgttgcagaacatggcaaaccagcaccagccgatccaaaaaaaatgtaaaatagaggtgaaatgctgacatcttaacaattgatgttctcaaaccgtaaaactaacttactagtaactcatttttttagggaacagaattcaatggtatccataaacatattatcacatcaaaccattctataataggataaataatagttacagtcttccagagactaacctcgtgcttattatactctctcaaaacaggaattagcagttcatcagccttttccttgctccacccaaacctttcccaacataacctgaaggaactcaacattagatcttctgttgttgcgccaaagaaaagaaatagagcatgtgtgttttttcataatcataatccttagttttgaaacagaactaacttgtgaagaaaaagatcagaacaaattgtcaaggtaatgataaggagctaaaaagcacattccacatcataaaaacaaattgattataacatatcaggcagctaaaagtaacagaacactctgctttctggtaaaacttgtctagggttttgcgctccacggtaccagtctgaacacctaccagaaacaagctggtgctggcatatcggatatattttaggtttttgagcggttaatgccactgccaatatgttggactacattgtccaccactttccagcaagaaaaacattgctgctcttaaaaactgattcaatacaaaaaagtgcagggaaatgaaatgaacggtatcttttattgtttgctcgcatccatgagaacataaggttattcaagaaagcttacttgcgcagtaagcctgaatctggtcttccccaggaaaatggttctgttgaatcatcaacttgtggggaaatatatgcgtttatg

SEQ ID NO: 51867 - DNA, 720 bp, Oryza sativa
atgagtcatgattttctcctacgctttgtaaggttcggcacggcacctgaaccacggcttgcattgcgtccctgcgatgaagacgcccctcgggcctctgtatttgcattctctgtgccctctccagtcgccgaatagctcatgcttttaccgctttgactttcagaaacctcgtcaataccctcacaggcatcacgtgtttcatgctccatttctgcaccagattgatccactcccgtatcttgctcgtcaccctcttccatgcagaatccaccaccggcgaagagatagtcttttggtgcagtgtccgtatggcaatcctcgggtaactcaaagcccgaaggatcttcgttcatatcagagggatctgtatgcgtttgatcgatgtttaattcactcgtatcctgatggagcagattagattgtgtgtcaagtccagccatgtgacacatgtcctcctccaaagaaccttggccctgattttcatcgatttgatgtatggaaacatcattatcatcagcttcctgaccatcttccgcgtatgtgacctgcttacgcttcctatttgactgcagaaacaacatcagcatgaaaaaaataataatgttactctccagtgcaaatattactgctcttcatgtgcagatcagaagaaatgcataaacaattctgattctttacttcaaaaaagaattgattctcaaagacaagcatgtgtga

SEQ ID NO: 51868 - DNA, 1109 bp, Oryza sativa
atttctaaattgtatttctatatggactctgtcttgtctttttctctccgaataatgtgagaatttctaagccatgagagcgaaccccgaggcttctttttctattcctttaataatataatagatttttttataattagtattttcattgttgttagatgataaaacatgattaatactttatgcgtgacttttcttttttaattttttttataattttttcaaataagacggacggtcaaacatagaaactagggtttgtcttttttttttttttttttacctggggagtacacttgtacacgcaaactccgaagtccgaacacccgcgtaacaaaagccaatttatccgagtcattagttcaacttctaccacacgttgttatgataaagaaaacaaactgacaactggtgcccagtgtccatgcagcatggtcgtatctaccatcatcaacacgcatcacaaaagagcctcgaagatacacagtacaggtgcaaacaagcagggcaagccaaaaggcagatagccattgccttctttagttcttttctccaaacaactcaccagccaccgggagaaaacgacgctggaaagccagaagccccagaatttaagtactagatagagtaatccacttcagtacgcaacgaaccgccatgcgtggcgtgcaaccgcgacggcctcatgccatcgcctgacacgtacgcccgatctccagaaccgcatggttactgaaaaatacaggatataaacggacgtgtggtctcgtggatcggcctcagttccagccatttcgtcagtgagggagagagagaggtctgagaagaggagagagagccttctgcctgacaagaaattctgagaagagggagaatggcgtcggcgacgttcctggaggtgctcctagccatcttcctgccgccggtcggcgtcttcctgcgctacggcttgggtgtaagttgcatgcgaggcacacttaattcttaactgaatagttcttgttgcagtatgtgcttgtgtgtgtgtttgatgccgtttgatttggatcctgtttctgatttggggtactgtttgcacattgagttctggatcgatctcttgctgacca

SEQ ID NO: 51869 - DNA, 726 bp, Oryza sativa
tccatcatctgcgtcagctataccacattattctaaccattccccatttagagtacccgggaccaacccaaacccacagtccaaaagcgtcagtctagccagcgtccttaaaatagcgagtccctcgttagtcgtcagagcgctaatcatgcagtttgcatgcaccgtatacaggggcggatccacagtacatttactggggtcatctgaccccgatgacatccagctatctaaggtaatgtcttatattttgccacatgtgaccccattagctaaagactaatgaccccagccaatcacttcagctctcacgctctcacagggcagtaaaacagtttacttgtttcactgcctcctaccaagcccattaaagtcaactttgtttggttgatatactttggtctaataagcatttactatagttctgatctttgcatgaggaaacgaaaacctctcttatcatagtctaattagcattacaaataaacaaatacctttatacaaaaaaaaacgattgtagattatataatgtatacatgtttaactaatgtgcctaagtagaaaagaagttaacttttttaaaatacaaccatttctcaaccatatatatccatattggagttgtatataacaaataaatatgtgatgttataatctatgctcacagatagggatgtaaatggagcagacaagcgggtttttcttacttgcttatcacacttctag

SEQ ID NO: 51870 - DNA, 5311 bp, Oryza sativa
cgcagcgattaccggtgcgcgacactgtttccgctgtcctcgattcagcggtggcagctacgaccagatcgtcgtacgagaccctgacgccgcacgtacacgtttccgatggtggcagcattaacggcgccgcgccgcgacacgacgaagaggcagcctcgcgcccgcagtgcagcaggacgtacgcgctcatgctgtcatgcatactgtcatacgcgcgcgcgcgcacacgcgagtctccgatgaggcgagacgacggtcggatctcgcggtggatacgagctgatgcatggggccgggccggagcacaccgcatgcaagacggcagaggaggggcgcaggcacatgcgcccacgtcagaacagcgagaatctccctcctcctctcctcacccactgcaccagctgctgcctcgctgcgtgcccgtaacgtggacaactgttactcctgtctacatgcccggatgccacacacgcattacacaggctcacgccgcattgcactgccacggtatgagagagagaatttagtcttggtttgactggaccgagaggaggggagaagactagtagcaagtagcaagggacaagagtgggctgggagttagctgtaagaccagaagagtgagctggcttgcatgcctctcaaaggggcaaaggggggagaaaaaggatggagaaaacaaccgcggtgtaatcatcatcagatgcaatatggggttagaaaggctggccgggttttgcagagagccagcagcaggtgggcatattggcagtgctggtttggggttggctttgtttttctagatcggattagattagacggacagttgatggcccatgcatgttgtcatctgggcagccttttctcatctttatttttttattgctttgcccttttcatcaaatcgctctcagttactaactgctaagcaaccttatggatgaatgtcagctactccagacagacaaaagattggcatttctgaattccaaacatgtatagcagttgatactagctccaaactgaacattatgtttagtcaaatttgatcctctagactgcagccggttctcactcatcagtatacttttcctagtcaaattatgttcagtgcacctagctagcttgaggagcaagggtggacggatgtgtgtcacgcacccgagaatgtgttaaatatgatgatccccatggccatgggcaccgcacacgacgcaatgttctgtccacctttttaatccccatgacaccaggtggtgcacatgtgtgggcgagctggccggccggcagcacgcaggcataatgcgggtagggagagagatcgagtcgactggcgatttcagcgtcgacgatctgtcaccgcttagcttcgattcccctcctctttcatctccgcatgtcgcgcatgtctgcgagaccgtgactatctgcgtgtgtgtgttgaatgaaaatcatggactcatgcaggcagccatgttggatttgagcgtcgatttgaggccacccacctaggttagtacccgctgccacgttcgatcctgtacttcctgcacgctcctaaccgggagagagaaaaaaaactagagaagaataaataagcagtagtatagtacgacatgtctgcgtgcacgttcatggcagagagcttagaacgacagcttgagagagaagagaagagaagtagaaaacagctagtgcctggcagcctcttgtgtgtttgcgttattttctcgccacttgctcgcgtcaatttgttcaccgctttaatttcgtgggtgaaatgatgaacatcggcgtcgtagatcgatccagcgtgagagatttatcctggtctgttacaataatatcaggatttttatctgtaatgctgcagtggtaccgattatatatggtccaaaaactctgagctgatcgatgcgtcccaattgcactcggagcatgtacctgtacgtaccaacagtgtgttgtcagttcgactggaagccagcaaggccggtgggagaacagtggaacacgaccaaaagggaccaacttgatcgacgacgtaagcaaggccccggcctgtctgcctgatagatggctcgctccctagtccctactgtgcgttctaataattgggcttagatcgatcgatcgatgagagagaccccggccggccgctcgcgtcagcatgtatgcatgatatgcaccaatatgcaccgcacggctgtaaacagaggcttcttgcgtgcgtgagcgacgcgatggtacaggccagctagaggaattagcggcagcaccgtacatgccaccgtcgcctctcgcctaatcgccttcgagatcacggcgtggctagcggctagaaaattggctggaaactagtccgctagctagcttatcagaccacagatgcgcgatccgggtgctcggctaggacaggctgttcgatcgattcgtcgcgtggatggatggagccatgcattgaggaggaataaccgaggtggtgctctgaattgttagtcgcgtgctcgacgcggcgccgagattgcggctcagagctgagaattgctcggggagataagcaggcagggtgggctgccgcctgccggtgaacggagctccgccggtgtgcgatttagatccgaagctttccgatgtcgatcgaataacaagattgtagtgtgtcggtcgttatgattgaattatttctccccattaaggtcctaatttgattccggttcgtacaatacaaagcacgcagttgggctgaattagtaactaactgggtggcccgcacaattgtgcggctagcacccaaataaaatcatatattttttagtatgattttacttaaaatttattaaatagctatctcatgtcttaagagtttgaaagattaaaccttatcatccccgtgtttctaattatatatattttttaaaagtcacaccagttgctaccccttatgacatctgcttctttatttgcttgctcgatctaccactatttctattcattctccttgaaacctttaaaaattggatcttatagtttttagagtttattgtcacgttgggtttcgtttttataatttctagatgcctcgtcaaacgttgtcattatactcctctatggcccgtccactgtctcttttcttaattgtcactgagattttaaaaatcgaacataattatcgtttcggttcatttttactttctagaaatcccgccaaaccgtcagcggctttgacattgtacttctctacggctcgcccactgcgtcccttctttattgtcattgagattttaaaatcgaacatgattatcattgtttttttactttttcaaagttcggaacctttaaaaattaaaccttgtagtttttagagtttattgtctcgttgggtttcattttttataattttttagaagcctcgtcaaacgatgccactatgctcctctatagcccgtccgccgcctactctttctttattatcattgtgattctaaaaattgagcataactatcgctagaattcattttttattttctagaaatcacgtcaaacatcagcggctctgaaactatactactatacaccccgcccactacttctcctttttattgtcattgagattttaaaaattgaatatgattgtcaatggggtttatttttttttactttctagtagtcccggtaattgcattgctcgtttgcttcacggcctgcctgtcgtccctccttttaatcgtcattgggattctatttggtgttttattaacagtttttatatgtcgtatcaaccgccaccactctactcctttaaaggcctgttacttaatttatctcgtcatgtgttttagatggtcttttctttcaatagtctttatttttatcacaagttttagttatttataaattgtattcctaattgaaatcttatttttctttttctaatttcagaatttatttttttttcaaattttaattaatatcgtattgtgttcttttaatatttttattttttatttttaatttcagttgtttcaaaattgtattcctacttgaattctcttttaatttttctaattttgaatattattttattttttattcttaattttaattaatctcgtattggattcttatatggattcttatttgaatattgcttatttttaattccaaatttcagctaattttaaattgtattcctacttgaactcttttttttttgctaatttcagattttattttttttattccaaattttaattaatctcgtaattgggttcttatatggactctttttttaatattccttattttaattctgattttcagctattttaaaattgtattcctacttggactatccttttcttttctaatttttattttattttatttttattttgaatttttattaatctcgtattgggttcttatatggaaacttctttcaatattgcttatttttatttccgaatttcagctattttaaaattgtatttctacttgggtctcttttttttctttctaattttggattttattttatttttatttcgaattttgattaatcttgtattggattattatatggaaacttctttcaatattacttatttttaattccgaatttcagctatttttagattgtatttctacttggactctccttttcttttttttctttttctccgattaatgtggaaatttctagcccccacagtgaacgtggtgccttctttcaaagctgtattttattataaattaaattttagttgttaaaaataatatcattggatattcatttaaatttaattttatataattatgattttgttgctacaatgaaaaatttaaagttaaagtttagtttttaagactgtactaaatttggacacgccttagcgagttggacggagagatgtatctctaccaatgcataagttttctggtctatttactctttttttttcatccataggtaaaaaaaatatcacattttaattctaattataccggctccaaaatatatatgcacgcactgtgtttgaatcctaatcacctgatctgttgattgatccttagtatccatataggataaggaaagaatcaaagcaggagtacgtccacctatttggacttgtattctattacttaatcagtgttgtccgtttgatctagcagttgttttctattcagacttctattatcaaagttaatctacaccatcaaagtttagtcccagtataatctaatagtatagatttttcttttttctccgattaacgtgggaatttctagcccccacagcgaacat

SEQ ID NO: 51871 - DNA, 1181 bp, Oryza sativa
acaccgctccatctccacccccaccgaactgttgctccgctcggcgcttgccggagccgagccgcgccgctgccttccccaccgccagccgtctcccctcgacggtcgccgcggcggccatggcggcgacggacagcgtcatgccggcaccgatgcgctgcatctcggtcagccccctcttgttgctggtgagccgccgcaccgcgggcactaccgcggcatcgtagagcggcaagaggatgagcatggcggcggcgtagacagagtggagcgacgccgccgggatggcaaacgcgccagctccgaacccgaggcggcggcgcatggcgcggccctgcaccgtgaagagcggctgctggacgagcaccatgcagtagacgatcccggtggccctggtccacaccggcagcatccgcacgatcaccttcagctcatccacctgcgtcactgtgcacagcctccacggctgcgccgctgccgccgcagcctcgcccccccccccaccaacgatgacaccgccaccgccgccgcagcctcgccgcgttgtccaagaacctgaactggtcggtgtgcgccagcttctgcccgcactttggcggaccgtcgtagaggacgaagctgtcgtgaggcagcgcgacgttcctcttactgatggcggcgacgacgacctggcaagctcgcaccacagttctgccatgaggctggtgcctggtggtacctgtacatggcggagccgaggaggaagctggccatggcgaggacggtgcagagagccgggacgccgaagccgacgagccagccgaagttgtcctgcagccacaccatggcggaaccggagacgagggcgccgacgaggaaacgaaggcggcgaggaggaggaagcaggccacggccagcgccgccgcgaaggacttgccgcgccacctgccatggttgggtgagagataaaagatgggagagctgacaactgggtccaggggtatttttgacatttcacgtgatttctctcttccctcctaccggaaattattattttaatgggtgcggtgtccgctagcaaattaccacattttgagagtgtcttcctccaaaagtgactttgtgcggtgtcctatgcctaaaaccgcaaagtcactgtgtcctgtagcaaaatttgccaaaaaaaatatatatgtcaatac

SEQ ID NO: 51872 - DNA, 1273 bp, Oryza sativa
cataagtaaaacaaacacaaaggcgctggattactagctcattgagctctgcgcctctgccccatgtgtgcgtccaaattcctgtgttgtcccaaccatgagatttgaaatgctcgctatgcttgaagtttcccggggtgaaagtgaactgtatcagtagaaatgatagagaaaagagatatgtgcttttaccagtttatcaggatttaagagtaactgtttccctggactgaagggagaaaaaggtgtgctgtcatgcgctttgcattgatagatgtctgcaatgcagcaatatacggatttttagtcttttcttcccgattaatgtagaagtttattgtctttttactccctctgtattatatatagtcaaatcatagcattccaaaaggcacttaagaagaaagacaaaggccccaaattgttagaaatttggtcataattcgacacattttaatccaaaatattaagacaataaacatgacatacccaatgagaagccaatctagtgaataaggttaaacaataacatatgagccatggttaagggtaaaataaggtataaaccatcattgatattcacataggattgaagtcgtatggataacagtaaggaacatgtaaatagcaagaagccatccaaataaagtaaaaatgttatacaaaagaagggtgcccaacccgttgaggcattcgtattgcctccgttgatgttgtctcctccgttctctctagtaaaagccatggtgaagcagaagcaggtgtaacaccctgaaaattcgaccaacgaaaatcaaaactctaaaactatgggccttcaaattttttttaaataaattgcatcatgccgattttattcgcccatttcattggaatttggtttcgaagtttatagatcgcgaatagagaataattgattaggaagaaaacctataattaaacgagcaatataaataattgaaatataatttggaataaagattaggtgatgttggaaatgaataaaatattatcgcgaccatattagtaacaattgaattctagcgcgattgaataagaattaattctaattaatttcaaagaaaaaaattatataaaaataaaatatgggtactattaatctagagtaaatattttgattgaaataacacaagtattatgtaaacgtcatttgtggaaaattaggaattaaaggataggatttataaagaaaaggttaaattaggctagcactgttcattgcactctaggtgctcgacgaggttccctagcc

SEQ ID NO: 51873 - DNA, 1155 bp, Oryza sativa
ttgtcaatgtctcggtgggctgttatgctcaactgcaatgctgcatccactgaaacctctttctagatgtgttggtatgaaatgcggtattgcgttcccgatttcccctgctactgtcttgaacctgccgtggtacaatccttgtttgctgcacttcatttttagttcgttctaattccgcctggaatgacttttgagtgcttcacgggctgactgcctgaccgtgttgctgtacatgcctaccccatcagttcaaaaaaaaacaatcctacctacgaaattcgttttttattgggacaggacatcggctgagtttaatttcaaaatttttcaacaaactttcaacttttccatcacatcaaaactttccctatacacgtaaactttcaacttttctgtcatatcgtttcaatttcaaccaaacttttaattttgatgtgaactaaacccacccatcattggatggacttggcaaaacatggcttgaccattgagatcgttttggggattttgttcagtcagctcttccatggtgtctatcagaagagttggggccgtacaacgcaaattatttcccagatggtgttgatatcatcaatgatcatggcaatttggcaaaccatttcttatttcccagatggggttggtataataattaatcatggcaaccccatttgtttggtgctaacttgatgaaacatgaatgccctcaacctcaacagatgggctccagtccggccggcgccggccagcactcggtcaacacaatatgggcacgagtggggctcaaggaagtgtggggcgcagcacaaggagccaagagacaaggagtcatgttggtcctttcagtttcaggcaaaaaaggaaccgaaaggagccaaggatcggaccctttcgaagcttttttgaccatttcgtccgacttgcaaggcaggcccagaaacaaaaataacccaactgtctagtggtaatatcatttgggatctgtagattttcagttcgaagaaactgtcctgattcagagttcagacaaatacgccttcagtagttggtcctgccgcccctcgtagtttcactatcgaaagggatcgctgctgtcgtaatacgtttggttttggcaatacagaaatcaatctgctcgcaaagtataatatc

SEQ ID NO: 51874 - DNA, 2770 bp, Oryza sativa
aggacacccattgtgagatgtagtatcctcatcgggttgcttcagattttaaggagcccatctagggatacccttcattgtaagccaagtttcctacgagtgtcctcggttagtgaggacagtgtctcacattgtggatgctctaacacatctgatccctggagcttctcgttgcgtcggcaagctgaatggaacaacgactcgaccggggtacaaacgaaaggcagcagagttctatgacgattaccaaaagattggaacactttgcagcatactgttttggtcaacttgtggctcatcaagatgtagtgaaccagtcgatgtttccttggtgtagcaatcaactgatatgtaggctggaacccacttagctgataaaactgaatttgactgatcactccatgtacttttaaccagaagacaccacgtacatttgctcggcctagacatgtttgaattttttatgtagagtgcaggtcaaagacaaagagcaatgcagtgcaaagttcaaccacgatcaggcactccattgaaccactgatttgaatagcaaccaggagggttgcgcctagtgcaagaattcattttggtgacttggatcataaacagtcaagatgacactgcataatcgccttgcaaatcacatgccgctggacatgattaaagacctctttgattcatagaaattttatgggaaaaatgtaggatttaggatttggcactgtagcagcctttgattcacaggattaggacatggaaagttagaggaaatttcctttggaactcatttcacaggaaaatggaaacatccatcctaacctcttttttccatcatgtgtgcgtaggattgaggcaaatgacagatctatgtatcattattgctcttttaaagaaaatgtatattgtaatattgtggataataccaaagtgacacgtattaatacacttcctgacattctctttcccgtgaaattcctagcccctttgaatcgcagggtagaaaaaacagaggaatagaaaaaacataggattctgattagaattgaagtgtaaaacagtggattgcaaaacacaggaatggttgtttgattggagcgcaggaaaaacgcaggaatcggatgagagagatagactcaaaggaaattttctaagaggttggagctcttgctaaatttcctccaaaatccacatgcaatgtgccattccataggaatttaataggatttggaaagattcaatcctttgaatcaaaggaccaaataaaaaaatttcctatagtatttgaatcctataaaattcctatataaatcctttagttcaaaggggccagtaacacaactttcctactcatacatttttacagtcacatccttgtttttacagtttacattcctacaagaatactacgtttttatcatttctctgtttttccattcctataatataatttaaagggaccctaaatatatttgaagatttgcagtaaaaggaactgtttattacttctttagggtaaaagaactcagaaaagtcagaaagcaccgacataccccccaccaaacaatgcggcggagtgcggcagatcgaaacagccgatgcggcctggagtgattaggccggaccggcggcggcgcagatggaacgggggaaccaccggattcgggggctgggtgggggctctctgcggccggccagatctagttcctcccggcgattcccaacgcctgaaaggctgcgtctggacccttggagggacggcggtgcgagcgggtggcgttcgccgacggctcggcatctccgcggacactggcggatcgatcgccgactcgccgtccacgacaactgcgccggggccgccgttcgtccgagcactccatgctgacgttgctctccttcgtgggccaagcccagtgcagcccgtatatcgtcccaatttcttacattcaggccccttattttggatagcgtaaatattaggatcgctattcgttaattcgtgtagggctggatatcgagacagcgggtttggtctggctgtctggctcgttaggccaatgaactggtttggctagttaacctaacggtctgagtagggttaaaatggtcatgaaatttttttttgatcgaccgagctttatttccgcataagatgtaccgtttctgaccgttttagctatatataaattttgtttttttctaatttctttctatatcatattaatatcgacaacgaatagttcaaatgatgaatatggtccattgccgaccgatcgactgtcgttttcgaatagatgctaccaattccgatcgtttttactccgtctgactcatgagtcaacatgactttatcccaaaataaaccaatttccgaagtttgaattgtgtcttaaaaaatgaatcaacttctattttcttgcctaccatctgcctgtaaatcaagaaattttattcctttaatactccatcacctactcgtctgccaatataatttttcattaattatggattttttttgtgttagattaatgggctaggccaattaaatcataataaatttcattggcctacagtaagtgctatgggtaataataccatcttggaaatctaagtgaagaggtctcaatttaaatacggggctagttgagagtctctattgaccaattgagatggtgggcggacagctacacacatgcacgcgcgaggcgaggcgaggcaggctgcgctcgcctggttctgttcacctgcacaacgccgtgaattgatttcgtat

SEQ ID NO: 51875 - DNA, 1409 bp, Oryza sativa
catatgtatagcttaaacaagtctatttttcgtccctgttctttgggctgacatatatatagctaaattaagtctattttatgtccctattctttcgactatggcatatgatgtctattttactccctattctttgtgtgttggacctggttgccgggccggcccaacgtgctagtggggagtgggggccaggcacggcctagcggtcgggcggggcaggcatggccccgacccccgtcggccggaccggcatgggcccgacccctgtcaggctgtgccgtgcttgggtcgggccaaaacgtcgtgccgtgggccaggccgtcgggtctcggcccttatggccatctatagtcatggaccacgtagacgcaggagactaggttcgtgcttggggactcgtgaaaagcaatgacagtatgctgggactgcttgggtattactacggtttttctttggaataagttcaatttaggtcccttaatttgtcgcttagtttgaaatttgtccccaaaccacaatactccctccgttttaggttacaagactttctagcattattctcacacacacacacacacacacacacacacacatatatatatatatatatatatatatatatatatatatatatatatatatatatatatatatattaatgaatctaaacacacatatatatctaaatttattaacatatatatcaatgtgggcaatgctagaaagtcttataatatgaaacggaggaagtaccgaatataatacatcccctaacttacagtaccgtattaattttggtcatttggcagtatagtggccggttttggttgacgtggcgagtgggacccatgtggaccctacatgccagctgccaactcttcttcctcccaacatattctctctccctccctcacttttctccacacacatcacctgctcgagagaatgtctgtgaagaaaaatctccctaaccgctgaaaaatatcttcttcatgtcttacccgtgttcggccgtcacccgcatccttgccagtcgttgcaccgcccgctccatcgccatcatgcacctttccacacagcatcgtgccgcatgaactccgtgtctatcgtcaacttcctctcgttcgcttctccccactgccgcacgagggacgatgatgacgacacccacagcgacgaccgtagcgattgttaacaaccaaatttggtaatatcggcatcgggaaagaagattagatcgaagcaaagtcggaggcggagatcgagttcggaaacagggcaggaatcggctggagtccagatcggctacgattaggatcggctgggtctgagtcgggctaggtaagccgatgcagccgattccgacaatgcaacttggtgtatgacgtcgggttgagttgaggtgtttc

SEQ ID NO: 51876 - DNA, 1592 bp, Oryza sativa
tatgacagcatccgcgattccgcgccgcccccgcccgcccacacggtcgtggtccccctttcggttcatgccaccccggccactcggcccagggagaaacacatggccacgaagaatttatgccttgaaaaaggcgtcgtcccatggatcatggggtgttccgttctcactttcttgctagcgatacatttatttacctacagtgatagccagcgacgctgtcaagcccaaacaattagtagtgtttttttaaccaactaaatatttgtaggtgtcgccggttattggcagtgaaaacggtaatagtatagctcgggcggccgtccaatctgtgtgagagtttcctgcagaaaaagtgagatgggattaacagtttaacgctgcaagcatgcctgaaatttcaacatgagagcacacggtgcgcatttgatttttgattgattgtgtggcgtccaaaagtgacttgtgttatgatgatagctgtttcgtgttgtatgtgagggagtttgctggtgtatcaagcatggtgcaagaggacaaccgaataagtttcgttgattaattacttgcgacatcaaataccagaataggtgaaccggtcggtaacaccgacactaatacacaaacagttttttttttaaaaaaaaataacatggtagatgcataaacacagacagaggagctcttaaataaaggacagttccttttaaatgtgatggctggcactcctagatagtcagtggtgatttaataagagtaatttatgtccaaacaaggagctcattgattttatgagtttatcgaaccagcagatggttagatatgaagttcagacagattaagtccgagcgaaatgaaaatatatgatatgtattaaatccaagtgaaatggggaaaaggtactccaagatgaagattggcacaaaggattggtagcatctgctgtctgtgaagatgctgcctgagacaatttgtggatagaagattcgagtggatataccatataccagtaggtaggatacatgtgggtgaccttgtactatttgacctccttatattgttctgtcacgcaaccatttcttgggtttactttgggagtatatattgcaggcattcatttgtttaaagaaaaattcacaagacctttcacgtaaatttataatttgtacttttattttgatctgaacttgtttcttgtccctaaagagaaaatgaataagttcatctaacgtcccttaattttacaccgaatccgattttcattcttaaaccccaaaactagatacaaccagtccccaagctgtcaagactggtgtaaaaaaggtccctcggcggttttgaaggcggttttagctgatgtggcgcctacatggctggtttgactaggtctacgtcccacgtggcaccgatgtagcaattatatattagaaaaataataaaactatgggcccacctgtcagctaaaaaaataatttaaaatgttggggcccacatgtcaggaaaaaaggtggggcccacatatcaatacatcctctccttctctctatttctctcccttccagctcttcctctcagcgtcgtcaaatatcggc

SEQ ID NO: 51877 - DNA, 10747 bp, Oryza sativa
tttacgtaaaaaacttaatgtttatcttcatcttcattttcaggagaaaagaacaccttctcaatttattcttcacataatcttttctgccatgaattatgtgaagaataaattgagaaacaggcttggggatcaatacttaaatgattgcttggtcacatttattgagcatgagatgtttttgaaagtaaaggactgtgatattacaaaccgctttcaagccatgaaggaacgcagaattaaagctactcttccaagccatgaagtaagtgaaatagaaaattagaggtaccgtgtaataatttgtagttttatttcttcgattatcgggattgacaaactgtgaaccattgattttttttactatggacttttttttttgttagacaggaatacccaactttaaaatcctggctccgccactagcgacggcggcaccgaggcagcggggcgcggctgagcggcggcttggcacgagcgtggccgtgcggtgacgccggccccggcgcgggtcgcggcctcggcggtgcggccggcattgtcttctccatttattttctattttcaattttcctttcttttcttcttcttttctcgattcttttcttcttcctatggcgccgatcaccgtggggaggcgctcgtgactgcttgggcggcacggctcctccggccatgtggcggctggccggatcggcggcgaggcaggcagctggtgccatgggcagctagcgccgtgggcctttatattggcattgatttgtacgtgtacgtacaacgtactatctacctgctcgtctgacagcaacatgcgcggctctggcggccacggcggacggcgcggcgtggccgacgagcatgaggaggcgacggattgagcgccatcctagcggctgggggccctcctccgacctctgctccggaccgccgccgtcctcctcatgacccgtcgtcggctgtcgtcctcccgtcagccgcatctgggaaggaggaggggaagaggggaggagatagagaagaccgagttgggcttgagtgctggaggatgacgatggtggtggaggcgggttggcggcggagggcgtgccccactccctctcccgccggcaccgcgtgccgctccctctccatcgcgactgagagaggagaggggagagagatatgaagaaaggggagatgtgagaggaggaagaagaggaggggtgagaatgacacgtgggccctattattttttattaatttatgtgcgaaactgacatgtgggtcccatgggctttattattattcttagatcaaattgccacttaagcgccacgccaatgccatgtcagatgaagaccgagtcaaattagccacgtaggcgtcacgtcagtcaaaaccgctatctaaacagctaagggatattatctgcaccagttttgatagttagggcacctaatgtatctggtttttcggttcagggacgaaaatcggatcgttgacaaattaagggaccttagatgaacttattccaacagaaaaaaaccagttctcttcccaagagaggctccacctgaaggcccatcttaaatagttgatcggtgtgttgtgttacaccgatgcaataagttcattttgtgtccctttaactacaatgctagtagaaatcttccacctccatcgtgcacacccggattaaataagattctctcgtaatatgagatggttgtttttggctgacgtgacattccagtcttataaaagtaaaaaataaatggagcctcatgtcattgacatcctttctttctcatctaccccaacctctcctagcgagaactagcgatcggtcctgtcctcgggagggttcaatctttcgttttcgacgttctatcggagggtgcccatataccgaaattttaaataaaattggtcaaatttgaacaaaatatagcgagaaatgcccaggggtcttccggctagctccacaagttggtgggttagacgacctgggttcaaagcctcacccctcctaattatttgatattagatccttccctaatttctagttttttttgaacaaaatatagctaaattcattaaaaaaagcttaaaaataaaaattttagccaaaataatatcattccgaaagtctttgaaatttttgttccggaattttgaaccatggtccttggtccaacgacgccgccggtccgccgatctggtggagagatctcctcgatcctctcctccatgcagtgacctcgtcaagctagaccactcagcaacgatggaggagggcctcaagatggcaacaggtgcatactatcgggttcctttgctccatacccacactcacgatgactaaatattttcacttaaatacccacatccggcgggtacaaaatcatcctcatacccacacccgtgcggataacgggtacccatacacatataattgacttgtagcatatatagttttgtactgtaattagccatattagaactgtaagttatcaatattttctctggcaacaatgctattaacattagcgttcaaaaggcaaataaaaaaactctacaacaacattacataatcaaaaaatcaaaataatttcatataatagactggaagaatgcttaagatgtgaaatgagttttatgctatgatttagtagtcgttaggacttttactcatagttttaggcttaatctacgggtttttttcacccacggattggtgggtacaggtgggtaaagagcggactatacctaggtacccaacgaataggagttttcgtccgtcaataggtctatgggtataagagttagaatataattagcttttaatagagtaaaaatccatcgggtgtggggttacatgtccccattgccatctcggaggggacgcgagtggtccgatggagttcccagactgacgtaacgtgcacgaggctcctgttggtgttcgagacttccatcgagccgcccatcgtggcggcgttgctgcaaacggcgtgggacgcgctgtggcctcgccgtccaactcctcttgcgaaccgctcgaccttcatccctcgtcgttggcctccccatcctccggccatacatgccgcagtgccgcagcctcgatcaaccggtgccaccatgattcgtcctcctcgtcggcagcgatcgtgtcctcgtctccggatgccgacgaccccctgacatgtgtcttttcaatgtgaccatctccggatgctccacggcggtgaggaggggaggcaaagctcatgctcagtacaacaaggattaggttgtgttcttcacttgaagttttcaacctcacttcctcgtttaccatacgctttccaaactattttcttacaaaaaaatctacaaaataaagttgcgaggcgcctataaatcggatgcccgattttttttcaaaaatcgaacgatgttccaccaagtagatcggaattgtttcactaagtagatcgaaaatgttttaattgtttataaagctaaaatacaaccaaatcatctcatgaaacattttgctacaacgtataaaacaacgccttttgaaactgtttcaccatatataaaaacaatttttcagcaaatagcgaaagaatgtttcaattcacagaaacatttgatctatatatagtgaaacaatacgagtatacttggtgaaacattattggtggaaaaaatgaaacgaattcccttaatagagcatttccgtaatatgtgagtgatttattacaacggcccatgtggtggggcgcgtggtggggatggtgcggaggcgctaggggcacgggcggaggcgggcgcctgaattttctgccgctgatcggacgcccgatcgctggcattttctaaaaaattgctataaaaattatattaatatattgtaagtttttaaagttgatacttaattaatcatgcgttaatctgttgctctgttttacgtgtggagaggaggggttaccgacccctgcaaaaacacaggcttagtgtataggtcgagctaaacatgattagtgctctttcacggaggccattagagtcatcgctttgagcgacacatgcaccaactagaagttggtggttgttgttgttcgaaccatgcttgagctcgtccttagtacagcgaggccggccggttgcctgcaagactgcacgtctgcaaacatgaaccatgccgccggccgattcggcgggggtcggcagccacatgtcagtgacccatgcgagcgtcgttgggcacgccgaggccaccgtccgaccgtcggcgtggagagagaagatgcgagagagctagaaaggcatagaggagaaagaaagggtcacatatatttttcatttctttttctgactgtatctgagcgatgtttcgcttattcgcgcggtatatttgtaaacggaaagtaatttataaataaaacttttatatatgtattattagcgatctaaaaggaaaagctgaaaaataaatttcgatgaaaaaaatttaaaatcaactctaagtttaaggataaaaggatcttatttaatccgattttgcaagatggagactaaaaatttatgataatattgcaattaagggatgtaatttaaactcgcttggaaataagggatgtggacttattcctactccgatctggccttggtaacttggtttgtccaagtctccaagagaagagaagcccacttattgtttgggcttacacagcacgccgaattgactcgattaaaacgggtaggctaatcgtggcagcatatgggacacgtcttgcacgtgttgtggggttcgtacccgtaccctgcacgtcgtacaatttcgcacttttttctctctcgctcgtctcctaatcctttcaccaagctaaaagcttcacgatatgtcgtgccggccgccgcaatcacaactcgatgtttccaaccggagtggggaagcagccgagccggacacattttaggcaacatattggacattctgtacacggagacaaaggatttgcccgtacccatgcggcatggttctggtcaagactgatggtgtataccaccaaacagattaactaatcgattactagtagctagtagcctagtactgtagttaactagtcgattactagtttcccggaaactaccatggccaatcggtccataaaaacaaattaagacaagacagacagtagcatgcatgcatgcatgtatcggaaagcttaggctggctaatcatcagttagttactggtttttgttctgttgtgacactgtcaattagttactggctttaattttgttctgttgtgtgacagtgtcagttagttactggttcaaatggcagattggcagccggccggccgtctacgatgaccgtaggcgatcgtcatttcgtatggtctggtactctggttggcgcatgcatatatgctaggctaggctagcgagacttggaaacggtacgtgttaatgtgacagtccaagtagccaaagtaggtttctggagatagagttaggcagccttcttttgggggcttctgatcgatggtgatcgaccagttgctagcttcgtgagaattaatataattgaacaatattttgggatctgttgctcgtgcagcgagtgtttgttcaaactacgtacgctacagttgccgccgggagctagtacgtcgcaggcacatgtttaatgttcatacggattgacatgttccacagagagaaaaaaaaaaacaggctgatcgagggagaaaaacgacagctgctagccagctgagctagaaactaaaatgttattcaagtgcagtagcagatttttttttcaacaagctgtctccagagctcggacaaaaacgtactacatgttcaatggccaccagcaccatcgtacatattacttgtgaacatgcgtttcctagttcctacacgatgttttttttaaatatatatatatatatatatatatatatatatatatatatattaattacttactcccccgtcctaaaatataatcattttttacttcgacacattttttgagatgttactttaacgaaaaataaaaagagtcgtatattacgatggtttgtttaatgataaatatagtaacatcaattttagtagattgattttttttatttttttctattaatagtcaaagtaaaaatatttgatttggcactatactaaaaatgcttatattttaggacggagtgagtagagtatttttaattttttaaactttgtaatatttatttcattcaaaacaatcatactgggctatataagcgtgttttatttcgaccaacgacgggagttggtctgctaatgaatcaaactagcaggactgacagatacgtactgcgctacggcagttcgtgagctcgcaaatgtagctttcgttcgagttccatcgatctccttcagtcgatcggagtagtgtattgtcaacccactgcatgcctaacatcagttatttttgcaaaacacgtacagcgcgaattttgtgatggccactagctagtcgccagctcacaatttaacaagtgtttcacaggcttacaagaactcctacagaactttacttgatcgaccctgctcattgcaaaatatctgatcttgttttaaatctgaagaacataacactctgaaagcaagcataaactgttccggccggctgaagtatgtataaccgttgctgttacatgtactcgaagcacgacactagctaagccgccaggtactaattatagttccttctttaaactgatctgtttctaattacagtacttaattactactagtgctctagattattaattaccctgcatgccaaatacggagtatggtagcttagcttagcttagctagccgcgctgaccatgcaaatttgtatcacgtccatagctggggctcgccccacgccgccgagtccaggtccgagtcgtagaacggctggtacacggtggcgccgaagcctgcgccgccgctacagtactccgccgggtgcggcagcggcggcgccggcgcctggtattccagctgctggtcgtcgtcccggcggcggtgcgcgagctcgacgcagacgagggcgacgaggttgtcgtgctgcgcccgcgcgttgagcaggtcggcctgcgcgcgcgcgagctgcaccttgagctcgttcgcctccttctgcagccggcacaccgcccccgcgcacccgtacaccgggtcccgcagcctcgcctccgcctcgtacaccatgctgctcaccgcgtccgcccgcgcgctctccggcaattcctgcacgttgccgcacgtcggtcgatcagcaatgtgccacgacgatcgatcgatcgaaatcctcgctcttacgtgcgggcgtactatgtatatacctggaggagcttgatgatgttgctggcgccgaacacgcggtgcgcggtagtgaacttggtcggttcggtaggagggaagtaaggagccagcacgcagccgtcggcgcaccggcggcggagcaccttgcacgcggcgcacgggctcagcacgacggtcgtcgtcggtgacgacgacgacgacgtgttgcccaccagcaaggaggcggtgccgacaggaggtggtggcggcgagcacgacgacaccctcgacggcggcgacacggaccgcccgtaatgcggctgctgcgccaccgtcacgttcgcgaccgtgttgccagcgtgatccattatatgacacagcctagcgcaacacagggctatagcaagcaggagaagtagctagagagactctggtattgacctgctaattaaagatccaaacaggaaggaggtatatatagagagacggggacgacgtgtggagatttttctgcgcgtgcgactttgctgccagaatcgatcgatgctccgtggaatttagaacacgtcggaggacacgatcattcgatcagatcaacatcaaattagttgccagttttttcctaacacagatattatacgtgctttgcttgaccaagtttggcaagttttgaaggcttaattaggtaggtgcttaattatacctgtagtacatgcattattccttccatgcatgcttgcaatcttgcatagctaatagacattaggcatatgctgcattaattgctactattagtttactctatactccagcttgtagcacaattatatatgggataccgctatatgtacgatccgttgtacaactcatatacatgtaactatatatcaattaaagtaaaacatatttatatacactgtagccgtttaccaccgttaattaaattttgtcgtacgtgagtcggacaattaagttatatgcatagcaattttctatatatggcatgtcgttgatttaaatatatatgcttgcagttatcatatatcaactagttggttatattttttaaaaaaaacaatagtaagttaaattaatatgtaatactatatcactcaataaacatacgagctcaaatttaacctctagaaattgtaaaaaaaattaaaccctaagtttgtatatccacaatgaaatttattatttttctctaatccgtagaagttgactttgaacttataaatttgtgaagtgatatattacatattaatttatatcactattttataaaaaatatataaatatttagttaatatacactgatcgagtgaacatctgctctagtaactataaacgagtttccctttcttttttctgctcatatttttgcgttgcccaaacggcaggtcgacagcgtacaggacctccttgcgatggaggcgaccctgacgccgactctcaaaccaactgttcatgggggcccaaaaccaagaccaggttgagcggcaggttggaacggaggcgataaaaaccaaagtctgtacacgtttagtcgccgtcgatcgccttgaacgggcatacacttatgacatatgtggccgcccattgatctgtctggatatcgtccataactccatatataggttggaccgttagtatgcaagtcaggctgaattaatatgtgtatgcccttggaaatcaaaggggacatgcataacttgtacgatagggtacagtaatactactccgaagtcgtgctaggattgtgttctttcttggctacagttatatatttgatctttttttttagctgatactgagtacttttcagcgaaggacacaaccaggacagtcggatgcatgtacgtatttagctagctagtctgtgtttagatctaaagtttggattcaaacttctaactttttccatcacattaatctatcatacacacataacttttcagtcacatcgtaccaatttcaacctaaacttctaactttagaaggaactaaacacagccctactccactagtgattagaggctactaaaattacttgatcactaactgtgcatttaactctatatgctgagtctgaatacacaaagccgcatcgacgagatcagtgactatcatcaccaatgctcttcttatcatcactcggtgtagggctggaaatgagccgagccaagccaggctcggcttgcaatggctcgcaacaagctaggcttgccttggctcggctcgggttgggaaacgagctaaaacatgagctcggctcggctcgtttcctggctcgagccagctcgagctggcttgcgaccttccgttgaagctatataatttgtaatcattaagaaaaacaatgacaaatcattaatatgtaaaattaaaataactttatatattcaattcatcagaatatagataataaattacatattgacaaataataactccactagaaaataaaattatccatataaatacatgatggcctagactcacgagccaaatcaagcggctcgcgagctagctcgggttcggctcatttcaggaacgagctgaaaagtaggcttaggctttcgctcgtttggcattcaagccgatccgagctaagcaagctcgagccaagcccgagttaagctcacgagtccaagctttttttccacccctaactcggtgcgtgcatgtgaggctccgattttgttggagacgtgcatgtgagcctccgattttgctgggagacgatggctcgatcgatcgatcaaacagttcgcaagcagcatgcactccggtgtcaaaggtttctgtctgcttcaggaagcatgacttttccactagagtctgaagatgcagctgaccgacatggacttcgccgcatgctacgcagcctagatttccacatttacacatcttcccgttttgtcatacgcgaggcgcccagtcagagggtaagagcaagttttaagagcaggtacaatagcagtctattagccagttataaatatattttaatgagataaaaaatgagagagaaaagaagcgggctacagatctgtagccagctgcagcacgaactccaggacgcagtgtgtgtatgatatgtaggaccatatattaatagtatagtaagcaactgtggtataaattggctattatattggctatagataaattggagctagtagtgggctatactattaaatttgctctaatagtatatcccgatactaactccaaatcatctatagccaatgtaatagccaattcatacaatagttgcttactatactattatacctggtctcatatgtcatatacacattacgttttggagtccgtggtgcagctggctatagatatgtagcccactgatcttctctctttctttatctttttaaaatatatttatagctgactta

SEQ ID NO: 51878 - DNA, 1230 bp, Oryza sativa
tagggggtatccagtaacttggttcaaaaattttttttatctatagtttatctattttcatcatgtatataccccgtcagtttaaatataggcaccgtaccaagctaaatttgattcaaaccagagtaaagcaagtgagtggaacaccccttcattttgttctagctccgcccctggcaatgctgtcttgcaattaggcttgttctcggttaatctctctctgaggattaaaggaaaactagagaaaattaatttcataactatcgagatgttggaattaatccttctcaatcttcttcaatctctttcttaagggaattaaccgaagtgggcaatatttgtagaccgcaggcataaaacaacacttcattgcagctcttcttgctgtcctggagaacacaaggacaaggtggggcaagcagattacacattattcagtacttagggcatgctgttaacatgatgccagggtttatgtactggaaattcggctttgattgacttgattggagcccacaactcatgttggaaaataaataacggtaacagctgtcatttattcaaaacaactccttgttttatgtggacttatgttcatcctaagctccctttgtctaaaacatgcacgcgtcaagtgataaaatctacacaagtagaagaaatggcacattgtatccagaagtcagcttgcacaccttaatgtttcaaatttccaataattattcaaaggtgtttcaaccccaatgatatgttcctaattttttaattcactatcttgtggaaaatctgacaaaggacgatctaatctacggctatagggtacgtcagttaggtccaatccgttcaatggacgtccttttttattctcttctccaagatcacgttgccctgggacatcatgatctgttcatcattaacaaaccaacacaatcattgtgtggcaataagatgaattagttaggttaagggaagcttttcatatggccgcattgaacattctgtgcctactcaagtctaaagccgtaaacttactcttaccatgctggcctcgtgcaaactttacaacgcacaggcacagcaatcctaaagcaatcgatccatactgtttagtcttacaaaaaaatgattcatatatactcttggaaaataatggatcatttttgtttgaagccaaaatatgctctggctcgttaaatagtacattgtctatgtctagtttgctaaaaaaaa

SEQ ID NO: 51879 - DNA, 2278 bp, Oryza sativa
gccttgatggtcgactggtccacaatgacgatcattgtatcatctgtctattattcatattttttatgcacaaaacatgatctgttatgatttgtaaccacttgctgaaacaccactaatttgttcaagtagttgctattagatcattggttcatttatgatcatttaaccgtagcagactgaattgtaattttgtgtttataagtttttaacatccactgttgtttccaggtcctaggtaacgcgaaaggtgctgtggcagttgttgtctcaattctaatattcaggaatcccgtatctgtaaccggaatgctcggttacactcttacagttataggcgtaattctttacagtgaatccaaaaaacgcaacaagccctgaatattttagaatgccgtaaatatggctgtcctttctcattccggtggatgcccagggctaatatatgacggggaactacatcggggacaattgcaacaaatcctgcactgtatggagcctgattggatagcaaggatagaagtccaataatacatgtagtttgcccatgggatctgggaggcattttgttttgctaatggaaatgatcaatagaatattttttttttgtgtttagagaactgtggctcacgttgccaacattggttaatacggttagttcgtggaaattgtttgagtcattcatcggttattgtaagttcatgttcccccattttgttttttctctgaagattgcctgtaccaaactttgctccaggaccccctaatatattatgacagtgaatttaatcccacagtgagctgttgttacactgatgctgttctgcttcattgtagtttaccttaccttatgaaatagagtctacataaaagtaaatttactggaaacttaagattacaccatgaataggagtagctattttttttaagataataacactatggcttttactcaacgagctacaactaattattacaaagttcacacatggacaaactcagcacacactgacataatgtaaagaaaacacaaactaaaaagacaccaacactgcaacacaagataaaagaacctatatccgaaattgacaaaaaatatatatataatcgttgactcaagtttatgacatgcattttgtggttgggtccaaccccgaaactaatatgttgtcctgaatagtacatttgacattctgattttcaaggttcctccttgccttcatcttttctgccctttgcagtgtgaagctagtctatcacttgcccttctcttgatctgtctggttggggctattaacgcctctggaacaacatgtagctttagagctaaactgtcctgcgactggactgactccaccacagttgtgtcctgtgctaatccatcatactctcataagatgttgtaagccctttgattcaggcaacaacattacctgggtgatggagtagcaataaccccctttctctgaaaatagaaccactgttctggccaccattgtccattatagaaaccatccttaacattggatatgtcttcacccttacccttgccatgccacgttacttccatcttcctcttttccatcttccttatcacctccactgtccatgtggaggggtatctattgatggtcacgggtatatgtagcgtgaacacttaacgccatcctctcaaacatgtgattttcatcgcagagtaggccacgtttacaaaatgctgataaggtaaggtaagctaatgaaaactccgtgtctactgtattggtagctatgtacgatagtggctaaatgcgcgtcaaattgcagaagagaatgagcagtagcgctatcgtattatgttcttgtggattgaggtaaacaacgtgtggaagtaggcgaagtgtcgataattcgagattttgccaattaaacgggagtaattagacgtgtggtttccagcgtctattcatttgaagtccagcaaacttgcgcatttagactctcgcggaatccatcaaaagctctgttttctctgacgataggcactaagtaccgagctgaacaatggacagtttagcaatgtagaactgataattcagtccgtgaaaataaccgcaacgtgggaaccaatattgagctcacatatgtgcaccaaacttagttgtttttttcatctaaagaaaaacctgagttactactgcagtaaaacaaggggcataatagtttgcagagctggttgaagtgggaaccaaacaagagtcatagcgagtgatactgtagtaggagtatcatatttcat

SEQ ID NO: 51880 - DNA, 1262 bp, Oryza sativa
aatcggctaacatccgtcaatagaaggcagccgattaggttaaataccgatgttgacttagattatataggatatctaccactctatgacacatccaacggcttgattgtctagatattgtccttcttttcatacttatagctgcatcagttaagtttgatcttatgagtcgtgattagaatctcaatctctagcccgcttcttggttgctgattagggtagtatcggagtttcagccgatcttacctgatttaactactttttatcctatatgcttgattgacatgttaaatctgccctttacgttaagatcttgctgcatttaagtatattatgcttttgtttagtatataatacttactttaatatcttaccatagagtggtatcagagtattagccgatacatgctagatcttctgatcggctatgttatgaacgtatatagtctcattattaatatatcattcgatctacgtgatttatactgtctccgcatggtgaccgatatatccctatcccttcctttaagtatatattgatataaagattatatattggtaatatctacagccgatcaagtagattcagtccttccttatttattaatgactgctgatcgatgcatatatgacgtcggtcaaaaataaatgatatgtcatcggcacctagccgatcggctatcattatagatttaactgcggtttctttgcttctatttcttgttgattacaggatcaaatcaactggcacgctcatacatttgaaggcgagctttggacctgcactggagttaagcagatctcccaggcctcgtgttttctgtcaacagcgatgtgtcgcgtcggccagccgcgccacgcccgcgccttcaccccgctgttgtggtgtcgttccctcaccaccgccgcactatgcttcggccgccgtcgtcaatccttcgccatcagtccccagtccactagcagcggaagcctggatgtcgagggcatggcgctggctgactacttcttcggccccgagttggacgacttgatgcagtggctgggcgacggcgacgtcggccggaagggcacgctgccaactaagaaggaggccagggagacgatgccgacggtggaggtgaccgccggccactccgcatccgccttcgcaactgcctcaaccgtctgtcgtgaggactacgccgttggcgagcacgccacggggacgccctacaggcacaggttccacgcaagtgcattgtgccatggctgaagatgca

SEQ ID NO: 51881 - DNA, 1243 bp, Oryza sativa
atctcgtcttaaaccggaaatataactattacaaccatagcatgaccatccacaagatgaacgccagagactgggattaaatttcaagcttcaggggactcgcttgctctgggcgagcgtgagccgccacggctaccaccatcaccatttccatccctagggctcgggctgccgttgtcccttgggcttcggctattgttgtccattggactagggcttccattgttccttgggcttgggctgcgcccattggcagccacagggctacggtagccgtcagatgggctcctgctgttctccctgccccaggggctgtcaccattgcgctcatcattatccttgggtggtgggcttacccgatcctgtggactccttggactccgcctaccattcgggctggggttgcgctcctttccatttgctgctggggagatggatcgcctgagacttctgctgtagctaagactccttgatctcctatcatcacgatctctgcgtcccctgggagatccagatagggatctggacctagatcggctgatagtaacaaaaagattgtaaaacaatcaggccaagggaaaacaagtaccaggtcaacaatagcatatctgcgatttgaacagacagcatggagagtaataatttgagcaggtggcttttgaagcatacctgtaactcctgctccggctccggctatagctacgactacgaccatgaccacgtccacggcgtggcgatggggagcgcgaataacttctctctcgcctggaaaaccaagtacgtattggagaagtcttgagtaattcaaacatagtaccttagaacagagtgctacagtgtatctgaccaacggtatcaatcaatacctgagatttcttggactgttttggcagtttctttctatgtgacctctttctccacaacggtaacatttgttcttccagtcaccagccttgcagtctcttgcccagtgaccatcaatcccacagttaaaacagcgacctgttcctggaggaggtcctctccccatatattcacgtgaaccaccagcagcaccacgtggaacctgcatgcacaattttttgaaaagaacatcagagccaacaaaagtacagataatcaattcagcagcagcatgacatgaaggaagaaaataaatagtatcaggatgtgcttaggaatgcaaccaaagaactgcttactcctttagcaaactcaacaggaatgcggcttccatcaacat

SEQ ID NO: 51882 - DNA, 1147 bp, Oryza sativa
cgcgaagacagtctaccaacatacaagcgtgtgcttccataatgatcatcatagcgaggcatctcctgaaaacaaaagcaaagaaacatcagtacttttcaaaatctaatgaatatgaatgactgaaaagagcatgaatacttgcgcagaaatgcattgtacagttagggaatatttttttcatgcaggaaaaacttacaaaacaaaagttcttggtaagtacaacgcacacatacagtatagacccaaatttaggggtaatcagattagaggatgaggtaagacatgattggataggccttgtcactcatagcagcatagacaatatcaacaagcatatatgcaaccactaaagttcacaaagaaccagttcagccaagtctagccagtaatcttagaactgactcgtcgtatctacatacaattctatataacttcaaagaatcaaaataatgcaattatagaatcctataggttgcatgagcatcaacatatagcagatattaaaaaccggagcccaagcaccatgtgactatacaatcacgcaggggcggatctaaagtgcgacatgggggagttcagttgaaaccccaaatcctcttcaggaacaaacaaactgttattagtactagtgataacaaggttaaggcaaagagaaacgcctccagatctagcagagaagctagggttaacgcgaattcgagaaaaagaaaaaggtgttggcagggagggatggcgaagaggatggacgctcaccagagatagaggatgcggcggaagcagcggtacgccggcgccggcgccgctgctcgctggatggagatcgccgcaggcggcgggcgggtgaactcgcgaggagacgggagagtcggtcgaggccgaggcaagagtcggaggccagttaatacgctgggattttttttgttagaataagttcaccgtaggtccctcaacttaacagcgagatttttttaaggtccctaaaccataaaaccagaaatgttcacccctaaactcactcaaaccattcacctgaggtccctcggcagtatttttgtccggttttactgatgtggcatcctagtcaacaaaaaataaaaaaataaatatgtggagcccacatgtaagtgacacaaaaaatgtgggg

SEQ ID NO: 51883 - DNA, 759 bp, Oryza sativa
gtacttgagcccccgcaggatctggtacaggaaatactgcaacaacacggccgcaatcatacatacgtgacatgaggaagatcgaattgatgtttctgcagctatcgattgattgtgtgattgatcgatatatgaaaaaaaaaatcattcgctcacagttcactcacctggcagtgctcttctgacagttcttggttggagcggatgatgtgatggaggtcggtgtccatgagctccgtggcgatgtagacgtcgttgaacgcctgagggatcggcggcgggatcacatccctgatgcctatgatctgcgtgttgttgtagcagttagtgacagattaccaaattcaggtacacgccgctgcgtaattaaccacgtagtcttcagttccactactagttatagcctaataggagcttacgttctcgtggtcgaggtgcctgaggagcttgatctcccggagcgtgcgcttggcgtccatgtcgttgttgaacgcgttggcgatcttctttatcgccaccatctccctcgtctcaaagttcatcacggagctgtaggcaccagcacacggaattcagaagagaaattagaaaaacaaagcaccaaaaagtactccgaatagacatgccaaccagtcaaccactacgctgataataactaactaaaaacctgctcagctcagctgcagaatcaaattaatcatccctgctctaaaaacaggggattagtaattggtcccaattactccatcctctcaacca

SEQ ID NO: 51884 - DNA, 750 bp, Oryza sativa
aaaatataatcatgtgagatcttgttgtaaagatttaattgttacgaacacaacggtgtaatcggattatagatcggataagtaatttaagagaaaatttcgtaagaaaaaaaaatacacaacctaatagaaaaactacttgtatgcatgtctgtaacgctactagtacttctcacgtaattgtccgcgtcgctagttaagtctaaatcgagatgcctctcgaaatagattttgcgtagctaaatgtatagttagctagacataatagaagaaggaaacctcagtcccaacaggctgcgaagaaacaacgatgggagaagccacctgcgggttggatgaagctaaacgtggatggatcttttgaggaaagagatggcaaaggtggtattggtgctgttcttatggacggtgctgggaaggttatctttgtagcttgtgggaagctagatagatgtggagaaccgctggaagcagagatattggcttgcagggaagggatttgtatggcgttacagtggacgctgctaccggtgttggttgaaaccgattgccatgaggcgatgaatctaatacgatccaagcagagagtgctctcggagatgggatttctagtcgaggaggtgcagagcctcgtgactggacgaagggatattaaactcacaaaagttcgttgtgatcagaacattgttagtcattttttagctaataaaggtataagcgagtctttaaccgctttctggccagataaca

SEQ ID NO: 51885 - DNA, 3038 bp, Oryza sativa
atgttcttttaagcaatcatgttcaacagaggtagagctcaaagggttgaatgtttggtaggtgccggtggttataggtagtggtgtagaacaatttcgctcgttcccaggggatgcgctgtcaaacccttcagtcggcttgccacccaactgttgtattttcttgtcctgtatgtgctcatggactcttagtcgtgagctcgtagcagatagttcaatcatgtttccctcgtgccaacatggcacagtacctcaaaattatttgctgtgtctttgaaattcttatggcggtattggaaggacaaatgtgggggttcggtttgtactggtttggccaaacctaagccaaactttctgcctaaggcagaaaatttgcagtcctttgttacattttacttcggattggcaggtcaacgagttgcatttttgtagtaagctacttggttaattgctgagttgtttaactgtatactagtcgtattttccaggacgaatatgcttgttaatcaatatactctctctctctctctctctctctctctctctctggacaagtggtgagtaggtgatattctctctctggctgcgctggaagaaacattccagctgccagggcatgtgcttccggactaacacgattctgcactgggatctttgttatttcatccaagttgccaaaaaatatctcaggaattaccaattccctatggttgcatgttttcagaggcgatctttgcagctccggagctacactgccatcagatgcgactgataactgtcacaagcaacttgccattttagtactgctgggtcttaacccttccggccctgttaggaatggagtagttctcctgaaatttcatattcccactctcaaaatatgttcatttttaatccatctcatatactaccaatacaaaataaaaagaactaaaatacatttactttattaaattccaatataactattctccactttatctattctcaacgcaagtttttttttactctcaccaactccgatggaatgataacaaaaaaataaacttattttgggacaaggcagatgagccaaaattgaacttagtatgggacggtaggaaattaataattttgtactgaattatcgtagacttcatatgttcgaaataagtactcccttttataaacacaagtcaacatgacaagatttggtaaatacttcctccgtactataaaaaccaacttcacgttacgtccaggttcgtaactagaagttgatttttatgggacaaagggagtagtggtgtaacgggatgaaatctgatgaagatggtttattttatctctcttctccattatttatctctggacggatcgggccaacatgggtgaaaaatttctcttctcccatatatacctcttctcttgggtgggtttttctaacccgttttttagcggtttttagtggaatagggtgaaaaccaaaggaaattgatatgttttactccttccgtctccaaatttaccaccttttacctttaattctaaccccagttgtggaaattaatacctccaattcctaatttttaaaaacaggggaagtaccttggaaaaaatttttcttttgctttttggttcccatgaactcttcgtccctgcttggtctcttgaaactctctttctctctctcgccgattttgaagaaagaaaaaagaaacaaaaacatggtcaatggttcgttggctcatctcgacgccactaatcacacactcacacgtgacttgagttcggatcgcgtgaaacggtctccctcgccgtcgaccgatgcagcccattcgcgtgcagtttctgcgatcgtcttcatttctgagaaccgtacaccgcactgcaaaagcctgcacctttttctaccttcctttgcgctactgcgtttttagtcaagccgattccatgattccatttgcacactacaaaaatcgtctaattatatcatcagccgcgccatgggagtatgggggacgaggtcacgaggaagagaagcgcgattccctccctgcgggagcatccggaatatgccaatctctctcacctgcttttcgcctgcgaggctcgccgcttttctgctggcaaaaagcgaaccgatctcatctctcgtctcgagaccggttttctcctcgctttccaccccccctgatcatctacagttcagctgtacatttcgtggtttggtacggagagtctgtcgctggtgacgaccgcgccaacgcagaaatttacaggtgactgctactactagccaccactactagtaccacgaagcacaaatatccgggacacgtcacgtcgctgtttgataacgttaacacgagggcttcgtctgtgctggaagcggctcgctcacgcgctctaccaaacgcaaacggggcacgcggcgaccgcttcgccgccacaaccaggtagtagtgtgctcgccatcgctatcggggtggcaatttgctttgctccatcggtggagcaagcgaccgagtccgcaccgcaggggccacgaattaggcaggcaatcactcgatcggtttttgccgcgggcgcacgtccaccatggcgaagtttaggtaggagtaattggggacttggggggttttggtgttttttgtcatgctctgctgccgaacataataaggtcatcgccaactggggtttgctgccaaacttctgacctgttgatccagtaccggcggtaggattggtagtgatcactgagaggctaagctataccgttggtggtgcagtacgaccaagcacactagtactatcgtgaggcatatatacctttgctacgattacaatggggttttgctacgattacaatggggttgcaaggagaaagtggatttcgaccagatcgtatgtgttttgaggggggaaaagagctaggttttggtcctcgaaactttagcttaaaagaaaaactaaatgaagatataagtatataacattacttaaagataggtatacagcttagctataaagaataatccttttagtttagataacta

SEQ ID NO: 51886 - DNA, 1663 bp, Oryza sativa
agctaagcctaaagtgaacatggaatacgatgtatgcataatttataaattttcactctaacaccatgtctgaagcatgtggtgggcattttcgtctttctcgaattcatttctctaattgagtcaaaagtgtcatttgtcgttttgtcgtgacatattttttcgatgtctatcagtaaattatataaattttaaatgttatgtagcaaaattcgcaggatacgaaggaccaaacaatgtacatttaggctgggaaggtatatacgcatgactacgtctaatctaaacagcagcattgaaaaattactccgtctagtacattatctactccagtgcctactactactactggtcaataataaataaacctaagccaaaaccagccttaaaaagccttatataattaaaaaaacaggtaaaaaggaagcgagaaagaaatctcgctctcgcctcctcgccaccgttctccgtccatccaccgagtcaccgacaggaggcgcgtctcctccctcctcacctccatctccataaacacagcaggctcacgcacacgcctccgccccggaggaaggaaggaaggaaggcaaggaagccaagcccgcgaccccgacctacccccaccaattcaaccctccctcctcagatccaccaccaccgagcgcccgcgatgacggccaagggcggcgccgcgccgtccccgggcggcgcgggcggcctcccgaacggccgcttcttcaccgtggggctcgtcaccgcctggtactcctccaacatcggcgtcctcctcctcaacaagtacctcctcagcaactacggcttcaagtacccaatcttcctcaccatgtgccacatgtccgcctgcgccctcctctcctacgccgccatcgcctggctccgcgtcgtccccatgcagctcgtccgctcccgcgtccagctcgccaagatcgccgccctcagcctcgtcttctgcggctccgtcgtctccggcaacgtctcgctccgctacctccccgtctccttcaaccaggccgtcggcgccaccacccccttcttcaccgccgtcttcgcctacatcatgaccgtcaagagggagtcctgggtcacctacctcaccctcgtccccgtcgtcaccggcgtcatgatcgccagcggagtgagttgttgctctgcctacctctccctatctatccccttttttggtagatctggtgccgctgctgttggatctgagggggaatccggccatggctggatgatgatggggggctcagttctcgtgagatctagcagctgagaaggctaacaaacaggaggatctgtttattgtgccttatgggaatccctttattacgttagtggcttgcttcagatgatctgaagtgctgatggttccttttctactactccttatgttggaaatttgggttatgattttttttgggaccaattcattagtatttactaaattcctgacacaaatgcacccaccaatttgagaaaattgctcttttgacacatggttagattttttttcctcaccagtttgtaggggtagctgatacagctcttttcagtatccttcttgttttattggccggagcccagagcaacatccaaataattgtttggttggtgataacccacaggccagagtcatgaggga

SEQ ID NO: 51887 - DNA, 927 bp, Oryza sativa
atggatcatgcaaactgaacttacagggagagcctagctttcatctgtttggattcatcatgtgcattggggccactgctgcaagggcattgaagacggtgttgcaaggaatcctcctttcatccgaggggtaaacctcttttcttttcattttatgtacagatcataactgatatgcatggtctggattcaaactattgctttcatgaaagtgatattcctgttgagtaatgtgcagattttgagggtttatctttttcagggtaaaatttgacgatgcatattctgccattttgcagggagaagcttaattctatgaatttgcttttatacatggctccaattgctgttattctcttgctccctgctaccatcttcatggaggacaacgttgttggcattacaatagaactggccaaaaaggacaccacgattgtttggttgctgctgttcaattcctgtttggcatattttgtcaatttgaccaatttcttggtgactaagcatactagtgcattgactctacaggtatggcatggagtctcactctttaattcatctcttgttactggagtagaatttagcagtgttcaagaaattgttttagatttcaaatttgttgctgacatgttagtacagtgtacccactcacttccatacatgattttagaatggcgtttgattgattggtaatacataattacacagcaatattcgcattccacagttaacaaatttagcttctataagtttaactgtagaattttgaggtggcccagggaatgacatcaaatcaaagttttaaacttatcggccagccagctactgagcttggaaatatgtttactatgtccattgatttgaactaaaagtgcttagcttagttccctcttaaaatttccgtaattccattgggttaccttaaga

SEQ ID NO: 51888 - DNA, 1216 bp, Oryza sativa
gtgcatgagagggaatcttgctgtgggcagtgggcacaccaaagtgcaccccgtcagtccccgtcccggttgtatttacatgtatgggtggatggagtagggaaagtaagtaggattggagtgctagatggatcggtataccgatctgaatcattctccagaacggctttaatttgcggtgaggttgatgaggttggggggcccatttccaggtcagttttatttgtctaattatgtttatggtgttttgtcaggtctccagtggaccagttaagtgcagtacagtgctgttggctgctgctgcctgctggtggtccccattcagcaagtggaggaatggatggagtcttgttgccgcaaggggtaagggacgattgatgaatagcttctgctcactaatctgatagtggtatcagatggttgtttggatctctgaattttttttggtactcggagcaaattaaacacatgtcgttatgatgctgtatggtacaacctcatatgcctatgagatgttagacgtagaattaatgtcaataattttgttgttgagtagtactgggctactggcaattaccgttaagacatcttacataactcacacgatcagtactaatgaatcagtatagggtttaaatgaaccaggtattagtcagatattgtgcaacaatttcctagattaagtgcaaatttttgccatggtaattggtaggagtaaatactaaatttctcaggggaaaaacaacactaactccttgttaattttaccttatatgaaatcagctccgacaaaatttgaattttaaaacttaattttgaaggttttttaatcaaagcttatttttcaacattggctaggaacatatatcaaaagttttacaaacaaattcatttgctaatagtcatacggcttgcatatgcccaaccgataggggctaaatataatagctcttccgccctactatgtttgtcctagcctcctcctaggtgtcaagcaagaccaagtgaaaatctagcaatagatggaagctagtgatgcaagcgttcaagttcacactgatgattttaagcccatttcctaatagaaattataatagattattgcaaatattccttacaaatgcgaataaactttgagttactttttaagttactttttctaggaatgtgtctcaaattctcaagttgatattgcacagtagaacactttttcaag

SEQ ID NO: 51889 - DNA, 1640 bp, Oryza sativa
ggattttccagcttttccatatatattctcaccagctgtttctcgaaaccttaatctctcaaaaaaaaaaaaaagatcttagtcacgacatagatggtcgtgactcagcaagggtgagattaatacgcatatatcttggccgatatatggttttaggccccgttcgatctctctttgggagatagtttttttttcacgcaaaacaagaaatatcattagcatatgattaattaaatattaactattataaatttaaaaaatggatttatttgctttcttaaaacaactttctatatcgaattttttttaaaaacacaccatttaacatattaaaaaaacgtgcaaatgaaaaaacgagaaagttagaatttggagttgaagaatataactgagcctaagtaccattcaactcaagtacggatgcaggctgcttgtagatacacatatagatatagtgcgtgtctctgcttccttgttaaaatcgtggtgtatggtatcgtcacatatgctaccacgttttaaaatataatatttttaacgctcaaaattaattttaagtatggggttgatcggaagtgctggctgtcagtcagccccaatccaaaccaaagagtatttgctgcagctgtgaatgggcagccaacacaaccgatcaagcactatagctatatctccatctagtctttccaaatttatttaagataataataacaattacatctcggtcactgttaaacagcacacattcaacgagccaaagaaaaaaaaacaaaaatatttgagattatatgacaaatccctgtccccctcccaatgacatccaactaaaataccgaatagaggacatgtaacatttataacaatgctggagattattactccctccgtccccataatacaagggattttgagcttttgcttgaactgtttaacgactcgtcttattaaaaaattttggaattattatttattttttatgacttaatttattatctaaagtactttttattttcctatttttgcataaattttttaaataagacgagtggtcaaacagttcaaataaaaactcaaaacagttcaaataaaaactcaaaatcgcttgtattatgggacggagggagtacctttactcccaacccagatgcgtttcaggcaacccaatcctcagtagatgaaaaaggaaaaagaaaaacaaaacaggcaataactaaagtgaaaaaaaaaaacaaagcaaaagtatgtgactcgatgagacgaggggtccaaatcccaggaacatctcgagaaagcacaagctcgacgccggctaaacccgcggaaatccccttccgctttgtctcgtttcctcctcctgccccctcggcactgcaccgccgcagcttccaccatggccgtcgccagcgaggccgcttgtcgtcgggcggctagctgcttctttgaggtcggcaggcaagagatcggctcctccaccccgcgcgcctcctcgcgccgaatcagcggctccgaggtgcccctttctcggttttaatcccatatgatcctggtgtctgatttcttggaaccttctaggtgttgatcttgtagagttcgcaagtcactaaggaagtaataaggccgcgtatttttgcccgtaaggg

SEQ ID NO: 51890 - DNA, 1689 bp, Oryza sativa
gacatggacatcatattatgggattggcttgctaaaacacaaaggctcatttacccttctggccatcaagaaaatgttttccatgctcgtgtaatgccatttacagatgatagcgccattgtaactgttgctgctgatggtcaggtttgtatctatcaacatctgagttgtgttctaatagtaatactaatttaataccaccatgttattcgcaattattcccataagcatgttgtgcggttacttttgtgttctccacaagtcgtagcaatcagcttcatgttgcatggaacattataataattgtattcgtttactggtacatgcactatttggaaagagacttagatctctgaattgcatgcaattactaagagaaagactaggtttttttttgcgtataacatagtaagtttgcaacaaaaaaaaccatagatatatctaacccttttacttgtagtttattttcttattttgtttgcaatggatgtagttttgaagtaaacctatatctctgtttttacacttgttggttatattggaaatgacttctctaccaatcaactgaaaatattagtagataaagtgataaacacattagcatattttacttttctgttatttgcaatccgatataatttttgataacatgccatatacccaggttagagtgggacaactgaacgagggtggtgaagtcacaaccaaacaaattggggtgcacgatgatcgtgcacataagttggccattgaaccagtaagtccttacatattttacagttgcggggaagatggtttggtacaacatgtatgtcactcaaaacaattttctgcaattgtggcaactgttttgtgatagcatgtacattgaacatttatttctttacagtttgacttgcggaatgattcaccaatgaagctcttcagctgctattcattctcaaatagcaggcgtcgtgtaaggcttaataccattgccattgacccttggaaccctaattatctttcaattggtggttctgatgagtatgtgcgggtatatgatttgaggagaatccagttgggtgcttcaaatgacatgaaccaacctgtagataccttctgccctaagcaccttatgggtgggaaggtccacataactggtattgcatactcctacgcaagggagatacttgtctcttacaatgatgaacatatctatttattccaaaacaatatgggtcttggtccaaatcctgaatcagcgcaagcagagttcttggacaggcttgagcagccacaggcatacacaggccacagaaatttccgaactgttaagggagtcagtttttttggaccgaacgatgaatatgtcttgagtggatcggattgtgggaatgtatttgtatggagaaagaagggaggtgaactattgaggatgatgcatggtgacaaaagtgtagttaattgcattgaaccccatccacattttccgttcctagctactagtgggattgacaaaactgtcaagatttggacaccttcagcaaataaagtgatgtcgctgcctaaaaacgcaaagcaagtaagttgtattgacataagtaatgttggacttgtatttatccatttccttttttttatgttttacgttatttttattttgtccctaaatagataatagcttccaacaagcgggcgagagaaatt

SEQ ID NO: 51891 - DNA, 720 bp, Oryza sativa
catacccgcaaaaaataaatttgttgtatttatggcattttcactttgttgaaactttggtattgctaaaatgggtacgtcaaactaacaaacaagtgatcgtagtactgataaggtttattgtggtggaacatatccatccggatttaagttctagacttacatggctgctcatatttatagctcattattctttcaatggacggcagactgactgactacatgtggatgtccgaacaacactttctgcgcgctttgtagacatactcgggaaacggtgttccacctcctagtaaacctcagatactctaggaggatttaggagaatctggcatcctggacgtcgcaagagcacgtcaaatcgggcaattgggctcagcctatgtcgccccaagactggtggactgtaatagcaacacacccagggacaccgagaaaaggaatttgcacccttttgttgctagtgacatgggagatttgaaaagagagaaatcaaagaattttccaacccagtgaactctcaacactatcgctctgcgcaaagataaaggaggagaccaagacctggaccctagccatcacaaaaaggctatccgagataaacccttaatttttttctccttttcctatgtaaatttccaaagttttagctttgtacagttttttcccactatattcaatgaaatgggcacagtctggtgccgattcgttaaaaaaaag

SEQ ID NO: 51892 - DNA, 8524 bp, Oryza sativa
tcttttgtaaatcatcgaattggtgtatgtgcgtcccttgggtgtcaggatggttggatgtattagaccttgaaaagtagtttacttattctttacgttattaggtgttcttttataatcttatgtgcgcccttatggcaagagtttctgggcctggctatcaacctatgcttctgcatctgctggacttgaaatgctccagttgaagcagttcttgaagaacacaaaggtgaagaggatgttccgatgcttcttctagcagtgtaccagcaaccgggaacaattcataggttagctgttcccttcatttattctctttaggaactaattatgtttatggaaattaacctttgctatacacaagccgaacagaaatttcgcaaagtctcttcaagaatgtcacatgccaatcaatgattgaatacttaattagatgcattagttagattaattgcaatgaggtgaactgaagtatcccttcttcttgcacaaatcttgtcagtctgttgttactctgtcactgtttccctctatttatgccatgcaacattggattgttgagcattcagcaatcaaattccattgccatttttcatgaacttatttcctcttacttgaggttaattcagtgttctactggaaaattaactttatgaaatgtgaaagcaaaccctttatcgtagagttttgatccaaacccttatctggagctgttccatacagatttaggaaaatatttctgtgtaacactatcaggcacaagtcgcaccacaaaacaagagtttggagaagagaattgggtgttggacatcaagggatactaaggtgtctaaagtagtcttttagtgcttctaactactcttagtttgagaagagaattgggtgttggacatcaagggatactatgctgttttagtttgagtccctgaatgaagaggtcttctttctgttagttagctgcaatttattgcagtgctggaacttctagtttctttcacaaataacctactgatatttatccttgaatgtgatgttttcacagcttccctcagagtggaaattggacacttggcaaaaattattgtttcactgcattgattgttgttgttgctaatggctaacagtcgctgctatgtggaaatagtaatgtgctattcagagatgagatactcaattgagccgaggtccgtcttgagccagagcactagcttccgactattttcacggtagttgaatctctgaacggtaaaagtcgtttataacttgacacggatcagaactgaaagttcaagtgcttctatgtcccaaatgatcccccaaaacatgaaaattcatggtaattagcaggctgttttgtttatttaggaaggaaacacttttgattgtgactataatcatcatgaacaagtgggatccgtggcgcaatggtagcgcgtctgactccagatcagaaggttgcgtgttcgattcatgtcgggttcaaaaccccggtccaaaacggatctttttttttttccaacgtattttggcaatcaactttttggttcttcaattccaggcaaagaactcgactgcacacgtgagcctgcgaccgtactggaccaatttgcgacactagtgatcgcgatcgtgatttgtgaataatgatgtgcgctagtacaaaacactccctgatgcacctattaattttagatgcttgtcggattttctgacgggcgtgcaggtacatctatatacattgcatggtccaaaaggacatgaatagatgcaaggaaaatatggccagcttaattatggctaagatttcgagtgaaattttaatgttcttcacaatattaagatgtgtctcattcggtactaagttcttacattctgagacggaaggaataattcggttcgggtgatcgatggtcgaattgtggtcttgtggctgctgtgatccatggtaggtttgtcgaaaccacggtgaaaatagtcagaagctgtcagggttacggataaggcataccctccatcctacgacttatgaaatataccgataaggtataccttcacgtgtacggatcgtttccgtatacgccattagaaatttatctcaaattatggaaaatatctttatgggttaagaaattgccggagtcctactcagaggggataaaatctctggttatatcgtgctagtttacatatccctaaatcttacttaggggtcaaggcattccactgtgtaaaaaggacccccgggagaggcaaaggggatcgcatctcatcacctacacacccaccgaagtttacgaagccggagtacatggagccacctcgttggaagatctcgtcgaatccctcgactacgattttgtcggtattgtctgttttggttactctctttgtaatatgttctcatcatcatcaatccatataaactggactagggctattacctgataaggggcctaaaccagtataatccttgtcttttgtctgttttgatgttatactatgtagacctctgctccaacataccccaatattttattcatccggtccgcgagtatcactcgtcgacagaagttaatagataatggccttgttcaggatgtcaggctgtagcgctgcggtcctgtatttttctggataagatatactccctttgtaaaaaaaagtacaaataggatgtgacttatcctaggataatgaatatagagctcacatcttatcctatgttgttttttttgggacgaagggggtagtttctacctttgttagtatgtttttcgaactactaaacgatgtgtttcgtgaaaaaatatatagaagttgctctaaaatatcaaataagtcaattgtaagttagtgataattaaaactcaattaatcatcaaataagtcaattgtaagttagtgataattaaaactcaattaatcatgtattaatagttttttttattttacgtgcctttatttaatcctcatcttcatcaaactagaacgggcctttctcggacatcggctctaaacctcaaagtagtttttagcttgggccattataccgtattggaacattgaacgtccactcgcatgggtcaccacaatgccatgtctcgtgaatggagagttagatgaagtctttggatgcggccaccttaatactcgtcccgtgtctatgagaaaattcaagaaacgtcaacgacaagcgctccaattcaaaaaatacgaacataaattcttgaaaaatgccatcatacaagtgccttcgtttaagagctataaaaagaccattttacccctataaattgttaaagatgattaaaacttttactttttcaatcaacttacaataatttagtgtaaagagccaactacatcatagtgtaagctagcagaaagagcaaaatttttaataaaatttcaacaaatcatagggggtaaaatggttttttagcactttaacggagggatgctaatgaaaacctaaggatgtgtttagcaaatgggttatgagaggtctgattgggaaatggaaattaataaatagttaggattaaatgaggtgtgaagaatggatggctatgatacaatattaccctttggagggtgggatataatttttctatcccatttaccaaacaaagcctaagggtgatatcatttatgggataaatgtgcttgtaagatgtcatttctataaagtttggtttgtcgatgccatttcttgaattggggcacttgtcgataacattttctaaaatttctttctgcgtagacaaaactaattgttattttggttttgtttagttttgtagttatctagtttgagcacaatctgtttttttttccttatagatgttacataagtagtagtaaaaagaaaggcaacattagaaccttcccttttttagttgagttgcgtgactagaagaacgtgtgtgctatgctggtccaatatattaaaagtgtttataaatgtaggatgtgcgtatttgtaatttataaggataagtgtgcgcgtgtgcgcatgtgatgttatgtttgaaaataaagatatgttagaaaaatagaaattaacacccgagcaaaatttactattccaaaaataatcaaagctcgcacgccatttaacctttttcttttttatgaaaaaaaaggtctaactgatgtcatgagtttatccactgcccctgcccccgggacggtcaaacacacctgcctggtccaccgccacagacccacgtgagcagaaaccgggtgggccccacgtctcgccagtttctctcgcccgctgttcccgcttcctacacagtttcacttcccccttggtcttggtccgtctccactctctccactccgccgccgccaccgctcgtcgtcgcctccccccccaaatcaaaaatcaaaatcaaaacccccccatctcttcttctagtttcttctagaagccgggacgaacaccgcgtcgtcttcgccttcgccttcgtcgtctcccgctcgcttcctccctcctgggttaggttaggcctccccccctctctctctggttttgtgctgatctcggagatcccggctccaggtcgagtgatccattttttatttttttattttgttttttttgggtttcgctgggtttgtgccagtgtgttgttctcgtggatggtttgtttgttgggttccaccggatttttttttttttgggggggggggggggtggggcgctggagatggggggatttatggtagggtttatcgtctcgtctcgtgcgagtcggcccgtcggtgggtgggcgggatctcgcgattccgtgttgattagttcgtcttaagcggttcgggtgatttgatgctcgtacgtgctgatgaactgtttgggggcttgtagttttttttctctctctctcttttaaagtaatcccgagtttgccggggatttgaatatcggtttcgtgtgtgatttgctctagagggtatggtttaaggtagagaaatttgatactaacatatgccatccaatccgcgtgccttgtgtgttttgccactttgatccggatgtcttggttagccatggcgttcctgcttgagctcacatggctagaggttgcgcaagtagtacttgctccgtgcgaacgattcaccatctaatggaaatctggcggaagattggatgcatttgttaagtactgtgtgcaattagaatacgtttgcaatcgtgctgtaccagtgtctgccccccattatttatctgacagtctgacagagcgtcttcagatttgtgttaattgctcctgtggttgatgagtctttatagggtgcagcatctcaactttatttctttttaattgtgggaagggtgtactccgtatggctgacagatcgctggggagtaccttaatgaatactcacgaatttattattactagcacagtatgaagcctctgagttacttgagctgtgcataatctgggttgtgtatcgatcacaaggatcaaattggctaatatgtgtagttgtatattcataaaaatgatctagcatgtattatctgttcgtcactaaataaccaaaattgttgagatttcattttcatacccatctaagttatttgtctaaactgtgtgcgccttgtgattttgtgaaaattcttgtgtgctaaaaggaaaatgaagaccataattgcaaatttattatgcatataatttctttcgattgtttaaggcacatgggaataactgccaacatgccttaatcacactattttttttttaaaaaaatggataaggtagatgatcttgagtctgttagtctttgttctacttaccatttatattctgtgtatttgtcttgctaaaataaacttcactttccactatcctggatgttttctttcagttatttctaatatgtcttgttggccatgcaggctgtgcactgaagtactgaacgttcttttgtagactgttaagcttatcctgcatcatggagaatggagacaaggatgagaaaaatgttgctgtcacggaaggatctaccaattctgaagaaaaggatcaagatgaggatttgttgaggagaacagaaatgctgaatgcaaaagaagcaataaattcttcaaatgagaattcaggcaatgattcagaagcacagatccatgtgagagatgattcacaaaaagaattcaatgagaagatgaataaagaaggaagctcagatccaatggaacctacagattcaagccagacagaggaagatatccttgctgaagacaaatctgaagaacctgtttttgatggaactgaggttgctgaaatggaagatttgaggcgttcgtccaatcaatctgtggaacttgattcagatgcccatgggtctgtactcaatgaaagagctactgcaatcaagaattttgttaaggaaaagggtgccattgcagtttcaacatttataaggcgcctttctggcaaaaaggacgaaaatgaattttctgttgaagatgaaaagaatgaaggatcagaaagcatcagtagtggcaatattggctcagatgctgaacctaaatcaaaagaggtgcagcccaaatctgaggagagaactacatggaatccactcaacttgattaaaatcggacgagattttgataccttcatgactggggaagctgggcatgaaaatgtgccagatttgatagagcaaccaacagggaagggaagaattattatatacacaaaactgggttgtgaagattgcaaaatggttcgctcattcatgcgtcagaaaatgctcaagtatgttgagatcaacatcgacatattccccagtagaaagatggaactagaaaataatactgggtcatccacagtaccaaaagtgtatttcaatgacttgctgattggagggttaactgaattgaagaaaatggaggagtctggcattcttgatgacagaactgatgctcttttcaaagatgaaccctcatctgctgctccgttgcctcccttacctggagaagatgatgaatctggtagtgggaagatagatgagttggcaaccattgtcagaaaaatgagagagtcaatcactctgaaggatagattttacaaaatgagaagatttagcagctgctttcttggtagtgaagctgtagatttcttatcagaagatcaatatttagagagagatgaggtacgatatcaactgctgcttattaataaaacaacttctagcaatgctgtatgcagaactcagccccatatagctctgaaacaacattaatcttatgtccctttttcagttggctattggtggaaaaaaagtactcataactgtatctttgaaatgatttcattctttggaaagaaaaatatccattttattttgttcctataagaatatagtttatctttgaagggatacagaggaaattaaatttagttatcactttccaaaaactcaccgatatatattttccatgtaggcggtggaatttggaagaaagcttgcaagcaaatatttctatcgccatgttttagagtaagttttggaaattatcttatataatattcttttcgttttatttttttttccatacatatcaatttgcaatatttacatctggcattctgactttgcagcgaagatgtatttgaagatggaaatcacttgtatcgcttcctggataatgatcccataattatgagccagtgctacaacatccctaagggtatcattgatgttgaaccgaaaccaattgttgaagtggcatcaaggttaagaaagttgtctgaaaccatgtttgaagcttatgtatctgaagatggtaaacatgttgactacagaagcatccagggttgtgaagaatttaaaaggttagcacttagaactatatgctcattgtcaaagtatactgcataatcaatgtatttcttgccagcagatattactgtgaacaatgttgtattgctctagttggctaattttaattgatacagatgtttaggttcataatgtgagctggccttgaatatgtatatcagtttatttttataatgttatgtgatatacaaatataatatatttcagttgttgcggttatcctattgtgatggttgacgggtatgctgtactaacatatttcttgcataggtatgttagaacaactgaggagctccagagggtggaaacccatgagttatcacgggaagaaaagctcgctttcttcataaatctctacaatatgatggctatccatgcattagtgacatgtggtcatcctgctggaccattggacaggagaaagttctttggagattttaagtatgtcattggtggatgtgcttattcaatgtcagctattcaaaatggcatactgcgtggtaaccaaaggccaccatacaaccttgccaagccttttggacagaaagaccaaagatccaaggtgaacagagcagatctcagccaaaaaaaggggaaacaaagttctctgatatgattgctttgtttccccccatatgtcatgataatacctgtagccctctta

SEQ ID NO: 51893 - DNA, 1754 bp, Oryza sativa
aggcccgttgtatatttgatttattatctgtatgtgtttttgggagccatagcctagcggtcatggtgctcaagtagcacctctaggtcctaggttcgactccccatgggatcgaattttaggtttggttaaaaaaggtcactcgttgtcactggcccctttaaaacacatgtttagaattgacctatggagggcgggccctcgtgtacgggttaaggaccgacccatacggggcaagtccgtgtgtgaggggccagggttcgtagtctttctcggccgatttggttgaggcttcctattcttaatgaaaagccataggggtggtcattcccccgccaccgccagtcgaggtgttttttttctttttctttctggaagtcagatttaggatattttttaaaaggtaaaagtctgtttatagaagtcgactactatgctgtaatggttgttttcagtacctatttgccaaaaatagccatacgaagtggcaacagcctttaccatatctgcaatataatacgggttacatcccattgatcaatccccattcactggttacatgcatgagtactggctttagcagcatttctttgaatcatttttttattactcccaattaattaattcatcaaacttacatgtcagacgtgagtttgcaccaatgctgattttccaatgatgataaattctccttttttccttgtctgtaatttgcaggtggcccttccatatgctgaacctcttgttcactttgctttggtatgtgggaccaaatctggacctgcacttaggtgttactcgccaggaaacatcgataaagaactggtggaagctgcacgtgatttcctaagaaatgtaggaattgttgttgatcctgaagccaaggttgcatctgtaagcaagattttgcgatggtaagaacactattattcttgcttcgcaaatagggccttgagagtttaataagtgctttcttattagtgtaccccatctaaacttgtcatcagaatgtacaactgcaggaacatatacaagaatgaattttatgttaggtagtttagttcatgatgcagggacataaacaacaacgaattttatgctaggtaatttaaattgtttttgagccttctggttggagagaaaaagtagataacacgtaccactagtgcctgctagttttgggctacttgaatatactctatggttaacctagcagcaaaaccagaaaaatctgttaattacctggcttagcagtaacccctatcatagatcagaaccacctgaaaagttctgtacaatttatagttaccgcatcttactacaagagtacaaggttaggtgtggctttgtgggaggcatgaagaccattgaaggctaggttctgatgtcgagcacctataggtcactgattttattttctcatttccataagaagtccaaattggagtgtgaaagttttgaacaaaatactttagataatgtcgataaggcctggatttcaagaaaaaaacatttttctctaatctgctctcggtataaattgtatgtgaaaaatggtgaggaattcccccaaaatggttacccaatttttagctcttgcatggttacatgagcaagactaatggaagaatgtgaattcactggttaatcaatttaagaaaataataatatgcaaattttatccattttactacattatacatgatactccctccgtcccctaatataagggattttgacattttgcttacact

SEQ ID NO: 51894 - DNA, 1166 bp, Oryza sativa
atctaaagtactttaagcacaacttttcgttttttatatttgcacaaattttttgaataagacgagtggtcaaacagtgtaagcaaaatgttaaaatcccttatattaggggatggagggagtacatcataattcgatatgcaattggggaacttgtggcaatgaataactgaaaggaaaataaaatggctacatatttgtaatggtgacattattattatttggccagtgctttagtaagaagtttctcatctgaagctcatttggtaaataaataatttttcaggtatagcacagactttggtaagaacgagacggaagtgctgaagcatgcggcaaattatctggaaccagcagagtcggagcaattcttggaactacttgcgaacactcaactgaaagtcttgtatcaaccctatgactggagcttaaacatttagctgcagccatggtattcacatagatgtctagttatacttgaatacctgtcacagatactcgtggaagatcacgacttcttttacaccagaattttcccaagagttggtcacagctctggatgctgttttgttgtggcacaaagaaatgagtaccaatccaactctgttcgattcactggacaaaatgtgtgccttccttgtttcttttggacgttctctgttgcggccattcgtttttttggcggtgaatagctgaatgatttgtgatagcctttcaaggatacacacgaatgaattagctagtgttataaagttaaaattggatttaaaatagttttccaagaaattcaaaatatactagtagtagaaagttattttttttctttttccaaaaaaatgctcaggaagcgtgttgccattccattcagaggaagcgtgttgccattccattcagaggaaaagtagagccatgcttctggtgtccaggaatgtgtcgagtcatatgctcctaaatatgcacgcgtgctgattgagtaagagcatgctgtgaatgcttgtgcagaagtacgcattgccaggctcacagggtttacaaaaccataagcttatcaagtgcggtaatctaagtttttgaagaaacggtatatctcgcggggtttacaaaaccttaaaattatcatgtgtggtaatcttagtttttaaagccacggtatatctcgcgataac

SEQ ID NO: 51895 - DNA, 9613 bp, Oryza sativa
ctttgatccgacatggtctcttataccaccttgagaaacagcataaatagttttggcagctgcagtttggctttcagctgacttggacctgagaagagcaagcaagggagggatgcaaccaccaagcagaaccttcacccttagctcctcttccttgcaaagagaccccaggacagtagcagccagcatcttaacaccagatgaaccagatctaaggagagaaacaagtatagggacagcctgtgcatgtgatccaacagctccaaatgtggtgtctcttgtttcaagaagatccaataactgcttcagggagttctctttctcttgggtggatgaagaaccttgccttaactgctcaatacattgagcaacacttgaaagtgtctcctcatcctccacattggcacggttcctgcaattacaaaacaattatgcttggcaccttggctatctacatatcaggataaattttataattaacatactgtaattaggttctaaaagatagcattatcaaggtacataacatattctcagtgataacttgtgtgtcacataaacccttttttcattatcttcaatatggtgaaagtgaaggtcccggaaatggttctacggtcatgatttactcacaaattagaaaacctattagttatacaaagtttttttttggctaatttaactgctatggctgagctcattttcccgacttcttcatgctattgatgagaatttcacagtgcaaaccaagaaatggaatcaaacttacttgaccattctcatcactgagacaggagttggtggctctgactcttgaactttgggttcctgttaatatccaagcaaaggtagttaatgttgagactcaagcatgcgacacaaacataaattttgaactttacataagctgatgcatgccacaagtttctatgccatgaatccttaactttactaaaaatgctgtgtagatcataaaatcaaattgctgacagacacttgattttataagcataaaataaagttgaacaagattgcaatgagggaaataacagataagaaatataatatgtgcattctcaatcaaacatggatcccagcactaagtgaacattagttttagtagatcaagatcatgcacagatgaagtaaaagatatgcagcagctctatatatacttatgtattgcttcacccaaataactgcattacacaataaatcaaacagcttcaacttagggcatttgcgtgggccttgtgtttgtaaaacagcattacagagccattcaatccattattgtaccattacctgcataaacactaatgacccagaagcatgatatctctcattcttggcttacctacacagaaaaaatagacagcgataaagacgtagacaagatctcctagactaatagaccatcagttgcttagcaaacctgattagtatagcccaagtatgatagataggcctagcgcaaaagctttaaaaaatgcagctgaaatgaagatccccaacgcttaaatattgacaaatatgcatggacatctttttctcaagtagaccgaacactgatctcactttcaaagcatatcctactgctatactattcaacgtttcacccccatgatgtccacatcagaaacaaacgcaatccaaataactccgttaacgtagacgacagcactcttacaattcaagcgacgctaagaaagtgacatgctgcaattctactagctcagaactacagcaccgaggagagcaccaaccagatctgcgcctccattggttccattgaaccgccatgctaatgccgccgccatgtttagctgcaaccccctttagctgagcagatcagaatatcccccacttcttcagtgcaaagctctcaacctgaaaccgacacaagagcaaaacaaaggcgcatcagatccaacacaaaatcatccgatcaagtgaattatacatcaaccaagagcagattccgcctcggattaaaccaatcaccgacgcgtaaccccagatctagcacgcacgagcgcaaccgctactcccaacagccgccgccaagtggatcgcacccacctctcgaatcaccagactaccaaaccactcaaaaagagaaaaaaaaacaccaccgctgcatctgcattccccgcgaattccccccactcacgacgcgcccagccagatcacacgctcagcctccgcatccaaactccggcaacccgccccaatcccacccccgtaaacaagccgcaccgcactaaccgccgccattcccccatcaacccagccgcctcaaccaaaaccgccaaaaaaaaaacagcacgaaattgccgcggaaggagggagaagcccaagtgcccacccaaccaacctctcatggaatcgccgcgacggatgagcgagattgtgcgaacaacctcgccgcccgaggatccgcgccgcgctgcttgcttcgccgccggctcgccgccgcagatccacagcgagaggagggaggcgccgagtctgttactctgccgcagcctccaccgcctcctctcttttttattttttttcccccggcgatttaattccgctaattaaaagggggcgtggtttatataagcgcgtagtgagctctctctctctctctctcccaacgactgccgacagtggcagtgtggtgtggctgtcacttttgcaagataccccctgcataatttagcatttgcaactatagtggtgtttgttttactgaaaatgaaaatgaggttagaactcgaaaaataagaaaatcattatctcacgattaattaagttttgattattataaatttaaaaaaatggttttatctgatattctaaagcaacttatatatagagagatttcacaccaatgcactgtttagtaatttgaaaaacgtgttaatataaaccaaggtaaaatatgtattgttacttcctccatccaaaagtgtttaatacttattcaatattttggtttttttaataagttggtcatactcttagttttcatatattaaagacttaaataaaaagataattaaatgttttagcgaacccaagaatttattggttacgtacatgcatacactctttaatatttgttatatataagatgaattaattttactttgatcttggtgataaaagtaatatgtctatttttcttaggaatgggtaataagaaaatgaaccaggtctgtagccttctcagatactgtgagggggtaaattgtgaaatttgggtttgaaagggggttgtgggtgatgattgtgtatttagattttgtgattaaattaattaatagggatgtggaattgttaattggggagcacactaggctggttgagatggtagttgattagtgccgtctgcataggctggaatgggttttgtcttgtggaagacaaaaaatcaacaggtgggagaggtatctgccaccttccaaatagctgtaaaaccagtgcccacgaggaaatcgaacacaaacagtttgtcacaacacgttcttaaaaaatcagatgaaattttggtgccaatgtgtttcttttttacaagcattacatattttcagttgcacttttcttttgaccaaacataaatattatacgcaaatttatcgtgtactataagactatgagtcatacaacgcactgtttacttggacttatattgaaatcgtctggtcaagacattgccctattatatatacaccaattttcttaattatgtccttaataaatcttgagaaattttcttggttctaactacgattcaatatttgttagaaaattcatgtgaacttgttggtgttgaaaatgggtcatttatcaaggtatcagccaatggcggtgcgtatatgcaaatctatcgtggactgttgagtcatagagcgtattgtttacttggccttctattgaaattgaaatcatctagttgaaacattgccatgaatggttttcttgatggccccaaataaacctcattccagaagtgagaaattttctcagttctaactaggattgaatatttgttagaaaattcatgtaatattgctgtgttgcacatgggacatcaaggcatcaaccagcagtagataaactatatatgctaatgatgctcataaaacaacatctagttatcagtgtttcctgtttgatcggtgatgattacttaaaaggcatgctagttcctgtcctacgtaagctttagaattgcctaatcagaaggatgccctacactgccgtataggtgtctggaccatatatacaactctgcaagtgaaaatacaatattgtcctcggggacctcgattcacatgtgcaagagatgatcaaataatgctcatcaattattgaccaaggcatggttcacataattaaattaaacagagaagcttagtgctagagggtgttttcactgtacgtattctactgctgtagcttgtaaaaatgctagtagaaacgatataagatgttgatctaccataagttttatttaccagacaattattttctatatgatggtgatctccgatataaaatgtcggtgcgtggtggtgttttttttctttttcttgattatagtcttctaggactatatttttgttttcggaactgctacataaccgtcgacagttttcttgagtgaaaactgtcaaatttattgaccatcgattccgctctaagatttgtaccgagatattttactatcggatctaaactctcttttcagaagctagtcccatcatctcatgtttatggtagatttgtaagttacattctagttatatgctagttacattatagttacactataattacattgtaattacattgtaactatagtgtaactatactataactacattgttatctctatataaattagatataaagttgcatatattattttaatacatatatacaagttattattattatagtatagttatagtgaaattatatactatagttagatttgaaagtttttccctaaaaaaacactcgacagttttgtagctagtccctttgttttttttcttgctgtatcgatatgaaacattgtaccgtctagtgttgtttgtttcaaaagaaaaatactcttctaatatataattggatcgaaagtagtactcctcactctatttgatgtttataatgatatttgttctttgtttagaattttgactatcgataaatttgtctcgagaagcattatcacaatataataaacttgtgtttataaatttattttaatataaaacttattgtcaaagctctaaaatttcagtcaaaatcttagcatgttctgaccatcaaatagtgaacaattacacagacgatgggtgtaataattcttgaacaattacacagaagtatttagcaatattctttttttttcatctttcctcatctctcttgtacggtcgaggcgggtaattaattacccgggggattattttcttccacggcgacggcgaccgcgcaacggccggggccccgggctctcgatctcgcgagagttgcaacgttctttgggtgaaggagacggcgcaaccgcttgggcgaccaggacatgcttagctatacgtgcttaactaattcgattctgaagaggacgaaataatgacgcgtgtttaaataattggtgcgagcgcgagttaatcttggccgcatttggatgcatggccgaatattttctcaaacttccaattcagatttgttatttttcttttttcagatttgggtgctgctttctttgagctagaattccaactgttttggggtttggcttaatcagtagaattatttgggaacagtcggtgtactcgctcgcaggtgtgtacatgtatactacaccaattaacacaagtcgtctttaaaataagatgacacataggcaagttctttttctttcctctgtcccagcctgaacaacatgtggatctgacgatgatggttcagcttagctaattaagccagatctaccctttcaggctttctcttcttcttctccccttttactttctccttcttctttccctcttcttggtttcttgccatggactctccgacagtacatgcacacatctcgcctccccatcacactacatgtctgcatactgaaattggatgatgatcagacgggaggaaacgatatcatttctatgaaagatatagtctcggtacagtcgagaattttattcatcaatttaactatttattagtaacaacttcaatactacaacgctaacagatattagaaaaatttaaatctaatatataacttgtatcagtaactgtatcatttttacaaaaacgaacttcgcacactcgggaattttcgccataattttcaccctagcagcaacctgaatacaccccaagtgacactcaaagagctcgatactgctgggtagattgagttgccatctcagctgagcaattcgatcgactgctcgctctgatgctatctcgccaactaaaaaaacgctccgttttccaacgaatccaacttttttcttctcgccatcatctccatctaccgggattgacctgacgaccagcaaatggcaggtaggtaggcaggacattcttggctctccttagctctctcgcatgcatggacaattggacatcctaatccctgaacaaatggcgatgtgtcaaaatccactgatccttcattcattcattcagctggagggcgatcaacaattaatcaaattaattaattcctcaggatcgatcatatgcaccaccatcttaattaaacgtggctgaagtgttcttctgttttgtccataacaaggtcactgattaagtgccactactggttgaattagcagcacgcagcagcagcatccagtggttggcgtgatgaggaaattaaagcagaaaatttcggatttcagatttcagggacactgcagctgtgatcttcttcttttctctgcatctttctttttctgcgtgcatgtgacggtggggcctcccgggaacgtgcaggtacagttggatgtagctgacggccatgagggtagctagagtacactgcgaatagaagtagaatcttccgcatgttgctcagaaaagctttcagaattgaatggttggtgaacaatgaaaaccgactcgtgtatacgtactgaaccgtgggatgctcacagctcagtactgtgcaagtgtaactgaaaactgtgctggtaacttggaaccagtactacggactgtacaagtgcagtgcaggaggtatagggactgttcgtctgcaatttacagcacagccacgacacagccggctgatggctactgctccctcctccgtcaaaaaaaaaaaaccaacttagaatctagtacaataaatctggatagaaggttgttcagatttattgtattaggaggggtcacattccctcttctcctaggttgggttttttctttgacggagagagtatttgctgcaggaatcaaactgaatagagggtttgaaagaatgctgtaaatggcagccgaacaactctatagagtggactcctttagtacaatggattttcctatgaaatttatagggttacatttttcctatgggcccgaggtttgaaatattgagctataaaattttcataggaattcttcatttccttcattttttttagtttcaaacataagtttaaaccttgtggttttgattttctttgagaagttcaatgcaccatctctcttcatctctcctctcagctctagtctagtaattagtttcctgtaaaattcctatgaaatatccaaatggcccattcgacgaattcatgtgtttttattttctatacgatttcatatgccatggtattcaattcttgtgtgtttttctcattctgttttttcaattcctgcattttcaaaggaagtctgtaccttctgttctaaaaaaattctgttggagaatatagtactactatgaagctatgggcaaaatttgatgtccagcatagaattcaccttttctttttataaaatgtaagtaaaatattttgtaataaatggcagtgctgttgtgtgcaaaaagaagagagctagtagcatttccacaaagaggttcgaatgtgaaagggggctcagctaagtttgcgtgtcggtgtaaaaagtggagtccatatctcagaatttgtgatgcacgcgttcgaaggctagaagttcggccccgtttacatggtgccttcaattctgggcttcccgcttttccggcccaattgaggaggagaagagaactcccaaaggacaaagaaagtaaggcccaacttttttttcatcctgaagagataaagagaaactcaatttttcattcatgctcttgtaattaatttcaactttattgatttttaaaaactgtgtcatgtagaacgagtggacaagaaactcgtgggaaaaaaaactgaatatcatacatcgctggaattggagatgaaactgatgtttgaatgctccacattctgcagataatttagagataactacccttaacaagatagagggggaacagcacaaaatgcaatttcagataagtattcagtacgtatgcatatacccttgtaagttagactccctcactccacaaacacaagggatatctgaggcttcttcctttatccacaaatataattcatttatccacaaatataaggaatttcacaatactagtagtattaatttcccgaatccatctagtagtagttgtatcgttaagcttctttttctaatcaagtagactggcagttgtatatatcgttaggcatcaaaataacttccctcaatcttaaaatctactaaataatcgagaattaatccctgtatttgtggatggagtaagtatataacgcatacttatccagagatttcaggtactaggccggcttatcttgtgtaaatacgtacttataattagctgaagatatttcaggtgctagctagagcttatcgtgtacttagctgaagatagcagattcactctagaaccctaagcacagcaatgcaagttttcttatcaaggaaatcaataatctaaccccaaggcaagttttttttttcgattcaattgaacctttccatcaagatgtatcaaatatccggccaatatcaaggcaagtatacatatcaaattatctgaatttcttttttccaaggatgaaacaatcatccattgacaaacaacaaactctctccaagcatgcagcaaagtgcgacctctctctatccggtatggatctcaactctcactaggatgatgactacaaaattctctctttgatgatccctactacaaaattctcactctacgatggcaactacaaattctttttctttgatggcaactacaaaattatcctacacggccacaaaaattcccctctaggatcccaagaaatgcaagaacttcatctcaatgcaccatcctgggcaggatcaatggcatcttgggcagggaggaggacgcgcggatcacgtcctcgtagcaaccctccgagcacaccagcggcggcagcggcgccacagccgggtgcagcgacagcgacggcgagaaggcatagcccaccgcggacagcat

SEQ ID NO: 51896 - DNA, 1520 bp, Oryza sativa
gggtgggggtgggaacggctaaagtgtgtgatgtggtccactcgccagtagagagaggagggaggtggggcaacggctaaagtgtgtggtccacttgccagtagagagaggagaaggaggggcaaatgttaaagtgtgtgcgatgtgtctttacatggtccacttgccagtatagagagagagcacacgcgcaataggtaaggtgtagtgtgtttttagctagactacttgttagagagcaacgggtaaagcatgtgcagtgtgtctctactggaccacttcctagtagagaaaaggggcaacgggcaaaagggtgtgcggtgcggctctatcggaccactcactagtagagagagggcgcaacgggcaaaaggtgtgcggtgcgcctttactggtccactttctagtggagttaccataggaccagtgacaaaaccgaaaatcagggactaaaggggatgccacgaggttggtgtgttggataaacccatccatgtctggaccgacattagagtggacacgtggttgaggtggttggcggcatgttaaggtggtcggatgaaagaacaaaggatgagaattaacataccatgattctcatagcgacaactaactagctttgcacctatggagtggtagcttcgtcttgatcagtcatctcctagtatgatatgatcgaaatcttggagattcggttagatggcaagcgccatagtgatacacaattggcttcgcggtgtcggccgtcggagggacgcacgttgtgtgccaagcaatgaggcatctcgtgtacatgtgttgcgtctttgctggtccacttgccagtacacacagacagagcatgcgcaacgggtaacgggtgcggtgcgtttttactggaccgtttgctagagagcaacgggtaaaggatgtgcgttgcgtctctaccggaccacttgccaatacacacacacagagagagagagagtacacgcaatgggtaaggggtgcggtgcatttttaccggaacacttgctagagagcaacgagtaaagtgtgtgtgttgtgtctctactggtccacttgccagtacagagagagagagcacgcgcaatggataaggggtgtggtgtgtttttactggaccacttgctagagagcaacgggtaaaggatgtgcggtgcgtctctactggaccacttgccaatatacacacacatagagagagagcacacgcaatgggtaagagatgtggtgtgtttttactggaccacttgctagagagcaacgagcaaagaatgtgtggtgcgtctctactagaccacttgctagtagagaaaagggacaatgggcaaaaaggtgtgcggtgcgtctctactagaccacttactagtagagagagggcgcaacgggcaaaaggtgtgtggtgcacctttactggtccactttctagtggagttaccataggaccagcgacaaagccgaaaatcagggactaaagggggatgccacgaggttggtgtgttggataaacccatcca

SEQ ID NO: 51897 - DNA, 13853 bp, Oryza sativa
agctgatatccataaatgaatatgcccactgctaacctacatgactaggcatatattccaacatatacatactcacatctaaccatcaatcaacaaaagaaaatgcaagaagtcttgtggtactagtactgttggacagatagcgattaaacaaaagcaagctagtaatatttgtaggaggagataaatgatttgcaaattggaaatattatgtacgggggtgggccaagtcaagatgcggatggagggggggtgtcaggaatttctcgctgcactggcagcttcaccactgcatgagacgctctcctaacacatgcttatgataaatagactagaggtgtgatttaaaaatttatttagtgtgatctagatgtgtctatgacaatggaaaaggggagtgtgtctactgctctcttttcaatagagttgtctcctcacgctctcctagacgtgtctatgatagatggctagaatgtgatttagcgatttaattcgatccaagtgtgtctatgatagatagactatggatttgatttattggctaacgtagtgaattttacagccatataacatgtcacaactatatataatattaaatagcggggtaaccattttactatttgtagcaggatgctatggccaccacaacaatagaatggttgaaaacagctagcatctagaatgtagcagctgcaatagtagtggtagcggcaatgctaggaggcactattaaattaagttcataggaggctatgagataagcattgaaaaaatgtatataacatttttgcaacttcttttaaatatatgcctattatatcataagcgaacacatattgtttatctcaatttttgagtgtgtatcacataaatcaacatttttttgaagtccatgcctaatgtggtcataaccaacgagtctattaaagattgtcacatgttactagatcatgtcatcctggatcatggcgatgcttctatcaacacttgccatgtagagtttgtcaattacttcaaccatgaaaagtataaagcgaatgcatggatctttcatgccctattggtatgcaatgttacggagctcaagattttagtttggtttgatgatgagttcctcaaggatgaccaatccggttatcatctccaagcagttaagaaagttggaacttgattccctaaacctaaaggataattttgttgattcactacctgtgtattcttggaggaactataaatgagttatcgtatcatctctggaagtaagatcatacgaaattcaccgtagcatctgagaatggaatatatggttttcagggcacataaggttggtaatttgactatccacattcacatttgtgtcccaaaccttgtgtcactatcaccggtttgatttgaaggctggacaccactatttgaaagcatgccatatttggtatagagtaaagtgcatgggcagtccctaaacttggagagctatgtcatctaggtccccaaacttagaaaacacatttttgggtccctaaacttgcttagccgtacatcacttgtccaaatcgtatttgacccggtctgctcgccaatgtggaggggcagggacagctggggtgtcaaatatgcaaagaaccccctattccctcatcctagaaatcaaatcgaatcccttgtccccatttttccccaccatcctgagcgacgaaatccctagcaagctcttcttcaattcgacaccctcttctccgattccctagcggcgctatggcgatgtcaagatcaactggagctgtgcgctgttcgtcgtgtcctaccgtggctacagcaccaaaaacaaccctgtcggtgtgtggccgtcgttggatccactaggagctcgacgacaccaagctcggcaccgtcacctacaattactgcgccgatggctggtgtggttacatggaatcccattgattaattgcgcctaatacatctgagaataaaggcagcatcttttacattaggttatttcttctctcctgttgcagagcattggtgtcttgcaagcattttgagtttacatgtgcaagttttatcagcgagatggaagtggatgtatgttttggtattgagaggatcaatataaggagtatttgacgaatacaggacatcttgcagcttctggtgtccatccgcagtgtccagctcctgttgtgcatgtgcagagatatgcattggtcaagcagggttcagagggacatgaatatgctgcagagcaacttgttaggaagatgaactagacattggtagggatgttgtcctgttactaaaatgtgtagtagcttgttgtgtatttgttgtggtgaacaagatgtatgacatagccctacaagtttagggaccgcccctgcactttactctttggtatatgtatttgtcgtatttaacaatgcatgttatggtgcgtgtatatactcgaacttttgagaccgtggcgatgaagcctgtgagagttgctatgccattgttgatcacaaaaatggttactgctttgctagcaagcactatttaatttaagttcataagaggctatgatataagtctagaaaaaatgtatctaacatttttgcaacttcctttaaatatatcgctattataccataagccaatatacattgtttatctcaattttacattgatcacattaaaatgtgtatgtatcacataaataatgggactagctatacaacacattaaaatgtgtgttactattttttttgtgagaaacacttttttttagagaaacacttccaaatgtaaatatactataattgtagtattgtttgtaattacaacttgtatgttaacttgcataatgcaatgcaagtgcacaaaagtggcactgctcaatttttcttacaggattgtcgccgcttagttagccacgagcgtacttgtgcttgccatgtcatgggatcgatccccaccattgcacacacttctgaattttcccgtctcgcccacatgaatcttgatgtctcactcgcatgaatcttgatgtgaatagggccgcccccgaggcgcgtgcatgcgaccgaggcccccaaattataggggccccgtggctgatggcccatggcccatgggggcatccatccaacatccatcgccaggcctggagcgaaggagaagtgatctgactcctcccatcgcagcgtcgcctcgatcacgccattcgcgtcgccctgacgcctcgatctctcggcgtctcgcgtgactacgtgatctgccactctgcgtgatgctgtgatctgctgctctgcgtgtctgtgtcatctcattgtcgagggctcgaggccaaccgcccggcggccaggcacctgctgctctcctcagctcctgctcctattgctcatcggccgatcggcaccagcgcgccaggcgcctgttgctcctgcttggcgctcgcggtcgcggctcaccacgctcgtcggctcataggtaaatttcatctggtaaatttctctatctttttttcctcttcataaataaaaaattattagctcatgatgatcattttttcagcacaacattaattatgttatcgggaaaatatgtatctggtagcgaaaaaaggaaacggaaaaaacactcggatgatttcattgaaccacaacgaggagctattgacagatttttcacaagtaatgctaatgcatcaatgagccaaattctagaagaagaggttgctgtagaggaagatgttccaactcatgagaatttagaagaagaagaagaaaatgttgacatcaatattataatcaacgactttgtatcgcaaaatgttagaagaaatttttgaaagtgccaagtgtttatgattatgttatttctctttgaagttttaaaatgttatatataggtaattttgtcacatcgaatattaaatgttgtgtgtttataagactatataaatatatatattagtttatgtatatatataggggcctcaatataagttttcgccctggggccccaaaaacccaggaccggccctggatgcgaattggcagtccacggatagacatttttccaaacaaaaaatcgtcaacaatttttaagcatttccataaataatctaaattaattgtttccatgaaagtcatcgggacctatccactatctgccataccaaatctatatataatccacaatttcctattgtccactatttagtgccttaactataaccaatatataaatggtttcagagcatgcgattttttgtatgtgaatgtctccaatttcacttatgtggttgtataacaagaagtccatatcatgttagctaggttccttaaacattagctatgttctctagttcatgttgtcatatcatatttctttcttaaaacaacacagagaatacacgaatagtggttttattcttttccacttttttataagaaaaaggtaagatatataccattgacaacataattaattttacaaatcttggtgtagctagatggtcttcgtcggagggattagctatggcacacatgggaaaccatgggattgtgacgacaaggggttttggttgtgcttggtatgcctggaagtgcttgggaggtaagaacacaaaagaagcatatatgtttagcctcccgaaggataataacccaactcctttctagatcactattggtgaaaaatctgtagaaagttgggagttcttgagcttgctagcctagttcttgccgattctagaagccaaccccctctaacgagctctagtcgggcttttataccctaccacctctctctctctctctctctaaatagtattgtacacaatcattagatcgtttcaactcttagggtgtgttcgcatgcccttgttctcaacctcatctccctcgttttccgcgtgcacgcttttctaactgctaaatagtgtgttttttgcaaaaagtttctacatgaaagttgcttaaaaaatctaattaatccatttttgaaaaaaaaagttaatacttaattaatcacgcactaatggactgctccgtttttcgtgcgaagggaatggttcccatccacaacatacaaacacagccttagagctccacgccagttttgctgtagaagcaaaacttcatatgggactccgtgttgggcagacctgtagggtcttgtagtttccaccacaatcatatgaaaataagaacttagatacgggctatctcaccacattaaatgaggtgagacaacttgagagaatctgtgcaaaatataaataattatatgggttagatatgtgctatcttgtacatggagatttctagtggtctttgtgcaaaacagaaggattggcatcaacttttgggactttttacaggggcaaccaactatggggcaaatctataagtgtcatacaactttggtgcattggagcaaaatttgcaggtataatcattgtttaaatgggcaaatagttaatatccttgtaggtacggaagaataatattctacatttccttacccttacatctgtcacatgcttgtctatgtgttcttcattgtatatactcccccacttatccatcaaaatggctgagtagtaaaaaaaagttaacaatggggccatggaaactgtggcaccaacaacaacgatctcccaagtgatgtcctagagtatattctctctttcttatcaacacgtgaatttgtgcagacatgcgtgctctctcaaatgtggcgctatatttggaagtttatgcctaatgtggtcataatgaacgagtctattgaagatagtcacatgttattagatcatgctatcttgaatcactgcgatgcttctatcaacacttgccatctagagttctcaattactttaaccatgaaaattataaagcgaacgcatggatctttcatgccttgctagtatgcaattttaaggagctaaagatttctattcggtttgatgatgagttactgaacatggctaatcgaattatcatctccgagcacttaagaaagttggaacttgattccctaaagttaaagtatatatatatatatatatatatatatattttatttcactagctaagcattcttagatgaactataaatgattattgcatcatatatggaagtaagatcatatcaaattcaccgtatcatctgagaatggaatgtatggttttcaggacagataaggttggtgatttgactgtctacattcgcatttgtgtcccaaaccttgtgtcactatcaccgcttcgatttgaaggctggacaccactatttgaaagcatgccatatttgttatctgtagctatgatatttaaggatgcatttatgtactctaattgttgggactgtggaaaggaagcccgtgagggttgctatgccattggtattaacaaaaatggctttctacttctcaaccatttgtcacatactagtcacttgtcaatagccatttgtcacatactactcaaaacaactagcgtctctgcaatagcggtggtagcggccatgatagcaggtgctatttaaaggctaagagacaagtcttgaaaaaatatatatacaacatttttgcaacttcctttaaatatatgtgcattataccagcatacattgtttatctcaatgttagttaaacacattaaagtgtgtatcccataaatgatgggactagctatacatttttttagagaaccactttcaaatgtaaatatagtataattgtagtaattcaattacaacttgtatgctaatttgcatgcgaaagcacacaaaagcggcgctgctcagtttttcttatgactgattgacgctgctttgttggtcatgagcacacacctgcactttccagctcgtgggattgatccctgccattgcatgcacctccgaatttttttcatctcgcccacacgaatcttgatgtcttgctcacctgaatcttgttgtgaatttgatagtccacgaatcgacaattttttcagtagatccatataaattaatgttttatatgaaaagacatgggggcttatctactatccgctataccaaatccaatccactacatcctactgtccattgtttagtgccttaaccataaccaatatataagtggttttagagcatgggcttttttttacgtgaatttctctaattttcacttgtgtgtttgtaaacaatgaagtccatattacattagctatttgtcgacgtggaaaacacgcactagcctaagagatttgctttactctagtgcaggtccaaagagatcactttcgggttcagggcgtgccagttggtttgatcctgcaaccaacaagaaacaaagaaaccaaagttaaatccgtaaaacgatagtcgatcagctggtttgccgatgacgtatcgtttgtatcgggcctatgcgatatggatcagatcgaccatgtagtgtatggcgaagggataattgaatgtgctctgtcggctgtagatgtcagtaatatatgatctatgctttgaagtactcttaaactaagtgattaggatagatcggtcagcgcaccaagacaatataaaccacttgaattcaagaacgctttaaggcagggattatatatctcgcagcatagccgacaggcatcgtcatatcggctagtactccaataccactttataataagatttcgatatagatcaaatatgctaaacaataatcaatctagtgtcagggtaacccgatagactgatggcaggcttaatatatttggtccaaatgagatcttaatgtaaagggcagatttagcatatcaggtaaacatacgaggaacgagataactaaattaggtaagatcggctgaaacaccgatgctatctctatcgacaatcataagacaagctagatattatggttctgaacgttacttaacagatcaaacacatagagaaacataagatctaaacaagtctatgaaagcctttttgagatggtagatatgctatgtaatctagttcgttgcggctatttaaccctatcggctgttttcgatgatagaggctagccgatgagattatatagctagatcgatccagattatatagcatatatgataactcggcggtttacatagatggggctagagtgtcatgaagatgctagcactagccccgagaacgcaagccgccataacaagctttacctcttcgtcggagatcgaaactgatgcatcccaactcgaaagtaagaacttgtcgaaaacaaagaaagtaaaaagggtggtgatgcaccaagagtgtattgaactttcaatttttttgtttacagggtctcgggtcatatttatacccaaaatacatgatatgtccttgccggacacgactctatctctattacaactcaaaaatacgaacaagtcccttaggcgggctcttaacgaaaatatctataaggaaactatcgaaatatcctaattaatagatgcaattgccttctccggactcaatctatgcttggcaatacttgtgtagcacttgaaccgatcctaacaacgataccatgattgtctcaccgggatcggctacatcggcttctccctatctggttcggtatcagctgatgcagatggtagccgttgcaacccgtagccgatgcaggttatgtttccatgattatcaagttcctccaaatccactttggttctgacttcggatccaatctatgatttaccaaattttgtcgttaacactagtctccttaacactagctatgttctcttgttcatgttgtcgtatcatgtttctttcttaaaagaacatagagaaaacatgaatagcggtttcattcttttccacattttgtataagaaaaaaaaggcaatatatattgccagcataattaattttgcaaagcttggtgttctatctatatgggagtacgatgaatgatgcctcttgctctacgtgctcatgatcacaccttggcattgttgaatgttgtaagcttatttgttctagaggatcaacaatgtcgatcttagcagttgcgctggtcgtgtccacacacgccttttgggcatatatactgaggatacataaatggaacacatattccttatcttgcatgcaagcttaatgaacttagtgccatacatggtgttaggtgaataagataaaaaaaaagtggaacatatatcgtttagtctcgaattatttcttttattcatgtataagaattaagtagaaaatcctagtttaccagtgtaccttctggctcaaaaatgtcatcaccaacaatgttgtaatacactcctttggcaattggcttgcttatctgttatcactacaaattatgattcactcagatacaaactgaaagtagtgaagtgctagtaaaataagtgcataacgaaacatatcgtacatgtgcgagtgtaatttacaattgtaagctaaatgaagtacacatagttagaaaggccctatttaaagttatgattctttttgtcatgtaaaaattaaaatgttcttgatataccaagggaaagctagagcatctgagcgtggggtagagtactagagttgtgcctacttcctagtggcatagcgggtgcattaccactttccaaatctaatatccttaatcgcatacgaaacagtagcggatccaaagatattttggagcctatgcaaattctattatatcaactatttgctatgaaaattttgtttacggctcatcaaaaacacttgaattctattgtgcatccatctagcaagtctgggtggctccttagggtcactggatggtggatttgccactacacacacatgtgcttttaataggatttttagggacgacacattgtgcctagctacctccctcttgctaatagagttgtctgatccagatgtgtctatgatagatggatcagagatttgatttattgactttactgtagtgaattttacagcctgtcgtgtcatagctatatcgaatattaaatagtggtggtaaatcgttgtactagtgataatgggatcctgaggccaccacaacaatacaacagttcaaaatagctagcgtttggaacatagtagccacaatagtggtggtaatagccgatatagcatgctctatataattaagttcgtaggctaagagataagtacttaaaaaattctaaagcattgttaactctctttaaatatatatgcttattataccatatgccaatatgtttatctcaatgttagattaagcacattaaagtgtatagtacatattcacataaatattttaaattgtgtggccaatctaatacctactatccgttatttagtttcacaaccataatcaatacctagaatgggcttttttagtgaatctatgatttaattttccttgtggttgtaaaaattgaagaccatgtcacgttagttaggctctaattttacattctcgtttatgatgccctatcaaattcctttctcaaaacaaacagagaatacacagatgacaatctcattctcttttccacgttttgtattaagaaaaaggtaagatatatttccagcatataattaattttacaaagcttggtgtagctatagatggccttgctatatacggtgaatgatgccttgctctacgctcctggtcataccatgtaattaagcttattttggtctagaggattgacctatatatgcactattgttggccatcgatctcgtagccgtgtgcgtgtccacacacacatcttatggaccaaatctacagggtcaatgtaaatggaacatatactattccttatctcacgtgtaattttaatgaacttagtgccatacacccatacacggtctcaaatgaaaggtgaaagaaatggtacaaataattaatagttttcatttagttgtaaattacttcttttatctatctaagaattatgtaccttcttgctaagaaacatcgtcattaaaaatgttgtaatacaattgctatacttgtttgtcatcccagcaaattttgcttcaccctgctacaaagtgaaagtagtggagtaccaaaaatcagtgtataacgaaacttagtcaacatttactgagtgtggagtgcaatttacgattgtaaactaaatagagtatagttagaaattgtgccgaaaccaccgtgggtgacgaggagggcctggcactccccatcctgacttggcccacccctgaagaaaatgttttcaatttgcaaatcactatgtactcagtagtgactagttctaccatgagccttcttgtgttttctttcgttgattgatggctatgggtgagtatgtatattggaatattgcctactcatgtaggttagttgtggatatattcatttacatacctatcagttcaatagtagcataccagagttgagaataggagatgggagacattgagatacatgatttattcaagggttggtgcacacgacatgtacccctttgaaggctgacatgacaaagccgattgtgtcttactatcgtggcatttgtcgtctcaccgaatattcgagattctgatcgagatgaaggctaccactctataggtgtagagccgtatatatgcgaatcatgacacgtaagtttttgttctttgctcttgcatctgaccacctcaacttgctaccaactatgcatccactctgacatgatcccaacacactagtctcgcgactggcccctctaattcttaaattatagcttttcccctggtcccatcacacaaactacaaactccccttgcctgttgccccctctctccacctcttagggtatacataggtggtgtgttgttcatcatcctatcgtcgaatcaattagatcgttgctttccaaagatgtcgctccttcaacttagcgaagctaactgtctcactatgtcgccatctctccaaacctccaagattccaatcataccatgcgagagggtgactgttcgagacgaaggttgccacttcgtagatgtagagccggcaagccgccgatatgcaaatcataatatgtaagttcttgttttttgctcttgcattttattattgtgacatggcaccaaccaaacgtctattctgttgtctgtcgagccactggtgagttctcctaacacactagtctcatgatagaccctctaatcctaaaattttggctttgctccctgtccatcacatctctactagtaagaggggcagtacgcacaacgcacactccccttgctcgttgccccctctctctacctctgatggtatgaataagtggtgcattgttgatcatccggtcgttatttgaattaattagatcgccactttccaaagattttgcttcttcaacatgatggcgctgattgtctctcactatgtcgttatctctccaaacctccaagattccaatcataccgtttgagaaggtgattgatcgacaaaagttgccatgttgtaggtgcagaaccggcaagccaccgatacgcaaatcataatatgtaagtttatggttttttgcccttgcatctgatcaccatgacatggcaccaaccaaacttccactctgttgtccgccgagccaccagtgggttcatccaacacactagtctggcaaccggctctctaatccttaaattctggctttgctgctagtcccatcacaactctactagcaaaagggtcagtatgcacactgcacactccttacccccccccccccacacacactctctctctcttgactcttgactcccgctataaatagggagtgactctaaatactggcttcgcccatgcgcaggaaggttctatttagagttgtgattcttttctcacgtaataattaaatattccaaatacaacggaaacgtaatgacgctacgataatctatctataggacaaacgaacaacgtaatggtgcagtatatttattgttttcaaccgccgcttcatctgtcgagcgtgtgtcaagtacactcgttaatccatactagtacttcgttaagaaagaaaaataattctagctaccaacctgaatcatagttaggattgtgttttttctttctttttacaaagagggagtacgtgcggtgtattcacattggtgtgtgtgtgtgtgttgcacattcacatatgcgcatgcgcgtctttgtataacgaaggaaaaatgtgacgcgcacacgcgaatcctaccacgctaccaaaaatatgttacagctgtcacctgctaccggaatcccacctcccccaaagaataaatacccaactaatcgagggtgaatctgcaaaaaggccaccgaatcccactcttcctcctcgcctcgcctcgcccgctcgcctcctcgcggaggaagaagaagaagaagaagaagaagaagaaattcctcgagaggaaatcgatccatcgcgttcgcggcgggatccgcatcctcgccgcgcgcggattctcggcgagctcatcctcctcctcctgcggcggctggcggcggcggctgctgctgaggctgcggttggtgggatcttggtcgagcacaccgggggggagagggagatggccagcggcggcggcggcggcggcgggatggaggcggtggaggtgaggttccggctggacgacggctccgacatcgggccaagcatgcacgaccaggccaccaccgtcaccgcgctcaaggagttcgtcctcgctcggtggccgcagggtgagacccccgattcgatcccacccaccatttccttcccccctctctctctctctctctctctctctctctctgcgtctgcgactgcgtgtgtgtgcgcttgtatttcgggaggttgctggcttgctgtcttgtttggtcgctcgttctt

SEQ ID NO: 51898 - DNA, 1068 bp, Oryza sativa
ccacttacacctctgcctcttgttgccaccaattacttatttcttgtgtaatatatttcgagcaaacataggtcaatttgcataaaagcaatacagtgcttgtctagttaccagacaatcacaatcggcgaaagtgtagctacacatgacactttctatgtgcccacatgtttattgtggtccagagtacaatgagatgcctaaatgcactccacatttacagctaaaagcttaactcggttatacttgatgaaatgaacaacatggccatcctaaagcagattcaccaaagcactggctggcctaatattcagttgtttagaactcaatctggaccactaaactcagtatgcctaaatgccaaggacgccacaagatccatattatctacagaagaagtcattccaacacatgtttcatacaagatccaaaatgatttcatggcactaacaattgcaatcctattccatcacatagctatagtgggtacatagaaaataacttctgcttgcctctttaagcagtgaaaccaaggggaaaatcccaagcagaagagcatagcaactgacaagaacttcataggtaaatgctgccatgtttgctaatacgggtaaggacacgtctaaaagaatcaatcaatactttctttctttgtccaggtattccaaaattgcaatagcaattatctcagaaaagaaatatcgcattcgcaagcaagaaaactgcacctacccagcgccaagaacaagaacagaagaaccacgcaatccacggaacaacctgatcggaaattagtagcttatcgcaacaccaagagcaagaacaaactcccaaaatcctaaccccaacatcaacctacgcccaacaaaatagcgacaagacaccgcgctttaaagcttctgcttatcacaggattcacagcacgaaatgctactactactcagcgcaagaacagaataatcacgcaatccgcagaacaacccgatgagaaattggaaaacctatcacccaccacgcctagcgcaagaataaactcccgaaatcctaaccccaacatcaacctacgcc

SEQ ID NO: 51899 - DNA, 1666 bp, Oryza sativa
gccagcaataggcgcttttttctctgatgtgcccgcctcctttccttttcacctatatcctatttcagagttatgtgatccctgtatcaatagagaaacacctaatcacaccaaattttcctgagcctttttgaacaagtgctccgtcctcctgttgtaattttgatgcatccctctgttgaaacctgaccaaactgtaaatagccgaagaagaaattttgtcccgagacaacagataatatgctgttacaacaaaataaatcccatattctttccattttgtcaactgctgaactgcagctactgctctccatggcagctcgtgcattatcatttcatcattgaatttttctctacctttgcaatgtggctgctcattttccatgtcttgcgttggccgtttcgctcttgcttgtccatgtttccggctttgccggcctgtaatgtagttctacctgccattcgatgccggcgagagctgggactcggtgagccgtcgtcttgtcttgccgttctgtgaccggcaagtgtttccgcctgtagactgtagtggtgctgcacgccttcattgcctttttgtcttctgattacgtgcgtgcagcgagcgagttggaccaaagcactagtacgtggcaatttggcacgttttggagagcgcgactatgcggcgaatggaactcgacggcgagataagcgaaattttattgttttgtttagaacttttttaattttagaaataaacctaccctcttgaaaattaccacgtcacctcgccggcatgctgaaataactcacaccacttggggttggtatatatacggcctgtttgatacgacaccaattctagctccacctctcatatagctagaattcaactattaaacttgctctaagctggattaattgtatagtatatttttatagataattattatataaattggctattaaaattgactataaatgatttagagtagatagttgactatactattaaacttagctctaatctgggttaggcttccagtatacctagcactaccgggaggactgcgcgtaggggtggaaacgttttttggtgggacctgcttgaaaaaaaaattgatggtagacctcatctaaagctacgcgcgctgggagatggagcctatttacttttttcctacatgatgcttgtgcttcttggtgagccgggacacatttgctattgcctgtagagtggtacgcctagtacgtacgaggcaggagacagattagcagctgcgtgctttcctctccatctgatggtgacggggatggccacgattaagttggaggaattaattcaatcgattggggtgaactgatcaagtgaaagcatgaacgagtcggtacgaattaatgagaggaggagatctgcgacgtgggtaaagattagaggagggacatgtgggcgtggggctcattgatggatgttcgcttcaaaatataataagctttgactatgaatttatttagatgtatgtattcagttttgtaactaaaatttattatattttgaaattagaaatcatggagatatagagttgtagttgtatttttctacggtactaccagtattggtaggggcgatgaatgtccgtgtcttaggcctcggctagcagaagtgaacaaatatagttcagag

SEQ ID NO: 51900 - DNA, 21873 bp, Oryza sativa
  unsure (1)..(21873): unsure at all n locations
ataagtttatatattcaattcttcataatcttaatgataaattttaagttgacaaataataacaccataaaaaataaaataattgatataaacacatgatagcctaagctcgcgagctagctcggctcggctcatttcagccacgagctgaaaaggaggcttgggcttggctcgtttggctgacgagccgagccaagtccgagctgagctcacgagcccgagctttttttttttttccatccctaactgcgcgtctgccgcccagcccaccaccggcgacgggttgacacgtgcggcgagccgccgttgcttgactgcccagccagcgtggcacatgacatgatgatcatcgaaccttcaagcctgatgacatgatctctctaccatgatttgtggatccttgtagtctgcgcttcttttttgtacgttaaaaaaaaaacttgtagtacgcgcttttgtgaataaaaagtatcaatgggcaccacaatttaaactatattttataactcctatcacaatcatatatacctttggtgtttgcccatattttattaaaatttagcgttgctaatttaataagataataaactaaactagtcaaaactcatagtataagcctgtaattgttacagatttctgagaggggcttgaaaacgaaccagagcagcacaaacaacatctggtgccggctagcgctaacataacagtcaagtctcaaaattggcagcgccacctactcccttctttggtctccatgcatgccaccaacccaaaaactcacaagtgacaatccgacgtggcaccgtgaagtcgtctcgttcaaaaaccagtcctgtatgcaaaaggtagggagtgcatggtacaggcttaacaaactccaaatttcattcattgaccagagttaagtatccccaaatttcgaataagagcttttatatgtatgtaagtaaccaaagaaacaatttttgttaaccttttcaccttgtatccgatgatttttttttgttttgttttgcattgaggataggagaaaattatcgagaaccaatttttcactttgtataggctactttccattctactccctccgtcccaaaatataagtatttttagaacagtgcgaagtcaaactttttaaattttaactattaatagcaaataaattaaaaagattaatcatgtaaatttgatgttactatatttatcattaaacgagctatcataatatgcaactctttttatttaaaacatcttacttttgtagatattgttggtcaaagtagcacctcgaagactgaaccgagataaaaaaaatcttatattttcggatagagagggagtagctctcacgcattgattgtctataagaactatggaaccttggaaagttggtgctcttacagtcttaccgtcagattacttgttgtttttgttttttatttctaacttggattacaatttccaaaatattatgggtctatttagattagtgccaagataaatgttaccaaaatttggcaatgccaaaattctggcaaattggcacattgccaatatttagtaacaaactaaatatagccacataattattaattttattaaataatggtattgttaaaaatgtcatcaacatgaacaggtcctatatatttatgtagtctaacagcaagtgaactctctatatagcactatacaatacctatgttttttaatagatgacactattaacttttggtatacgttcaactattcatcttattaaaaaattgtgtaattatcatttattttgctgtgagtttttttatcactaaaagtattttaagcatgatttatatctcatacatttgcataaattttttttaataagatgaatagttaaacatgtgtctaaaagtcaatggtgttatctattaaagaacggagggggtatatcatgaaaatattactcacggtgaataaaagaataaatcttatggtgttaaacaatacaaaattttaaaatttaatgatcaaagttagtcatgtttgacttagaacaaatctaaaacgacaatgagtttgaaatggagggaatatttacataatcttacaattaattattacatggtctagagaaaaaacacatggaattattgaaaaccaagtgtaaacttaatctgtgttataaataataatcccttaggtacaactttcgattatattgaagccgatttatgtacaggagaagaagttgatatatatgaccataatccataggagacactgataatactctctatccagaagtctcaacgcacgttgttactaaaaccaaagaacaattaactaatcccgcatgtaacaaatatcaatgaattgtacacatacatgcatataatgacaaatgagtatttagatagctactcggattctaattaacaattttatctagcaccgcaaaataaaaggcaaatatttgattaagacttttggatagaaaataaaatatgatttagacttttggatggtgggaaccatacggaggtaggctggatcaactcgtggatattccttgacccatgtttgttttagattactgcaaaagtgaacattttaaaaatttggcgacaccaaaatttttataaggtggcagcattgctaaattttagagtaaagtccatcaccggtccctaaacttgtaccgttgtgtcatcccggtccctaaactcgcaaatcgaccgttcaggtccttaaacttattcgactgtgtcatcctggtctcaaaacttgcagatcactcgtttaggtcctccaacttgttcagttgtgtcaccccggtccctaaacaagacggtctaaaaactttataccaaaaaataattcataactttttcatgtgaactctaatgatgacaaactttatatcaaaattgtagccctcgacacgacctacaactttgtagtagaaaagtttttgaattaaaactgtttagggtcccaaaatattgttgcatgtttatagattttgaaattttaattttaaaattatattttgggacaaaaaatgacttaaaataaaaaaaatcgactacaaagttgtaaatcgagggctacaagtttgatataaagtttgtcttcattagagttcacatgaaaaagttataaattatttttaaatataaagtctttagaccgttctatttaacccaatgatatttaaatccaagtttagggaccggggtgacataacttaacaaattggaggacctaaacaagtgatctgcaagtttagggaccgggatgacacagttgaacaagtttgaggacctgaacgatcgttttgtgagtttagagaccgagatgacacagcggtacaagtttagggatcggtgatggactttactctaaattttagtaggataggctaaatgtattggtatcaaaattttttaggcattaccatatttggtgacaagctaaacgcattggtatcaaaattttctaggcattaccagtgtttgttaatttttaaaaaatgatatggtacaaaatggcacttatctgaacgggctcaaagaaacactttaaacttaattaattattatgttaactctcttattttacgtgccctcaagttctcggtctccattaatcgcaagccgcaaacatggcctacgaccaaaggttgttgaccaacccagatcgtttttctaagacctgtaatttacgcgtatattagctcagctatttcagtggtagtataaagtactcctactggctactaacacaagagaaacgtggaagccgtgtgagccgttcgacgagaccgattgcacgaagcagctaggaaaatgtggataataaggtcatctcaaactaaaactatcaaaatagtttttatactatactttacatgtcatatagacattatttataaaaattatatacccagtgaatggcatctttaaattaaattctcatctaatcacctctcttctctcttttttttatccacagtttttattcttgttattgtgttctctcatttcttatgtctccttttatccaccgttttcattattggttcctgtgttctctctttttatctatcatttttattctatagagatggtttcttgtatgagaaataatgtttttatctttttacatctcttctcttttaactcttttgtcacttttgtcacattagatttttgcttacgtgatactccctccgtcccaaaaataagtgcagttttacactattcacgttcaacgtttgaccgttcgtcttatttgaaaattttatatgattagtatttttattgctattagatgataaaacatgaatagtactttatgtgtgactaaatatttttaaatttttcgcaaatttttcaaataaaacggacggtcaaatgttgggtacggatatccacggctgcacttattttgggacggaggtagtaacatatttagggcatgtttggattgatgccctactaaaaattttgatagtgtcaaatcttagtcaagttttggttgccaaaactttggtagggtagagttaaaaatattcatttggattgaagccaaactatacttataagagacaagttcattggcaaaaccaaatttatagcattaatagtgtttcaacctatgtgtttagattgttaccctaccaaaattttacaatccaaactgcccattctatggatggattggcctaaagcatactactcctaagaagggcagatccgtaaattcattatcttatacactctcgagccgcgaaccaaccaccttcgcgacacgtcagcatcccccgacccccgcggccgtctcgccccgtatttattagcgcccggccgccgcgcgtctcctctctgctctgctccgcccgcttcttcgccgccggcttcctcccacccgcaacccaacgccggcgcggcggccgtggttggttaccctacctacgctactacacgcctcaggggcaatggaggctagagcggggctggcgatgcagtcgcgggcggctgtcggggtcggagctggccccggcgtggggcggcggggccgcgccgtgatccgcgtggggaagcggccaaccgcggcgagcctgcgggtcggaggccccgccggaccggcggcggccaagcccctcgccccgctgtactgcctcaaggcgtccagaggtgattcatctgttttttttttcttcttttttttttaactcccttgcagcgggcgattccggggttgtgctcgtgcgagcacggtgtcgttagggttaactttggcgcgattttgtccgggatttttttctcttcgagcggatgcggatccctctggtatggtattcagtgtggatatatgggttcgtcgtggtagccagatttttgcagttttttaattggattgggggaagtggtcactttcgtggtgatctggagtaaatgtgacaacttatgtgttggaaatggagttgttcagggtaggtgatggctttgctgggtcaaataggaaagttggatggggcaatttcaatgaagctctctctctctctttgttaggtgggttggaaggggttaaatttcagtttgtagaagtgtgtattgttacatgtttttcttggtatcaacctgctatttacttcaaaaatggtcaacattttgtaacaaatacactactacaaataacctctgatgatcacaccaacgttggattgtctatgcaccttgtatcatttcttgttgtgatttcttacccgatgtagtcttctattttaggtagttgcctgacgagatgtatatgctaaattttgcttgtgttcagctgaaataactttctttgtaatcttgtatcgtacaggccacgacagcttgcataactcagttgatgaagccctcctgttaaaggtaaataacgctttacaaaaattcctactattagttaaatcaagagtaaaatatggctagaactttgttctctcatctttggctttcggccattggtataatgttttctaattgtaattgcagaggaaatcagaagaagttctattctacttgaacggacggtgtatttatttagttggttagttctgaacctgtatcatttaattgttaacctgtaactggagactaaataccaagttaaatataacttgatcttatttgaaaatgaaattaataatattgagtacgtattgtaggaatgatgggctcagggaagagtacagttgcaaagatattagccgaagttttgggttattcattctttgacagtgataagttggttgaacaagcagttggaatgccttctgttgcccaaatattcaaggagcacagtgaagcgtttttcagagataatgaggcaatgtttcttttctgaattatgtttccctgttgacaacatgacactgttatttttcagatagtttctatttttttgtagtgatttgaatggaaagatttgtggagtaacaatttctcagacatgatagactaacaattccatggttccctgctttgtctaacagagtagtgtcttgagggacttgtcctcaatgcgacgattagttgttgcaactggaggtggtgccgttattcggccagttaactggtattgggattaatctgatctcacgcccatcctcttgtaaatttggctttttctgtttatggataataagtgaaagctcttgtgttttttcaggaaatatatgaagaaaggtctatctgtctggctggatgtgcctttggatgcacttgcaaggcgtattgctcaagtgggtactgcctctcgtcctcttctggatcagccatcgagtgatccatacacagcggtagttactctctatccttgaaactaatcgtttgtacattcacaagacagatgctttcttaactagaagataacagtcttcatgtgaaaacaccaatcagcgttagtgcttatagaccttgtagcttttgaacttgcatgtatttcatttaccatcttcattttgtctttctgcatggttgtgctcattaaaatggatggctcatggaattgtttgttccccaggccttctcaaaactcagcatgcttgcagagcaaagaggcgatgcctatgcaaatgctgatgctcgagtttctcttgaaggtatgtttcttttctgacatgtccttcatcttaatatgctcctagtatgctgatagcagatggatatctagtgtcgcttcagcgaagcttttcatgtatccaacagagaataatacagtctgcatgattttacctctgcagaaattgcagctaaacaaggccatgacgatgtctccaaactaacaccgaccgatattgctattgaggtattgcacatttcgggacaattattcatgtaaacttgtcatttcatctctctttgtaaggacgtctcatactctgcccgattgaatttttttcctaacataacatcctgttgcatttcaggccttactcaagattgagaatttcgtcaccgagcattccacatcaagtggcccagttggggacttaatagttgattcccagaatcgaaggacaaaggccttgtagaattttgccctctttttttcttcttttggtgtatcctgtatttgtagcatgtgctgtttaacattatattgatttattctttatatatccaaaagagagataaggcaaagcttgttccccttgtaaaaatagaataacgaatggagctgacgcgagatgttccacaaattttcgttctggaaataagaatcgttgcaatatcgtttgcccaacttcatgcactgtcactgccgtgttttttgctcaatttctgtagatcactagttacaaacatatcgttatctctctatttcgactttttgagaggcagaaaggaaggattattaatttgttactactccatctgttacaaaatacaacttgtagcgttcaaaatttaattaagaatgcaataacgttttcatcttatttcatttaatttaacccacttccttgatgtccgtacaaaactaactatttatactttgggattgatggaatacatctttattcatattttagaccaaaacgactctccctgttcccaaatacttctcaccatacactgttcacattttaattttgaccactagttttttttcgaaaaaatcaaagtgattgcgtcataagtattaatatttttatcgtagactaactatctaaaattattattgattaaagttgctcaattaagtgcaatgggcgaatgataagtttgttcctgtagcagcataaattattgaatcaatgcattctatttatcctgaggaccagtgaagatcgaatacatgataatctaagtgtgtatatgtactcaccgttggcatgttcggccgccattcccacggcagcgctgcggctgcagcagcaagcagcatgctcagctgcatggcagttagctgcagcttgctgcgaaaaatgccagccgaataggtcctgtagtgttgtagtgttagtacgtgcatattactagttcggagtattttagtttaataagattgtgaatatttatgtgtgcgaaacagagcctatagaatgtttagtgggttggcccaatgtagtatgggctaaggtgcgcatgacttgagaaggcagcccagcccatatccatccaacccaaagcgggtagattttgccttggaaaggcaaaattaaaagtacaccgaaggtcccttaacttgtcactgattacgaaatcgtcctccaaccacaaaaccggatatatgacaatatgacattcctcaacttacaaaaccggtcactttaggtccttcggtagttttgaccccggttttatccgatgtggtggctgagggacgntgggacccacagaggcccgacatgtgagtaagccatgtcaccacctctctatttcccctcctcttccttcctcctctctctctctctcacacaccttctctcccttcttcctctcctctatcccttactcctctctctcactcttccggtcttccctgggcaggctagccggcgcggcgcggcgggacggggtggggcgagggcagcagcggccaacgcggcggcggtggcggccggcgacgagcggcatgggagaaggagaggcggtggctcttcctaccaccatcaacggcaccatccactccctcctcggtgtgtcctccagctccgatttcctccctccctcctgtgctgcatccactcgtcctccttgttcgccgaatccctcctcaccgcatcctctccgacggtttgcttcccgaagtagataagaaagagccacacgaggccaacgggcgcgagacgggagaggagatccggcggccgacgacgtggtggccggcgagaccgacgctagcgccgcctgagctcctccagtgccgcccaagcccaacaacggcagctctttcccagccgccgccttccagatgtcgccactgcgatcttcccagaagacgtcgtcgccgccttcgtgggagtctctggcgaccacgcactcaccgtgtcggcgaacgccgattccggcaggatgcaaagcttgggacctcgccggcgtttagcaagacggaggtagtggtcgatgaaggcgtcggaggagagcgcggcggcccaggcacgggagagactgcagcagcggagcaccaacctgagcgggatgcgcgcgcctcgctcgcctccgacgaggccgatgccatggcagactgtgctgaggaggctatggggcgaccaggccgcggtggaggagcaatcctcccgtgtcgtcgtagccacctcctccccagccgtcggccggcttgccaaaccaaaaaaaaaaaaactgtaataaaaaaaggaggaaggaaaaaaaataacttaacagcctgacatgtggggttcacgtgggtcctatgctgactcagcaaccacataggataaaatcgagatcaaaaccaccaaagaacattgtcggagatatgggcccgggggtatgcgaggtgaggggaatctaccttcccatcctgccacgtgtccctacaacctggtcctacccccgcattccgcgaatcgcaggagcggccgggggaggggacctcggggtgccacgtcatgcccctcgggcccttgcaccgctttgccccgaggccctcgcccagccgccatttggtaggggtagcaagcgaggagggggcccaggctgaacctcctttaatgcgcgcagcgccccaactgccccctgtcgcatttaatgcagtggggcagacgtgcggcgagcccgactggcgcgcgatggtcaagaatgaccaatctatgaccggcctgacgccggtcacgtctgactggacagacaaccgtgctcccacgtcgcatctgcttctggcggagtggaagtaggtatgacccgtcccatcggagggtcattcagagggcggccaccacaagtcttcacccattaatgagggattgacatggctgtccctcgtgtcaggcgagggacggcgctgggccccgcttaaggacaagctgtggtttagcttccaggcgaaggctcgggtcgagttccggtcaaggtagggcgggtccccacccgagagaagagtaggtagaggtggtgcatgtagtatctccttgaggtataaaaggaggattttgcccaccgaggaaggggacgactctcagaaaacctgaactcgaggaggagggaagtaagagcgttctccggagtttaggaacctttgtaactctcagtctaaatcccatacacaggagtagggtattacacttcatagcggcccgaacctgtataatttcgttgtgtgcgagctagctagtagccttcgggacggatacgcgatttccaaaggcgagcttcttcccccggccgaactcacgaaaggggggtctcacgatcccccgctagagaggatcactccttgacaaatatattgtgaccggtttggattagttaagtgacaccagatatatggttttatggttcgaggacgattttgtaactcatgacaagttgagataccttcgatggagtactttattttcctttcagtttccacccgagccaaactctcgctccaacggaaaatgccgtctgctcttcctcctcgccacacccaagctcccgcgccgccggccgccgcctccgcctccgcctgcctcctccgccgccggcgcggccgactccgtgtcagcctctgttactgcagagcctccacggagcctctcgtgttcgcctccccgagctctccgtcgctcctccgctcctccgttgccgtccccgtcccctcctccccgcgccacgcaaatcgggggccgggagacggcggcggcctcctggtagtcaccgtcgctgcgtccgcggtacggccccccttgctcccaaccctcacacatctcatatcgccttctcaatccagcgacatgacactggggtagcctccggtagcgatggcagcatgacggcgttgctgctttgaaggcgcaagattgatatgcgtaacgtggttttgaaagcgggttcttggccagcttttgcatctgtggatggatggatactctctcccccctgtgaagagtaaacagcgggtggaactgaaaacttatctgaatcgaaactcatgatatgcttttaagctgtcggttttgaatatgaattagaaactgaaatgccaatgaaacagcataatgtgataagggtttaaggttggtttttccactctatttgaatctattatttagtactagtatcacatgtctaccaaaaacaaaaaagttctccatttacattcttgaaaaaaaaaaaagatacccagactgaaatagagtcatagacacccccccccccctttttgttgtttaatttttgtaattcttgtaaccgtcaactccttgccaaattgattctgacttgattcctgcatgcgaagctttctgctatatgatattctaggaacatatcagatcaagagtagagcagtacttaaaatttaactggttatgtggttgtgtgttaaatttgaatatatacaagctttttgtttcaccatgatctacatgttaaattcagttttgtgttgaatcaaatatatttgctttattaaagaatattcttatacagaaaaatggttgacaagtgtactcattaacaattttgattccattttcacttgtgcatgccaatgtatactcttaatttgatagtgcgtaactttggaaccttactcttgctgacagttgctgtcttatataggttgttctttctgcatgctttgtattcctttcagcaatgcgctccatgttggtacgttcatctaatttgctactacctctcttatgggaccggtaacagttacagatatgccgacatttttaggaatgcaagaaggcagcagaatctcttgagaagtccttcggttcagcaagagagaagcttcctgaaaccatggcttcagtgaaactagttggaagggagatctgtgacttggctgtggatctcagtaatctaaggtgagtagttgatatgtatcagccatcacttgtattactttcatttatgtgttcttggagaatcttataatcgtccataatacacattcgtgcatcttgacgagtagatttggatgattaactcttcacaagttacacaaacaaacctacacagccatctatggcagtatctcaacttgcattctgacaatttgcctgcttgcttgtgcacaaatttagcagtgtcatgtatatgtttgatcacataaggcatcgggaagacaactactaatgccaccattctgtagatcagtcaagaattgaggaagggcgtccaaagttccatgagcgttgttcatgcagccgatgctcaactgcaccaactgacgacctctgccccacaaggtgattgatttatccattgttggaattaacttccaacgtgatgtacggaatcatatctccttttttttcccttcttttgccctgattgtttctttcacttgaataggaaatcagagggtgactagtaatcgaaagagagcagcaggagagcctttgctcgctagtaccgtgagagaactccgtgagttaattgcagaattacactcaggatttggagtagccgtcagcatcgcgggccttttaacgtgggcatcaaattttgtttctaagcgtcctaagaatcgctcatagcgagacacagaaagtagatagaggtcatgagggcttctggccggtgtaagtgatactgaatcattttgcttgaagttagatcatgatcatttatcctgggttcatgaattatgatgagttcatggattatgaagattggctttcaaatgaaaatggttaatttgaagagagctggactgtgttgctttgcaatccaatccatactaatgaaagacagacaattaaggaaattgtgaaaaatgaatccatactaatgaaagacagacaattaaggaaattgtgaaaattgggatgaatcattttgcttgaagttatgatcgtgaatcatttaacttagtacatgaattactatgagtgcatggattatttagattggcttaaaaaggtagagttggactgtgttgcttcgcaatccaatccatactaatgaaacaaattcaagaaaattatgaacaatccatagtaatgaaagacaattaaaattatttttgatttcaaattggtaggggccgcgcggacgcgtaccccctctgccacaaattatgacgtccactctcccgcttggggagatggtaaaccaacccacccacaaagtgcaatgtgaggcattgatctaggccatgagcctttcttgatcgcccattgaccccgtccaggtaagtatgttccaacgttgccccgtgggatgcttaaatagggataaccacttcgtaacgatacctgagtccccgatacggtactaaacttgatttacttcgcataacatactcccacggattggccggagcgttgaaactaggcctacccactaaggcccaaataggcccactgctcgatggtaattttcggaaggatccctgtagtccggatattttctaaaaacaccctgtacatgaccgttaccacttgctcgcggtctaaagttttgtaaaaacacccctttccggacagttatcatgagtaaaattattaattacattggcagcgacacatatttttacaaaaaagacactaatggatttttgcgattagcccccaagcatttttgcaaaacttgtttggaactttggccaccgccgccggcgccgcgacgcgacgacgggaaggcgccggccgccggcggccagcggcgctggcggtgaagccgatcgaggaggcgtcctccaccgctcggcgaccaaccgccgacggcgacggcgatggcgacagcgcgcaccatgcagggggccccactctgtttactcccccgcgtccgcgaccgcgaagtctccggtctccgccgcgcccgcgtcgcctcgccctgaccaccaccagtccaccgccgcggcccacacggcacagcctctcacaagggaggaagggggaagtgagcccccgcgccacggccacgcgccgcgggcttcctcctcctcctcctcctcctcctccccgagccgcacgccgatcgatggccgcgcggcggcgcctcctcctgctcctcgtcctcctgctgtgccgcctcgccgccgtcctccccacctccgaaggtacgcacgcgctccctcgctcccgcccaccccctgttcgatgaaatcgctggctcgctcgctgcggcggtctcgcttgttcgatcgattgcgatttttattttatttttttttgggtgcagtggaggccttgcagggtttcatggcagggttcgccggcggcaacgcggcgttccagagctgggacgcgtccgcgcccaacccttgcacctggttccatgtcacctgtggcccggggaaccaggtcatcaggctgtaagcatctactgtactacctgctgcagtgttgatcactaattcactggtgctactgctgaatgaatttgcatcttcgcgcagggatctcgggaaccagtcgctgtccggcgagttgaagcccgacatttggcagctgcaagcattgcaatccctgtgagtttgtccatgtttatttgctcatttcttccatggagaatattgggttgcattgcatcttttcaccgatcagacagcactggtagtactcatgcctgctatgaatgtttccgttatgcccagtgatgtggcgtatgcaatgcatatgccctttttccatcttgcctctcgcttattatatgagtaaaaagaatgttgtttctggtctatctcttctatgaatcagtagcgtttgatcatcctttaggaataaaagctgacgatgcatcttgcgaaagcatactatacaatatcactatgagtcttgcattggaatgttggtcattttctattctcagatttgatgattctatgtgactaatgtatcttttggtagcagggaactttatggcaatagcatcagcgggaaaatacctagcgagcttgggcggttagctagcttgcaaactttggatctctacttgaacaatttcaccggtgaaataccgaatgaactgggaaatttatcgaagctcagtaacctgtaaatattctcatctctgcttcaaataatttgtatttgatgttaaatttatgtcttatgatatcacatagccagtgaaaaattaatgtagaatttactactcctgctctttgactttgcgtgcaaggatagccgtctgaacaacaatagtctgtcaggtgcaattcccatgtcattgacaacaatccaaaatcttgaagtgctgtaagttctctgctacaccatgccgcaagatgccgcaattgagacgctgatatgctaatatattcattcagggacttgtcacataacaacttgtcgggaataataccgaccaatggttcattttcacacttcaccccaatcaggtttgcttggcctggagtagtgattatgtcgattcaacaatgcattatgactggtgtgaaattttgtaattgtgtcttgcagtttctccaataacccacgtactttcgcaaattcttctgattcgccatcaaataactcgggagcagcggtgccatcaggttgtctgttaattccttactctggagtgataaactgcatttatttctgcagtgtttcattattctgtgtagaatcccatacataacccagttgccaagtgccaagtgttccaaaattgtctataacctgttgttgcagcagcctgggcatttggaattcatctagtttttgctcttatctcatcatccatttcgatgctatttatctaaacaaataagtcggaaaaacaccactttaattctttcgaattggcggttactctagttgattctgtatttggcacttgttaactcaggaagaagtagtgcatccagcattggaacaattgctggtggagctgctgcaggtgctgccatgttgtttgctgctcctattgtattgttcgcatggtggtggcggcgtaaaccacatgaccaattctttgacctactaggtcagtctacgtgagaacttttggcaatctctacggtttcctttgttatttgatggcattcctttttctctatgcagaagaagaaactccagaagttcatctgggtcagcttagaaggttcacactgagagaactgcaggtggcaacagataacttcagtcaaactaatttgctagggagaggaggctttggaaaggtctataaaggaaggttgttagatggttcattgatagcaataaaaagactaaatgaagatcgaattggaactggagagcggcagttcctaatggaagtcgagatcatcagcatggccgtgcatcaaaatctcctacgcctccaggggtattgtatgacacccccgagcggctgcttgtgtatccttacatggagaataaaagccttgagacacgcttacgaggtattttctgaatattctgcacttgaactatggagtatagaggtgttagtttctcaaatatgtgcagtgagatgatactttcaataaagatctgattacaacattaaaataagtttcatgtcaactacacagagtgctctgattcacaacaaccacttgactggccaacacgaagaaaaatcgcgttagggtctgcaagagggatctcttacttgcatgaaggatgtgatcccaaaattatccatcgagatgtcaaagctgctaacattttgttggatgaaaaacttgaagcagttgttggtgatttcggtctggctagaattatggattacaaagtttcccatgttgtaaccggcgtgatggggacattggggcacattcccatggagtacctgactgcaggaagaacttcagataaaactgatgtttttgggtatggaatcatgctttttgaactgattagtgggaaaaggggatttgatcttgttggtcttgcaaatgaagaaaatgccagagtgcatgattgggtaagtcatgctttgttgaatcttcccttgttttgcaggatatgtcttttctcaagctattatattctgtcagttatattgactacctcccatgctttacatttgacattataatttgcactataatctttagtttcgattcttatttctagggacaacatgctaatgtcttcaatgaaccacttaattcatactgtattactgaagcaatccttatgaaactccaactttcttcaatagatcaaacatgtctacctccctaatcattagtagttcgcacgatttcatttgttaaaaaacaatattgactgcaaattatgcagatatttacattctgttgatctctttaacatggaacgaccaacatacactgtaaactggttaccaattcttacttcatattgaattgaattaaaaaaaatgatacagtgctattcctgtagagcataagcatgaactcagtgataaaagagggccatattctttttattattcaggtgaagaaactgctggaagaggacaggctggaggtgctgattgacccaaacttactggaaatctacaatggtggggaacagggagtgcgagaggagatgaggttgctggtgcagattgcgctgctctgcacccaggagtccgctccaagccgccccagaatgtcaacggtggtgacaatgctagaagacggtatcgcggagcactgggatgcatggcaaaggaagacgattgtgcaggcaagcctgcaaggaggacagggcgtttctgaggctcgcaatgactctgttgcaaatctccctccagacacattgtctggtccaaggtgactgccaccttaaggactatgaagggtggttcttttgtagagcttagtgaacttagacagaacacttgccattcttaaaaaaacagcagattatatgttttcttgtagcatgtgtatgtattttagtttttcccctttttttcaagtaattcataatcactactagacacagggctttcagaaactgttcagaaaccacatcatagttatgctaacgcatcaatacatgtggttgtgctactccaggatcatcaaaggcggttatttaaccctctctgaaaaaaaaacataactagagatggctcgaaggtgagctgtaacctattgccagagatatatcaattttgaatcaaagagtactctaaatctggccatttcctattcattttgcaacacctgattttatataatattcttgtgaagtgttaactttaggtagtcttctatattttcatggaaagagtatatgcactaccatttttttcaaaaagataataatcttgtaaacattcccaatttgacgcattcagcccaacaacttgaatcatcgggtgttggtttagtccttaatgcctttttgttgctaagtggagtaagtaattgccataaaacctttgatgttctcaatccccagagctacaagatgcaacaagtaccaaacaacctacatgctttttcaccagaagagtcaacattagacattacaaaatgaagtaacaggggacaaaccgtaatatcttgcattcttccgcagtaattgagccgaattctccacaaactgtagcgcataatccatttctgtctacacaccaagcagtgaagcaactccatttgctgtttccccggcacaactggacgtataagcatcagcgaggcctggaatgtggcacttgtaaggatccacaaacttccgcacaaacttcctctcactcatcgcggctgtgttgtagtaatccaactcacaatccagcaatcccttcatcctgagaaccttgagcaagtgatgccgaggcaacaatcgccgctcaaggctgtacaaaaacaacactggcctatgcgcaatgtaccgtccctccaaaccaacatccctcttcaagaattcagcggcttgccgtatcttttcctccgatgaggccaccaactgcggtgccttcctgatgatcatcaacaattcatcccgcgaaaacccaagctcctccatcacctgtatcttcctcgcaacggactccttgctcgtgaaagccaccgcgatgagcccatgccggaacatcctcgagctgcggtccaggcctaactcctccacccgtgccacggcgtcccggagatagatagggttcgcggtgaagagcctgctggtgtacaaggggaaactagtggcaaaatcactcatcccacattgctttagcaattccaggttcggcttcaccaccttctcgaggtcggagccgagtagcgaggagttcatcctgagggccttgaggatcttgtcgaacgagcccacgatctggagccagaaccctagattcgtgccgacggagctggaccggaagcaggtgagggcgagcgggacgaggcgcgcgatctgggagcgggagagtcccaggccgccgagctcgtcgacgcgcctggcgaggttgctctccacgtcggcgcagaggaagcgcgggtctgcggtggcgacggcggcgatcttgcggggcgggaggccgaggtcggagaggaaggcgaggacggcgtcgggcttggagggggacctgaggtgggagagcttcttcgaggccttgcgcgcttgggctccggtgaggccccaggtggcgacgaggtagtcctcgacggcgaagggttcgggggagacgggcgcggcggtggtggagaagaggaggaggcggcggagggaggagaggggagagattgcggcggtgggatgaggatacgctggccggaggaggagagaaatcatatgcctccggaggtggtggaccatggcggcggcggcgcaatggtttgccggcggcggcgcaagggtttgcccgcggccgcgtgaaatcgcaatgtttacgtgcagtaacgttggtgggccatgtttaacggcccatttgaaatggacgaaggccttattttcggctgtgtatgttcgcgtggggaaagtccgctttacgttcccgaaggttttagagcgtcatctaactcgtatagctaggataaaattaagtttctcggtcgttctcactctgtcttaaataaaaagaatttttaaagagatataatatattttagtactatgtgttttaaaatataagagaccctccaaaatttgtaggacggagggagtgtttaagttggttttgacttgtatatcgcctacattacttgttgccttatttttcatcctatatccatatggctcctacacgatgtagaggcaaaataataagtaaataaaataaaaacacccgtggaaattaagtcactaagaatcttgttagaaaaatataaaacaatattatgcattattctaagcactaagattttaaatcatagtactcacaaatactatgcacgcgcgaataggctttcaataaaattttagtggtagatgcgtgtcactgatctctgtctctttgggcatgtcatccatgtaataaaaaaaaccttaaattcagcggttcaacttgggtgtgcaaatatatgcatgagtgtggtgtgtacatatgcatcatccgtgtaatcggaaaaaaaaggcaagagatgagaaagaaactagagcaatataaaattgcgtgtttttgcgtacgcgttaattagaaaagagaaaattttacaaaaactcaggtttttgggtatctataatgcaaaaccccaggttttacaaattgtttcataaaatcctaagttttgggtaaagtgtttcataaaaccccatctaaaagcttatattgtctatccaactaacatatttatctataacaattgtaaaaatggtatgagatatttttttttaagttcatgtacacgtgagagcattaccaagaaatccctacagctactcccaatttcaaacttttgggttttttctaagataaaaaatggatccaacagatatcaaaactatagctctgaaaaaatttgagaccctaattccgtgctttcaacagtagttgatgattatagtatgattttttttacatttaatcaattattgagttaggattatattgagtttctagtgcactaaaaagtaagaaaaaaattaagctagacgagagaaatgtgtgctttgagtcgactaatgtgaatttatgaaaaataatcatatgtaacaatgaaataggagtatttcatataaatacgaggtttttctgaaatattttgttctaaaataatgcgttcttggaaacaaaactcgtcagaaaaaattgcctttggtccaagaaaaaaaaaaggaagaaatactcgtatgcattttgttgcgccatagccgctagtccccggctccccgccctt

SEQ ID NO: 51901 - DNA, 2607 bp, Oryza sativa
gcttccgccgccccaccgtcatctccaagctccagtactacgtcccgctgttcggatccttcgagaccctcctccaggcgctcaagaacaactcctacctcctcagctccgacctcgagaaggttgtcaagcccaacgtcgcgctcctgcgggagtgcgggctaggtgcttgtgatattgctaagctgtgcatcccgttgccgaggctgctcaccaccagcccagagcgtgtccgagatatggtggctcaagcagaaaacgtcggcgtgcgccgtggctccaagatgttcaggcacgctattctggccgtcgcgtacatcagcgaggaaaagatcgccgccaaaatgcagttcttgatgaagacattaaagtggtcagacgcagaggcgaggattgcggtgtccaagcttcctgtggtgctgaggagctcggaggacaagctgagccgtgtgtcggaattcttgatctctgaggtcgggttggagccggcatacattgcttacaggccggcaatgctcacttatagcctggaacgccggctcatgccccggcactgcgttctgaagtatcttaaggacaatggattgatagaatccgacaagagctactatagcgcggtccaggtgaccgaggaggtctttgtggagaaatacataagtccatacgaggacactgcgccgcaccttgctgaagactatgctgctgtatccagcgtaaagatacccaccagattcagattgaaaggaccaaaaacaggccatgcaagtgcgcaaactgcctaattcttgccacgagtagtgagctggtaagtcctcttgcagtgttctttgcctgactggttgttgagtgcgctggttttgctgttgctagccaccaacagaactgaactgataattagattcttgaattaagatatgccatctggtagatatgtaaccatggcactgttatgaaccggttcatcgttttgtcacatgtgtgcaatcgttcattcgaatgggctcatccatctgtggttgtatgaatttgccaatgaagtcatctggtagatatgtggcaccgttatgaaccagttcatcgttttgtcacatgttttgcatattgttcattccaacagctcattcatctgtggttgtatgaatttaccaatgaagttagtcttgaacaactagctttgagcatatttaggagtatgtgtttacacattcccatctatgcatgtttcatttgctcttgtttttttcttcttctactagcaatctagcatatactatgagtccatgacacttcaaaaatttccattctgatgcaaacagtgtaggcaatcatagaatctctttgtgaaatcatgctcatattattcatatgaaatgtcttgattaattgatacaagaggcatatagatacatgctctgagtctctaccatgttctacttgatgtactgtgacatccacctgaagccatcgccgtagcccatccggcggacgacgctgcacatgaagacctcgaccggccgcactccggttcctgcaaggttgacattgcccttgccggtggtgaggccggtgagcccgaggtagtagcacagctcctgctcgggcaccgcgtacgggatgtctatcttgttcccgaggacgaggaacggcacgccagcgagcgcgtcgtcagacaggagggcgtccagctccatcttcgactcggcgaaccggcacctgtcggcagcgtccaccacgtaaactactgcatcaacctgtcaagcagacatgaagcttatgaagaagcagcaaaagtggctcacttcagactttgaagagggaagtagctacaaatgctggaaaaacaggtggtatttggctattgacaagatatgcaacagcatgtgacaattgacaaagtatgcatgagctggcgccaccactgtgattactgtgtactggctgattgggaagctgtgttcatactagcatgaattctcaggcaagcgcccaactcaatccctgttcattatgagtttcaaaggaaataaacttgttggtcagtcctgtaaatagtccattttctcctactctatcagtataaaaggcaaaccttttgcccgccttagaaaaaaaaagaagaaaaacttgttggtcagtcatgaatatacacatgctggctgtacgactaaagaaacatggtacagttcctcccgcaattgataccactatcagttttttcttggttttgttgtaacaatatgcagagttgggttatgcactaatatatatgactgtcaatctgtcatcccttaataaggtactagtactaacctacattattattctttttttttgttcagattccaccaaggttattatcggcgccaaatattaaaagtaagcttcctccagtcgccagggggctcacacaatcgctgccaccgggaggggatacttcgtggtcactcatgtggtgcacccatctcttgacgatgaatccccgtcaagtcgatgtccgaagaaggcgatgcccaaaggccacggtgaggccccgcttaagaaaaaaggagtgattatatcctatgtataccttttgagaaacacccagggatcttatgaatatcttca

SEQ ID NO: 51902 - DNA, 4721 bp, Oryza sativa
ttggtcatgtggctaatgggcggttgacgacacacggttgaggtccaggcccacctccgccccttttttcggtcccgaatatgttatacatatgtataaactaactttgtagatgtatctataccacttaaaaggaagcaatggtagtggcagattttctgccaccaccacccctatcaattacatgtaagtccctatttgtcagggtttaccttaccgcgggttaccgcggttaccgggcttaccgcgggggtacggtaatataaataccgcggtaacctccttaaatacaaataaatttaaaaaataatttgattttttgataaattttgcacggttttgtacggtttttcacggttaccgcggttaccgcgcggtaaccgtgcttgccgccggggtgcggtaaccccggccccggcggtaaggtaaaccctgctatttgtactctttaaaagaagaagagagtactaggccctctttgtttaggcttataagccaacttataagccaaaaagtctaagcctaaataaacaagcagttttttgtttggcttttttaagccataagccactctaacactattaagccaaaagctaggttggagaagctttttcagcttatataaggtagatgtatgactccaccactaaacttaagacattaaatccactggcttataaatcatataagccaataagctgacttaaaaatctaaaccaataagcctaagcctaaacaaagaggccctaagagaagcttttatttcaactagagagaaatagtaactacatcaaaatttgaaatgtaggatttgatttgaggataaatttgaggggttttttttccaaatttttttcacataatgatatagccatgttaagtttccccatgtgaatatgtaataccatatgattctctttttaatcccgttacaaagtatgggcattatgctagtatatagaaaatttatgtctctaattctactattataaaaattgaagatgtttttgccggtattttgatacgtcatccgtgtatgagtcggtttttaagttcgttcgcttttggaaatgcatatccgtatttgagtcgggttttaagctagttcacttttagaaatacagaaagagtcatataagaaatctttttaaaaaaactcgcatgctaatttgagatgatcaaatttctaattgcagcttatgattttctagaaaaatatagatccaaacgaattcacacagtgaatttcaccttaactaaaccgtataacaataataagattaaaataatcttcagccgttgcaacgcacatgcattttttctagtatgtatatactttgaacatataaaaaatctataactttatatgtatatataaaaaagtttatatatgtacatataaactttgtgcatatatgcattaaaaaattgtaaaaaatagataaatgtatgggcccggaaactgaaccgcgtgcagctaattagcgatttcggtgactaggactaggaggggagcaaagaaagcaaaaaaaccaacctgggcgtagtagtccctccagacgcggcgagcgatccggtggccgccgaggtcgaacgccttgaacctgatccgcccgatgctcagctcctccgacgtcgggtgctgcgtcggctggtgcaccgccagattctgcacacaaacacaacacagcccaaccagccatcaccacacaatgaacactcatgagcacaggcatatatgaatctaggagtagcttttgatatcatcaccatcagcctttgcaaatcaaacatatgtggcctttgcaaatcaaacatatgtgcagcgagcgatcgatctatataggccctatcgtttggcttttttcttaataagctaaaacggcttattagataataaaaatagatttgtaggtaaaatttttatatatgtgttcatggtgacttaaaagccaatgctgaaaaaaaaactacgttgaaaatatcttaaaatcaatctcaaaattaagtttaaaaatttaaaatttggcattttcttcggttgattaggccatccgatgggagcctatacctcttgtgagagcatgtagaagagggtggttttgccggcgttgtcgaggccgaggaagaggatcttggcctccttctgccacagcccgatcgacgccagcacgtcgtagaaccaatccagcagaaacgacatctccaggtatgttatgttcttcttctcttcttcctgttgttgatttgatttcaccagcttttttctagctaaacctatctttcgatctttccttgcgcgtgttctttgtatttgtagttacccggattcacgagatggcaaccgggtgccaaggccacgctgtgaggagtccacggccgcaacgtacgcgtcatctggcgaatctggtgcgttggtttcccatccgacgggagtccctcgattgctttcgtggtgccgccagcctacgatgggtcgttactgcgtcggtctctgtagaccgtggaaattaagcaaacctacacgaaatcatgctagtcaatcgaatttgtctatcttaattggtgtgttttttttaagaaacaagttctagatagtaacttttttttctcgagcatatgggctttctttgttataggggtaggaaatttaaaagatttcattcatatggaaaagaaaatcctatggaagcctttgaaacaaaggattgaatcatatccaatcctttaaaatttcaatggaatagataatcctatgtatattttagaggaaagttagcaagaggtctaacctcttggaaaattttcgttgagtctatctcattcatctgattcctgcgcttttcctatagtccaatcaaatggtcattcatatgttttgcaatcttctattttacaattgtattcctgccagaattctatgtttttcatattcatatgttttttcattcttacgattcaaagggaccctaaaggatcaccgacctatgcacatatgaacaaacacatacaaaggttgttatccatatattatcatacaatatcttagattcaaaatatcttaaattcaggttaaaataggaaataaacattactgagaaaagggctcatgttggtataatttagaaaaggaaaaatatgtgaaattaaattgaaacgaagtacagatagttaaaaaacttgcaaaattaaaaagaaaatttaacttacaaaatgttaaacacatataaaatagaacgaaggggattgtacttaaatgtttacatatttaggtataaccaatatatttatagcgcagagattggagggtattatttggattagtgatgcaaatacatcatggtattaccaaaaaaaaattgttggcagagcttgactggctcttaaattattcctcaactagaaatcacattgggttatttaggaccctttaaatcgcaggaatagaaaaaatatgaatataaaaacacatgattctaatagaaatacaatgatggcaaaatatataaatggttaaattggatcgtatagacaaaggatcgaataaaatagatatgctcaaatcaaaattttcaaaaggttgaaactcttgtgttctctgcaaaatctacctgtaatgaacctttgtatagaaacttcatagcattaagaaaacctcctttgaatcgaaggcccttcaaaaatagtagtatttcacattttcgcgattttacgaatttgtcagtggcaaagtagaaaaaatagcggaaccgcaggtttcctctctcccctagttcgccggcggcgtctgaccctagcgccgccgccgccgccatgaaccaccttcgaaaccagatccttcttctccgcgtccgctcatccagcacctcgctctctcccctctcccctgtccaccgcctcttctcctcctccaccgccgccgcatccatcgccgcagaacccttcgccgtcgaggactacctggtcaccacctgcggcctcaccggggaccaagcgcggaaggcggccaagactctctcccgcctcaggtccccctccaagcccgacgccgccgtcgccttcctctccggcctcggcctctcgcgctccggcatcgccgccgccgtggccgccgacccgaggttgctgtgcgccgacgtggagaagaacctggccaagcgcgtcgccgagctcggtgagctgggcatctcgcgctcccagatcgcgcgcctcatcccgctcgcccgtcagtccttccgcagcagctcgctcgccacgaaccttggcttctggctcccggtcttgggctctttcgagaatgtgctcatggcgctcaaggcgaacggagcgattcttggctccgacgtcgagaaggtggtcaagcccaacctggccctcctccagcaatgtgggatacatgtctgcgatttcccccatacacgcctgcccactgtgctctgcaggccacccaaccatgttcaagaagctgtggcacgcatcggtgagtttggcgtgccacagtactcaccggtgttccgcaatgcgcttgtgccatttgcttaccaaaacaaggagaagctcgctgccaaaattggagtccttgaaatgtttgggtggtcagaggacgatctctcgatgactatgaggaagggtcctgtcgtcatgaacatgtctgtggaaaggctgaggaaaaatgtggagttcttgacaagggatgttaagtacgagacgcgttacattgc

SEQ ID NO: 51903 - DNA, 9950 bp, Oryza sativa
ctgagaagaagtttcttgacaagtttgtgcattcttgcaagtgtagcattgcagatcctgctaatgcttatgcttctagctttgttggggatgttctgtgaatttattgtctgagaggacaacaggaaaatgggctcattcttgtgctgggagggtactgacaggattgttgtgttggaaagatcaagggtttagacttatacttttgctatctccttcgtgctcattaaggtttgctatctccttcgtccattgttgcaaaatttcttataactttgctctaggttatcttgtgttggctagtatcactattcactgattgataaacaggaacactacagcctgtggtcaccctctaggttgatggaatgttgaataacatttccaggagttaacatgcttttgttttataatgcagcatgtgtagctctgttgtttgtattcaggatccgatgttttccttccctaaacgggtttatccatgtctatggcctgctgccagaatcccagtgcatatgcagaagaaagaagacaaaaattaaacactatggttatcatatgtggtgggtttagttagttccataacttgggtaaagtttggacaatgagagatgctcactgcttttcctgggggctgttgttattttcgatcttttccttttctaacaaaaaactgtaatgactgccttagctctaccatgtttccttgggaggggattagtctgtccaaaacgatgctagagattaggaataagtatttacgtatttctcttttcctcaaataaaatggggtcaccaaggaggaacatccaatcaatttaattatcaagaacattcccaaattttaattcaaagaggcctcaaacttgtgtagtggggtactggagagtgtaccaacttccccagaatctttttaggaaattagtggcatgtacccaagtcccttaaaattttagaagtcttaatattaaaagaagtggtagaaatgatccttgaatttatccaatatatgagttgcaagcatgaagtcgtgtcttccccccaagaacaatgtattcatatcttctagtgtgcttcaaagtcaataatctctattcataggtctgacattttcatccgagcaatagtgctgtttacaattggtgactgccgtcactattgtttctccaggaaatttcaactcaagtgcttataagttacttatcactgttttccgatagccttagcccttgagcgatatggttgttaccctggcactgcttgttcaagcttctaaaggcaaagggattgctgaatgtgaaacttagctactacagcattgcgttgcaggtgaaaagaagttaattgacaagttcatgcacccctacaagatccaggcctagtgagcagatatgcttgttctgggaaaaatacctgactgaagttctattctagcagatgaatgagaactagagaatgcgctcacgctccccattgctttgttggaagaacatagggtttgccatcccccttgtacattgctattaccctttttgccattttaccgtaggtgatccattgtagtaccacatgcactacaattgattccctataaaaatgcattaattgattagctgaaggaattttcttttaaaaagttgatgagcagcagagctacagtatggctcccatcttgctaggcatggattagatactgacatttccatgagaaacatgaatgatttgttgagcaagcatgctatttcccaggttttaactgtttgtttttcaaatgccttcatgacactatcttagtttgtctgagattcgtagtactataatgtgttgcatcacatactacattaggttttttttggatggattgagtaattatttatgcatggacttgacatctctttctctctctctttctctctaggattgaattgttacatttcgatatgagcttgctcaaagacaggtttggtaatttgaaactttatattattcatggttccagccgttcaatccttcatatcatccagaattccagggctggggttgcatctgtagcccttcatcaaccccacaaaattgccttgaaaatatgttgacatccaagatccaaccatccgtatcaggataggggatccttgaactgactgttgttcactacttcactccatatgatcaacccctcgaaattccaagaccaaaaccaatgggcctttaattaatcttacattggtcagcctcaactttagttatgtaggccaaaattataacagctaaagacaatttataggccaaagtagataccaggggttcaccttttcaattgagtgctggatcacgagccccaatagtataactttttcagtcaaatttcgatcaaattttactatttccaatttgaattctcaaaaagcattcagattttcattcagaatccactttcagaaacctcaaaattcacagttttcgtaaaaaagaaaaactaaaccctggttggtacccaatgttgatctaagatgggaccaaattactaaatggaaaatggtccgtaattaggtccacactacaaatcagccctaaactgcggacttaattaaggctacagaaattatttaagcccgttacaaaatttattcggcccatttagtttgcaaatgtaatacctcgaattgggcctaaagtttccttgttgggaaaagtacaccgaaggtccctcaacttgtcatcgagttacaaaatcgttccccaaccacaaaaccagatatcggaggtccctcaactaacgaaacagttcgcttgaggtcctctgatggttttggacccggttttgtctgacgtggtggctgagtcagcgtggaccccacgtgggccccacgtgtcaggttgccacatcatcacccttcccctctctctctcacactcttctctcctcgctcacggctcactcgctgcagggcgcgcgcggccgctagggggcgacggcgaggtgggcggtggcggcgacggggatggggatgagaacagcgggggaaggggaggggagcgagtcaagggcggtgagggagaccttgtcggcggcgaggcaatggaggggcgaggtgggagaggaggacgtcggcggccccacacacccgcaaccacccagcacgcgctgcagatgcctggcggtccctcgcgtgccgccgttgcggacgacgacgacgaactctcgcgtcttctctccctggccgaggccgacctcgacgccggccacctctgagccgtgccgcccgcctcgacccggactccccgcgcggctcgctcctcctcaccgccgcccgccgcatgctctgtgaggtgggccgtgacggcgtcgtcgtcgtcgccggccgcgccgtctccgcccagttcgccacggctggcgcggacccatcctctggcgccgcgaccaccgccatcgccaccatggacgcctccgccggcggcgggggaactccctgccgacgaccggcgccgacggggtgaagcggcgggtgtgctacttctagcgcgcgaccacgacctctgccgcttccacgccgacgacccagcaggaccagatccgggcgctcaagcacttcaacgtcggcgaggactaccccgtcttcgacggcctctacagcttctgccagagctacgccggcggctgcgtcaagctcaaccacagccacgacatcgccatcaacgccctcgagctcgcccgcacggcgacgccgccgcccagctcctcccccggcggctgccgcccgcgccaagctccatcccgccggccgcgcacttctccgcccccgacggccgcgcactgctccgccccccacggtcgctgcccagctcctccccggcagctgccgccggcgccaagttccacccctcgccgccgccggcttcctctgggccctcttcccctcatgcctccctcctgccctccccggcggcggcgcggtatggcggagctcaaggatggcgaggacggcgcggcgtcgtgggcgggcgctgggtggcgcaactcgagaacggcgagggcggcgcggagatggggcgggggtcgttggcggcgaccccgacgcggcggcctgatcacgcgtcgcggctgccatcgctgcctcgtcggccgccgctctcaaccctgtcacgccgctcgtggccgaccccttcaaccagtcaccggcgtcggcatcaccggaggaggagaccgcggccatcgcactcgcgcagagaggagaagagtttgagagagagaaggaagggagagagatgactcatccccacacgtgggacccacgtgaggcccacgctgactcacacgccacgtcagacaaaactgcgtccaaaaccaccagaggacctcaaccgaacggttttgttagttgagggaccttcgatatctggttttgcggttgggggatgattttgtactcgatgacaagttgagggacctttagtgtacttttcccttccttgtttgtgagctcaccgagctgagaaatcataaccctgtgatttcacgcggccgccgtcggcaacccttgcgccgccgccgccgacgacgacgacgccatgatccgcctccgggagcgcatcctatctctgctcctccagccagcatcccctcgcccaatcgccggaattttcccgccgccttgccccctccgccgcctcctctccaccaccgcgccagtttcccccaaacccttcgccgtcgacgagtacctcgtcgccacctgcggcctcacccgagcccaggcagccaaggcttcggagaagctctccaacctcaggtccccctccaatcccgacgccgtcctcgccttcctctccgacctcggcctctcgcgccccgacggcatcgccgccgccgtcgccgccgacccaaggctgctgtgcgccgacgtggggagcagcctcgccaggcgcgtcgacgagctcggcggcctgggcctctcccgctcccagatcgcgcgcctcctcccgctcgccggcaggtgcttccggagcagctccctcgccacaaggctcgccttctggcacccggtgttcggctcgttcgagaatatcctcaaggcgctcaagatgaacgccgccctcctcggctccgacctcgacaaggtggcgaagccgaacctggccttcctcgcgcaatgcgggataaacgcctccgatgtcactcgcacaaccttgtccctgtactcctgccggctcttcaccgtgaaccctaggttcctccaggacgctgtggcaagagtggaggagttaggcgtggcccgtggttggaggacgttccaccgcgtgctcagtacagtggctttcttaagcagggagactattgccagtaaaatgcagctgctggatgatcttgggttttcgcaggatgatttcctggtaatcgtaaggagggcgccacaagtgctgcgtttatccgatggaaggatacggcgatctgttgagttcttgataagggatgtcggtctggagcaaagctacatcgcacaaaggccaacgttgttggcgtatagccttgagcggcggttgttgcctcggcattgcttgctcaaggtcctcaaggcaaagggattgctgaactgtgacttgtcttactactgcatagccgcgatgagcgaggagaagtttgtgcaaaggtttgtggatccttttaaggacaaaattcaaggccttgctgatgcttatacctccagttgttctggggaagcaaatggagttcgttcattggtttgcctgtagactgaaattggatgatgttaaagtttatgctgggaaatttggctagattgttgcacaagaatgcaaaatattaaggtttgtgatcccttatcattttgtactacctttgttaaaacttgtgctgaaaaagtatgtaggttatagttgtatgctacatgttgtatcttgtagctctggagattcaattgcaaagatttaatggcaatgggttaggaacaaaaatgtattgtcctgctggactgaatctttagacttccacaattcatttagcacctgtcaagaatatttctatagatcaagtgttgcaaaatggataggaacgaccaggttaggagtacttcttgttcaacattccatctgtgatttggcggcaaccatgacgttctaaatgacttaaaagggtaatatgggctacaactgtgttgggacttgttttgttctctatggcaggattgtcgttaaatgtaattgatttgtggctaaacggagctacaaccttggcaccacgctgaggctaggtatgcaggggatctgtgattatttgccacagctcacacatcatgtgccttcctaaagtggatctcatggtgctctaggtggagcttgaattgccctttcctgacaccttactccctgcttctgcttgaacattttgatgaggtgaaggatcatttcctaccctgtgctgctaccctgcacctgccattttgtctccctgtgcattctcatgctgttgtcatctattgtcgtaagtcttagccgtaaaacattaggataacattgtggccctaacttcgctctgttttaaacttaaataggagtagataaaaaagaaggatacgctgtttccaatgcgatataatcttctggatacactgatgctatttcttgcaagaatttgttgacaccaaatcttgtaggagtatttctctaaccacacttctttcctgagattgcatcttcatatatggagttcctgacaaacttagattttttttctcttgtcagcaggtgcacatcaggaacaggaagtgggctaagggctttcttgcagctaccaacgacagcggcactaacaccaggcggcattcgtcgacacactgcatttccatttcaccctgtatttgttccattcagttccctattatttgttccattcagttccctattgattttgtggccaagatcatcgtcgtaggttgtgatttgtgaatatcattgttctcacgcaatttctgtcttgtttgttctgatttggcgtccaagatggatgaattcggaccatcagttttactctcgttaacaaaagaggcccaccaaagaattcagcccaccttcggccatggagtacttcggcccggatttgaattcggccagttaattcctctcaacgagtttggcccaccaacaaatttgttaatgggcttaaatctggtcattgacgatgcttaattggcccaatcataatgtccactgggcccatcactccaactccaaatgggcccaatattagaggagtttctttccgccggcttcgatctgagcaagagtaggcgtagccctgcgatttcacgccgccgccggcacctggcaatccttgcgccgccgtcgccgccatgattcaattccggcggcgcatcctcactctgctcctccagccagcatcccctcgccccatcgccggcatttttctgcctccttgctccctccgccggctcctctccaccaccgcgcccgtctcccccaaacccttcgccgtcgaggactacctcgtcgccggctgcggcctcacccgagccgaagcagccaaggcttcggcgaagatctcccacctcagctccccctccaatcccgacgccgtcatcgccttcctctccgacctcggcctcccccgcccccaaatcgccgccgccatcgccgccgacccgaggttgctgtgcgcggacgtggagaaaaatctcgccaaacgcgtcggcgagctcggcgacctgggcttctcccgctcccagatcgcgcgcctcctcccgctcgccggctggtgcttccgcagcagctccctcgccaccaacctcgccttctggctcccggtcttcggctcgttcgataagatcctcaaggctctcaggatgaacaaaaacctcctcagccccggcgtccagaagtcggcgaagccgatcctggccttcctcgagcaatgcgggatcaatgcctctgatgttgcccgtagttcaaccatgtactccagccggctgctcaccgcgaatcccgagtacctccgagacgccgtggcacgggtggaggagttgggcctggaccgcagttcgaggaggttccaccgtgggctcgttgcggtggctttggtaagcaaggagactgctgcgaggaagatacgattgatggaggagcttgggttttcgcaggatgatctgttggtgatcatgaggaagttgccaaactttttggctttatccgagaaaaagatacggcgagctgtggagttcttgaagagggatgttggtttggagggacggtacattgtgcaaaggccagtgttgttgtcgtatagccttgaacggcggctgttgcctcggcattgcttgctcaaggtcctcaggacaaagggattgctgaatagtgagttggattactactccacagctgcattgagcgagaagaagtttgtcaacaagtttgtgcatccttatgaggaccacattgcaggccttgctgatgcttatgcctccggttgttctgaggaaggaaatggagttgcttcattgcttagcctgcagactgaaatggatggtgttcaagtttatgctgggaaatctggctagattgttgcactggtatgcaaaatattaaggtttgctaccgttagtttgtctcgtactatctatgttgaagcttgtgctgaaaaagtctgtaggttgtttgttacttgttgtttcttgcagcttgggagattgagaatggcgaagattttcttgttaggaaaaaagaaggcattgtggtattgggctgaaatcttcagatcaggaaatttccttggaaaaaaatgaatagctcacataccatttgactgaaaatatagaacacagatgtggaatttagcacatgactagaatatttctatagatcaagtgtttcaaaatggataggaaatgggcaggttaggagtacctatcaacaatccacctgagatttggttgcaactatgacaggaacgtgctcagaatataatcttgttgggggatataatccaaacattgcaaataatttggaaaggtaatatgagctacagctgtgttggggcgctttttttcttttgggttctctttgacaggactattgtcaaatgatattaattgattatgctggggctaacaatgctggagaggtgtgaatgagctgagctgccacaaatcacacgacacatattgctccttccggtggagccagaaatgccccttcatggttgatccttgcctgatgctgctctaccttctcgatgcgcttatggatcatttcctaccctgtgcagctgtgctgctcagctgcttctgccatgatgtctccctgtgttttctggctgctcaccattgcaagaatactgttcgacgactagctgacccatgttcttctagctgtgccggcaaaatacctaatgaactatattagcagttgttctaaaatatcatattaatccaattttcaagtttgtaataattaaaactcaattaatcacacgttattaccacctcgttttacgagaaacacttaaactttatcttcaacttcatcttcaggagattcaaacaccatcatacattcatactataatcattttgcaaaaagaaagagaatcatgttatacctataaaagtcaatctgctaattcaatgttactggactctatttattcagccatttggaattctttcgatcaaacattcaaaccgtgctcaatttctctctctctctctctctctctctctctctctctctctctctctctctctctcttctttttctttgcttgcctgacaaaaaaaaaacatcagccgctgcccgtccaaaaatgcaggccttcgcccaacgggctacaattgcggcccaacaacttttaaggccatatcgaaactgcagtatttgcaccctagtctctactagtcgtagcttgcgatttcacggcggcg

SEQ ID NO: 51904 - DNA, 9461 bp, Oryza sativa
tcgccggcctcggcatcccgcgccccgacatcgccaccgccgtcgccgccgacccgaggctgctgtgcgccggcgtggagggaaacctcgccaagcgcgtcgccgagctcggcgacctgggcatcccgcgctcccagatcgcgcgcctcgtccccctcgccaagatcccctttcgcagcagctccctggccaccaacctcgcctttggctcccggtgttcggctcgttggacagcatcctcagggccctcaggaagaactcctccctcctcagcgccaacctcgacaaggtggtgaagccgaacctggcattcctcaagcaatgcgggatagatgcccgtgatgttgccagcaatccaaacctgtactccagccggctgttcacctcgaatcccatgaaactccgggacgccgtggcgcgagtggaggagctaggcatggtccgcggctcgagggtgttccaccgtgggctcgttgcggtggctttcctaagcaaggaggctgtcgcgacgaaaacacggctgctggtggagcttgggttttcgcaggatgatgtttcggtgatcttcaggaagatgccatccttcctgaccgcatccgagaaaaggatacggcgagccgtggggttcttgaagggggatgttggtctggaggaacggtacattgcgcgaaggccggtattgctcttgtatagccttgaacggcggctattgcctcggtattacttgctcaaggtcctcaggacaaagggattgctggattgcaagctgtgttactactcaacagccgcactgggcgagaagaagtttatagaaaggtttgtgcatccttatgaggaccacattgcaggccttgctgatgcttatggctctatttgttccgggaaagtagcaaatggagttgctccattgcttggtttgtagactgaaattgacggatgtaaaagtttctgctggggattttggctagatcgtcgcacaggaatgcaaaatattaaggtttgtggacccttggatcatcttgtactatgttaaagcttgtgctgaagaagtatgtaggagtaggtttgttacttttatcttgtagctctgatggttgaggatgacaatggttaatggcaatggatttggaacaaaaaagcattaagattttatttcacggactaaaccaacactggctgatccaagctgttgggctgaaatattcaaattgggaatttgctttgaaaaataaatggtagcacatgtactcttgacagaaaatatagaagattaccacaacttaacacattccaaggatatttctgtagtactttctgaccatccacattagatttggtagcaactatcgcaggaatgtgctcaaaatacagtcgtgttggggctttaattcaaatattttctgataaaccaggtggccaaacatgagtggagccatgctggggctgttcttgttttttttttctctttgggatgacaattatcaaatgtgattgaattgtaggctaacatgagttacaggttgacaatcatatggggctacggggttcctgccatgatgtctccctgtgcattcactctttgatgatgtgcccaattttgaagagaaacacacaccaaagaagttgcatttgtgattgtttgctcaaaacataccccatttcctcaatttgaatttccatttggcccaagcgtaaagcaaacctatgaactatgaagtgtatgcagcgggatattatttatcccaaagcatgaaccaggaatgcattactgacaatgagccaccacacgttcaggaaaaaaaaatgttgtatagcctgctgataatcacaaaacggacaaagggcacacttaggagatcaatctgtttcattttggcagaatctttggtgagaactgcattgcaattaatcatccatgtaaaatttctgactgttctgcattgatcgctccaaaacgcttgtattttatacacgatgagcgcaggccaacgcattgctttacctctgtcagaacacaagaaactggatgagctccaacttagttcagaagaattaattaaatccaatttggttttgatcaagtttatagaaaaagtagcaacatctacaacaccaaattagttccattagatgtaacattgaatatattttgataatatgtatattttgcgttgaaaatatcattatatttttctataaatctggtcaattttttaaaaaattgactagagaaaaagccaaaacgagtatgaagagggagtagggtttcttttttttcttttacaggagtagttttgttttaggctgtgtttagatccagcggtgaaaatttttaccgtgtcacatcggatatacgtacacacatttaaagtattaaacatagactaataacaaaacaaattatagaatctgtaagtaaaccgtgagacgaatttattaagcctaattaatttgtcattagcaaatgtttactatagcaacacattatcaaaccatggagcaattaggcttaaaagattcgtctcgcaaattagtcacaatttgtgcggttagttattttttaacatatatttaatactttatagaggtgttcaaacgaattttagggtgggatctaaagatggccttaaaggagaaacaaacgtgagaactggaaggcctaggcctttttccaaattaagcccaggagtagatgtcggaaatgtcgaaaaggcccatctacagtatacacaccgtctctctcggaagtctggaagcaagcgaagctccggtttcaagcggcggagcgccgccgccggcaaccgccgtgacgccatgattcacctccggaggtgcgtcctttctcgcctcctccagccaccgtgcctcaccgccgccacgcacgccaattccctcctctccctccacctccgccgcctcctctccggcgccgccgaacccttcgccgtcgaggactacctcgtggagtcctgcggcctgacgagagcccgcgcggagaaggtctccgggaagctctcccacctcaggtccccctccaagcccgacgccgtcctcgccatcctctccggcctcggcctcacgcgccccgacatcgccgccgccgtcgcctccgacccaaggctgctgtgcgcccgtgtggacaggacgctggatgcccgcgtcgccgagctcggcggcatcggcctctcccgctcccagatcgcgcgcctcatcccgctcgctcgcggcggattccgcatcaagtctcttggttcaaagctcgccttcttggtcacagtatttggctcattcgacaggtgcctggaggttgtcaggatgaactgtgggcaattaagccgggaacacgtctatttgctctcgcagttgtgaagtttgcaatcctcagccaggggaagatcaccaagaaatcagggctgtttaagaagcttggatggtcacaggaagatttgtcattagcagcgaagaacatgccaagtatccttgccatgggtgagaaaaggttgaggcaaagaatgaagttcttgacggaggatgttggtctagagataccatacattgcacaaaggcctgcactcatgttttatagcattgagcgccgcttattgccaaggcattgcttgatcaatgttctcaagaggaacggattgcttaagatcaattatgacttctattctactgccttgattagcaatgagaaatttctggataaattcgtgcatccttatgtggagagtgttccaggcattggtgatgcctatgcttctagctgtgctggatgtggagtggaccagttgaagctgttatcgaagaataagataatgtgctgaagcttcttctattaacacccacaagctgggacaatttttaggttagttatcagtttggtttttttacttctagagccaaacgaaattgagctttgctctcgacaagccaaactgagattcaggtctcgattaaggatgtcactatgccaatcaaagactgaactttctattaaatggatttatctataaatctttatgaagtgagctgacgtattttctagcactaagtcgattgaattgttatagttctgtcactgttgctctgatttatatggctcagcaacagtgtttaatatttagggatcaaactctcttgttttttctgttgccttgttccttagttatgtgaggtaaatttgatttagtttatatgttctgggaaactcactgttgcaaatgcttgaaacttgtcctcttgatgtagagttctgatcctaaaaagttgcttttgtgttactactcaaaatgatctgggaaaagattgatgtgtactccacaatacacaacttggacaacaacaccacaactggaggtctggacaagacaattgggtgttgaacaacagttcatttactacagtctacagtttctaggatgccatccagtaacaccatctgctatgctgtttgaactttcgtgatctaagtatgttccatctttttgatagcgtcctgcaattttgtgcattggagcaaattctagtttctttcacttgttactacaaatttatccttgaagaagacatgttaatgatttcgtcttggatatctaacaaatgaatggtgctgtcgcattgatttttattgttgctaatagctggcagaaaatgctatcaacaaggggcagttaacaattcagaaataataataaaaaggaaattgattttaagcattgctgagatatggtccaaattcaatactgttggtagtgagtcatctaagtaaacccaaatttgtgacttttgtgaaattattgataacatggattttttttgtcatttgtctttctttggaaacatctaaagaatgaggtcaggtcaccatcataaggtaagcttgagaagttgagagcagcaccaattcaaaggttctagatggttcatgcatttttggtcagtatctattttattgacagttaaaatagttggttgaggccttgagggatgcttctggtgttcgtattgcctaacagaattccctatttggttcctgttactgttatgaccctagctgcctgctttgcggtcaaagattttgctttattttgttcagacatcaaagttgaaacttgaaagttaacagctggtttccatttctacgtaatttactgtttcgagtttgtagtaactttatttataaatcaccaaatcggtgtatgtgtgtgcctcggtccgatatcaggatggttggtgtgttaccttgaaaaatagttcacctattcatgacataattgggtgttcttttagaatcttagatatacataatatgggcatgacccgttgcaaagcactggtatattactagtgtaaagaaaagctacactgatacatactgcatactactatctatcatactccattatatacttcctccatctcattttaaatgcagttgtgagttttttttccaatgtttgaccgtttgtcttatttgaaattcttttataattagtatttttattgttagtagatgataaaacataaatagtattttatgtatgacttattttttttcataaatttttcaaataagatggatgatcaaacgtcggacacggaaacttacaactgcacttaaaatgagacggagagagcattgtaccgcaacttctcgttttgtgtggtactgccacctagcacatctatttcaagaaagattttcatgttcaagtgatcaagtgacgttctcacatctgagacaatcttagtaatatttgcaaattcgataggcgggtacttctgaaatttgaagactgtaaactgaaaagttcggactgagtgatagcccccaacaagattcatggagcaattggctgtaagcattggatgtttggatctatttgatgcaacaatcccaactgtgtgaatttgtaaactatagctgtgatgcatttcttgcaacaagaggacttcttgaatagaccagcggctttgatatacttttagtacttggtcatgcttttattatggagtttccttcaaatccgttgagcaatgatggtggatacttagacatgtattttcatgaggtttaatatcaggagatagtaattatacacatgtattaattacagaaattcatcattgacaatgagccatcacacattgagatttttttttttatgttgtatggcctgctgatggtcacaaaacagacaaaaaggcacagttaggaggccaatctgttccattttggcagaatatctatggccaaaacagctctgtaattattcacacatgcaaaatttcttacttattgccatgcattaccactccaaaacgcttgtctagttcagtacttcaattgcctgccgcaatcagcccacatccgaagattaggcccaattatgttctgatcaatggatcaaatccagtttacataatgaaaaaataggtatcttatcttcttatcttaactattctaaaaacatcgttctcctttcttcctaaaaaatctccctccttaaaaataccttccaaaaaaaacctgctcccctttcttaaaaaaaacattcctaaaaaattatcgtaatctagttacagtgtacgaacaagtaattggcataagcggctgtttggtgcacatggcgcagcagctacaccaacaataccagcattaaaaaaaatgaatccgttgcagcaaagccccactacaaagaggtaggcacaggtggcgatgacggtagtggtagggcggtgcttgtggcacccacacggttaaggaaggtgataataggaaggctggcccgaccgacggcacgggaggccaacggtagggaggccggcgtgcttatggcagggatgcctagcgaggggggggggggggcagaggatggccggtgctagagcattggcctgttaactgcgggttgatagggggcggacaacaggtgtaaaatctcactcggccttgccaggccggctacgacggcgttttaggcgtcgttttttctctgggggccgcgatcgagccgcccctctccctcaagtgggctgctgggtgaaaccttgttttggctctcctcaagacctcgacggatgatggcgtcgggttcatcgccacttttttctctggagacatcgtctaggaggcctccccagcttgtgcgtgcttctctagatggatgtcctcttatcctctcgtggcagtgccctagtcaatgctagtcttgtattttttttctctattctcatcatagtgtttggacgttaaaaaaaaaactatggatatatgaaactggtttttcaaaaagaaactcagaggattggaggagagttagaatcgggcgcccgatccaaattggcaaaaatcgggtgctaacgtgcgtggaaaaccactttaaactaatttttctcttaaattatttatccaaataatgatccgattgtaccattaaatttattgcaattaaatcttcaaaataagaccacacatggatatattccgatgaaattttttttagcttattattgaattatttttaaatattgcacgatgtttcaccaagtatatcggaattgtttcactaagtagatcgaaaatattcaatcgtttaaatcgggcattgtttcaccttatataaaaacaatgtttcagcaaatagcgaaagaatgtttcagtttagcgcaacatatctatacatagtaaaatattctgagcacactaggtggaacaaattctcttaatagagagtttccaaactatatgggttatttgttgaaaaataatatttcgttcactgtgatatgtgagcgtctgatttttactccccgccggtcgcgcgaggataagcattctcgcagagaattgatcccactggaaggcctcgtcctcgtccaaattaggcccacaagtaggtgtccggagcttacaagcgaagcgaagctgcggtttcaagcggccgccggctaatccttgcgccgccgccgcccgccgcccgccgccatgattcacctccggaggagcttcctttctcgcctcctccatccaccgtgtcccaccccggccaatcccctccccctccaccgcctcctctccagcgctgccgccgccgcgcccatccccccggaacccttcgccgtcgaggactacctcgtcgactcctgcggcctgacgagagcccgagccaagaaggcctccgggaagctctcccacctcaggtccccctccaaccccgatgccgtcctcgccttcctctccggcctcggcctctcccgcccggacatcgccgccgtggtcgtcaacgacccgctcttcatctgcgccagggtggacaagacgctggccacccgcgtcgccgagctcaccgacctcggcctgtcccgctcccagatcgcgcgcctcatcccggtggtccgcagcctcttccgctgcaagtcgctcgccccaaggctcgccttcttgctcaccgtgtttggctccttcgacaggtgcctcgaggttatcaagaccaactatggcgtccttagctccaacgttgaggcggtcatcaagcccaacctcgccgtactcaaggaatgcgggatatctatagcggataggccctcatacgcgttcgcatcgcgggtgatcagcaggcctactaagcacctggaagaagctgtggtgcttgctaacgagtttggagctaagcagggaactcgggtgtttactaatgcggtcatgatttttggaatcctcggacaggagaagctcgccaagaagttggagttcttcaagaagcttggttggtcacaggacgatttgtcattggcggtgaggagcatgccacacatcctagccatgaaggaagaaaggatgcgtcgaggtatgaagttcttgaccgaggatgttggtctagagataccatacattgcacgaaggcctgcactcacgatgtatagcattgagcgccggttgttgccacggcattgcttgatcaatgttctcaaggggaacggattgctcaaggccaattatgacttctataatatctctgtgattagcaacgatgatttcatggaaaaattcgtgcaaccatatgtggagagtgttccaggccttggtgatgcatatgcttctagctgtactggatgtggagtgcaccagttgaagctgctctcaaagcgtaagacaaagtgctgatgtttcttctagtaataccagcaagttgggacaattttaaggttagtttatcactttgattcattcacttcaggagccaaatgaaattgggctttgctctcaacaagccaaactaagatttggtcttgattaatggtgtcactatgccattcaaagactgaactttctattaaatggattagatgaatcttaatggattgagctgacatattttgtagcactaagtcgatcgaattgctatagacttttgtcactgttgcttggatttacagtatatggttcagtaacagtg

SEQ ID NO: 51905 - DNA, 1721 bp, Oryza sativa
ctgctcgttccatttttgtaactcgttcatgctcgtggcgtcaaaagcgacggatggacttacctgtatagggggcaaaagaaccagataagtatcacaaaagcacagcacagtgaaacattggagatgcagtagccagtggttaggttatacctttgcttttgcttgcacaaaatcctccaactttaagggcctcaaagatatttttgtgccactaacgcctccctaaaaaaatggagatcgtatgaacaaacgtggggacaccacatccaagatgatgaacaaagcttaagaacggaagtacaaatatttacaagcatggacaaatcacctagcttgaagtataaatatttacaagcaaggacaaatcaccttttcttcttctagaagctcatgaactggtctgtacgcagctgcgatgcataggttctgcagaaagtgccacgttagtctccatacacaaaacaaacatggctagtagatgttttcttggaaagcaggaggttaagagttgaaccgctatggagggcttagcaataccttcaagtcactaccagagtaaccctcagttgcattggctagttcgtcaaatctgaaatcagattccaggttttcttttgcaagtaaaatcttcagaattttcattcgattctgtgagtccggaaggtcaacgtatatcctacatatcacattgacagaccgtcattttgatatactgaccaagcttagataattttggtaaaatcacacgattgcagatcttaccgcctaggtaaacgccgaattactgcatcatctagatcaaatggacggtttgttgcaccaagaataaggatcctttggttctctttggatcttaaaccatcccaagctgccatgaattcattccgcattcttcttgttgcttcgtgttcaaatgcaccacctcttgcaccaagtaagctatcaacctgtcattatcaaatacaaattgcattagaataaagagatttcgtatgaaattggaaaccacaagataatctcctgaatataaatgactatgccagtttcattaacggaagcaaaatttacctcgtccacaaatatgataacaggtgctagccgactagcaaaggagaaaagggccttagtgagcttctcagcgtctccaaaccactgtaaacagagaaatatatggacaagggctccatgagaaaagttttatgcaagggatggactgctaagttctgtgttgcctcctaatttctttcaagtggcaggcacacactcgcaaaagatggggaaaaacgttaaataaaagctgtactgaaattggtgtgggagctagtagagattttgattcagtgcagactgcagcaccagcacagttcatatagtcagtaatttgtccagtcaccatttataaaagaatgtttggcattatcatgtctttcattcacttaaaaactttgatgaaggggagaaaactaaatacagaagggcatagaaatctacctatggtgaaataaataaaagatttaacatgagtacatgactccaagtccaaacagttaaaaagaatcaaaagagtcagacagaacctttgatgtaagattagaaccagttatgctgataaaatttgctccagcttctgttgcaagtgcctttgccaaaagtgttttccctgtccctggaggtccaaaaagcaatataccttagcaaggctaaacaaaggtccatac

SEQ ID NO: 51906 - DNA, 4990 bp, Oryza sativa
aaacccccgaacccctgccccaaccttacacagcagcaccatagcccatgtgagaacgaccaatgacctggccaggccttagacctgtgcttcggtgtaggacagacgaggggaatttttttaaccccaagctgaaattcactcccacggggagtcgaacccagtacctaaggagtgctactagagccacctaaccaactcacctagaggaaatcaggaacaaagtttatgctataaagggacaaaactatttagagacctgatttaaggatttattttccatccaattaacattttgttgtttttgcgtctagtgcaaacatgtaatagtactgtagactcactatgacccattatatcatatgttcaagacataacttgtaacaggtaaagcagataatacagaaaagacgtccccattaaaattggcatcagataatcgctgattataaaacaacatcaagcaatagtgacatagctgcaaacaaacttgtagagtcacgagtcagaacaccaaaggccccaacaagttacaagcttctttatatagaaagggatagcactaaattttttgtacattagaacataacattccatgattttaagctatggattggtaacatactccaaggtattttatacacccaagtggtaacaatgaagcaaaaacactatatacaagatcaaaaaaaggtgcaggtagacacgataacaaaaacaggaaggcatacccttaacaagttcccatgagaaaaaagctctggtctcctcattggaagagtaacaagttcatccagtgtcttcttaacatcctcaagagcaccaatatcatcaaattttactccaatttcattgggaggtacaactgctgaaatgaaattgcgctcgaattcatcttttgccaaaatctgcagtgaagatcccccttgagcttggaagtaacgcagtacaatgacttgccagcaggacaaataagactagcaactaatagaaaagttaaacaactaaagctaaattaccttaattttttcagaagacttcctcgatgaagcctcctgtgcctttaaccttccaattgctaggtccagacttcaaaaaaaacaagaaagcattgtcagtgcagagccaacagagatgaccgaatcccaaaatcaatgatgaaatacctctcacggggaatgatcagcctgtcaccctttatagagggacacgtcactgatgataaatagtgacttctagcccatccaatgaccttctctgctcctgcaattggaattccaaattttcaatgtatatgaaattacgtatgcataaagtaagaacctgtcctaattatcactccaataaattagttgagcgagttgcattcattatgcagtattagaaaagaagtatttattagtgtgttaagtttcatcacaagaaggtgcaaaacaaattgatagggccatgtagttggcagacagtggttgcatactatattatgtgtttctgctggggtaattgtgcagtaacatttcacatgtgattgcataaatcaaataaaaatgcatacaaccagaacattcaaacgtcaactccaacaaacttcaacttgaagacactatgcttcaaattttcatatgatcaacaaagcatatataacactggcaacccaggtaaaagtatagcatatacgcatcataatatggatccagctagcacactcactttgttttgtcaaaataatgccctccaatttcacatgcaaaagatcctcacatgatagctcatgctcttcaagcacctacattaatcagtcattacttaaaggcaagcactttgaggaagtgatgttttaaccatatggttttgtaggtcagtaaatgaaattcaaaagcaagggcaaaattactgattaaagcacatgtaatcagcatgtccaataccttgggcctttctaccagggatgccttgagataattatttttctggcttctcaatctgggtattgaaaactcttaactggtcattatcctgcccctaaaaaggaataccttaattttaaaggtccagcttgaaaagtctaaagcaacagctgtctaatcacagaagaattgcatttagttattggcataatgtaacacacagacgcatgatcattacatgtcagtgaacaaccgcagtcaaaacctttggaaggattcacatatgaaaacttcagagaatcagtactaaaaagatgtcaacttacctttggaagaggaataaagaatttatttctgaagagctttgatatgtcatttgactttgaaggcttccgcgcttttagcccacctaccagccgcttcaaggatgatgtctgaaaatatggtattacagattaatagactttttgtgactataggttgcgggaaacccaccatgcatggtgttagaaagaaaagcagctctttagaacattcaagttctccaagcagcaaaacacagaatgatgtacagcaaaaccaataagctcctcctatcaaaacacctttctttgttttctaactattcctgtggcaaaactacagttgagtatttcctggtagcgttgtttgttttaaaggttgcatatggaaaacctaagttgtctttttaaaaagcatttccattttgcctttttcttattagctaacaggtaagtggtaaccattgttttgagcaaaggccgggatgttatattccattatctaaaaaataataattgcaacagcaacaatttgccaattactagtacttgaaactaatcacagctcaatacatcattgtagcagcagcaaacaggtacacatcaaccttgctatatttggctgttcccaacgtacctagtagtgaaagtcactacattttcagactaggctgagccagatcttgctttctaacagcactataaacacagcttgatatggcacaggatcacatatatcagcatccctttgcgttttcttccaaaaaccagcatgatgtcaagccaatcttattaacctactggagtttatgggactattcagcacatatatatatgttatatgttagatgagcaactgtttttttcatttattcccaagcagtggtggggccaggattcagacatgggaggggcctaatacactgttatttaggttaattatctaattataaggtggttatgtgtggaaaaaaatgttagagggggccagatcactgcccctccccccgccctctagctggatatagtctgaaggcctaggaacctcacatggttttccatgcataaaatcaagatgagcagcagagcaaatgtaggagaatgcaagtgttttctgaacagttgaacaaagaacttgaagagtaccataaactaaacataacttctttgatagattaacaagacattaccagtggagataggcgagcaagattgtggaacactagcgtcttctgcattatgaaaaaacaaataagatccaaaagaagtgcctaactgcctataatataaatgcaagcagctggaacaataagtgtatctaaaatttaccggctctttttccttgggcgctgcctcagttatattttgtccacatatcaaaactaaagacccagtaagctggtcaaacacttcttctaccttttcaacaaactccctgcgatttgatcttggaactgccctagacagccactgggaactatcaggaaagtaaacaatggctggctgtagagatggcagtacctatttatataagagacccagtacagttaagttcattagcagatcatacaagacacaagtatagtagttacagcatctgcatatctcaccaagtgtacaacatagaacaagacgtcaaaactatgcaatgcaaacaacaagaaaattcaacaaaatataggttttagacaaaaaataatttctgtcaaattacctcacgaagtgcttcgattgcgatgtgccaatcttctgcctgtatatcatggtcaagctcaatatcctgagctaaaagtacaaatgagatcagtgttaaaattgcagaattttcaggtcagttacaaaactatggatgactgggaatagaagcatactgtcgacccaacaaactgctggtttagcaagatgctctttgctagcttcatcttttttatcatcagacagcttgtcttcagaaggatcaaatataacagctgcttgatcgccattgatctcatacacctctccacgctgtccatttgataatgtcctgcaattatgacataatatggtgttaaaaaataaacttctcacacaaattgtgccttttaacaatgctaaaagattagttttcgatataaggaatatcaaatgtaaaatgaactcattcatcagaaacaatggtgatacaaaggactattgagatggaaacaaacataaatatgactagtggctatgagtagagaccacactaacaagtattaagatattttgcacctacgtcacacctgaaactgcaagaactttatgcacaaagatttaaagcaaaacttgtagaatattaagataacatgccagcaaatgatatacatttcaggagtaactcttccaccataaataacaactgaatctaggcatatattgctcaaaatgtaacagcagtaacatggagtaaagttccaactaaaccttctagtcctaacctacacaaaactcacctgccattaatagaagtataggcatttgttcctccctcttgagtaggaatttgccccaaattgatcctgtgatatgaaagatatatgttatgaatcatgaatagcatcaagaagtacgaagatctaaaaccatgtaagaagaaagggttcgatggataatatgcagtacaaacaagttcaacatgcctttttgacgcaacaagaagttgaatcaccaatttcaccagcattatgaacatgaatactcaactgtcaatgcaagagcgtgcatccaactagactaacacacgtcgtctaaaccaaccca

SEQ ID NO: 51907 - DNA, 11029 bp, Oryza sativa
  unsure (1)..(11029): unsure at all n locations
ctgatgcatcattattgcaaggtcagctttgcaaacaacacaaaaaaaaaggtaccggatcaagtgaggcaccataatattggatctaattagaccaatagaacttcaatacaaaagcatgaatgccatgacacaagtagccaataaaccaaacatgggtaagcttaactcccaataagtacctgtgatctgcttcaacaagcactgatgctccaacatacttgaccctatctcctgaaatagttaaacaaacaattagaaaagttgttttgacctttggcaacttttcgacctttgttcaagttcagtaagtactaaggccccgttctttttagctaatggaggtatggattattcgtgccatgccacgctttcaaaagtacgatttctccaaaaacattctgcatcaccgttgcttcaataactttttctaagctattgttacctttataatctatagtatttaattaatccatgtattaattaatgagcggataagctcatttggacaggccctaagaaggtctagcttgaatatcatatttcaccagtagatacaatgctatgaacaattaagccaatacttagcatatttgccagggcgttgcaacagctctcaaataaacattccataagtctagccatacataaataagagataataataaaccccatattcaaagaattgcatgcctaattcacattagatcaactggcagctgctaagtatagagaattgaatgtattaccaaatgtttttacaaataacacatctatgtttacatagatcggtccacaaaagatctggtgaagtgggggcgtagagcacaccaactccttttgataagtagttaaaaaacaagatgaaaaagaaaggtagctcatgtacccttttggagcggccttttcccatcttcaggagactcagcagtgtcagaggattctgatgttgatgaacttccctgggcactagcaactctctagaagcataagtgatcaaggcataagccacgtgccagaaatagaagcaaacaaatacagggggaaacaaggatgattataatttgcactaaaagatgtttgcaataaaaagatgggaacaattcggcttgaataaagttattaacaataatgccacttatgtatttgcagggatttttttctctttgtctaaaaggtctttctctcattcattaaacaaatgtattgatacaaagtagtggtataaacatatatcagaacaaagcttttctaagaattttaaaaggtcagacttcaatatggttctgcagcttaacagaaacaaacacctttgcaaattcctcaagagtgcatggaacaagcttcttgaggtcttccacggatttaatagcatcatcatcatcgctttcacctgatttttcttcatcatcatcgccttcatcttccacctctgacacagacccttcatcttcagattctgcatgatcatcttcttcctcactctctgaacaatcttcaccaaaatcctataaaatgatgcattaggtttgctcataaaaaggattatctaatacttagtacaacataatgaggggaaatcttacatatggagctagaacactgctgtccaaaaccaacagtggcacgcgtagctcatgggcaagtgcttttaccaatctctcccggtagagctcagttcctgcattatagaaacaaaaataacagcattccaacatccgattaataagacacacatattaacgaaaaattcaacctcatttgcacacagcacctgacaagctctggagcaatatcctcccaccagaggactgcagccgagaaccatactccagagcgacatctttgtggcgcaggtgtgccgccacacaatcactcagcagctgccttgcgtcctcacttgcaaccaaagagagagcacacaatctaagttagtctggttcaacgagcaaaacatttacagattagagtgttcgggccagttcgtcgtcaagcttactcgacgtagtacgggaagctgcgccaggagagggtggccttctcccatggcacgacgcggcgcaggaactggtcgcggaagcgctcccgcttggtgaggaatggagactcccgcctcctgcagccggtgacgaaccgctcgccgctcagccattccttctggtccctctccccgagccgcgcgtgctcctgctcgctgctgctgctactactaccgcctccgccgctccccacagccgcctccacgctgccgacgccgcccttggagcagtagaaccgggacgacggccgccgccgcccgtcgccgaaaggcaggggaggcggcctccgcgccaccgcgctcccgccaggctctccgagccccacgacaagcgcgcctccggtctcatgcgtgcgcaggagctgcgggcgcaggaggccgcgcagccgcatcgcgcgatgcatcgctggaagccgcgtcgtcgtcgggcgaggcgaggaggaggagggatccgcgagcgcgctaggcctccctctggcgcatgcggcggtggcaacaggtggacggtggatgggcgccgcgagcgccggcggcgcgacggcggggagaggtgtcagggtggcggcggctgcgacgcctcgggaggaggagtacggcggcggctgcacggctcgccgatttgggtgggtgggttagcttcgcttcggattgggccgtgtcatctctgggctttggagttttctttagattcgaccagaactatcgagttggaccaaccctatctacagagttgtaagaacgggccgagtttaccgtattgggccagaaaatttcattcctatcgaggttaagggcctgagctggagctcagccaaaccgtttcagctccactaaaaatggagcggagctggatggagctctctcactagagaggtggagctgggtttattagctccataactccacttcagacccaactcctgaaaataaatttaggagtttgagctctaccaaacaggccctaactctttgggctgggccacgtcaagatctgagcaatttgctggctctgccactacaacttgtcactattagtcctgaattgaactgctgattcagtgttgtattagaagaaattcttctcctctcctcttaaggcctttataatgtggcaagctgtcatttagctcgatctcttcacgtcacagattcggtatgaatctttgccacgttcatggatgggctcaccaaattgaagcccgcgtgatcttcgttggtcacccgttcttggcgtgaggagagaagactacaaacgcgctgcgaaagacgtggctccgttttgtttttcctacatggactatagaccttgtggtcttcctgggtcttactccctccgtccaaaaaaaaatcaacataggcatggatcgaacgctcatgtccagattcattgtcctaggatccatgtctaggttggtcttttttaggacggagggagtaagccttagtggcgtcttgggccaagcctatgcatgacctacattgtaaaggctcttagggcatgtttggtttccggccaaacattgccacgcctaacttaaggctcgccacgggtattttggtaggtgtttggttgacaactaaagctaggctagccacagctcataagccctcccgccacacttttttcccccgaaagtttggcggacattttcaccgccacactgatttgtggcgcgccactgccgcaaaaaactccccaacaaccacgataaattcaccgtccctcaactactctcagatatatcaccacccccatctctcctcatctcccatccatggctgctctctacctcgtttccatggcagatcctctcccgcggccatgctcgttgatcttgtgattagctaccttctcctgtaggttgtgcgttctttccttcttcctctcctagatccattacatctattaaatctcttaattttttcatgtgtagatctgattaaagggacacaagaacttctgtgtttgaggagcagctgcgtcttcatcaagttctttgtgtgcagcaacgcgtctgtgcgggtcgaaaggagctgccgtttgtgtgcggcgacgacgcttccgcgcagccggaaaggaaggtaatattctctcttttccactgacatcgatctgatggatttcgtgttgatttctgaagtctttagctgtgccttttttttttgcctgattagcactaaggcacatgtgcatccttgtataattgatggtgattgaataatcgtgtggcactagaatgtggaccggatctgaactaatatatactagttcttcactattagttttatgcatatgtatgcagtaatagatagatttcattcttgactaatatatgataaacagtgagcttaatagatagatatccatatcatgttgttgctttcaagatattcaaagtgtgcttacagtatattaactatcagttttttttctcttactgatactgataaccagtaacagtgtgcttacagtatttgcagtgaccttaatagatagatatcaactatcagtttttttctcttactgattccatactttttctgaaaatatgttttagatgggtcaaagaaaattgtatttacagtattacttggactactgccattatatatggaggagaagattgattgctggaattctggtgtgcctaaccatgtattggtataggattaatagaagaaaaaggaaaagagccattacatatgctcccatgcttgatagagatgttgaaagattaagacgtctagaccgtttataccatggaaccgaagcacattgcataagtgagcttcgtatgaggaaagttgtcttccataagttgtgtgctgagcttagatcacgtgccctgctagaggagacttttcatgtcacaatagaggaacaagtcgctatgtttattcacgttgtgggtcacaattggtcaaatagaccaattgcatttgaattcatgagatcgggtgagactgttagtaggtatttcaatcttgttttagatgccctctgtatccttgcccgtgaccttgtatgcatcaaatccattgacacacatcaaaagataacaagctctcatggcagatttcacccctactttcaggtacatcaaaattgataatccctgtttaagtataccctaagagtctagggccatattcacctatatttgttctaaacaaaattgtctattttcgtagggatgcataggagccctggatggtacacatattccagcatgtgtacctatgcatatgcaagaccggtttaggggtagaaagaaatttcaatcacaaaatgtgctagcagcagttgattttgacttaaggttcttatatgttcttgctggatgggaaggttctgcccatgattcttatgtgcttcaagatgctctatcacgtactaatggccttaaaataccagaaggtaggattattcacatcatatcctaatagctccatatctgaaacttcaattctgttcttagctaattaatatgcacaaaaaatatgtaggtaaatatttcctagctgatgccggatatgcagctagacctggtgtattacccccataccgaggtacccgatatcacctaaaagaatataagggcgctagagaaccagagaacccaaaggagttattcaaccttcggcattcctctcttagaacaactattgagcgagcatttggtgccttgaagaaccgcttcagaatatttaaatgccaaccattttttcctttgaaaacacaagtgaaaattgtgatggcttgttgtgcacttcataactggattatagaggacggtcctgatgtctatgtgtatgacgatgctgcttggtatgcagcgctgccacggagtgtaagaaaccgtactgatatgcaccaggagaatttgtcatgggcaaagaaaagagatgatacggctaaaaagatgtgggaagataaagtaggacaaactgtaccttagatttaagttgttctctaaattatgtaactaatgtattgagctgtctcttgtgaatgaaaacagaatggctaaaggaaaggcgaaggctgatgcttttccaacctctcatgagaggtccttgacttggcatgaggatcaaacaaaattcatgctagagtggtacatggaatacttgaaaaaacaacatgcaggttttaaggtaaaaaagagtcaccacatgttgtgtgctgatgctttaaacaagaagtttggtatgggggtgactgccgatcaagtggatcgtcactacaggtatcacaaagaaaattggaagtatattgcagcagcattgagcaagagtggcaacgcatttgaccatacaagattcttggtgactatttcagaatctgaaaaggcaacgctatgtgtaagttttctacaaaattgacatgtttgcatgttacattttagaatctgaactgcatatagcaatttaacatgtttgctctttatgcaggatagagcaagacgcctactctctaagcccatcagattctttaatgagatgcaggagctattcacgggatctagtgccgatggttctttggctatggatcaaaacacatgcatgaacgatagtgatggttcaaatagcgatgattcaagagatatgcttgacctcaactgctacacacaacctgaagagccaactggtgaggattctgacactttgccatctccaaccacgaatgcaactgttgacaactcttccagcggtagtcaaggtaaaaagaagcgtccaagaggcaacaaatcaccaactaaaagccacaaaaaagcaagagtcgctttgccgagtccaatgatgaaatcgctactacgatgaaatcacttcgagaaacacttgctaccacagctcctccaccaatgccacagcttactgatccacatgcaattctgtggcagaaactagaggcaatcccaatgacacctgatcaaagggttcttgttggtgagtatttgtctgacaaggagaataaaggtaagcgtggttggttgtgcaatgcgagtgatgctacactaaatgcttgggtgttcaagttcttatgtgagaaagatgggcttaacctgtgaagcatagcttgttaaagtagttttttggcgaactgtctgtgtgatgtgcacatgaacttctgtatggctgtgcactcattttggctttgtgttataaggaatgatggctagaatatatgtattagttgttggttgtctaattttagcagtgtggtcatgacaaatggctagaaaatgtcattgaaatagttttagttggatggttgctgatattattgtaatagctcaactagtgttactggagtgttatctttagctggactaatatttcaatatatgtgcactttaattccaatctacttatatacattttgctgctgaaatgtgattgctttgtgaggagggtaatcttaccactgggtgtttttatcaagatgtggttgcaatccaaacatctaccacaaatttttgccaaacatttgtggcatcaatccaaacagcacccaaaatatttttgccacaccttagttgcaaaccaaacagtctaatttagccacaaagtatggctagccaccattgtgacaaattcttaagcttaggcgtggcaatgtttggccgggaaccaaacagacccttagccacaaagtatggctagccaccattgtgacaaattcttaagcttaggcgtggcaatgtttggccgggaaccaaacagacccagtatgatggaagcaacatggggaatcacaatttgaccatgcgtactattccctttatcctagtaaaggatacgatatattctagtactatgaatcttaatagaacatatactagtattataaatctaaacacaatactatgatgtgtcgtatcacgtattagatttgttttttttatgagacgaagtatgatggaagcaattccagtcacccaagaactactaacgacagtatcatatatgcattttcatttgggcattcagggggaactgaccaaaccccaatggttaaattcctttgtctaccgaaatttcatttgtgctgccaagattgaatattcagaaagattgcgaggaaaagaatcaaaccataacggttggtttcccttttgcatagtgaaatttcatatgttctaccaagtgctaactgccaatggctaacccgttcgattaagtgtgagtatgcaaaacgagaaagataatagtgtatgactgattgcggtattacaaatttaaaaaatgaatatatttgatattataaagcaatttatatatagaaagcctttgcacgaaatacgccgtttaacattttaaaaaacatgcaattaaaaatcgaggtaaaatctatatcttaataaaaaaagaatgagacaattcgtttagaagtaaaaaaaaaatccagatcgaagttttggtttcttttttttttcgttggagaagacaattcgcccagcataactgcgtcaggtcttaactgctatagataccagcttaagattgatgctttcaaaaccaaaaacaggccccaaacagggcaacagagcttaggaaacaaaaactatacatggatccgcttaccaacaattggtagaggattcggatgcttcccatggtactaactaataacatgccatgtaatactagatctgacgcgcgaggtaaggaagtttttcttcttacaaacacggtacaagcgcacacgctcacaacacacgcataccgacccctacaaacgcatatgtgcacaccctaccctataagccacctccagaaaactgagccggtatatcttgaagctgtcgaagtcaccactagtgcctcgttgtcgacgtcgacgagtatggcgcctaccgctgaaagaataattagtcgtaaatacgatcacccttattaagtccaggatttgaacctgggtgtattggtttcaccataaggatactaatctatcgagttacgctcacttcgcgggtgaaagggagaaaccatataagggtagaatggatatttaattgttaactttgcatgtgaagatgatgtggcatgttcacgctgtattttttttctcaagaactatgtaaatcaaacgataattattttgaacaatttaaaaatatcagtgactaaattgaccctagaacgttttgactcttcgcccaaactaaaataatagtatcgaaatcaaggtggcatatacacgaagtagtgaatggaaagagagagggggatgaggtaattaagtatttggttccacctatatagattatgcttggggtaaagagtagtttcttaattaggttgtggagtatatccatatggtggtattaaataggagtattaaatatccatatgtcttgtaaataaatgttacgtgcgccagctagatgtcaagaacatgcggtaaattaaagcaacgtaacgtggcaagttgagcagcctattgtcataagcttaactaagtcgatcatactccacattaaaagccatcagccagagcttgaaaattaatgtcagctcaacacactatattgccatgagcttaatcaagtcataggcattaacgcaagttaggccctgtttctttcagcttaggattattataatccagattattgggagtaaactgaaagaaacagacaatttattgaagtagcttattataatctggatccagcttattataatctgataagcttatttaggtaaactttttctagattattgggtgaaaaaatacccaccatgccatcccaccccctctttagacttgcaaacccaataatttaggctctaataatctagattataataatccaaagctgaaataaacagggctttagccagcttaacgcaagttactgacaattaatacgtatacttgcatgcatgtcctgttcacgttactacttgtaacaaagctttcctgctcacgttactacttgttacataagtgaaaaaaacgtttgagggcacatggaaactgtacatgtacttgtactgcgctaagttcaattaatatagacgtacataaaagagtatatatcaaaaagagccaggggaaactgaatttgcacgcatgcatgcacattcatatgatcgagatcagtagtctaccaaacaagcactataaataggggcctcttatgcacaatacaatcacaaaattaacaagctagctatcattcctccaagtgtcaagtacttacgaaacggtactatgaatatatgtctagttacattttgcacttcaatatatatgtgtagcttctgcccctctgcttgttttgcattacatgtatttgcttgttggagaagtagatagctatatcttaaacatttagatcttattcggttaatcccatatgcgtgaaattagaggggattaattccacacattattcctcttcttccctaattaaataaccttataggtggaattagccgaataagtcaatgattaatttttctagtcctctcttgtgagtggattgattaattactacttagaattggctcatatacgcagaatatgccggcattggtgaagatcgggcagtggggtggatatggagggtcagctcaggacatcactgtgacacccatcaaactcaccggcatgacaattcgtagcggaaatgcgatcgattccataagcttctcctacagtggcattgacggacaggagcatgtcgtgggcccatggggtggtaacggtggacacgctaccacggtacagtgcaaaattctcaatgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 51908 - DNA, 4534 bp, Oryza sativa
gattcatgcagtaacttatgttgatctttcctgcagaattaaagagatcactctatgcgttgggctcccaatatgggaggatactggatgtggtggccttaaaaacacctaaactgagggggcaggcatgggtggtcttcagcgaaattaccgccgccacaaatgctttccgtggactgcaggaattcgatttttatggcaaaagaatggtaatcatttgcactttagttgataactgatgttttaatttccaatttgatttttttatatggtgtgtatgttttgccttagagtaacattgcattgctattttttcacatgggatattaagtatttgcagagttcagtctggtgccatatgttgggctgtaaattttttacaacaaggttctaaattcaatgttaaattttcagtaatgaagctactcagatggttatcaatttaaattttcagtgatgcaagtaatgtacagttacacatggatccatttattaatagtatgataataccttgatctggctagcaagcatcatatcatttgcgttctacaatgttttgcgggatgcttaggttaatgaagtagcatagataaacatgcattcttcatagtgttggtcttacatacattataatttgattatgtagtaagcattcacctttttgttatttgtagaataacatgtcaggataatctctatctagatgctgaaaaacatatgccttaactactgtagagtcaattgctcctaatacaatctcttgtttgtatactgggcaagtgaaaataaacaatttatatggacggtctattacatcacaatcagaagaaaatagatcaggcttaatagtaccactctatttattaccaagggctagttacaacttaattcttttccttgccctgtgcagcgagtacaatatgcgaaaacaagatctgactgtcttgcaaccgaagatggttctactgctccaaaagagaaaagaaagaagcaagaggagaaaggtatttctaattgcattttcatttatggatgtttgatcgttctatgcacaaaactttctgatttgcaatcctagcagataccttcaggtagtacaggaatggggaaatactaagaattctacagtgcaagttaaaattgcattcttcaatatcttcaaaactagggcatcagcctttcaaacatctatgtagtgtatactccctacatcacataaacatgccatttcggacatacatcaacttgaactttcaaaatcttcggcattgatgtcttttaagtatttcaattatatatatcaatatcttaggtctgttataaaacacgtacttccaaagtattctcatcttcttggtgcctatgtccaaaacaaaaatgttctcatgaatggaagttgtgtagtggctagcaaaatggaaagattcctttctctatctctgctttttgtatcaattgtactcctgttcattcttgaaatttaaggaggtactcataagctccttttccaatagaagaatacattaattatctcaagaagtctatgtctattcgacacgcatgacacattggttgatccaccaattgtgagcaagctacggagacatttaatttctttgttcttgaagataggtaattacaccatagtttctcacacttccatgatgctccacctatgtctatgaacttgagagcccaacgtttttttttatactttgtgattttcttaaggtcctttcaccacatttgacttcatcctagacatcctcaaatgccttatgttacgttaggtacacaacactttctttggtgatgaagatgtatgttgttgtggggacttccgtctgaagttttttcaacaataaaataaaattttggaagtgcctaaagtgtccgctaagcttatcatgagcatcattacctctattttatttcagatgcgcaagctacttttctaggagtagtaagttttgtgttggtagttcagtcatcagtcataacttatgaaacttgatttatctgcttgttgagttccctttggtttggttctactctttagttattagggaattactgcttaggactacattttattttcatttttcactgttcgattattgaagaacatgtatttatatgttttgcatttggtttttgctctcttttagcagcggagaaaaaacgacgagctgaagaggcgcaacaatctggtcctaatgctgctgcccaaagcaatgggactgtaagttctttactggtttatataccatgatttcgttttttataccattattctatgccacctcttatcaccttgccactattatttcttgaagcctagtttttttaatgcattctgtcatatatatagtgtggattttgctgcttaggttcatctattctgataccagatatctaccacagtgtttctttgtgccagcattgtcttattttacacaaatgttgaaatggtatatacacttgactggattatgtcttttactagtttcaaggtgaatgtccatcttttggttgaaagatttgaggcatcatagggaattaatgaattatatgtgtgtgcgcttacattagggggctacttggtcatcttgacttgtatggaaaaattactgctgttcaattctttaaattgaactatttttagattattctggcagtaggaagatagtcttacggtagtacagtttttttgttagctcaccaatttatgtcctcggaaactctgctataactgttttttcttgtctatcccagaaggaaccaacttaggcttcctggtaataactaccttagtgttgtccatcttccatgacatgggttaagtgggtagtagttagtaagatataatatctctctattgttccattaatctatgctgaatgtatcgctatcgtcaattagattatgtggacaaaacaagcaccggtatacttactactttcatattatcatttgtaatgcaggaaatttcatatgctcaactactatgcaactttgagtttcttcaagtattttgagtttctttgttgacttctgtgcagggttatcaagcctcacgcctgggcaagacttcgcaagagccacctgcacctccaaacaatatccttttcatccagaacttaccagctgagactacaagcatgatgctccagatcctgttccagcagtaccctggtttcagggaagtccggatgatcgaagccaagccaggcattgcttttgtggaatacgaggacgacagccagtctatggttgcaatgcaagctctgcagggtttcaagatcaccccatacaacccaatggctatatcctacgcaaagaagtgaatgatccatgggatcccacaatctggcaagaaaacctctgtacttgtaagactttccgcccttagctttcaaactgctgtatcagttttctaacactgtatttttggaaagcaattgcttagtttagaagtctttgttgcttaaatcatatttggtcttcattctttttgttaaccctgcttttgatgctggcatgtctggtattgtggcctttgtaggctacattatcttttctcctacactggtggtagaagttagaagatgtatccctcccttaaaagccaagagaaaatcatgcccctatattcccctcgtccattttccttggtcagagatgaatgaggtgtatatgccatattatattgccaaaaatcataagtgtcacctcagtagttgcaggcatgatgattgttgaacacgtattttagtggtgggatggtaggtttcgtggccttgtgattttatacaataaagtgtgcggccttctactactatttggctattatgggattcttgttgcattcgtggccctcatattaggtgtatgcctatccattctcccatctatgagtaactttgaagtccatgaacgtatattgtgcatgctacccatgcattggcatgtttctagtggaaaagcgatcgcgcgaagatagccacagccactcagccagccaggctacagtgtagttgtgctcactcgtgcaacctatgtgctggtaggagtatctcttatcaggtcggtacaggtagccggtagcctggaatttgtaggggcgttgtcttgtcgctggacaccgttcgttccggcaaaaatcacacgagataaatcttgtagcgtactgaccttgtgaacagtatttttgtcgtgtaagagggggccgggaggaaaccatgtgacatgttaaaaggcgtttgcttgtttttgctgtgggttaattcgcctttttcacctgtgggccgggagtatgctggatgtagatggatttttttctggggttgcttagaatggtactaactatgatttgttttcaacaattcatacagaagtataggttttactgttgtctctggctgcagcccgtgatattccttgtgctaggaaacaaagcagcaaagacaatttcatggtcgttctcttatccctgacgaaagaaaggggagattatacgatcaagtgatgacgg

SEQ ID NO: 51909 - DNA, 2750 bp, Oryza sativa
  unsure (1)..(2750): unsure at all n locations
ttcacaagaatcgtcgcatacacgagcagcaacaaagccaacaaaattaacaagttcagatgcactccgccggcggtacggtggggcccacatgggtagtagagtcacctcccggtgggtcccgcttgacctgacctcacccctcccccgggagaacggacggagaattaattagcctcccacaactccttaattccatctcctctcccctgctgatgtgttgtgtcatcgtgtgcttacgagaaagaaatacaccttggagaagaaacaaaaggcccgccccgacccgacgaggcgacgaagaagacgaagcgccaaaaaaagcgtaaaaggcagcgcagagagctcttctcttagccatctgaattggaagctgcactgcgcagtggcacagcggcgcgcaccggcagctgcaacgagaaaaagctgccattgttgctgcaaggaggagaggtggagggcaatgcccctgtcgaggcacgaggtcggcaacgagtactcgctcggcggccgcgagctctaccgccgggccaaccagcacgacccggaggccgtcctcgatggcgtcgccatggccggcctcgtcggcgtcctccgccagctcggcgacctcgcagagtacgacgaccctccctccccgtcctcacatgtcttactttgatttatttcgagagagagagagaaaaaaaacgccttcttcgattgctctcccggttgaattcctcatggatggtgagcttttctgattatatttcttgagagcatttttttctgagttattatttggcgaatttcctgggattgttgcgtcgcaatttgctgggggtcaatggtgatgggatgttgatcgcagtagatcacctaatgacctaatgcatttgttatgaacaaacaccggaggccttggtgatcctttttttcttcgaataggtaggtgattgatgtgttagccatttgacttccaggtagttaactctggtaatgtcctagtcctagctcagcaactccaacaaaaaatatcttttttttttctcccccgtcttctgattgtgatcgagcacgtactggtcatcatgtactagcactttatggcccaacttttttttaagaaaaaagtctcaggttcgcgttcatctattgaaggatgctctgattgatttcttagagcctggaggttgaagcaacggaaaacaaagaattgcataaaagcaaccatagtttgacctggattcatccctttagctgttgctgtgattgcgatgataatgatccttggcatttctgttgtttatcaacgttggaatcagttggcagaagtccaaaatgcgcatcaaaattcatcagacgttcttgaattccatttaagccttacaccagatggctgttaggacataggacacatgtgtcgagtactcttcttttcactttatgaacaataatgatttggctatttttggatacaccaactaattaaaagcctcaactgatatattttgctataatcagtaaagattccatgtcaccacacggcaacataactagaacttctggcaatcttagtatcatcatgtcataatgcaaatcatgatgccatcaaattgtcccattgcatgtgtgcagatttgctgcacaggtgttccatggtctgtacgatgaggtgatgacagcatctgcacgagggcatgggctcatgctccgggtgcagcagctggaggcagagttgccactcgtggagaaagactcttgtcatacagactacctgtatgttgcttctaacaggggtatgtgcaacagcacacaacacaagcttctctgcattctgaaagaaacaacttctgtcacctctacctgtttctgctaaggaaagcgtcttctactggtctcgttcataaaaaatcgattggttttttttgcaggaatcgagtggcattcgaatccgaggttggaaagtggggttgtgacaaaaggcgacacgcctcgcttcatcatggactccatcaagaagtgtcatgggcctcccaaattgttcatgcttgacaagtatgatggcctaacctttttctgttcatgtgtgtgttgagcttgcacctactgatgactgaagataatgctgatctttatggatatgatcatgcatttttgcaggtatgacattggtggtgagggagcttgcttgaagagatacacagacccgtccttcttcaagacagattctgcatgttctagcatgctagagcaaggaattcaaagagaaagaagacctcttagagctatggtaatgaaactgaaaacagtagatttcttcggtagaatgatcctatttgactgaacctaatagattgagtgcttgtcatttcttttccatttcttccaggagatcaggccgaccttgcaaaattctgagattttcagaccacctaatgcagccaacaatgactccaagtagcacccactataatcatctcataccacccagaattttctcttctgttttaatctcagacaaacggcaatttcttttttgtagattggagacagatttgtctggtgaagctttggatgaagtcccaacaaggcgccggcaactgaagtaccgacaactaaatggatctgtgttccgaagcttcaggccacagatgcagatctnnnnnnnnnnnnnnnnnnnnnnnngaagccctgctccatgaaccattcagaagtgcagatatctttcactgactcacctgacacaaacactgaagagagggaca

SEQ ID NO: 51910 - DNA, 2522 bp, Oryza sativa
aaatactcaagatcagattggggaacatttttatagggaagtgactgaagatattcatactgaagttgtccctgaaaatggccctgatataggcgaagaattagaagaaggcagtattactaagagaaggtgaacgaggaagatgtcgaggaaagcaatgagtccgatgcatacacattggatgaaaacaccgagtacatagaagagcaagtggtttcagatgatttgatctcctcaccgatctcatccaagcaatctgatgatccttgtcagatggcaccactcactcttacagatgcagatgatgccttggcaggtaaaaatgtagacaatgacatctctgaaatgcatatcacattgtcaggaacaataacagaatccaatgtatctacagtggttgttgaatcagcaacaaccaatgatgtggccgtccaatataatgaacaatgctgtttacatccagaaaccagttttgcacaagatttaactcatgtcagcagctgtgaagttgaaggacaaaatgagccattaccactgtgcagctcatccatggtgggtacaactccagatctgtctgtagacactgaagaaatacatgaaaaccccattttgtgcattgacagcagttctgatttgttcagagatgcactagctccagactctagagatgtgccattaccaaacatctcaagttttgattggatgcttaatggtgcaatgcagaagtcgttgaatgtacttcctgctaaaccacctaatggaattttacaggaaaataattcttccaaagatactgaagatgcaccaccgccactaccacctctcccgccaatgcaatggagaacaacaaaacttcagccagggcctgcagttttatctgcaaaatttgggagaccaccaagaccaaaacctccagttaagtaccaggaaaatgagagttactcctcacaggatgaaagaaatagagagcctgaaattcttcaggaagcaagtctgcagaatggctcgacttcggtcactccagagaaggaaatggtagtggcaaaagtttctaatgagatccagacaaatataatgtttggtagggattctcaagaaagccacctcaaaggactcaatgagtatgatgtgcaagcttctgattcattctccacatcagaattcaagagcgtgggaggtgttgcttcagtagaaggcgacaatcttgaaacttcacagttatctgagcttatagtaattccagaggaggcatggtctgagcttgtagatataaaatcaatatctggacaggagaaaggaggaaaacgccagcttagcactggagttttcaattgcaatggcatgcatactactggtctgtcagcagaaaagagggatgactacaaaatatatgatcaaaatgaaaagaatttattagctggaaagggaaatgcaatagcagattcagaagaaaaggaaccaaatggagttacttgtcaggatgatacgaagaattctgacttgttggtgcaacaggaagatggacaacatgatagttctgctggcacggcaagggaatcgtcttcttcatttgaagaggaagtagcaaagttttcaccaccgagagtgccaacaccacctaaatatcctctattccaagttactgctcatgatagaagcatggtatggttatttttgcattattcgtttcaccactttatgactaagatttcacctgaccaaatgtctatctttctcatgctttattagctaaaaagggctccaactttggttcagccttctatcaagctttcagacgagaacaacacaatactggaacagataaagaataaggtaaagtactcactgttggacctaaaaacattggcattgagtttagttttgctaatgtaattttttcttgtttacttcacagtctttcaacttgaagccagttcttgcaaagagaccgaacatgatgggtgctccaagaacgaacttgcaagtggtggccatcctggagagggctaatgctattcgccaggtttataaaccatctcttgcaacattattaatctcccttacagtttcagctgatcatagctttgtcatctatggtcatatgattattttctctcctgtaaatcaaacaggctgttgctgatgacgatgatgaggatagctggagtgactagctgattcctcagagcatgcaatttggcgcctgatgtttcttcacattcacatttcacaaggtctgtggtgatcatgccatcatggacttgcgtttcctgttcttgcataagtagagctagcaaactgtgaaatgaactacagggtatcatctgataaagaagcttaatgtctcatatgaagttcatgccatgaagatgcaacatgtaaacggtatatcaattttttcccgcttttccggcacgtgatgtgtttacgccccgtttggaacaggaatttcatagggatttcacgtcgaacaattcaaattccgttgaaatccagagaaattccctcttccaaacatggcc

SEQ ID NO: 51911 - DNA, 1526 bp, Oryza sativa
gaacgagcacaaggtgagccccttccttttcgcttcttggtgggctctcgagtaaaatgaagtaatgagcctttcttatatcttgcttctgaatatggcaattgataaaatcttcgatatggatcagtgtatttacatctgctgggtagaatttatatatgcttctgttactattgtagtaatttcatagattttccctcataactgtatgtgaccgataaacttcatcaaccactagctaatttagcttgtgtgcttccttgctaaatgctaaccatcgtcaatggaggaaatcggttcaattgaacttgtaatctgctcgtaaacatgcttactgttacatctgcaatcataatacagatggaattaatcataaatcgtcttttttaattgtgttctcatggttaacattctaacagaaactacctggtaccatttttccagtcctttggtgaatgtggatataccagttacagctttttgacattcacattagagttttcttaacatagagttaaaacttaaaccaaaattttaggcgttgcttgtacatccacctagattggacaggtgcatgttgtcagagggggtggggatggcttgccactttccatcttggttggaggctactcatccctctaaggcgcatcaagtgaaaatgcagagcacaaaagaacgaggaattacaaccaggagcatgtaatattcctaggggaaaactggagctcaaagcagataagattggttaacagtataggcatgccaaatctgtgtttcgcactggggcctggcagcagtaggttttataacatagggcctgtcaccaagcattcttactgagattttgggtttctgtttcttttttattcgatgcattattcttctttatgttgctttgctacaattttttagttgattgacaatgacatctttatcacataggctcaaatttggacggagaaagcatcacgatatcgatctacagtctggaaagttagcaacaaacgcccaggttagcgatccgcagtgtaacatcctgcctatatttaagaccattcggttttttttttcctctagaattcaaggacccttcagtattctgtttttctggtatctccggcttgcatttgtctcctgcttctgtttttctgttcttttcaagtatcttgggcttgtgaaggttaaagaaagaaaaagaaaaaaaatttctactgtttctggggctgacatattgttttgttgcaggatacaatgctagtgactcagattcagatgattccaaggaaacaggcaaacaatcacatgttactggaaaggtaagtttcatgtcccatgtgccactgtgatccacaacagtctccattttctggcgtcttgtagttaaccattatagttccagatgtctgattgttgagaaacaatctttgtttcggttcatagatgtcctgcacatttgggttagctcaccacgtatagaccatttagttgcacaatgaagaatttaggatttcatgtgattgattgct

SEQ ID NO: 51912 - DNA, 2878 bp, Oryza sativa
ctctctctctctcctgagcgccaatcgatctcgtgatctagagctcgcttcctcgacttcgtgtcaaacaccgggaggagcggaggccgatcggagcctaagcggggctgcgccaggagctggctaaccacaggcagggaacggcggcggcggcgcgcgaggcgtcggcgtcggtgtctgagctggcagagctggacggcgcaagggatcagccggaggagcaggacgccaagttcctggtgctgcggctgtacgaggcgctcaactccggggagcgcgcagggcgcaggagctgctcgcgccggacctcgagtggtggttccatgggccgccggcgcaccagcacatgatgcgctcctcaccggcgccgacccggcgagtcaaggttcctcttctcccctcgctccgtcgacgccttcggctccaccgtcatcgccgagggcaccgacgacacccgccagctctactgggtgcacgcctggaccgtcggccccgatggggtaatcacccagctcagggagtacttcaacaccgacctcaccgtcacccgcctctccgcatcgccagccaagaccaccgccgccatttcttcctccaactccaaccacgcctcctcttcggggccgccgccgccgccgtccaagcccaagtgcctgtggcagagccgccgcgccgaccgcgcgcacaagtcgctgccgggcctcgtcctcgccatctaagaacgaactcaaaagacatcaagaactcaaggcgcaaaaagcttccctaaattaatcacatataaaaaaaatcaagcgatacttatcaatagtgattagctaaataaataaaaacggaagcgcacgcactgagtgaagtcactagctatagtttattgcttatgggctaaagccgctcagctcaactgagctgcttcaggtttgcgtgattaatcccactaccactactgcaactagccagccagttaagtagtgttgcttttgcttgcttgtctgaaagctgaatcagcagtgtgaccagtagcatcagtagctttggtccaagtcattatggattatgtaagtgtgtactccttccacggtaaagctaaaccgtggctgaatatgaatgatggtctgttgttgttgcataaaagtactcgtagcttgttttgttggacacttaaaatcaacatatgtgatgtacaggtacttcttttctcttctttccccccattttcattccttcttgggttccaaatgaaccgagcaatgaactctgcttattttaatctggccatgaactgaataattaactcctacgaagtttgagcaaggaacacatctgcttgcgtgaagaaaggggatggactaattcgccccacacttatggaagtcacgagctgaacggcacctccctgatcaatgaatgcatggttgatggtttggatttcggaaaaccacaacgaaatcaaagttttgtttggataagctgtgaggataagttgtccagctgctctggagaacccctaatccgaggagaaaaatctacaaaatccaagggggacaggttcaggatgttgctttccaacaaggctatgatagcctcctctttgatgtgaagttcctacggattcccggtagatccggaagaaaaattaaacagcgagttcggaatttctttgctctcaagcgatgtcatttccttttcttctttttttttttagagaagtaagcgatgtcatttctttgctctctagcctttgttctgttctctcttttcctcacgatctgtcgctgtcccaattatatttgtggcgtaaataaaaaggaattccactgatatgtcaaccgaaatccagccggccacatgtttgcattctcattttataagcttaaatctgacttagctgtaaaatggtattcctccgttagaaaaaaataaatttcacaaaactaagtattttgcacaatctattacttttagcatgaagtgatggaatactaagatcactggtaaaatttactaaaaaaaaacgttacacatctagcgtttggaatttgtctaacaagggtcccttagaacactaagatcaatttataagggtgctaatctacccacttcatggctagaagtacacaggttttggacgaatggagtacgtgtagccgtgtaggactctaaacttgtccggtttgcccttaataaccattatactccgtatttctggcaggcttaggcttcaccggtcaccacaagagccataaaaatcgtgaactccgtcagaaagtgcatgcggcttctagaatttcttagaaaaggcttaactgctttaagcatttcacaaggaaaaaaaaacggtgatgacatcctcttcagtagcttctctgattgctgcacccttttgcgtgcgtgccacgtgacatggagtatctgggacggagcagatcagcagaaactgacacgatggttaatttcctcgccacgagatagacgtgtttacagtgtactattcactactctcgattctcggcatgaaacatgtgcggtgaatttacggtttacggagccctccagctttgaacgttacaggtgccaataaaactttatcggctcgactaacagcatcagtctgtaatcgtgcacgtacgtattagactagagcaatgctccggtgctttctacttgtagtattatactacaagtaaaattaatcccgaccgttcattttaaagggtagattagtaatctcctaatatatattaggagtaattttggccggatcaattttctctgtctcggtcggtcttggcttgatcgcgtcaggtccgacgcatgcacaacatctcgcccgacgcacgttgcttatcactactcctcccagcacgcggtggcgcgg

SEQ ID NO: 51913 - DNA, 5778 bp, Oryza sativa
ttggaggattcaatccattccgccggcgggtagtgatctccattccgtgttgccccgattgtgtgggctgcggccacttgggaggcaactgcgatacattccggctccccggttcccctccgtgcgtgcccgagtcttgtggcttgcatggcgagcacctcctcgaccgcgagcaaggcatgagattcagaatatgcaacagtgtcgctcgctgcgtgctgccgtggaaggcgtcgccggcgaacctgatagaccgcaatgctcagaggtttcagcacatccgtgctctcagcggcgtcaggacactggatcgggcgctgaacgatgcatgcggcatacccgatctgctagctcaggatggtggccggcgatgatgtccgcacgctctcctgcgggcatgacttccacgaggattgcaacactgcaaagtggttcagtgacaacaagaaggcctgcccagttcattctgcttgtaatattcagttgtatggtgttatgtgtcgaatacttcattgactaattgacgaggtttgagatattgatgtttattggatcttgtgactgtcccaatatattcattgttcagtaatggttcaagtaaaaaagaaaaggtgaatagtgagggactactagtaatgtcaatgtgttgaccatgtcagtgtgttgtgcatttttttgtgtgcaactgtgatggggtgagaagagtccaggcaatttgaactgaaatatgccatcctgctcctggatcagtaaacaagttgttttgctcctgaaaaagtgagactgaaaaaaatctgataaactgcttaaatgagatttttcactatcagagttttgcccatatgtaaattgcatttcagtcagagctgtaattcaggatttgttttatatttcataccattgaaacatctaattgcattctgtcatattctggtgctctgaatcatcgctacatgattcctttcttttgctcatatgggggtagctaagcgctcaattgccactagattgaatttttttttcaagtcataggacaatgtctactaatgggggcttagaacatattgattcactctttgctgcaaactccctggtctactgtcgtgtttatgcaaaagcatttgcattagctccgcggcagctagtgaagtcatgcacagtccctattcatgtagcatccaaacgcctcattcccaagtcccttagccgctcgtacggtcgccggcggcgaccaaatgccaccgcctcactcgagctccgccaccgcacatcgccggctgccgtagctcatttcttagacaatccgagccgtccaccacatccccatactacactcgttcattcacagttgcccattcctcctacctcgcagccgttcgccggaacccgtcgaacgtcgtccgctgtccaattgcccggctatctcctctgtcttggtcaaagctacatggcaggactagtcgtccgccgtgggcaaggaccttcagcggctcggcgaagaggagaagggccacccttggtcgctagagagggaggagatgtcgatcgcgctggagatgatggaggcggagagggagatgcacaggcgacgaagtcgacgatggatggggtcaggcgcttgagaagggcgaaggtgtagagttactgaataataatttacaataatacccttacgtgaattattatctatgaacaaatatacccctccatgtttctactaccactaagcgtggtggtagtagaactagatctcaacctgacgattatatacgatcaacggctcggattattttctactacaagtagaaagcaccggagtgaggctcattagactattagcaggcagaaaaatgttgttgcatatgcaagcattgagtacttactactccttttacctccgttttataatgtaagtcattctaacatttctcatatttaaattgacgttaacgaatctaaacatatatatctatatagattcattaatatcaatatcaatatggtaattgttagaatgacttatattataaaatggaggaagtattaaaaaacagtctctgaacagtggaaggcaaaatagtcattcaacactcatttaagagttactgagacgtactcaaatgttacttgtgctaagatacagtaccttctggtacgtactttgacactacaaggagtgcataagagaagggcctggggtctttacggctagcaacacaaactacgagctagctggtacgggttcaagcctcactcccttagtttaaaaatcaatatagtcctttctagattaatcccatttttcaaaaggagtgcataaacctatcgatttttattaaaaaaacactgtaaggaaatctatcacgaaaattgaaaagtattcatgtgcggcgaacgggaccctatcccccgaaaatgcaagcttagtgcatttggagtttcctctttttaaaggaaaagggcaggatttccctaagaaattctacaagttgcaacctcttacgatgagtgcaagattttggtggtttccccctagatctccctcaagcaaggatcgtttcccacatgagcggagctagataggaggagggttgcctaggaacccgatcaaaaaaatttttaactatagtttagctattttcacatatatacaccactcgatctaaattcagacactcatattagtctaaatttaatctaaaataaagtaaagcaagcgagtgacccccctctctagtatgttctagctgcaccctgatttcccaagtaacgatttaggcttcgttcgttcctgggcgatccaggggattgagagagaaaagtatctcattttccgcgcgcacgcttcctaaactaataaacggtgcgttttttttaaaaaaaaattctataggaaagttgctttaaaaaatcatattaatccatttttaaagtttaaaatagttaatactcaattgatcatgtgctaatggctcatctcgtttgcgtatcttcccaatctccacaatcctcttcttctcaaacacacccttagctgatgattgctaccatcattcgtcgtgagcgccaaaagcatgcaacctgttaggcgcatctggcaatctggcatggagcaaactgttgtggcagctggatttcctaatccacgagtttggcgggtgctctccaagattaacacgcctgaaacacgtgcagcttagtacgagcgtactgccgtactccagttaagagccgctttgaacactgcctgccatcgccaacagaagcccattgtgactgactgaactttcagcgtcccaatcaagcacctagcttttggtacactactgtactgctaccgctgttaatatacttgagaaggtacgtgtaggtattaaaaatttacactaaaaattttaatatctcgagatatatgatatctgaagatattaattattatatcagaaagtatggtatcttccgatgttttttttaaagaagataaaattacacaataaattttgtttttgcgggcatgaaaaaggcgactttctccaagccgacgacgatatgcatgaaccgatgaactctaccaaggcgcttcgtacctgggggtgtggctggaaagctcgctctcctatctgatcctgtggctgctagcgcttgattgaaccagtcccaccaccatggccaccgcctttattatcattgggttggtttgttttgtagtataaataggccttaccaaattttgtcaatgtcaaattctgataagttttggcatgactaattttggtaagggaaaccaaaatagcctaagttcactattgaaatggcctattttcttaggcataccaaaatctggcttcaaaccaatatacactaaacactactaaaattaccaaatattgataagcctaatttagttctcaaaccaaaccagcccatcgtgccgttgaaagctgacctttcatgtaggagtagtaaactgactgcagatatgagagcaacgagacaccgcgatgcagtcatgcatgatgctcgccataccaagccaaagctttggaacggcagttcagttcacttcgctggacacactgaggccacgcactctgcatgcagactgcacaaagtcagacgttcaggttccattcggcaggtgtgtattcagtattccaggggcgccgaatccgtttgagtcgtgagcagcagatgtgttcttgcttcttgttcagatgacatgttggtttcctcaattatttagccttgaaaataatccgtaccaacactttcaaaatgttaatggtttcctttaatcctgaagtatatccttatctattaacagtttcagcgtgaaaatgattttacctttgtgtggcacatcaacaggataagtcataagtgataccattccaaaacattcgcttatcagggagccatggttctctgatcaagttgactgttcagtgcagctcattttataggggagagaccgaatagcataaaaagatgcctcgattagggaccaagaatatgccatggtcagctcgtaatgcttgcatctgtgataaagaacaattcagatgaagtcttgcctgatcagttgctgatcaactggtgaagattctcgtgaaagcggcgacaggaaagggagaaaacgaactgtcctgtccaggagtggcgacagggtatcaaagatcgatccagcgagcatccgaaactattccctctccctgctgggtttggaagtgatggttgtagctgaaacattccaagtgtaactattaaccacaaaaggtaaatagcagcagcagcagcttaacccagtgatatatagaacctgatactgttagcttggacattcttctatacaatctgcagcctacactggacgatcacaatttgcaacatcagaaaagttggcatgtagcacattatcagaatgttcctcagaaacatacgatcagaatatatgcccgaggaccgtaatattcatatcaataataagttaccagtaatgctaggaggatataagcagaaaaaggttgatttgcaagtaatgtatgattaatccaaattggcatgcgattctctctatcaattatgattcagataaagtactttagtactaggctgaaatttttgagaattctgaacatgtactatttagtggccggcgtgctcgtttctgaacttcaagcttcgcatacggagccaccgatgctgtagccgtacacggtacaaacaattcgatttgctcgtaccggttattaaagagatggaaaaaattggggcagacgaaatcaagaaagggggctgctatataacggaatcccgtttttaaacgggatgatactggttaggtatcaggtccggtatcgggtgatacatatcaggtatcaggcgattctaccacgttttcaggtgatactcgcgacgtatcaagtgatacctatcaggtatcatgtgattcttgccacatataaggtgatacttgtgaggtatcgggtgatacctatcaggtatcacgcgatacctattagatgatacttgtgatgcatcaggtgatacctatcaggaatcatgcgataccagccaagtatcacgcgatacctaccaggtatcacgcgatacacacccgacattgacgccgccgaccactgccgccctagcgccccttcctccctagctccggccaccgctaccgctccctcctccggctccggcgacgcaccaccgccaccccctcccatcccctggatccggcttcggccaccgtcaccaccccctccctgccgg

SEQ ID NO: 51914 - DNA, 2539 bp, Oryza sativa
gtttccttctgaacaaaggtagatccccggcggcggcggggaagctgcccgtagtggcgcttttgatagccgtcccgtcgctccgacgactgggccccggacgagaatctatctgttgggccttgctgttcatgatggaggcccaaccagtccgagttgggacacggaccgaacgtttgggcctaaaacttactcctatctgggccaaatctgccgttctaccgttagtttacggcctggtatatggtactagagcagaacaaggtcgcctcattgatcgagagatacgtacatctgcatgtagcgtagaccgtagagtctcgaggtactactagcttgtcctggccggtcggacacgaggcagttggaagcgaggatgcagccagccggccggccggcaaggaggaggagctaggcacatgctcttgccatgcatggcgcccgcctatgccaactctgctagtcccaagtctcatcggccaatgcacaaactacaaggctaacctagcagcaggtggtgtacccaggtgtactgtactggcgaggagtagaaccccaactactggaggagtacacgggtaacacggcgcacagaatgcaagcgaccaaaagacaagcgtaccgtactgcaagctacagctagccgaggacgcctgtgtggctgtgttcatttctgaatcttttttttttagatggtcaggacactctctttctgtcacggtgtcagccgtcgctgaatttgatggagaggagggtactcctactgcagaaagaaaattggatgtgcgtggtggtacagggctctgctccatgccatgtagaacggtagggcagcatatgcatggtttatgatctgatgagtctgcctggccattggccatgctttgctgcggccgctctgaaccacgtaggcgccctgcgtacgtgtcgtgtactcgtgtcgcgtgactcgcgtcccggcatgcgttacagtaaccagtatgtacgtccgtacggccgcactacttctgattggaatttggtttcacttaaaattgtggcgccttggccacagtacaaccaagtgagtgcagccttccaggcagtcccagctcgatctgaatgtatgtgtgtgtactcagacaaacaacagctagctagctgtatgggtatggcgctcatcgtgccgtcgtgatgactcacgcgagccaaagagtgagctgtaagtagcctgtaatcgagcatatgtatgggcacagtacctgcacttcgttcagctttgtgccttcatgttttttgaacagccatcagtactcggagcacaaaacgtcgatccatatccactaactgcatgattagcaagtgagcttaatattagcacaaaactgttgccgttacagtaagcaggaatcaaacaggcgatgcctgctggaaggcctcataggcagatagatggagtaggcagtgcacaagcagacgaaacaggagtccatcaaatcagcgtgcaatagatgaagccaaggcacgcatatgcatgcccaatgccatgccaattgcaagctagatgcggacgggggacgggatcagactcggagcgcagcgcctgacgcagcacacggattccttccgtgccgcgtctccccgtgcaagcggacaaccactacaactgcaaggggctctcccatcttttcggcggcagcagcagaaaagttcctgtacttgcatcgcctgcacccgagggtgccgggctccgattcgacggaagaacctggccgcgctgcacatgagcaccctcccggcctcccctccctgcgactgcgtgccagcacagcagattaacacagctgtaaagctcatctctctactgtccgcattgtctcgttgcaattcttaatagtgcgcgtgtagcgtcaactgggtgtactagtactctactagtagtacgactgtacgagccaagaccttgttaagagtattcttctgcgtggcgcctagtacacgagagacagagaagagagccaaaacccaagctatctggggacaggagccaagatcccggcattaccagacatgaacaaaacagagctgtgcaaagtcgatgtcctcttgttctttgagatcaccctaaccaaagcattaagcgggcaaaaaacagcgagcgagcgagctcgtcgtcctcccgctccgcacgtcgtgctcggccgcagcgggcagcgagacagcgattcagggatttcgggggagctgcccggctgatgagtgctttagggggtgtttagatggggctaaaactttttagtccgtgtcacatcgaatgtttgacgctaatttggagtattaaacatagactaataaaaaaactaatttcataaatgaaagctaatctgcgagacgaattttttaagcctaattaatccataattatgaaaagtttactgtagcatcacattgtcaaatcatggtgtaattaggcttaaaagattcgtctcgtgaattagtccaaggttatagaataggttttataattagtgtatatttaatactctaaattagtgtataa

SEQ ID NO: 51915 - DNA, 4670 bp, Oryza sativa
ggccgggagcttgtaccgcttccgcatctgcgtccgccagaagccgccgtagaggaagccgcagaggcccaggagcacgcccacggagacgacggtgtcgcggatgtcgtcgtcgtggacgttgagcgccgtcacgctgaagatgaggaacggcgcgacgcagagcaggatgaaggtgaaggcgtgcacgtacatgtttccgaacccgagccgctccatgttccacccgaacacgcagaacgtgcacgtcgccgacagcgcgcacaccgtcccgtcgtcgcagcagtcgaacagcccgccgctccactccgggctgctcaccaccacgcgccggttgtatatcttgatctccacctcacggtcgttctccgccggccggtttccgccgccggcctgcgccgccgctgactcctcgtcggaatcctcgtgctgcttccgtcccagcgggccgtacgccgcgtagaggccggcgatgacggggcagccggtgccaaggccgtagccgatgttgagagcccagtccggccgttccttgcgcgcgtagctccagaagagagcgcagcagaagtactgcgccaagcaggtggcgtgaagcagcaccaccacgacgagcatgtgcgcgcggtcgtgcggccgcggcgcgccgtccttgcagtacaccttgcggatctcctcgcggtcggcgccggcgccggggcgccaccggaggagcagcacgaggtggtggaagatcttggggtgctggtacaggcacatgatggtgaagagcgcgttgaggatctggttgatcacctccgtccacttcttccgctgctcgtcgtcggggatggcggagtcgagcatgccggtcatgagcatgaacagcatcagcagcccggcggcgacgaacgccagccagatgatcatggcgaagttctcgggcttcctgcaccagctcaccgcgtagctccacagcttcccccacttgatcttcctcacgaacggcacgcggaaccgcctccgcggccgccggcgaccgccgccggagtccacctcctcgtcatcccccgacgccgcctggccctggccccggtggcggaggcggccgacgaaggttgaccggaggaaccagtccctggacgggtgggcgcggaggaagtccaagaaccgccgcttgcgcacgctccggctcagcgcgcccgtctccaccgtcgggatgtagatgggtatgaagtccatcagccgcattgtcgacgacggcgcgccgggctcgccggcgacctcgacgatctcatgcccctcgccgccgtccgggaccatatctgctcccggctcttgttccagacagcagcgcgcgcttggagacttcagaacagcatgtggtttgcgcgcgctaagaactagcgcctgcaactgcaaagagtttggatacgtggcagtttcttcgggtcagtagagaagtcagaagagtgcaaaaaatgtcaacacagtgcagcacaaccagaatgaccaaatctgtgctcgtctattctgactgaccattgctttgacggacttttgaaacaggattaattaatactcccttcgtctctaaaattttacgtcgttaacttttttttaaaatatatttaactgttcgtcttatttaaaaaatttaagtaatttttatttttttctatcatttgattcattgttaaagtatttatatatacatatagttttacatatttcacaaaagtttttaataagacgaacaacaaacatattttaaaaaattaatagtgttaaatatttagaggtggagggagtactactcgtacttacgtctgccacaaggtcaaacatggttgacctacttgtttaatggctaggtgtaataaatttgattatctaaaaggagtagtaattctatgaccagaaaggcacaaattctctcttttttacttagggcttctttgattgattggaaaaatggaggggaaaaaagtaagaacaggaatcctataggaactagtacagttcaaccattaaaaactcataggaaagacatagaaatatttcttgtgaccatgatttaaatagaattctaagaaaattaacatccaccttaaacttattttttttactatgcgtacgatagaaacgaagcacgattggaagatatgttttactttttcttgaccctagattgtatggattaaaaccatctggtggtcctttggaacgaagggttttcacatgatttttgtgggattaatgatcctttggatctgccactgttcacgtagaaggaattgctcaaacgaattatggagggatattatagcattaccatgaaaacgcatgaattcaccgcaacctctagctagcataggatagaagctaaatcatatgttcaagacaaccctctgttccaaacaaccagccctataaaattcctttgtttccatgttgatcctatcatagtcctacatttcctctattgatgtgtgtgtttttatcctgtatttcgaattagccctcaaaattttatttactgttgatttaatacttaacattcccatgttttttctatacaccatcaaataatcattcatatagtttcctgcgtttctttaataatatgttttgcatacgcgtgtctattcatatatctttattttaacatgttttctattcaggcatttctccagtaaggtgtttcaaatattagtttatagtgtctaggtatttcatccagagctattgataactcttatgttattctttccgagtattatgcacaaatatatttgttaaatgtaacatctaggcttgtattggtcttgcaaaatattttgctctaaaatatggggttcattaaaataaattataatagagtgaattgtaaaatttggagttctgtatcttggatgctaaacaaaccgagttttgttttttaagttcactctaagacaaatatcgagaggaaccaaaagttgatcgcacaaaactatgtggtgagatagttaagccataggtgcatgacttcacttaatagggtttaaattctggtgtttctgaatattaccacacgttggtgtattttcaaataaaatttatcgttggtccatgttttttttaacgtaatgggcgcatacgcggttttgtgcgtgtaatccatgtaattggaagagaagaagttgaccccactgattgctccaatgtattgaagagggttgtgcggtttgtctgtgatcgtgagataaccagatgtttcatctgcaacacctttgtggaatgtggatgcaaggaccatgactagaaatcattgtgggtcaatctagaaacggatatgatgcaaaacgattctcgattgctgagatggtagtggtactgtgttgggtgcacctcagtaaattggattttatttctgcataggaccacggcgaaacatactacgtggaaaccgggcagatcacagtgcgtagtggcagtaatgttctgaacaatacgctactgctacaggaaacataggagcctctagtttactcgactcatcaagaattcaagattcaagaggcatccaaggcatgttcttttggttatgattccaaaaaagagaaaaaaaaaactctgaagagtctgaaccatctagaagaaagcacaaagactactactaccaactagtaaaagctaaacacaacttggtttgggttgtcagccatgttacttgtagcaaatgtcaccatatgcaaggatttttccctcctgtggtgggcggctgaatttacaagtactggtactttgtttaacaaacattgggcgtcactatcaacatggtgctgagccaacgatgtgtaggactccaaacaaaatgtagcgagaaaagaacgtcaaaggaaaagaggaaagctgaacccaacagcggaagcactcagcacggctccacggaatgccaagaaaaatctaacactgctaagtgctaacggggtcgctgttccaaacaggtttcgtttggaaacagttacgatcagatttcagttaccaaatcaaaatgacggttttatctactaaaagatagtagcagtagtacagtggttgcaaaatcaaaccaccgccgtgcctaggcctcgcgtactactgaaagcgctgcttctgttcaggcgatgatcggtttgatgatcaatcgcaagaacaaatggggacgattaacattgccgttagaaaaaaaagagtagaaatggagaaaaggctagcatgcagaaaatcgtaacaagaacagagtaaccaatccatgagatacaaaggttgagagcgaattcgagaactaaaggagatatgaataagatagaacaaattgcacagcgcatagtatagcaagtataacacgtacctgagctcacccctacccatctccttccaaagctgcatctccatgaccagcctgaagaattccactggtatgcaagttcttccttcttttccctccaagaatccaactgtccaaggcctccacacctctactgcctcttgatctttgcctagctacctcacaagagcaggcaagcggttgaagaggttgtggatgctggaagggaacagatgggtgtgggcacggttaaattccctggttttccgaggttatttcgatttattgaccaaaaggagtcttctttttttcgtgttcagaggggaagctgggactggga

SEQ ID NO: 51916 - DNA, 1585 bp, Oryza sativa
ttcctctccatgcaccatcgagggcgccgggcttatgcttaaccgcgtcctcgcctctccccgtcgatgaccccaacctcgccgccgccatggccccccggccgtgtcacgccctgaagttcccctccttgctttaaaatttgttaaataaatcgtccgaagaaattgtttaaattaacctagagatgaatccctaaattaataaatgcaactaataatcagaatcggcatgtggaatttttcttggattctacatgtcaaaatatgctaacaggatttagtggaatttttcagagctcaataaataattttaaccaattaaaaacattaaaccacaataaataatccctggaaaatcctttttttttttcttttctcttgtttttcttcctttttcctctctttttcctcttgttgggccgtcggcccaattcctcccgcgcccttcctccttcctgggccggcccaatccctccctcctctctccgggtcaccgacaggtggggcccacctgtcggccccttcttccacctccagccggcggtggcaaccgccgccgaaaccgccacgccaccgccgctttccccgctcctcccgcgcccactccgcgccccacgcccctccccacgtcgccacccacgtcccgccgtttcccgccctcgcgcgcacccgagaaggggcaggattcgattcgaatcctctccccactctctctccccacctccctcacgtcggcgagaaatccggccgcctcccggcctcgtccgcccctcccgagcccatataaaccatccccgcattctcctcctccttttttctttttccatcggccgctcccgagctctccaccgcgcccgcaccgtgcgcccactcgccaccgccgtctccaccgtttcggccgcctctagcagccgctagggccgccgccgcaccacgccgccgccgtcgtcgggctcgcgcggccgaggtccgccttgtccacccctcgtccgtcgcaatccgtcgccagagatcgctgtccacctcacgccggtgagcaccactaccgccaccttcggccatggtttccgcccgccgtgtaccacctctctccctctaatccctcccatcttgttccctaggaggtctcggagctcgtccgcccatcgtcgccgttccccggtcgctcgccgtcgccgttcgccgtcgtcttcccccacgccggccaactcgcggtgaggcactcctcccctcttttccccttcctctccctcctagcgccgagccgggccgagccgccgcttcggccgtgcaccgtcgccttcggccgccgccgccgcctcctgcgccgccggttgccatcgccggcgaccgcatgctgccgccactagccatggctagccggccggctttggagccgagccgcgcccggcggccgcttctcccgccaccgcccgatcggctcggggccgatctgggccgtcggtcccgtggaccggcggtggaccacccgcgtggtgccggtccacgatggaccggccccttgagccgctaccgagtggggcccgcatgtcgacgcacccctgatgacgtcagccgggggatg

SEQ ID NO: 51917 - DNA, 1081 bp, Oryza sativa
cttaagaatagattcacacattactcgttattatgtaatctacatgttttttagaattcactaattaaaaaaatctgtcttatggaattaaattccttaaattaatcatatcatcttggcgtattggttggaactcaatagtagccacttatattatgattattttaaaaaaaaaacttctccacaagaatggcggttatctaggttatatgcatatgctctagacaggatatttgcttggttggactaaccactatgcaatgatttctaaaaggttgcatctaacgtatcaaacgtacaaaattcgggctttgcttttccgaatagcactatggaggcatctcgcgagcgattgtatactgtgctggaacatcttacgaacaccttatacgatatacccctgctttcacgtacagcatccagttttctcaacatcaaacatcatacatacttacgctaaaactaacaaaaggtcatcaattagaaatggaatactaccatttggcccggtcccaatagaacatttcttcgcgataatgcagtgctctgttgcgtcgaccctgccgcgctgcatcgtcggcgtcgtcttttctcggcatcatgtcgttgtttatcggcatgcgcggacagccgcttggtagctttcttaagctcgctgaagctttcgtcagtcgccaatgggagtatatattccccaatcccccactatatgtaagtttatttcgatctcaattgtcgcacacccgttttgatttgcatgtacatttacacatggttttattcggtttcctcagcggaaccgaattcctcccccctttctgttactacaatgtttaatattgcattctattttcccctgacaaaagaatactgtacattctttatttttttctcgaaggaccagcttaggcggctggcattccatttatcttagaaggaacaaatacgattttgccaaaacggcggtatgaaaaagaaaaaaaatacatcaactgcagcaaacaggcttaccgttattgtacaagtcactataagacgatattctcgttaaatccttggcgcctcccatgctccaaaccct

SEQ ID NO: 51918 - DNA, 5560 bp, Oryza sativa
cattcgacgtctccaaacactcgcttgtattttactccacatcagggctcaggagtggtggcaaggggggttgagcagatagatcgataacgatgaagcacatgacacccctcggcccaaatggaggctttgagccaagtaataagaagtcaccgccgcaagttggagcgattcctcaacgctcgtgtgaaacgcgacgccctgactggtcgcctctcccgctctatctgcgacgacgactctgcatgcgcccaactggcaaaaatctctccctccagatcagccccccccaattcagcaagtctttcttcagatcagtatctgatcattgaattttacttctcttgcctaattcagtactgtactctcttgggttgttgggcattgcgtgttgagtatgtccctggctagctgtaaacctgtaacgacgggtgtggcttcaaattttaagccaaaaaaaatcacaccttttgtccaaagtttctattctgtcgactggcttttcagttttgaactcggtgatgtggaatctgttgtgcaaaatgttttttccctgatattgctatcaacgagacaacgagtggtggaccacaagtaactctcggctactgttcatagagtatgattttgtacttgatcaatcgtactttccagggttttatttaaccttcactttggaccatggcgattattcaagcaagtagcaaagcatccatggacagtgacacgaaacaaccaatgagatgaccaggcaagatgttaatgcaacacgaaagggggccaatgctcagttgcacaagtccaattaacacattgaatcaagagattaacaaaatgggatgaagctgagtacacttgcgttgcgtcacattaacaaatcctttttagttgtgttctaaactatcgcattcatctagagggagaagaagagtcaaaggccaattaggtttctggaggtggtgacgccgccgtcgacgacgaggttgtggccggaaatgtatctggagtcgtcgctggcgaggaagagcgccgcctcggcgatgtccctgggtctcagcgtcgcgcccttgagcgtggcgaggcccctgaccacctcctccatcttctccacctcctggtcgctgggcacggcgatgtcgaggtcgatgtcggcgtcggcgtcgtcggcggtggaggcgtcgtggccctggcgccaggcgttgatgagcatcggggtggcgacgccgaagggggagatgcagttgacgcggatgccgtgggcgccgagctcgcaggcggcgttcttggtgagccccacgatggcgtgcttggaggcggtgtaggcgtgcgggccgaggccgccgagcacgccggcgacgctggcgacggagatgatgctgccggcgcggcgctgggtcatggcgagcgccgcgtgcttcatgccgagcgcggcgcccagcgcgttgacgcggagcacgcggtcgaactccccggcgtcgaacgacaggatgctcttggcggcgcgcgtctggcggcccagcaccccggcgttgttgcacagcacgtccaaccgcccgtagcgggccaaggggcgctcgacggcgcgctccacgtcctcctccacggacacgtagcaccgcacgagccggacgtgcggccccagcgccgccgccagcgcgtcgcccgccgcgtcgtagatgtccgcgatcaccacctgggccccgtgcttcacgaacagcgtcacgatcgcctccccgatccccctcgccccgccggtgacaatggccaccttcccttccagcctgcacgccaaaattccaaccaccattaacaaacagctccaagaaaacgacgagacgaacaacacaacagcgccatgagtaatttgtagtagtagtagcctacctcttgggcatgggagtgggggcgccattgggggagtcccaggcgtggagcgacggcgccatggacggctggtgcgccttgtcagggaggaggtcgagtgcggcggcaggcatggcgagatcctgggcgtaggaggcgagggtagtgtgcatgtacgaccctgtcctagcaagtgatagtgtgtgcgcctctgcaggggagaccggacaccgccttatatagcccgttggggcgcgcagccgcgcacggcttccctcccccgtcgaaagcgacactgcgttttctgaccacaattccgtcgacgtgtttggctcagctgccgcgcgggtgcgcgcgcgtgagcattcgtggaacgcgactgtgcgaggcagcagcgaggcagggagttgtctcggcttcgtgacgggtagaccgagtggcgcggcacatggttggagccggtcgagttgaccgccacgggtgcgcggttttttgtttcggtcaggatccgggaccttgacgctgaaaaagagttcactctctagtaagcctataaaattcatgaaaaaatcattttaaaaaagtccagtcaatttaatttcgaaacaattgaaaaaacaacatgcactacaaatgggtcgttttttttttctgttgttccttggcatgcacatttcgaaatgttttttgcgtggatatgggtcggtcggaacgggcatgccttagactgaactttaggattgaaccggtgtggtcgtgtggaagattgaggcagagcggatcaagatcttttttggaatttttgtttgggacgtgcagctgcaggagaggtaggcttggtcaacctcactgtaagactcgagaggcgttgttggcgtttcaacttggctcccacgatttccagcggtagtggttgccgatcggaggcgagttccaactctttcaacctaaatataggcaggtagatttgttcccaagtgagggattaattagttggagtattaatagaatccggagtgtgattgctgtaacaccatcctaattgcttcacggaacaaatcagcttcatgccttttaccaagttgtcaccaaacaagtactacgtgcctaggtcgatctgaccgtgcttttttccttgcccaattggatttcgtgcttaaggtagagtttgaatcagctacttattttttatggacacgcttgcagaattaataaatagagcttcagagacttactcttccattctaaaataagttaatttctagattttaaagtttatcacaaaacaagtttatttctatgttcttttgggttcataaatcaataaattttatcccttcaatattccttaactactcacacaccaatatatttttctattaatgagagatattttggacttttatcattgctgctaggaaccttaacgtttgacttgtaaagaatccccacaaaatttaaattttaaaacataattttctactctctttattttaaaaagaatcaaattatagggaagaatctggatacacattgattctttttggacagagtgagtagttaattctaggtatttcaacatagttttcttttccgcttttaagtagttaatcatagatatataaaagttttactaataaattatttcttagtcactaaaataaaccattttggtatataattagctattggccaaccaataggactgtgattatttttagagaaaaaaatctaagaaatatcattcacaagtgcccaattccaagaaatactatcgataagtgtgagttccatgaaatgtcattaccgtttccgtctatccgcgccgttaaatacattgtttatcctatagcacttaacggatggttgctaacagaactctaatggtgacggtatttttgggataaagtcgcttgcacgatggcatttcatggaactcacacttgtcaataatattttttgaaattgggcgcctgttaatagtatttcttggattttcttttatttttaagatacgaggaattgatttattttaggatagagttaaatactccctagaagcttttagagtgaatcttttttaatctttctgtcaggcagtcttgtctattaaagtgtaaaagttttattctagatttatttgtcgttgctgtcatatctagttggggggtataggagtaagtcgcaggaaaaaaatgcattcccctgaatataaccgtggacgaccacgtttaatatatatgattaattttggatggctaccagacttcgttagtgtggctgcttttcacgctgtcttttgtcctgatttttgccaaagctttgttatagtataaactactccactaattaaggatatggtattgtagcctttcatttttgttatgctgcatcaccctgcatctctcaaatatataaacaaccaaccaattaatcacatcaccttttctgtcccaaattgagtacaaataattgatcatacaggtacctcaattagcattggacgctgtgcttttaagacctaacagtgccatcatactgtatctctcaagggaaaaaaaatagtgccatcacatcgggcataagcatatgaccgtcagaccgtgggattagacacggaggcgattcagctgcaaatgtgtgaagatgatagagtgcttatgaaggttgcatgtggtaggcttaagacaacggtcatcaactctttgcaaactatggatggagattcacaaatagacttgaataaatgtgctcttcttattttagtttgatcttttattttgttgggtgtgtttagttcatttgaactacactcagtgtttggatgttatttttgtaataattagttgtagctttgatgagcaaagcccggaatgttttattccgttatctaaaaaaagacacagaggcgatattgaaatgtaccattgatctgtttacttttctttggtgctggtgcatgatatttcagtactttcgatccgttctataatatttacgttttattaatgttataattaaacaattagaattttaaatatagatacctttaaaatattgtttctgaagacactataatatgatatacagatcaatcttaaaactactttataaaattaaatatttacatatttttctatataataaaatatatagtaaaaatatgttctgaaaaccgtgtcattatctgaaatatcaatatctactattataaaaattgaagatgtttttaccggtatttggtacgtcattcgtatttgagtcgggttttaagttcgtttgttttttaaaatatagatccgtgtttgagttatattttaagcttgttaccttttggaagtataaaaggagttttatgagaaatatattttaaaaactcgcatgctaacttcagatgaaagatggactcctaattgcagctcatgattttctgaaaaataaatatccaagtcaattcccacaataaattttaccctagctaaactgtataacaataataaaattaaaatagcatttacccgttgcaacgcacgggtattttttctagtaattataaaaccaaagaaagtagtttaaactttgtaagtggagtccactagtatatgtttacttttcaaagataatatccatatatgcatattttaacgttgtgtgaacgcatgcatggtgatagagtctagggatggtagtgggtcgg

SEQ ID NO: 51919 - DNA, 7806 bp, Oryza sativa
ccgatgcccgacattgcccgctcaaaccctacccactagagttagcgggcaaaactccgtgcccgtacccatgtctggcgggtgcgggtatgtctgacgggtacccaatggatctcgcatgaataataacttgaaagatatgtaatttaacaaagagaaataaaattaataatttaccaaattattggttatcaacaataatttgaattacatcacaacttagtatcagttagcatcacaaatgaaccgagagaaatggtataagaattaagaaatgagtcaaaattagctaatacatatgtatcaggtcgggcatggattacccacgggtaaaaaaatgaaacccgcctattgcccataacgtcttcgggtctcggacggacgtgcccatggataaaaaatcattaccacgcccatgcttatcgggtacccgaacccatgggtaaaattgccatccctaatagagtctccaataaagggaacatgcacgaaccagatttcgtgaagaaaatactccctgtgtgaggctgagcgtgtctccagtcacacaacaagtttgggggtttttctcaacttatctattatatactaaaaatccattaaacttcctacaaacgctcttaagccgccacgtgggattcctacaaacgcttctaagctgccacttggcgttctaatacattagaaacatctaacccttgattttcatttaaagattttcatttaaatttgtaggtctattattttaattattttagaccattagattagattaaattaaaaacagaattaatccctccctgacgtgtacgtgtatctcgcacgtacgtacatacttgattcctctttttcctccccattcaaaacgctctcaaagccgtcacgtgggatccttcctacaaatgcttctatgcgcgttctaatacattagaaacatctaacccttaatttttatttaaatttataggtctattattttataccattagattagattagattaaaaacagaattaatccatcctgacgtgtacgtgtatctcgcacgtacgtacatacttgattctctttttcctccctccccccccaattcacctctttttttattttttttactagatataccgccaaaatatatttatatcacctccaatttctacactattgatttttgatcatatgttttatcctaagccgctacgtggcactcatacaaacactcataaaccgccacgtgtcactttctaatctagccgtcgattttcactgaaattggtggacccactattttagaccattaaattagatctatttaaaaaagtctcagcttcatagaaattatttactaaaaaaataacgtacatgttatctaaaaaaaccaaacagacatcctgacgtagcaagatgaaaaagccaaaaaaaaccatatgtacgctgtaagaacaatacggtctttaaaatagcatttcctatattctacataaaatttattactccacaaatatgtacggttaatataaaagtaccaaatcagctatctttaaatgctcatcttttaaattatttttcaaaaatatatctaacttataatcctttgtattttttaattaaataaaatactgatcacttataatagttatatggaactgctaaattcattacgacacatggtgccgacatataatagtccataaaacttcctacaaacgttcataagccgccacgtggcactttctaatctaaccgtcaattttcacttaaattggtgtacccgctattttaaaccattagattagatcagcttcatcaaaattatttaccagaatcaataacgtacatgttctcctaaaaaaaccaaacagacatccttacgtaaaaagataaaaaagccaaaaaaaaccatatgtacgctgtaagaacaatatggtctttaaaataggatttcccatattataaaataaaatttattactccacaaatatgcaccgttaaactagattattaatataaagtaccaaatcagctgtctttaagtgctcatcttttaaattatttttccaatatatatctaacttataatcctttatatttttttaattaaataaaatactaatcacttataatagttatatggaactgctaaattcatcacgacatatggtgccgacatataatatgtaatgtcataattatttttcaaataatttagctaacatataataattaatgtcatgatcatttttaaaataatttcacttggtgtcaaatttgcttgacaaatatataacactaattcatatctacatgaagaaaaagtgaaacaacattgtggtttacaattagatttgatttaattttaatttatgtgagattaagattatcttttcttaaaaaaatttagaactatttgattggaatttccaggcagagatcttgctataatacgaccccttaatccatcacgagaattatggtcatatatagtttttctttcgaaattggtttggtaacaaatgaacaatcatgtgcattaaactattcatcatatatgttttatcgtttagaaattctaatatatcgaacataattgatgatgtatgtcatacaccccactgaagtgactataagtgtactccaacaaattagttactttaaatgattttgggaaatatattcttagtaaagatgtcacatgtaactatgaacaatacatgatgaaaataaaccggacgctaaacaatatatcttagtcaaaatataaagaatgatatggtactcgaagattgtcacggtcatatgtcagtatagctatatttttttattaacctcgctcattttgaaagatagtattgtatctacacagtaaaaaaaataagcattaccgattaataccataaacaattttgtctacacaaaactttttaaaaaaatcattcgaaaaatattttcatcacctacattccctcttttttttccttaaagggcaccaagcatgctatgctagcacaagtatagcaagggtcatacatatggatgagttgaagccgccccagcagaagaccactattgacaataatgctttactttgtaattactgatgctattatctatgagggtgctgatagtgaactagaaattgaaattatgcttcatgctgatattgcagcgcatgactatgtcgacttagaacctatgtttaaaggtagtggagaaataaagcctcgacggatatggttggcttcacttattaaaggggacattcatatctgattttaactgtcgtcaaaattacaaaaaaaaaccttacaaattataagaaaaaaaacaaatgatcgtcggtttgcttaaattatttataaaaaataagaaaaataaagtccccaaacctcgtcctccccggcacatgcacacaacattgccggtccccttcaaccttggctcacgctctccgctctccattcctcccccttcctactttttagctatcaaaccacactatgaataatactgaaaagaccatatttttaagatatacctcgaatttccaatctaattgttgctatattaaataattaaaccaacaattccttatccataatgtcaatagggattgaattaaatcaattagagagaatctaataaatttgtaaaaaaaaattggaacgacaattgtatgttccattgccataaccatgtttagtattatgagtttctcatatattattgcatatataagacatactaaggcagcatgatgtagaagtacttagttggttaaaagagttatatatatgctactatcagctttaaatttaggactcacattgactaggtattgtttttaaaagaacactataaatgacatatataatagggaaacgaggcgtacaatatatatgtctcttatgtatttattgactcaaagaaaataacgaagatcattgataattgcttatagtaatgaattaaatattatatagttcaaatcttataaatatcttgtaaaaaattatctaagcaatatcgatgaagaaaatttataaagaaatagtactttaatttcaagcgtagcaggtgtcattcgattaatattctaccttacatgttactcaagcgtaatctactttacatgcccgcgcaaatgcgtgggctaccttcctagttaaattattaaatgtcgtgggctcctttaacctgttgttcgaatttcttttttatattccaatgtgcccttggatacaataaaccaatactagttcagtagaatgttgtccttcaattattgttttcaatgcaagttttagatacgaaaatgccagtcaagtttgtcgtaataaatgatttcataatcataaaattgtaaagattttcccctggtttatgcaacataattttgtgatggaagccgcagtaccgtatctttgttgattctgaaaggtaaacggcaactctctctttcttttggtgacaaaagattgtatgaatgaaatctctgatcagttaagcggatagtgtttcttcaaaaaaataaaagttaagcggatagtcttcgttgaaaaaaattttaaaaaaacatgaaacgaacgaactagtcaagcccatagcaatccgtagtgttaacttctccgaaagtcaattatgaaaaggctacgctcgtaggagccacgaagcctcctcctcttctcctggatttgcctttctttgggtccccgaatgtcgacgacctaaataattgaccaaaccatggcttcacctaaacacttttgaacaagcaagcgatcgatcgatttggaatggattgttcagccatccatctctcttggttttggtcctagtcgttgtactacagccgaaagtaacgagtagttctcttccctctcccttgcgtatgcacttacatatgtactctcttttactttctttttaggagaaaaaaaaagaagataaggcatttcgtcgttgaatctgtgcagtcatctcggattaaatttgacgaaatacatcgtcaatactatgtttggatatacacaaattgttgagtaaatctataagccaaagtttttctttaaataaatcaaacaataacatccggtcatgttgatgccaacgtttgtactccgtacacaaattggcatcaacatttagtcattatgctcggtacatttttacacatttgtactgtacggagtacaaatgtgtaaaaatgtgtcaaacatgctaatgttttagtgtacggagtataatgacgtcatattgatgccaatttgttatttatttttttaaaaaaatatataaaacaacatttttcaacacaaactcttgtctttttccttccgctccctccgtcctagaaaaacaagtattggatgtaacacattctaatactacaaatttagatatacttctgtacagatttattgtactaagatatgtcacatccagttctagaattttttttttatggaaggagtatatagtagtagagtttttttccccttgcaggctgtgtgcgtggtattgttctccatggacaaagtatttcaatttttaaaacgacttggcagagtgtgttttatttcatagtgtccacatggcaacttctgtgatacactacaaagcagtacgttgactgttttcagtcgactttccgtcaccgatcgcagctgtatattcgctcgatcggaataaaagggaactggaatcgaggttagttaggaccgggggtgttggccgacgaatctgcactactgatctccaatctccactgacttttgtcttaaactaatcctcttcgttctcctctcacggtcagcatcaaggctagctaagctaaaagctacagccatgttctgaggttgcaacatggcgatcaagctagctagctagctgcatctaaggagattattacgaccgatattagctagctaggcaaggcaaggaggaaagcaatgccggccggtgggtgggagctcaagggtcaatgtcaggaaataattggtgctcgagatcgagaggacgaacaaaatcgactaaacggggaggtttaacaggtgatgaagcaagatctcagtaggtgaaattagctgtttaagctatagtagctagctagctaggaacagcgtgggcgtgccgcgtgcatatgcgtgctgatccgatgaccaaagaaccaataatccgcgatgtgtgtgtggtagccatgcatatgcattgacatgtaagaatggtcaatagtcatctctaatagtcatccatgtctaactgaaaaaagggcggagctaagaaactatgacgccgagctgatgtgtttttgactttgtctatcaggggttgttcactttgtttctaaaattaacaatctaaacattgtcaaaatcttcactatcaaatctctcattcacgaaaactttataaaagtaacaaactaaatacaacctacacatctcaaccttggtaaggttgatttaggcatcaaagcataaacaaccccttattacattcgtcctaagatataagcatttttgattaaaaaaaatagactaggacatttctaactacgaatgtagacaatcacttgtttatatttttttttctatgcccacacataactacgaatgtagacaatcacttgtttttattttttttctatgcccacacatattaacaggaatttagtgagattagtaataaatttctgatttttgcctctcgaagcatgtattagggaacacatttctagggtaggggcgggtgtcgtgttacgtgtgtatttgtgtgtgtgcatatgatgtctcctgtataatgaagtactctttttttatatttcggaacggtggaagtaagatttttctcagtatgttgatcagattttatttttcagattaacttactggtttatatgtcgttaatcgagcatataaacatacactaattagtggcaagtgttacgttgtgatgtcaattagtaattaccaccttttttctatctcaatgagtccttttaggttgttgggttgatacttgtgttttttttaatcgaaattgaaaatgacttgtcagttgtaaccctcatagctgtgactacaccagcaattattccactcttttaaaagttggtagtttttctttattatgtatgttttataacccaatgtcatggcacatatacacacattacgtgtctggattgctggcttaatgcgtagtagatgttttctttgatttgtatatgacttttggttgcaacattcctgacaaaggactacactaacaagtaaaccacgcttttaggaaaaacaatttcatcttgtattttattcctttgtggactaatagacgacatgtctacattattgtcatttttctttgaaagtcaatatataatttgacaccttttccgcccaaagaataaatactactacaaaattttctcatttcggttgcgacctgaattaaattcccaatggatacaggccggaagcttcctgatctgcgataattaatcctcatcacgacatcgtagccagccgtctctgtacaaatattgatcagcaatgtcgtgagcaacttacgacctcgtcccttccgacaaactcttgtctttttccttccgctccctccgtcctagaaaaacaagtattggatgtaacacattctaatactacaaatttagatatacttctgtacagatttattgtactaagatatgtcacatccagttctagaattttttttttatggaaggagtatatagtagtagagtttttttccccttgcaggctgtgtgcgtggtattgttctccatggacaa

SEQ ID NO: 51920 - DNA, 2506 bp, Oryza sativa
catctctagtcatgctcgcatcaaattgggagataatgattctgatagttgtagcatgagcctcctatttgcagtgccctggtttggaaatgcggagttcgactgtaactgccaagacatgggaaatccagtcccctggaggaatggctgccggcggggaggcccatgccggcgcggtggagcagtaggaggttgactggaggtcggacgaggagttcaagaggttcatggggaacccgtccatcgaggccgccatggctccatcgagctggagaagaagcgcgccgaccggaagctccgcgagctcgatcgcgagcccgacgccaacccgctcgccggcctcctccgcggcctcgccagggactagcttgccgagaacaccgcggtcagcctccctgccattcccacctcacgcttgctctcggatctgcgcgtgcgggggtgacgtcgtctggtgtgcggttgtgctcgtcggcggcaggtgtggggggtgacgtcgtctggtgtgcagacgcaggagtgtaggtgggccttcacattgtggcgagggaactgaggatgacatgtgggtcccatcattttttattattatgtgtgcgaaactgacatgtgggtccaatgggttttattatttttctgaattaaattgccacgtaagcgccacgtcagatgaagaccgagtcaaattagctatgtaggcgccacgtcatccaaaaccgccatctaaaccgccgagggacctcatctgcaccggttttaataattaagggacccgttgtatctggtttttcggttgaaggacgaaaatcggattcgttgacaagttaaaggaccttagatgaacttattcctctacgttgtatacttgtacggaataagttcacctgccatccctcaattttacaccgactttgtatgatatcccttatcattaatatcagaaatcttcacccctaaactatataaaacaattcaatttaggtcccattacagtatagatacatgtttttgctgacgtggcatccatgtcatcaaaataaaaaagtatgtgggtcccacatgtaggtgaagcgagaaaaagatgtggggcccacctgttgggaccatcttcttagagagaggaaggccggctagagagagtgggggcgccagcggtagaaggggtagagggagggtgttgacaggagatggggagagaggcggacgacgcgacggcactggcggttggcacgacggcgctagcaggatagggagagagagaggcggatggcacgccagcggcttggagcgcctcatccagaagctccgctatcctccatcgacaagaccgccgccgtatgcgtcttcgtcgacttcatctaggtctcccccctccccgcctctgtcaaagctgccgaggaccaagccgcataactcgtcgccatgcgatagggtttcgccaaggcggtcgcccgtcgcctccactcctgagatgtgaagagttgcctccacctccacctccacccgccttagtcgcctcccgccgccgcgctttgcccaccgtcgcagtgaaggaaggtaggcctcctaacggcggtgaagggtgcgtttgcctatgagtccaactggaggacgtttgtggacgcaagccgccacttgggaagaggggggcgggcaccactggcacgcggatctagcagcccgctgctgcgcccgctttgcctgccgctgcacctgctcaagagaggagaagaaaaaaacaagaagaaaaatttctcacttacatgtgggacccacatattattttatttttattttgctgactaggctgccacgtcaataaatctatgcatctatattaccatgggacttaaattggacggtttgatatagtttaggggtgaagatttctggtattgagcataaggaatgtcaaacaaactcagtgtaaaagttgagggattgaaggtgaacttattcctacttgtacagaggcaaacgtgtacatgggctgtggacccaacgcgccaatacggcccatcgatattttcgcacgcgccgactacgaggcccgagggccgaagagagaagcgaagggggcagaggaagcaggagagccaaatccctcaccgcggccacaatatcgcggccctctctcctgctcgtctcgtctcccttcctcctcgtcttcggcggcggcgcggcggagatgttgtccggcgacatacccccgaaccagacggtctacctcaggaacctcaacgagaaggtcaagaaagaaggtacgcatcttctcccgggcggcgacccagcgcgcggccgcccgctggccaaaatccctcgtaaaaccctagccctcccgatctgggccgctgctcgctgtcgcctactcgcctcgttgtagggtttggtcatgtagcgtccggaggtttaggatgttggaggtgttttgattttttttttgttcccatagcagttgatgaaggggggcagtcggcgggcagatgttggagttgctccatgtttt

SEQ ID NO: 51921 - DNA, 3689 bp, Oryza sativa
ccggtatgtcgtggtggcatgtcagcgcacggtaacgtgtcgtggggctgtatcttgtgggtacagttgcacacctctgatcagagtaaaactattcgaatagccgtgcccacggttatggacggtcgaccagattcactgtgattagtctcaccctagttagctaatgaactggtgtagttcaggtggttggttgggcctgttgcaacgtgttgtagcgttggacagtgattggttaatattgattaattactaccctgttttactgctttcaactactgttgttaaatgctagctttatgcaaatgagcctttagcctcccttggatatatcctgcatcatacctcctcttccggtatgatttgctgagtacagtgggtagtactcagtcttgctctcttttccctcacaccagagttgaagttcttttcacttgaagatgtctcgaagaagtttgtttcgtcactgccatcaaggatgcctgtggagtgaaatcgccccgctgcaggaatcaagtcttcaggcttaactcgcttttatctttttctgctgcatttgtaatcttttatatttttgtaagacgtggatctgctatgtcaacaattgtcgtttgtgtatcctggctggtcctggacaagggtttaatgcacattcagcttagaaattttggttcgtgaatttctgggcatgacaggccgccgccgccgccgatttggaagggagagagagaatggggagaaaaaagagagaagggagagagagggaggagaaagaaaggatggagaaatgatgaaatgtgggccagtgggtcccacaataattttgggttgaatgacagatgagtcccatagatatttgttttaactctaatgccacgtaagcgccacgtggcatgaaaaccgggttagcaccgccacatcagcgccacgtcagcaaaaccactctccaataccgccggaggagtcaaatttgactggtttcactaattcgaggagtcgtcttacccggttttctagttaagggtcacgaattagattcggtgaacaattaagagagtctaagtggacttttgctcggtccgcgaagcccatatgagggaggaacacaccgcactacgagcgcaccatgcgtccacccgtcttgactaaacaaaacaagcaggcaccagcaccacctgcccggctagaaacgtctgccgattttgtccaagcggagaggagccgagctagacttgcaatctcacgcgtcgttccacacttccgcttttgttctgcccgcacagattgaccgcttaccacccccatcgatccatagctgtagctgtctccccggccatcccgggcaattacgaatccgacgactaattagcacggcatgatgccatgctggctgagagcaagctcaagagtatagttaactgacagcttcaaattatctatagttagcttaatagtcaattaatacaatagttacctataaatatatattacacaattaatatgtggttctacctatcatacatacttagagtctgtattgcagctgactataaatctgtatcccactgctattctcttttcttttttatcttattcaaatgtagcctctgctattatactgctctgatacatactttctgcttgtggttcagcgaatcgtaggcgagccggcgaaacgagcggcgactcgaccgacccgctgccttggccttgagttttcgctgtcccttttaccattttccctcggtggcaggctgcctgagaccatgccgtgcctgctgctccgacgactgggacgcgagagttggcacggatcaatgcattgacgtccagaaatgattccagtctagacgcagtacataggtgtggcgtgtagaacgagccgttggcgagtagtattagctgcagagaggtattagcgagtagtatgtacgattcgcttccaaatgaaacgaatcttacgaaaatacacggggtgtgtcctcagcgtttggtattggaataagttcattttagctctctggtttgcattgtcctggtttcagaagttgggagattagttgtatcttgtttttttttttacaagggtaggtgtgagtccttgtcggctttctggctggataattattgtaattttatctcacatctcgccggtgttgacactatggctgagtaatatacctccctttccccggaaaaaaaagaatgaaaatcagactaagtgaccaatgaagccacctaaagttgaaccgattttgctaaacatcacacgggtgattttttcgttgatatttgacagatttttgcccctacaattatgcgccgagatcagtacacgattctgcgtcgatgttgtcgtgaggtggagatgagacctcgtaggtcccacgtttgccgctgatcacgattcacaagaaatttacatcctagctacgtgtaaatatcctatatagctaaaataaaatataaaattacagtcctatttaactaaaattgtatatgtaaattcagttgatattaattacaatcctatttaactaaattcacatttgtaaattcagttgatttaacatgtaagtgcactgtaattttgataaaaatattgtgtaagtaaatatgtacttattattttctttaaaatataaaattacagtcctatataactaaaattacatttgtaaatttagttgatttgacatgtaagtgcactttaattttgataaaaataatgtgtaagtaaatatgtacttattattttctttaaaatataaaattacattcttatataactaaaattacatatgtaaatttagttgatatgacatgtaagtgcactgtattttttattaaaatattgtgtaagtaaatttgcattagttattttatttcaaatataaaattacagtcctatataactaaaattacatatgtaaatttagttgatatgacatgtaagtacactgtaattttgataaaaatgtcgtgtaagtaaatttgtattagttattttattttctagtatgttggacgtaaatccaagggaagaaaaaatctgggtgaacccgagtgatgcataggcggtccctgaacaaagtgaacttaattcttttgctatttcgcagggacaggctcatcttaattgggcctgcacattgttgagccggatgctaatggacggcccagcttataaacccaagaaacgggccaccaattttgctcgtgtgctgagctgaaaggcacacatgaattctcacatgaggcagcacagatgatcgcggtattgctgattgctaatccctccttgctttccggggagctgtctcggccatctccaatccaccggaattgagggggggaaaccaccaagggtcgccgcaaccgccacggcgcgtggcgagaggaacacgacgccgtccatcgtttagccccgcgggcacgcgcgtcctcgcgctcgactgcatgtatgaagccaaaacaactctcgccacttgtgccaaaaagccctgcgtcctacaggcacttagcccttgttttcctcctgcttctaggcacaaaagcacgaaatctgccgtcacctgagttcatccgtgcatactgcccctgatgcaactccccctgaccccctctataaattggctaagctactgctagtcgatagtacattgagcttgcgatctgatggactactg

SEQ ID NO: 51922 - DNA, 9267 bp, Oryza sativa
agttggtgtacttgtgcagggtggagaagcagggcacgtgagcggccatccagtgtagcttcggtgcgcgtccatggcggcgaacgcgcgtgatctggagtttggatggtcgttcatgtgtccgtcttctccaccgagcactggcatatccaagaccgagacagcgagactccgagagacattggtcgagcgagcgcgcgcggcaccgtatcctgcactgtctatgagttgacaacacagacagctgtgctttgactgtctatattcataacactgatctactacaagaaagtgtcatatcttatagtactatgttagtttattttaagatactgttacattttattttaaattggtatatctcatattaggttgatttattttgagagacgattacatcctattctggttggtttattttaggatagtactgtaataatatatcaatatctcatattaaattaatttattttaagactgttacataaaatttttgattgatttatttaagtacagagcgggtaagtaaacgtacacgttgccatgtcgttcacgtttgcaaccaaggcaacaactcgctacatggatcagctcatcagcccacggaaaagcggtgctgccgcgtgggctgctcgtgtagtaggcccagcccatgagtccaggaatcacccagccgtctctctccaaagcctctcaactccatcagcgaggcatccaccagcgagccctttcctaatccgacccgcgccgccgccacctcttcctccgctgcccaagagcgatggccgcctcccccgccgccggggccgcggccgccaccgtctcgtcgttcgtctcgccgtcgtccttctcctccgtcaagtaatccagtcatctccgcgcgcgcgcgcgctcgcgcttcgttgattgattcgttgtgctgtggttctcactctgtttgggcgtgattgtttacagggcatcgaagcccgaccgcctccgtccggcgaggagggcggcggccgtcaacgtccgatgcgtcagcagccctccggccaccgaaacttgtaccgtcctctccctttccctctccctctccctcctagcaactcatttatggttgctcccaaactgctcactgccgcttagtaggtttttgctatagtagttatcgttggaggtgtgcaatcgaatgcaatgagctcgatattgcctccgctgatgctatcacacgcagtttaggaacaaccagaaagttactgatactatcactagcactgtggtagtaagtttactgaaagattcagctttcgttttgaagctttcaagacgaaagtaccacgaaatgccaatatggccaagctgcaagctggctatctgtttcctgaggtttgttttgttccaaccatttcctctctcttctttccctccctgtcttcgttgatgctgttttattgaaattgcatgttgatattggttctttgccaactgtggagcagattgccaggagaagggcagctcacctgctgaagtttcctgatgcgaagattataagccttgggatcggtgacactacagagcccattccagacgtcataactaatgccatggcaaaggtacatcgttgctcttaatataataaacaccggttgtgtagcttcagatgatttatgttgcagtttgtcaagatcgtagttaaatttcttattgaaaaaagaagttcggcattgcatggcacacagttcttatggttcaatgtaaatgattttgtcagacaggctgtgcatcttcctaggagtaaactaagaaatcatcatcttcttttcttttttcttttttttttgcattttttgtattatagttattttttttcaaataaacattgatctttgatgggtctatttgtaaatgcagagagcacatgctttatccacagttgatggttatagtggttatggagctgaacagggtgaaaaggtatgcttatcactttactagcattttctgccaatacatcagcattcagttgacaagattgtacataactattttgcttcatatatgattttaaagtttgtgtagaatattctagaataattggagcaggatagatctttgtgctaatccatgaggttcagtaacaccttatggcatctgctggtgtggttcatcgaattagttttttgaactattaacttcttgcactaatagctgtcacaaagatcaaacatctgccacattttcttgatgagtggattcttacttttcttttactgccccattcaaatatattagtcttgacattgcatacatttcatatagcttcactatcataagccgtttatgttcatcattctgaaattatacattaattttctgcacagaaactaagggcagctattgctgcaacctactatgcggatcttggtattgaagaaacagatatattcgtctctgatggtgcaaaatgtgacatttctcgtctgcaggttctgaaataatcctatcctccctttcagtttatcattcatgctataatgtcccttacatttcttccaattttcaggtcctttttggatctaatgtgaagattgcagttcaagatccatcatatcctgtatgaaaattcttcacttgatgttaacccttcctagtgcatgattccattcttaaactgatgtttatggtcatgtgctccttttttttcatttctatcatactgcttcttattactaactattactttcacacttgtctgatgtgtattccaacatgtgtcccatttttataggcctatgttgattcaagtgttatcatggggcaaactggtttatatcaggagatgttcagaagtatggaaatattgagtacatgaaatgcagccctgaaaatgggtttttccctgatctgtcaagtgttccacgaacagatataatcgtcttttgttcacccaacaatcctactggtgctgctgcatctcgggaccaattaaccaaattagtcaaatttgcaaaggacaatggatccattatagtttatgattctgcttatgccatgtacatatcagatgacagcccaaaatctatctttgaaattcctggagcaaaggaggtaggctttgggatttaagcccttcctaccacatatggaaatttatggattttctgcaaatacttaaatccacacctgtcatgtgttttcttgtgtgtaggttgccattgaaacagcatctttctccaaatatgctggattcactggtgtgcgtttgggttggactgtggttcctaaggagctccttttctcagatgggcatcctgttgctaaagatttcaaccgcatagtctgcacttgcttcaatggtgcatcaaacatttctcaagccggtggtttaggttgtctatctccagagggtctaaaggtagcgtttcagagtttctgaaaatcttcatgtggctcttttggcaatgcttcatttcatctctttgttcctatgcaggccatgagtgacgttgtcggcttctacaaggaaaatactaaaattattgttgacacatttacatcacttggattcaacgtctacggtgccaagaatgctccatatgtgtgggtgcacttccctggccgtaattcttgggatgtcttcgccgaaattcttgagaaggcacatgtggttactactcctggtagcggatttgggcccggtggtgaaggcttcgtaagggtcagtgcatttgggcacagagagaacattattgaagctgcgagaagactgaagcagctgtacaaatgagcagtgatccggcctttatattctcaacctcttggggagccatatcaaataaaaccaagcagagttcgaagacaaaatttactctgtcgggctatcagtagatgttagaattgaaacctaatactttataggcagttgttctgttccgctcggtatttatccattcagagccattttacattctgaacttctcttgttgtttagccctgatgcacctgagtgaatcgcaagcttatttatctccttttgctaagttcgtttctactactctgcttaatttgctgctgccgtataaggctcagtgatatctccctggatgcattgaaacgttaggcacacttgagtcactggttgcaacaaaattaagagtagagaacattgctcagaccaattcagttttctactctcgtacaggaagaaggtacagtaatactctattttaccagactaccagagtaccagtgtagaaagtactatcaaatatgaattgtactcagctacctagatgcgagagaactcattggagaatgaactctattaaccgaaatctatgagcatggagagaagcaaatcgttgacttcttcaggtcaagaacttacacgatcttaatttactgaccatgtgatatgattcccccgaaatatcacatttcccagatctacagctgcaatagtgttcatacggcacgcgccaaaatctaccgagtttcacagtatcagtatcaggatgcagaaattcacagtatcactatcagcatgcagaaattctgccgaagaaatcccacagtgcacttaagtacttaacaaagctccacaacgacatatcatttactcttcgtatgtactttgatagagaaatactcttcgtatctatcaaactgtaaaactcactagaaaatagctaaatcttcagggggacgcttctgtgcaaactgcaaagacaagtacttatatgacatcagaaaaggttgcttacaacaagaattagaggcaggttaacatgacacaattgtgaatattgtcaacaacagtcatttttcgtaatggtgggatgctgacttgaataacagttacaagaatacatcacaaacaagtttacatcaatccacgaataaagatgacagctgacgaattgatgtattgcatcaggccctcttcaatgatttaaacaaacaatggataacgatgaacgctaggacgaaacaggaatatagaaactgaaaagtaggttacagccaagcacactttggagagctccgagcctctcatatgtgacaaactggatatcttgctacctaactaccactaatagcgagcagagaggccgacaaccatatccttctgaaggtaccaataagcacatgaaaaattcttttgagtaagacataaccaaaacacttgtgacaaaagaaaaatctaaaccattcattgaatatcaccggaagaatactattcatcgaataagaaatatgaaattctatagaaatatatagtggtgatcaattaacagagttcccttcactaactcaatttctagaagtgtaagacataaattatgccagcaataaacataccattgttctcctaaaatttcacattacaacatagatatccatcctttgatgtttgatcccaacccaaactcccttgtcaacccaagtctacaaaaagaacacctttttaagattttagacccaaaaggaactacaatgaacgaaataacgcgtggcattgtactctaattatcacttatcacgtagaagtagtcttcatggccttgaatgctgggtggagcaaccctagttcatccttgacatcaagtgggttgctagtctcattcctgatcctcttcaccttcctgctgccaagcgacttgtgtgtaaacccatacatttgcaagatctgattatccccaaaattgaaagcacgctccatctgcttgaggcacctctccacagggtaatccccaaacttcccacacggcttgcatccgacaaagtgagtgaccagtggccaccggtgatcaccaagtcctggatggtaattctcaagcatttcctcatacctatcaaccaagataccccaatatccatggaggtaatacccattctcaaggtacaccttgtcaccccatttctcacgctctgtagcaaggatgtataccatggccgactgatcatcagcctcaaacaccggccgatccttcaagtacttggtcaaaaccttcccggcctcaatacggacagggccctttggtcccattggtgcccatgtatcaaggaaatcaagcgaccattggcagttgcgcagcaagaagctgcctgtgttgaggccaatccagttcttgtcgtcgtagaccatctcatcccagccgtgcatgatgaggttgtaggggccgtaccgctcccatggcagctcgaatgccatgtcggagaacatggcgtcggagtccatccaccagaggaactcgatctccgggtgcgcgaggagcagcgcgcggaggagcgggagcttggcccagaatccggccatctcggcgtcgagcagcgccatgttgtagaagatctcgaggccgtggacgcggcagtagtccatcttgttcttgatggacttgaggaggtagtggtcgccgacggggttctcgcacggcttgggcgaggagcccgtgacgagcagcacccgcggcttgacgtcgttgacgaagggcggcgtctccgggtggcggcggtgccacgcggcccgctgctcgtcccagtcggagatcttggggcccagcgtgtagggcgggtcccggagcgtcctcggcggcgggtccggctcgtcgtcccgctgggccgcgcgcccggaggaggacgacgagccgccgcccctcgacagcgcgtcgtggtgctccgccagcgcgcggtgcgggtgcgagatgaagcggtggcggagctcgatgaggtcctgctgcggcgtgccgaacttgcccgccccgacggtgccgcggagcacgacgacggtgagcagcaggcacactacggtgagcttcgcgttcctcgcgaaccgctggatctcccgcatccgccgctcccccaccacccgctccgccacccacattttgccccctccctctcctgccccttcctccgatccccccacaccgatcaaacaaacaaataaacaaacaaaccctcctcccccaacccaaaagcagcaaatcaaaaatgcaggcaaggaatcaccggtataccgcgtctacggcgacggcggcggcgtcggcggcgcggagtggtggtggtggtggtggtggtggaggaagaagccgaggaggttttgaaccgcggagttggaggcgaattaataagagaaagggcgaggcggagtggtgccgcgacccgcgagcgagcgaagcgcgcacgttggcctcggagagcggattgcggtggctgtctgagcgatcgggaggcggaatggaaggggaaatctggggagacgcgaaatcggaatcgaaatcgaatcaaccccctgacccggccgctgcaaggaggaagaacgaggataaaaagaagaacgccgaaggggaaggtggtggtggtaaaaggggaggggaatagccagccaacgcgttgcaagatgcaatgcttctactcctttccccgctgtcgccgggtaatttgacttgatcctctcgcgtgggcgtatgaccggtggggccacccgcgtggggccctacgggttttgtatggtaattttctctggcttttttttttgctcggttataaacggggggttaattaaccagtggcggccagttgtaaccagcccaggggcaagcgacgtcgcgaggcgattgcacatgacgcggtgacttttctccaacgtttaaacacgcgtccccatcaacggccgtgccaccacctcgctcaaacgaagcgggctgttcctccgcgtcgctgacgggtgggccattgcgtcgacactgacccacctgtcagtggcgtggtactagtttcggcgatgtagctgccggaggtggagttgtcggttgaggagctaatcactggtgtgtgatggcgatggccataacgatgttttttttaaagattaaagtggacatcagggtatgtaagccaaattactcctctagaagcccagttattatgccttttccttttgtttagtttgggttggtaagtagcgccaaacagtagtagttttatttttcaaccatgtaacatcacattggaccaggtttctctcaaatataatgtactacgcatgtttacggttccgagatggccttccgtttcgggctatgacggaataacgtttttcgtgaaatccgatgaaaaaccggtagatttcgaccaaatttcgtaaacaaatatttgaatacaaatacctagagtttaccgataaacttatgaaaatcggtcggctttggtgaaattccgagtgaaatcatcgaaatttcaattggtaattagaaaaagaggtaactgaaattgttttccttttttaattcgttattctttttttcctactataaattccagtaaatacacggaacacattaattttttcaaaaaattatatcccaataggttctacgaatatcatactatttataagatttttttccttttctatcattcaaataggtctcagatggtttttaccttcgaagcctcgtcgaaatctcaaaattttgtgaaatgcaaccggttttcgtcaaaattgttaacctgggtactacgtgtactactgtactagtagtacagagatatggaacgcctcgaaaacagacttcaacaacagagacgctagaacgaggggcaagtaaccagtaatcactgccacttgaacgaattccgcacagggagatgcagatccgatctgacccagagaactcggtgttggagcgagagacagacagctgagagtgcgtgaattagcatgttcacgcactgatggatctctgagctgattccaaatttcagcactggtcttcttcatggacccttgatcagcggcgattattgtaaagcggccagtaccggtcgccgtcaacacgggaagctggggccagtgccgcccaagaacttgcacgtatctgaagccaaaccaattaataaattaagcaatcaaccaaactaaacccatttatttgccggccacttgctagaccacggcgtcgcctgcatccgcagcggtaaaactacacaaaaaagtgccggtggatccggcgctctccacttcactaccacctcggacctttccagccgatcgatacgatacctcccgtgctcctcctgctcgccaaatgctttcgcctgcgtgcgccgtatcattcatcgcgagcaccaaattaagcgcggcagaggcagcgccaacgcgtgtgccttttttttccgcggacgagccggccgtggaatcggcaagcaaacatgggcgcgtcgcgttgatacttgacctccttttgccgttcctttcggctcgagcttcctcaggacgac

SEQ ID NO: 51923 - DNA, 3458 bp, Oryza sativa
cagatctttgctgaaaacaaataaagattcttaacgaacactaaagatatactaaaccaagcacggtggtgaccacaaggaacacatatatttgttatcaaatgcgctaaatgggccctagtggtctagcagatcaaagccaatgtagcgagcacaaagcatttgggaccacggccctacgctgctcaacattgcacgaccaactgacctggaatcatcgaaaccacaccccactaaaaaatccccagtagaggaaaacaaatctatctcgtcttgatcagttgagctcccgacttcacgtcaaaaatgagtgcagatgatctcagccagctccctatcaacacaagagaatatgctgttaaatcactaggagttatcattagcatagtgcagactagcacagccacaaggtacacgccagctaaaacgaacctatccagcataataccaggcagagggaccaaccaactgggctatcagcttaaggaaaatgtcacatgagaaaatattcatggatttatttttggacgaattgttattgaaagcaacaaggccattcaatgcagatgtatatgacagagaagccgtgaattcagtgatcaccgcaaaatacacaagtctgaacccatactgctaatcagcaatagcgtccacacatgacaaatggaccaaaatgtaacaaaaatatacatttttactgcaagaattgctacttcagtagttttaggaaaatgtaaaagattgggcttcgtgcagtcagttctcactttctggaacatcctatcaccaaagtctatcatcatggtgcattagatgaaactaatcgcatttctgatacaatattttacagttcacagcgaacaaacagtaaacagaggaaacgcacaaacatgcaaatttgtccttgttcatgaattgctaagcctacattaagacttgaggaaaatacacagagtgattattagcgttcaacggagaaaacaaatggagatgttccgcacctgtaggccattacaaagcttactctgtgggggcaaataaaccataaacattatcatgaccttgtggttgttgtagggtataactgaacccatgcaaattcctccttgtagctgacattttgatcgcatgatcctttacatgtgtacacaacaattgttgcccaatcaagagagtctggctcatttttcacaccaaagtaataaagcagctgtggcattatctgcagtacaaattagtgtgatatgtaagcatgtctgtgtgaaaaagggggtgggtgcctgtttgccccttactgtcgtacaccttagggatggtaggtcttcactgtctaagtagaagaaataatttgaactgatgggatttgaaagaaaataccaaactcaacataaaggctgcagaagtatttgataatctcatttacagtactattttgagcagggtatgaattcccactaagccatggtttattggataccagcacaagccagtaataacaaagagccaccgtcgggtatatcttggctcagtctggcctggtatcacaactggttaacaggcagttgagctagcagccattaacttttgggtcttgactctaaaattgatgcattggtgtctgacaatatgcacagtatgtacccagcgaataattcatacagcaaagatataagggcaagatatttggcatgagggagtagggtttgcaaatttattacttgtgttgcaatgtgcaactggatataagtgtatacccactatatttcagtgacggaatttgccccagaaaaaaaaaagaccaacctgaaattcatagcatagtggacctctacagtagctacatgatgggatatcggcatttgatggacaaccagccgataacgcccatagaggtttggcattctcttctcgacagtatctgcataatgtaagcaagtttattcaaattcctgtaacataatattttgagaaaaaaatatgcaagggcactaaaaaaggctaattagaacattaactacacaatgctactattctgaccaggcaaaggctgatcagtataccaccaaatataaaaaagaatccaagcaactgatgcaatctcacctcaatacttgctttggtgctcttgagacccgctcttgaaaagacgcccagcatttgttgtcagcatcagcctacaaaaataatagtggttaacaaaaacaaagatgaacagataagaaaaaaaaaagaaaagagagagagagaggatgtagggttaaaacctcaaattgatccatccatgactgcatcatatcatctggtttaccaggtctttgcatcaccaaggactttgagttactctcatcacaactgtcagaattgaaagcaccctcatagtcgattgcaatctcatattctggccaagatttgctagcaggaactgcaaagagatgaaactataaaaaagagatatgattcaatgtttacaagcttatcaagcactcaaatacaatcaccttttcctacagcaggaaaaatagagcttgaagcttcagaagaactgattaactgtaggcaatcactcttatggccagagcgccagtgcagtgtctgacaaatagaaaaaaaatagttcaacaaagcatgctttagggcatatatagattaacgattagcgggaaaatgacttataaatacctgatgcttctcagagcagtagcgtgctttcttgcagctactacagagtttatcacctttccatgtaccgcaccaatggcagacaggagctgacagcatagttgaataattgaaagaaatctatattatttgactatcaattaaaacaaagagttcaaccatgaaaaatggccacctattaataaaagttaaaacagtttaacaaggctgaaaaagaaaaatgttgcctatgaaagcatgtcacacaagaaaattcagcaactagcataacacataaatcttacacagggtctctgcaaatgaacagaatgattatctagaccaaaaaaaagctgggaaaaacagaagaaatgcttattaactttagaacataatgtaggcagtacctgacatgctgagaaaagtttttgcaacagtagaaaaaataatgaggatgaagctttaagaatttatcacatggaagattcgatcaagtcacaagtcattatcaatcagatatttatacaacagctagataagtgaggaccgatgatccatacacataatgcaggaaacacatcattttgatacttagaatcattaagaaaaagaccaaacatggaaaggaatgccaagctgccatccaaagaagaaaagaaaactacctcctggacatagtggcttgtcagaatcattgtgctttggtggttcacttgagtagaaggcattactacggggaagctggcaccggaaaaccttcacgctgtaacccacagcagtcaaaatcagcacaacaatag

SEQ ID NO: 51924 - DNA, 934 bp, Oryza sativa
ggggcaaaaatgcgtgcgtgttcggcgactcgcacttgggagtcgagacgggggaaatggtttgggcgaaaaaccctagctagcctcctctcgggaatctcagccgtccgatgcgggggctacaaaacgaaaccgaccgacagacaccgaccgagcaaaacctttcgccgcgcagccacctaaacccctctcctcccccttcctctcccgccgccgccgcgcgcgcgagccggcggccatggcgcccgcggccgccaccatccgcgacctgctcacctccttcagccccgccgcggacttcctcgccctctcctctggcgacggccgcatcaaggcatggagctcgaagctttccgcccgcccatcctccaaaccgccgggagctgcacggttactgatgatgccatgggctaactcgatcctttccacctccattgcaggtatgggacgccgtgcgcggccaccttcagaccgagttcgctgatatcccgccggtggaggtgggcggcggcgcgcgcgcccccggggcgaagcgcggtcacctcgcactggactacacctgcatgaagtgggtacagctatcgagcaaggtgagcattgcccccgaattttcgagcttctacggttggtgttgtggtaccgtgtgcctatcgtgtgctcgtgtttttgccttgcagaagaagcggaaggcagggagttcgctgctggtgcttggcactggcagtggagatgtccttgcacttgatgtcgccgcagggcagtggaagtggagggtcactgattgccaccctgggtacgtttggtgcttccatgggaactcgtggcttcatttgttaaactatactccaagctcattgaacccttgattgtcgctttgaacatgtttggaatttctatgttaatctccgcaagctttagctagatgtgttctctt

SEQ ID NO: 51925 - DNA, 2052 bp, Oryza sativa
atgctaatttacccaacaagaaggtttgtgagaactgaatttcagtcaaatgttctgtacttccaccatataactgtttgcatgtttacacattacagtatatatacaactgatgaaacctgatgcattgatatggttcaacagattcgagcacatctaagatccttgaagcctggagatgcttgcgaacttttagaaaaattagtatcttcatggaaaacaaggtgtccatgactcttttcccatgtttgttcccccacaacgcattttcattcgtttttatccttgtatgcttaccaattgctgatttattctctacagatctggtagtgcagaggttgttttgcggtggatatactgcttattaattatccatggtcgttttatcccctttgagaaatctaaaaaaataattagcgaccttgagaaggtatcatatgtgttaccagtactatctcttgtgtgctatgcagattatttgaaacatgttactgttgtggttgtcatcatgccccccccccctggagcttggggggttaagctattagcaactattgccttaaatgactgcagaatgtggataacatattctgattctaatttaaagaccaccaatgcaggcagggtatttcagaatatagtttcgtgacctatttttctgataaaagtacaagtaacaatgatggcaagaactcacctttgatgagaacttgccaagtcacaatctgagccatttgatccactctagtggatgctaatgtagttgttttcccatgagagttctcaagtcgtcattgaacaatggattcccattttagatatctcctgacaactcaaacaatgttgtattgacacttcataacatcaattaaaaagtcatgtgcagtattgagcaaagacatagaaagttaaagaaataagcatgctgtgtatctagattgggaagatgtcatgctatgcagtgctagtaaattatagatatctttattttatgtaccatgactgatttgatcaagttgcccccaccaatgctggccaatttctgttatgtcaaatctggggttgtcaatttggctgcccaaacttataataaatttactaaagtatattgcatgcccagtatttacaaatgaaacacttcccaatttcaacaacatggtcagattttgatcaatattacttggaaaaaaactgagactataactgtgtgtttactacgtcaagaaaaagaactgaaaattcaaaggtcgaactgaaccaccgcaactatgagcttaccatgtcttaccatgtcgaacatacaaaacaaaaaattgaaatgaaccattacagctatgtgtttttcttcttttttcttcttcggggaattgcaactatgagtttaccatgcgaaacaaacaaaaccaaagttgaagagattgaaagaaaccatttttcgtttgcagatgtgtggggaaagatacaaagcagctgaagatttactgaagctttctggtcgtcttcgattgctcatggctcaggttttaaccattaataatactgcgtaatgagtcaatattcttagtgtataagttaatgatgatttaatgatcatgtgcgtacttcacttttgtagatcgtcaaggatccaaacgatgtttctgagcttccatcagaggagatgcaggattcagcggctgctcagtctgatgaagaggaggaagatgatgaaattgatgaaacggtgtatggtgaagacgctgattcgtctcaaacaagtgatgacgacgctgaatagaaacactgagactaagcgtagcattcttatgatgtgttgttttatattcaaacttgattaccccgtagtcaggtttgtatgactaagcaaccccgaagggttgcgcagaattttgacgaggcgaagcatcctctgaatttcacctcggtgtttctcccctgccttcaccttttaccacaacacggcattaagaccgagctaaagctcatatgccgtggttaactacttgatgggttctctcaagtgttaatgcctgcttttttatcacaccaacc

SEQ ID NO: 51926 - DNA, 3734 bp, Oryza sativa
ataccgccgtccactaagctcaatattccatcatccccgagatgcacttgatagtgcggtggcaaggggtgtgtggtttcaactatgacgtccgtcccgtgttcaatccccaacacgttcataattacattcacctgctgttctttctgcagccatgccattcagccacatgaaggagaggctggagttcctggacgtggacaagtgcgagtgcaagtcgacgctggtggagggcggcggcatcgcaaggcgatcgagacggcgacgtcgcacatcaaggtggagccggcggcgaacggcgggagcgtcgtgaaggtggagtccacgtacaagctcctccccggagtggaggtgaaggacgagatcaccaaggctaaggagtccctcaccggcatcttcaagaccgccgaggcctacctcatcgccaacccggacgcttacaactaaatcgtcatcatgcctatgcccccaaaatatgtttgataatatttgatctttgcgagtgtgtatgatcgaaataaagctgcttccaagcagtgattgagaagtgagcagcgagaagcttggtgtgtggtttggttgctgtcggagaatggttttgtttgacatgatgctgtcaacaccggctatgttatgtatctatctagcatctacctgttggttttgcgtgggaataaaaacatactataaaagataatgagctcggaagctactatctgtgaactgtgaagtactctgctttggaagatatcagctcactgtcttctgcttcctcatagaaagtttcactgaacatgattacatttcactccttttcaatgaggattagatagcatatcagtaatcagtctggtgaggccgtcgaaaattgatttttgtatcaataactattggttgccaccatttctacctatcatgtagtactacactagggaggtggatttttttcccccggagaaaggatgtccctctcattttaatgttttaataagatagataaatatgtgagatatcagtacataaatatgtaagtatagatcatttcccaaaccttaatgaaattggatgaccttccttcagctgtcccggaaaaaaaaatcaaagtagaaaaattaataaatttggctatgtagcgtaagttgaatttaaacttacccctttatatagtgatatatcatatatttttctttcttgttattttttttaaaaaatatgatttagatggcatgcaaatacagacgagaagaaataaaccttccttactagttactactctatcttttaaaattctaatagtatactgctgtactagttactagttagaaggaaaaatcgtttttcatactgatacaagatacaaatgatgtttccttgtcgtctaatccatttattgcattcaaattaactttcaaaattattttgcagcacattctaaattattttgcatgtctaaattaaccagagcaaattttataaaaattatgattgttttgtgtgtgttgttggatttagggtagtatgcttgtttgtttggcctgcggcctgagtccgggacatttaactatttgcaattcataatccctcatgtatctataatatgtgagtatagtaacaaatttttaattacccattcaaaagtgacaaatagttaattattcccatgagtccctgttgagagttgtgtgcggtgttaccgtgttcgaaagctggagtccccaacgctttgtatcgaaccaaaccttacgctttcagtaaaaagctgggctctctgggcctttctctaaaaaaaactatgattgtatttgttaattaccggttagcacaatttaaacaagtcatttaaaaatttataacaatagctgatgattttagaaaactacaacttaattcattttgtagaactaaatttaccatagttagttaacgtatattcacaatcaactttgttttttcattgtgatatgtaaaagttggattttatgttacatgtttgtagagaaatatatcacatgttaatatatcatctcaatgtttaaactattttaaatggcatgcaaacaacggtaacgttcccttcagagttaaaatccactccccttggcagctagtacaacttgcagtttgcaagttcatctcctgcattaaaactagcaaaagtttgagtacgtttcagaaacagaagaagtaaaactctgtcaaaccttatctattagtttcaccatttgtcgatcagtaaaaacaataatcgattcgtaacaacccgtacaacacgtaaatataattaagtagtactagtatatgcaatgtactacgcgtacgcaaattctatggagaaaagaatgcatttctatggattagagtacagcagagaacgctatagagatcacaggagttgacgacgacagcaacatgatgcaaacaattacccgctagcatatatataggccgacgagacgacgcacgatggatcagtgtatcctccctgactgctcctgcggcaacaggccggggatgaacggcacgccgaactttgggagccacgtctgtccctggatgaacctctcgacggtgtacttctgctgcgcctgctggtacgtgaccgtcttgacccctctccacttggcgcgcttgctcatgtcggcgccgtcgccgcggttctccacctcggcgtagtagcaggtgttgaggccgaagtcgccgagccacggcagccacccctgcgggtcgatgaacccgccgatgtcggactggatgtagagcgtccgcgagtactccttccacgggcggccgaggaacgtcttgaacttggcggcgtcggccttgaagtcctcgtgcggctcgatggtgcagttgtggatcaccgtgccgcccgcggagtgcttctccttgcgcccctgcgccgtcacgatgttctgctggttgtccatgcaccggcgcacctggatccggcagttctggagcaccacctgcgcgttgccgaagatgaagtcgatggtgccggtgatggtgcagtcgcggtagtactgcctgctggtgtgggtgtagagcgtgtcctggtgcccgtcgactggcactcgtagaacgccgactggtcgctctgcacgcggagcgccaccgcctggtggttcttggacccggccgtgttctccacgccgatgccgcgcatgaagaacccgttgccgatcgcctccatggtggccgtgtccttggtggtgatgttgagcatgaagctcttgttccccgtgatgatggtcttggtggcgccgtcgccgatcatcaccaggttcgtcacgttgcgcgccaccgacacgtactccttgtacgtcccggccttcacgtacatcacgtacgtccccgtgctcttgaccggcaccttggccagcgcctcattgatggtcttgaagtcgccgctgccgtccgccgccaccgtcacgtccggcttgaactccttggagcccggggtcgcctccagcagccggcgcttcgcgttggacatccacacgggcacgccgtcgtcgccgagcagccggcggctgaatccggtgatgtccaggttcgccagcgtgtcggcgaactggtccacgatggcgaggatgttctccgtcagctcctgcgagctcttgagcgccttgcgcatcttctccgacgcctccgtcgacgtagagttctcgaacccgtcgaggcacgtctcctggtacgtcagcgccgagctgagccacgtcttgacgtcgtcc

SEQ ID NO: 51927 - DNA, 4669 bp, Oryza sativa
gcggcggtggcatctcttatacgagcccgcgctaacttggacatggcgaaaaacgacggtggttgcgcatgggctcggaggtcgccacaggccgaggtgaatggagagccacacgacggatgccgccagtttgtttttgctttgctcgtggggattttctagttgcatgcaggcaaccatctgaaattttgttgtgctatcggctctgaaattttgttgtgccgtactgccgtcggccactaccaagggtgaagctcctggagctgctattggtggagctgcatgtaggcgccatgttgaatgaaggccacgccaatgtgtccgataatgcttatgcacgggtgcccgatgagagagaaaaatatccggcgctcgcacgtctcattccacgtcacttggctccccacacctcgctcggctcgcctcctctcccccgttcggcgccgcctcctctcccacgagctctctcgcttgcgccgccgtctctccccagccgacctcacccgcacagtctcctctcccgtcaatctcgccagcgtcgttttctccgttggatctgccgccgctttttgtcttcctggacgttgacggcggcttcgtccccgtggtggcggccgacgcggaggacgacacacgtgcggtgaggtgatggcggcggcggtggtggtgtaggctcgccggctccctctctcccccaggagcactctctcctcatctccgccgccctcccccttctcctcctacagatccgatgatgggagtggtggagaagacctacgcgagcaagcctgtgttcatcggagagaaggaagatgcagtccatactaggttctgtgtgtttttttttctgtgtttcaagctagtatactcgtgatgttcttttgtgtttggatcaaatgtcagtggatatttcgatagtgttctatatttctattttcgacacacaggttttgttgatgtttcaatggttcaaaaacaatgtttcagttagtgtacttgtgatgtttctttgtgtgtgtgtatcaaatgtttgaagtggattttagatagtgtttaatattttcaaatacacggggtttgttttgatgtatacaaggtttaagtgtttcaatgacttaaatcgtttattgtatatattgaattaaattgtttcatctaactatctcactatgtttcacttttttttaagaactgtaacattttttttctaagtgctgaaacatctattatataattaaaggaatagaaaaaggagcctccacgttcgctctcatggcctagaaattctcacattaatcggagaaaaagaaaaaacagagtccatatagaaatacaatttacaaatagctgaaattcggaattaaaaataaggaatattagaagaggggactagagtccatatagaaatacaatttacaaatagctgaaattcggaattaaaaaataaggaatattagaagaggagactagagtccatatagaaatacaattagaaaatacctgaaattcggaattaaaaataagaaatattagaagtagagtatagactccatatagaaatacaattaggaaataactgaaattcggaattaaaaataaggaatattagaagtagactatataatccatatagaaatacaattaggaaaaaatagaaattcagaattaaatatataatttaaggaatagaaaaaggagcctccacgttcgctctcatggcctagaaattctcacattaatcggagaaaaagaaaatacagagtccatatagaaatacaatttaaaaatagctgaaattcggaattaaaaataagaaatattagaagaggagactagagtccatatagaaatacaatttacaaagaaatttggaattaaatatataattaaaggaatagaaaaaggaacctccaagttcgctctcatggcctagaaattctcacattaatcggagaaaaagaaaagacagagtccatatagaaatacaatttaaaaatagctgaaattcggaattaaaaaataaggaatattagaagaggagactagagtccatatagaaatacaatttagaaatagttgaaattcagaattaaaaaaaggaatattagaagaggagactagaatctgtctatatagaaatacaattaggaaataactgaaattcggaatgaaaaaaaggaatattagaagaggagactagagtccatatagaaatacaattaggaaataactgaaattcagaattaaaaaaaaagaaatattagaagtagagtatagagttcatatagaaatacaattaggaaataactgaaattcggaattaaaaataaggaatattagaagtagagtatagagtacatatagaaatacaattaggaaataatataaattcggaattaaaaataaggaatattagaagtaaagtatagagtatatatagaaatacaatttagaaaaaaaaatagaaattcggaattaaaaaaataaggaatattagaagtagagtatagagtccatataggaatttaaaactaactaaaatttggaataaacataataaaattaaaagtagagtttagagtctgtataaaaatacaatttacaaataactaaaattcaaaattaagaaaaacattggaagaagaatttaaggtcaatataggaatacaaatattggaatataatttagaagcaactgaaattcgaaattaaaaattaaagaatattgaaagatgagtttagagtccacatagaaatacaattagaaataataaaaattcataaataaaaatgaattaaaaaaagaaatattaaaagacgagtctagagtccatataggaatatatataatttacaaataactaaaatttgatattaaaaataattaataactaacacgtatataaaatataatataaatattacacattagtagttttgtaaagttattgtaaaatttaaaattatgttgtcattttaatatatttgaataatataatgagaaaacatatatgctattatatgagagaaaatataatgatgcagccgcgcatctgcgcgggccactatgcttgttatttttataaagggtgaaacaatgtccaattttaaatcgggcgtccgaatttgtagacggctaggcgcctcccagtacgttgcgtaggatgaaaccatcgttcaggccggttaggaggcaaaacgaatcggtttggtagttgagggatacatatcagactcgtcttattccatatttttactagtatggggtgggagtggaagaactcgaaaggcccataactcagggactagctagtagaacaaggaggaaaggaggccacctttttactcagccttactgttgaagtgtcgatgaaaaactgaaaacatagataagtccagcaagcaagtggttagcctcttaaaacgtgtcgacgatgatgtatcacgtcacgtacgttctcgtgcagatcaaaaggggaggctagcatacacggcctcggcctgtacaagttgtactctacggagacagcgacctcagccctccgagacgcaaaatgggacgggtcaattcacccaaaagttggaatacttggggaaatgtcaagggctgtgctctcttaaaaaaaaaccatcaataagcttaaagccaacggatcgattatacgtcaagcatcacgtaagtttgatggtacttcctccgtttcacaatatcattctaacattatatatatatatatatatattgatgttaataaattttagatataacatcaatataaatgtgaaaaatattagaattacttatattgtgatacggacagagtagtaacaaaggtgaacgtctgattacggcttccctgccgcattaccaaaatggaagagagtggcgccaaaacacgacaccagcttgcttaattatactactaactcccaaaagattaaagaaatagagggaaaaaaatcgaccggtagattgccggattgttatctgacaaatctcccaacgggagatattttactcccgtgtacggatacttcgagtagcaccaccgctgtgtgcacctctcaataaacaatacccatgacatgcagggagggagccgaaagaatgtcccagtactcgtacaagaaacatctcgactcactctgtcctttttttccccttttccaaaacgaaatcgagagggggaaacacatccacccgcaagatttttttcgatggaccaccagatggcctcttttccaaactgctacagtactaaactacgtctacaaacaatctgccatgcacgagatgccccggctcgcatgatcgcccccccgaccggccattccggattcccatctctccggagccagcaaaaatcgccgaaaaaatcctctggtccaggcgacccggcaggcccagcagcaaccgcaactttgctcgccggaaaaggcgcccggcccaccagccacgagcggggcaatcccacgacaccaccacacaagcgcgatcgtgcgatcgtccaatccaacggcgtcttgttagcgagcgttgaaggcggcagcggcgtatcgttttcggtcgtacggctgcaaaagagcactccagaacacctccagtgcacatccatcgcccacacgatcttgacgcgcgcgcgcgcgcacaaaacacacaaaaataaac

SEQ ID NO: 51928 - DNA, 2867 bp, Oryza sativa
catctcctgcatgaaatcggagaaatcctgccgtcgaaaaacagggcagaattttaataaagaatattatatactaatatattttattgcactattagccccaaatttttttttaaaaaagaatgataatattggttgctacgcaagaaaaaaataatcgagtttcacctggtcgtcgtcgtcgaggggatcgaacagcccggcgtcgtacatggctcgcttccccttgtcggacagaactgcagcaaccgcgcaaaaaaggatttcgttcgatcatacacgtagcgagcgcaaactgggggcggccgagcgggtgagccttaccggagtacgcctcttggatccgctggaaccgccgattggcctcgccggggtcgctcacgcaccggtccgggtgccacttctgcgcgcgcaaaaaaaaggatccaattcacaacacaatccatcacctacgcgcgccggcgcgggcgcgggcgcgggcgcggccgacgggggagaagagagcggaggcgggggacgtaccatggcgagcctccggtaggcggcgcgcacgtcggtggcggacgcgttcttccggatgccgagcagggagtagtagcagcacgcggacgcgccggcgccggcgccaccggaggcattgccggatccggcggaggcgtccatgggggtgcggtggcgggggcggcgagcgaatccgcgcggcgaggagggcggggcgatgcgaattgctaccgcggctgcatcgaattgggagggagaggggagaggagatgggtttgaagggcgcttggaaaaagaaaaaaaaaggttattattccgcgaggaggagacggatgcgtgggaaaatatctaaatagagtttttggtcgtcgggggttggggccaggtgaaggttcgagagctcgtgccgatgcgagatattttcgacgcccgtttcgggcttcgccctcggggttcgcgagtatttacgagtttgggattctctctcgcggcgcgtctgccttctagagccgtgaattacgctgcgtgggctttgaagatttgggctcgtcggggcattaggcccattttccctcggttcaggccttcaggataaaattggttgtgggcctttgctaccagctgaggctcattttgaaagaggatatataaaggactttttaaattaaaaaatggatcttaaaggatatttttttttcctaaatagttctttggaacaaaggatttgataccattgaattttatgagtttcctttggaataggtccaaagttagcatgaagttcaacctcttggaaagtctcttttcatccaattcgtatgttttcattcggtccgtccaaatggtttcccttatgttttgctttttttttttgtataggcattcttgccaacatcatgtgttttaccatcgttgtgtgattgtgtctgtgatagctaacagttacgaacaccatgattcttttaagaaaaaaaatcatgtgttataccatccctattgtttcaaagagggttaaatagctcgcagttctacataaaagtatggtgaaacaacttgtaatgaaaagcattcccaataagcatgatcaacaggcctgggaagcatgatagagatctgcaagttaagagtagtatgataattcaatgagctatgcctggctaggcatggttgaaaaaaaatcctatgtgtttggaatgatacaggcggcagggaaaagagtacaactaagaaaataatacgtactgagaggattagttccatactcagtacgtacttgtatggaataaattagcctcaatctccatgtgagggtttaaccgaaagaccttacagtctttacagtcttacatatgctaacccgcgaaacaatgtccacttacatcccaagttcagagtacaagcaaaaatatccaaatctgaaccagaacacttgattaatccacagaacataaggtgtgagaatcttcacaatgtgggaagatcacatatccaactccagaatagatggaacagaatttatatcacatctcctattcactgttacagttaattactccataaccattgtaaactgtgaatgacatcgatattcaatgtcagtcatcaaactcccatgaccattgcaaacagcccaccttcctccagcgatattcaatgtcagttatcaagtggagtacttgtagaacaatatacttcatccgtcctaaaaataaacgaatctatagatatgatgtgatattttataatataacaaattttaagatatctttgtacaaatttgttgtactagaaaatataacatcatatttaagattaatttattttgggacgaagggagtacaccgttgaatattttcaaaccaaaataacgaaatgcgtgagagttgatagtaaatatagtttgaagctaagcctcttgcagtgaattgtaccaaaattatcacaagaaaaattagccagccacatggggaaccagctactcctacaacagtaggaaggattgatacattattcaggcattaggctccggacacctaggatcataattcctccgaaattgaagaaatccatctctaaacaattaaatcggaacagcacaatcatcaagttacgcaatattcggacctgcatatagcattcgaagattattagaaagcaagggaactattaagcatggtttgattttgaccgaaacatcagagaaccagatgatctttgacagtttcacggaagtaggcactgccccgctcaaaggaacatttttttttaagataaccggcatctacacccaaaggatgtgcacagctcaaaggaacatgcatgaaaataaacatagaatatataagatccgacctgcctaagataat

SEQ ID NO: 51929 - DNA, 2921 bp, Oryza sativa
cactactcccacagttcaccggagcaaatcgacagaggccggcatctcattctttatacgggtccctctgagctctctgcatttccaagttatacaacgcctcttgcaccagagccgattgggcagcagcatccacggtagcaggagtttgctgccacatcctatctctgatctcttctcgcaggcctcttatgaataatgccacgtcgaagcagttgctggagactggatcgaacagcttggcatggtacaagcgctcctcgaactggtctctgtactcgctcactgtcatgatcccctcctgcctcagatccaagagtgccgtgagcttctgcttgtgatcatagggcccaaatctctcctccacggcctcacagaaccgaccccaatcacgctcatggcgcttctcataggtcatcatccacagctcagccatcccctccatgtgcatcgaagcccaggaaacccacatcttcattggcatgccgtagaactcgaagtagcgcgtgcacttggtgatccacaggcgcgggaacgtcccgctgaaagtggggaacttcagcttcgccagacgaaagaaccctcccgagtagccgtcgatcctggcggcgcgcgacgccgccgccgccgcctgctccttcttcacgtcctccaccagcgccgccgcaacggcgatctgcttggacagctcctcgaggcgatgttggtgcccctcgaccacctggctgagcaagggcagcgccttcagctgctccgcgatgcggtccagcttcgcctccatcttgccgtcggggagaaccgtaggttgctgcggcccagaaatttcgagacaaatcaggtccgatgaggtcggaggcgtccgcgaacgagacaaataattaggttttcaaagatcaaataaaccatgaagaagacgaataaataaagaacactaaaagagaaaaagaaaatcatggcgcgggtcgagaaggggtggttgctacgacctcaccttggccttcgttcgatcgtctcgtctcgtcggcgtcgccggttgcgctgcaacctgctgcggcggagcacgcggaagcggtgggcacttctccatctcctcggggagaggcgccagcttaagatggtgtttggttgttggggataaaatggagctaaattttagtccctcttaaaaaaatataagtccctattatagggacttataattttcccaaacagcccctaagtgcttccttctctactaagctgggccaagagaataggcccatgaagattagggctttctatccttctactgtactttttttttccaaattagatttcttttctggttttacaggcttcctatatattttaggctgcctatattttaagggtagagaattacaaagttgacaaatacttatacaattatcctcaccaataatgttattgctaatatgttttggtcttacttccttcgataataaatctttgacgttgatgataaattttgaattggaaatcttattatgttgcgttcgatattttgcacaaatttatcaaactaataaaataactaggggattttcccttaaaattttgtgcaagtatatataattgaaatataattatggatacagtatttgtaatttctactccagcggtccctaagtcaagatgcatggccaaaaataaggtgttttagggggggtggaggtagtacaatagtagatttacaaagtaaatttgaatcatatacaactcctatacaactcctagcacaccggcgagctggcgcccggctagtggccaaaacgacccggtgtgctagcggccaaaaatccaataatcttataaattcaatatcttcccaaccgtaaatccgtttgactccgttcaacttccaaaattcctcaaatctcgagatctatctaatggcacgcttagaggtcattaatagggctttattttcgccgtttgttgagttgtcccattttgcgtgtagtttcggagcccgaagacccgcagtgcgaggatttcgaggatcaagctcaagatctcgagcgaggcaagccacctttgaatatcttgagcctatatttgaacttaattatgttgcttgaaaaatattatgcattgataggatcacacttaatctgcttgtcccgtctgcaaggcagattggaggacctacctatttgttgcatttgatccttcctctgttaattgttataccatgtttccttgtaaccacctagtcacgcctcggaaatcgtgcactctgcacaagtatcgacggtcgccttcaaacctaaaatctgagtaacttcttgggtaaaacttgggttttacaaaagacttggaaaacccgacacctgggtcggtgcttgtgaactaaatgaatttccaaaaccgcggaccggggaacgtaccgggtgtacggtttcccgctcttgcacttaaggaccgtttccttggaatttcatccgaacttaagacaagtacgaccacatgggtggaatgggacacccctggctgagtaactagcttatcaggggagccttgatgccgagagacatgtggattcgccggggtggtgtcggggaggacccccgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgatccgggttagtaatatcgtgtgggtaaagtgtaccccctctgcggaggtgaacaaactgttcgaacagccgtgcccacggtcatgggcggatgtgaggtgattcctagcgtagttttgtttgactactgccttatgaaattgctgttgtggaaaggggatcgatgtttggaaaatctg

SEQ ID NO: 51930 - DNA, 1053 bp, Oryza sativa
attcctgcattcctgaatgttgctttggcacatgcccatgaatatgtgttaaaacaatcatgtgagttgtgggatgtaaagtgtgaccttttatatgtgcctaataaaaatatatatttttttcagttttttggcaccagctggtgcactcctatagggttttcctacaagtgtccactcctgttttttatttgctcaggtcagtctagttcacaccgtttgattgagagatttaaaagctgatagagttggagttagaactctgttaatcaggcactaaaagaatacttaatttaatttagtcgctcgttgtcgccggatctcacacacgatgaccagaattaaacatcacccgcgagacgcgacaaagctcatagcatgtagcaccaggtggtaattaggccctgtttttttcagcttgggattatcataatccagattattagaagtaagctgaaagaaacagacaacttattgaagtagcttattataatctggagcccagcttattataatctgataagctcatttaggtgagctttttctagactattgggtgaaaaattacccaccatgccaccccacttcctctttagatttgcaaacccaataatctaggctataataatctaggaaagaaacaactaaccacttattctactacatattataacaatctagcttatagtaacctgattcaataatctagattataataattccaagctgaaagaaacagggccttaatcacctaaaccaccacgtttttggagtataaatgattacggcgtccaaaacccaactactccggtgcatgaatcacgcctccgagcgccccgcaagtacagccaatcaatcaacaacgagaaagcactcgtactatatactccatccgtttctaaatactaaatatttgacatcgttaactttttagcatatatttaaccgctcatcttattataataaaatttatgaaacatgtaaaaccatatgtatatatgaaagtatatttaacaatgaatcaaatgataggaaaagaattaataattactt

SEQ ID NO: 51931 - DNA, 8134 bp, Oryza sativa
attcctgcagtccgtataatataatagcagctgatgaactaatccaatctcaggccggcctgtggcaggcacacgcaagggggggccctcgaaagatcagttgcaacaacacattagtctctaatgatctactctctccatcccaaaatgtttgacgccattaacttttttaaaaatgtttaaccgttcgtcttattcaaaaaatttaagtaattattaatttttttctatcatttgatttattgttaaatatacttttatgtatacatatagttttacatatttcacaaaaatttttgaataagatgaacggtcaaatatattttaaaaaatcaacggcgtcaaacatttagggaacgagggaatactatacttttcagaattatggatgagaaaggctgctgttttggttgaggcccttttgggttactttggccttgacacctgttgtctcctcttcttgtcatggaatatatctcttcttgtctatgcttgcatatgcatgcttgcttttcacctgtcaaaatatgcatggctctcgatctactgcctatatctatggacattttgtctctccggttcatcattcttgagaggattggggctatatgatttgatttgccgtgtcccacgtgtgatttgagtttatttagagtggaacctgtcgaaagagatattttccagcacactgttgaaatagatattttccaagatttaaacagtttaatttccggttctctctttttttcctgctacagatatgttctacgccgtttcaaaatataagcacttttacgtgcttttcaagttgtaccaggacacatccctccatctagatacattttagaaaatcaatccgctgaaatatatatatatgcttatattttaaagcagggggagtacacatgaaacaaagtgtcaagaaaaagtccattttatacttttaagttttataaaattctgaaaattcaaataggacaatatttgcctcttaacttttcaaaccgtacgttcacctccaaaactttacaggcaaagcttttggctcacctccaaaacacaagcactgtattgaactgtcaaaattttctatgttaatcttgacacgttccctagacagaaagcgatgcacgcagtgacctgctcacacacgtaaaaaagcaactagtctccaaccttgattgcagctttgaagattagaaaacactaaaaacttggaaggggacgcccttacccttgttccaagagacacttgggccaagatcctgcaacaatattccagcaggtatacatgattaaatttaagtaaaggaagaaacgcacgcttatttatgtgagtagctagcctagccatcgtctccgtgatcagggagaaagtggagaagatgacaacgtttggagttggttggatcttttgtctagatcgaccaccacacatcatgcctgcatgttaatttcttcagtttttccatgatgctagctgtgcattgacctcttcttctgcatgcttgctgcatgcagacgtcggtggtaacttttcgttttcaccactttccacttcgctgattaatttatggataatatacagcatggatctttgatgctatgatcaaagttctgaaaatttacttgttgtagagctccgaagaaaaatagggatgaaaacagtttcgaaaaattccagaccggccgatcgagtatcgcttccataatagttacagtttgaccgttttccgattcaagctatatataagattcgtttttttctaacttatgtcagtatcatgttgatgccattactaaatatatagctaaattagtagatttagatttttcacattttcaccacttcacttatggatatagtagcatggatcttcgatgctacgatcaacttctcaaaaaaattacttgttatagcaccgatgaaaacggtggtggaaattccatacagaccgaatcactaatttctatccgcgtctgttggtttatatatagtcgctaaatagttaaactggtaaatacgaaaaaaatccttctttgatcaacccagaaccgtttatttgtgcagacatgattgacatcgattccaacccaaccgtgttttcgtcctcggatgataaaatcactccacaagttgaagcttgaaacgggatcagttgggatcgattcggtcccatcgtaggtactccctccgttcaaaaaatcccacttctaaatttgaatctagacaagtaggttaaaattcgatcgggttaagcacttatgttggaccggttaatttcccaaccgaaagctggtgtgtgtgcagctgcagctttatctggtggtcgttggcttatcctttcttggatcagccagcgagctagcgctagtgcgccgcacgcgccgcctgcggctgcccatgcatgtctcggtccctagctcgtcgtccttttcgcgcgctgctcgtggcggccacacgaccacgggacgacgtgccgcgcgcccgcgtacgcgcgtgtgcacgccgccccgggagcccgcccgggatgatggccgccgcgcgcgaggcgttttgtcgtgtacgcgtatacgtctccccctacgcgtcggttggatgggcacgtacggccgatcgatatggatccgatcactcccatcacacttgcgacactagggattttgaacagatgagatatttccaagtactatagatctatacaggactccttatccatattcattatactagagaatatctcatctgttcaaaatctcttatatttcaggatggatggagtataatgtgctgttttgatccaatttgtagagaggatcaacgagcagtgttttcaactaggcatgcataaggatagatagagctaattaaaccgcccatttatagcagtttaggcaccaccgggagacagttgaaattcaatcccttaaatcttgttttcaaaatctttaatgggatttaaagacatgaaaatatgttagcctctaacatatagcttataatttgacttcccagaacaattaaacatcgggccgtgccaaaatgaatcggtcatcgatgacggggatatattatcctctctccatacgcacacgactccacctccactcggcacacgctccgtgaaggaagaaggtccaagcggcggattgagagctagggtcatcttccaatttgtgggtacagggtttggggatttgatggaaagattttctttaacctaaaattctgtaattttgcgctttgggagtagtctagggaactcttattggtgcttttaattaccccatacgattttgttagctgacacccttttccatgcggtggatcccaccaaccgttctctcccaacccgccgctgtaggtgccaccgttatcaactatcacccattaccagtcagtcactaccccgtcacccctctaagatccaggaatcacgacaagcggtcggaatccattcacgtgttgaacacacacgtgtgtgttcacccattatacttttcagagcggttgaaacccgttcgtgcaacgagcattaggcttatcggatatatattacattgatagcctttatgcagtaaatttggccagccttactgtgtcttagctagtaagtactcagttatgttagatttcgtacgttatacatttagcttagttaggcacctatgtgaatggcagtatcatagcagaaatcgaactgtgaataataattgatacctgtcatatccatccactatagaagttgttttaaaatatcaaatatatccatttaatttgttaagtttgtagtaattaaaacttaattaaatatactaatagctttctcattttacgtgcgccaacttaatcttcatcttcatcagttttaaacactaccacagtagcttaaagcaatcaacagctgttgcatatcatgccatgtttcgtaattggaatcaagagtccttaatctataaaggtatttcacaggtaaaccactttaggttaacgttcttcacttttaacctccaaattaaaaagtcatatacatgaaaaatagacgatgtgcatttttaagataggaaagcaaatattaccacctaaactaaacatgccactatggcacaattaacaaattttgctccactaccattgaggtatcaattaattaatgtcgtgaaaagaaaaacacattaattcgagttcaaaagaccttgtatgaccaaacagccataaatcccttcttggcaaccatccaagcccaaattggtcatttcaccaatgctctaacccctataaatcccctccccaacccttcccatttcgctcacacatcgatcacagaaagctaagctaaagtgctaaactaagcacgagaaaatctaatcaaccaagcttagattagatcattagctatatatagctaggcgatttaatcatccacgagctagcttattagctaagcagtagcagcagcagaagatcgaagatggtgaaggagttcgtgcaggacgaggagaagcagcggctgctgctggacgagcacaccgagaagcacttcaccgccggcgaggtggtccgcgacatcatcatcggcgtctccgacggcctcaccgtgccgttcgccctcgccgccggcctgtccggcgccaacgccccctccgccctcgtcctcaccgccggcctcgccgaggtcgccgccggcgccatctccatgggcctcggagggtaagcccaaaaccaaaaataaataaaaataaaacaaaataaaactttcctcctcttcttcttcctctgcaaatctctttctgttttttctttgatttctcaactattttgcttggcaaaatggcaagcatatgaatgcatgcgttttcacagccaaattaattaattaattacccttttttaccatgttttttcgctgcatttttctctcttggaattaaagttaattttgattgttattggattattttgattttaattataggtatctggcggcgaagagcgacgccgaccactaccaccgcgagctgcagagggagcaggaggagatcgacaccgtgccggacacaggtaattaattaagtcggtaacagtaattaatttctctcggagtttttttttactacatctgagtttattattaccacggtggtggttcgacggctgagattggtttggccccacttggcagaggccgcggagatcgcggacatactgtcgcagtatgggctgggcccagaggagtatgggcccgttgttaactccctccgcagcaaccccaaggcctggctcgaattcatgatgaagtaaggggaaaaaactaattaaatcgaattaaatttaaattaacttcattattatggaatttcatatttcttatgacaatagaaatgatttacatctcatgatcagtgtgggtgtcgtgtgttaaatacttggagaaatatataataacttatcggggacacatattataggtttgagttgggactggagaagccggaaccaaggagggcgctgatgagcgcgggaacgatcgcgctggcttatgtggtgggtgggctggtgccactcctaccctacatgtttgtgccgacggccgaccgagccatggccacctcggtcgtcgtcacgctcgccgcacttctcttcttcggctatgtcaagggccggtttactggcaaccggcccttcatcagcgccttccagaccgctgttatcggcgctctcgcctccgccgccgccttcggcatggccaaggccgtgcagtccatctaagtactgtagccggagctccggctgcaggcatccaagtaaatgtaattaatttagcagatccaataagtattgcagaaatgtatgtataagtatttatgtacgtttgctgcgtgcttgtagtgtattagatgttctggaggtgtatccgtagttagccctaagtgtaccatgtacacgagtgtaatcactcattttatatcgtcttctattttggctcccttttttatattcggttgggattaattaataatgtattgtcgatttgtaagcaatgatgtgctttgttatctatacttacttaatttaattaggtagttcggtgcattgagaggaaatgtggatgatagttgatgggctgtgaagaacagacacggccaagattaattttcagtgcaacccaatatttgtcaaactatcagcaaaattctttattttttcagagaacgatcatcaacagttacattattactaaacgtgacatatgcagtgataaaagatattttttataaatatttgagtttctcgcaggataaaaattctactcacagtggtttattattatatatgaaacaatgatactctatactctatatgttcctcagttaggcggtacagatgaggggcctcatcggtgctggttgttatccggcacctataggttgtacgatttgaaaaacaaaaaacggacttggctcaattcgaaccgatgctccaaatccaccaaaaataaatcgaaaagcgagagagaaagggagtacaatttcatcatataaatcaagccgatgattggataatgaagaaacagatacccaagaaaacaaatcattgaataaacacatcacataaccaatatttacaaaattcatcacatggatttggaaattctaagaccactcgttgctgttgttcaccatggagaacttcagccacctgctgccctacagataactactgatgttgagatcatagggatagagggatgaaaggagggagaataagaggggaggaggacacaaacctttggcgtcagtgtggaggatgaggccagcggtgggaggatgtcacaccctgaagttcttctctcaagcctaaattgaatttataaatcacctagagaaaataccggtgtcaaagcaagagaaaccctaataaattaatgcaaataaaaatcggaattggcatgtgggatttttcttgagttctacatgtcgaaatatgctaacaagatttttagtggaattttcagagctttagaaataattttaaccaattaaaaataagcacaagcattatttaatccctggaaattcttctcctttttctttttcttccttttccccctccttttccccaaatgggccgccggcccatttcctccccctcccgcgcctttgttgggccggccgaaggccacggtccagccgctcgcccgagcccccctccccctcggacgctgacaggtggggcccacctgtcaggcccatccctaacctccggccgcccgccgtccgcagccgccgcctcacaaccgcccgcgcccgccttccccgcgccacgtcggccaagaccgcacgtgcgtccgcccctcccgcacccctcaaacccctctcccgctcgcccgcgcccccgagacggccgggattcgaattttgaatcccgcctctctctccacctccacctccccacgtcggccggcgaaatcgggccactcccggtcgttcccgacctctccgcccctatataatccatccccgcatcctcctcctcatttttcctttttccgccagcctctcccgagctctccatcgctcctgcaccgtacacccacccgccgccgcctctttcactactccggccgcctctagccgccgctagggccgccgccgccgttgggttcgcgcggccgaggtccacctcgtccacccctcctccgtcgaggttcgccgccggagccccatccctgtcgtgtgccggtaagaaacgccatggccgccgccttcggccggcgtttccgccctctatggtctctctctccctctctaatcctctccatttcgttccttaggtcgtcccggaccccgtccgccgcttgtcgacctccctccgttgttcctcgtcgccggtcgccgtcgtttccctccacgccggtcggaccccttcggtgaggacgcccctccttccccttccttcttcctcctctcttttccctggtagcaccgccgcttagacgtcgtcgcgccgccgccgtctgccgaatcgccgccgctgtccgccggtcgccgccggtgccgcgccgccgccgtgccatagccccgggtcggcttgagccgcctgcgcgcgccggccgagggtagatcggtgccg

SEQ ID NO: 51932 - DNA, 8679 bp, Oryza sativa
catagcccggggtcggcttgaaccgcctgcgcgcgccggccgagggtagatcggtgccgtcggttcggctgcccgcgtggctgccacgtggccgctgcgtgtgcgccgcgtcggcgccacgtgtgcaccacgtggtgcgccgctccttcccggtctgtggacccggtccaccgtggaccgccctacccgagtcactgccatgtggggcccgcatgtcggcgccgcctctctctctaccagggttatttattgcgcaataaatcaaataaggatttttctgttcatagtaaaagcacattgaatcttctaaaattcatatctaattcatccgagctccgtttaagcccattcaagtctcagtaaatcaagcaaaatgtgtaaaatccattaaaaatggttttgttctctgtttcagtagtcttatagcatgtttgtattgtttgttttgtttgtcgcttagattccggctctcccaacgctctggtgtactttgagatagtcgccgaggttcctccagcagcagagcaaggcaagtcatgcttgtcacttgaacatgttgatcctatattgcaaatgttctattgttttccttcaaatcatgcattgttttacaatgatactatggggtgtttacctactgttacagccatgctatttttgtaccatgctcctttgttagcttgtgttataaacatgactagagattggactagggattgcttagccatgcttagttcaactagcacacaatgggggaaatcacattaatgcttagatatcggattctagtaagacgttggttaatgccatcgctccggtgttggttaattaagatatgttaaatggtgggctgtgggtgcatggttttgttggtcgcgcccatggcatttaaggaccggttcgcgggatgccctggaagaacttatcgtacttaccacaagccaacgtgggcaacggttgggcttgtagtgtagctttcctctagttaacgcatccaggcaagggtgggcgtgatggagcggggcgggccctgcgacggcctctgtcgcttccggattcacctaggcacgagaggggactgcccgttgcctgctagggacaggggtgaaacctgaggtgtggtgtgcttggctagagggggttatgcgaagagtcttgtcacgacctctttccggtatgtcgtggtggcatgtcggcgcacggaaacatgtcgtggggctgtgtcttgtgggtaaagttgtacacctcttatcagagtaaaactattcgaatagccgtgcccgcggttatgggtggtcaaccagattcaccgtgattagtcttaccctagtttagtctgatggaactgattagttcaggtggttggttgggcctgttgcaacgtggtgtagcgttgaacagtggatggttaatattgattaattattacaactgttttactgttttcaactactgtttataaatgttcgctttatgcaaaagaacctctctagctatcctttcgtaatatcctgcatcataccccctgttccgatatgacttgctgagtacagtgggtagtactcagtcttgctttattttccccaaaaccccagagtttgagtatgcgtcagatggtggcttttccaaggagtagccttcgtccgtggcgtcgaggatgcctatggagtggtgttcccgctgcagttaaagtcaaggcttagttccggttatcttttgtttttccgctgcatttatgtaagacttttataatgtttgtaagacgtggatctgtatgtcaaatttgtcgtttgtgtacaccggccggtcctggacggggattttaatgcacattctgtttggaattctattcgggaatttctgggcgtgacaagttggtatcagagccgaccttgaccgtaggacaagccaaatggaaaaacctcagagccctctgaatccttttcattgcatatgttctttgcaattggatttgtttcgggaaaattgggatctgttcttgtggtgcaagggaaaaattttggtcgctcgtttaagtgagatttgtcaaatcaagtcagtctggggttttagtaaaattatttgagatttattcgacagtcagtcgggatttgatgggaagaatgcattaggtcctaactcaggaatatgggttgcaaggtatttatgctcttattattagtagtgtgtatctaatttctcattattttatcgctatgtaagttcgtcttatttattcgccctcatgcaaaaatggtctatacacaaaattatgctctctttagttcactttcattgagtcttttactgctttatttaaattggatttgagcatgcattgatcctacccctttgtcttctctagatggccgatcacccacccaaccaccgcggagaaggcatggatgattttgtggcagagttggctcgcatgaccctagtggtgggctaccccaacgcgccggagtactcgaccgttccaccgctcaatggcgagcttccccaccgtgttcgtctggaggttcatggctatgtgggcacctgcctcgctaatatggtggttgaggcatctgggggcactgcagatcatgcctgctaggaggcagcatatctgatgatggccagacttcgtgagcgccacaactacatcttctgcaacacggcataccatttccaccctcgtcgagcaagtggtgacgatgtcaacaccttccgcccgacagccggcgagaacgacaccaccttcggccacatgtgcgccgtgatgaggggaatggacaggatgcactcggatctgcacaaggcatccaaggccttgaatgacaggaagctcgtgaggatcatagctttaaaggatgagatagcgcgcctgaagaaggagaacgcttagttgaagggtctctctgcgctaggaggagttcggatccgcaccacgccccgcaagtctacgactgctcccgtgcgcattcagcttgcgcccaggaacccacctcctcctgcagctcctcccgcagctcctcctgcagttcctgtagcgcccgcagctccaactccagccccagctcctgttctagtgtcagctcccgcgtctgctctctccttcgctccagcgtcagccgccaggggtctagccagtggcagccacgaccgcagcagtagcagttccagtggctcagagccgggcagcggtgagacgtatctgccagactccaggagccgctcagaggaacctggcgacgagcaggaggacgcattcgactccaccgaccgcaggagccgttccgagcattaggctcgttttcccttagtttatcgactgcttagtaattgcctgttagtttgtgtgtctaggtttgttcgcttgtgggtcagtcgacggtcgatatcatgtgcctatgatacgactgtcttaataaggatttgcttgccgttttaagtgttttaattcagatcagaacaattgcagtttaaattcctatataataaagcttagttcctgagcatctgtttttcttgttttctccccctccgtctgctctcccttcagatggtcaacaccaggaatggcagccgtgcagcaggtgaggacagcaacagcgaagaacgcaccgatggtggacaccccaacagcgcctctggcaacggtccgccactgctccccgagaacccgacgctcgcacaagtgatgacccatcagactcagatgatggcagccatgatgcagcagcagcaccagcagatgcaccagaggatgcagcagcaaaccgagcagcagcagcagtagcagtttggtccccctctcccccagttcaagctgccggagtttctacgtgtcaggctacccaccttctctagcaccaccaaccccatggaggcgaatgactagctccatgccatagagaagaagctcaatctcctgcagtgcaatgatcaggagaaggttgccttcgccacacaccagctccagggtcccacgtcagcttggtgggacaaccacatggctacccgttcgctaggcacagaagtcacttgggcggagttctgtcgcagcttcaggaaggcgcaggtgcctgacggggtggtggtacaaaagaagagggaattccgggcactccaccagggcaacaggacagtgactgagtatctctatgagttcaatcgtctagcgcgatatgcaccggaggatgtccgcactgacgcagagaagcaggagaagttcctagcaggcctggatgacgagctgaccaaccagttgatctctggagactacgccgactttgagaagctggttgacaaggcaatccatcaggaggatcagcgcaacaaaatggacaggaagagaaaggcagcgcagttccggtccaaccaaggaagccaccagcgaccacgcttctttcctggacagcagggtggacctaccaccatgatcgtccgccagcatcgccctttcaactcaagcagcttccaccagggagccaatggcagccagaaccaccagggaggtcagcccaaccgcagtgcagctccgcgcccaccaatggcaccagcatagtcagctccatcagcccaagccaagaaggagactggaacaaagccagggtcctgcttcaactgtggtgagcatggccactttgctgacaaatgcccgaagccaaggcgtgccgggccaaggtttgtccaggctcgtgtcaacaacgcaacagtactttttgattctgcaccagaggtcgtactgggtacgtttcctgttaactcaatccctgcaacagtacttttcgattctggtgcaacacattcgttcatttcaaagaagtttgttgggatacatgggttaataagagaagaacttagtacaccaatgcgggttcataccccagggaatagctccacttcggttcaattcagcccttctataagaatagaaatccaaagatcaccatttctagccaacctcattcttctcgaatccaaagacctagatgtcattcttgggatggattggttgaccaagttcaagggtgtcattgattgtgcgaatcgcacagtcaccttgaccagcgagaagggagaaacattagtgtacaaatcaccagtctcaccaaagcagggggcctccttgaatcagattgaggtggaaattccagcggtcaccgaggagaagagttcgaggaaattggaagatatccccatagtctgcgagtatcccgaagtgttccccgaggacctcactactatgccacccaagagggagattgaattccggattgatttgacaccgagaactgctccaatttaaaagagaccgtacagaatggcagccaatgagctagcagaggtcaagaagcaggttgatgagcagctgcagaaagggtacattcgaccgagtacttcaccttggggtgctccggtcatttttgtggaggagaaggacaagacgaagaggatgtgtgtcgattatcgcgcactcaatgaggtcaccatcaagaacaaatacctgttgccgcggattgatgatctgttcgatcagctgaaaggagccaaggtgttttccaaaatagacctgcgatcaggctaccaccagttgaggattcaggaagagaatattcccaagacagccttcaccactcggtatgggttgtatgagtgcacggttatgtcttttggacttaccaatgcacctgcattcttcatgaacctgatgaacaaagtgttcatggaatttctggataagtttgttgtggtattcatcgacgacatacttatctattcaaagtctgaagaagaacatgagaagttgaaggagcaccagttatatgccaagttcagcaagtgtgacttctagttgtcggaagtcaaatttctgggtcacgtcattacagctcagggcgtggcagtcaatccattgaatgtggagtcagttaccaaatggaccccacctaagaccgtgtcacagattcggagttttcttggacttgcgggttattactgtcggttcattgaaaatttctccaggattgccagacctatgactcagttgcttaagaaagacgagaaatttaaatggacggccgagtgcgacaagagttttgaggaactcaaggagagattagtgtctgctccagttctgattttgcccgaccaaacaaaggacttccaagtctactgcaacacgtcccgccacgggcctggatgtgttctaatgcaagagggcagagtggtcgtttatgcctcgtggcagttgtgtccacatgaagggaactatccaacacatgacctggaattggcagcagtggttcatgatttgaaaatatggaggcgctatctgattggcaaccgctgcgaagtttatacggatcacaagagtctgaaatatatcttcacccaacctgatctaaatctccgacagcgaagatggttggagctaatcaaagattatgacatgagcattcactaccatccgggcaaagccaatgtggtggcagatgctttaagcaggacaagctactgcaatgctttgtgcaccgagggcatgtgtaaggaattgcagcaagagcttgaacacttcaacttggaacttgttgaacacgggtacgtggccgccctagaggcacgacctacgctcgtggatcaagtcagagcagcccaagtaaatgatcctgagatagctgaactgaaaaagaatacgagggtcggaaaagcccgagacttccttgaggatgaacatggcacaatctgtgtcacgcccggaaattcactagtaatttccgaacttatttgtgcataaaatcctcgtccaggaatcagccgaggaacacaaactgacaatttaatatacaaatccatcataataataacgttacacacttacaaaagaaaagaaaacagcagcggaataacggtctagcgatggcttcagctccactcccacatgcagctcaactggggtataagccaaacgtcttctccttctggatcctttttcttcaactgaggttgattgattattgcaagagtgagcatatgacatactcaacaagccacacagcaaatatgcaagtgcacaaggataccaaaggatggcataatataggctcatttgcaaaagcagcatttagcaaaacatttaagagaagtaaaacagtcgagtaattaatcagaaattttaatcaacactgaatagcacacccatgctgcacaggcccaactatcctgaacaaccatacccggctgtacagatctaactccaaaccaggagctaaacaaattattaccagttatagcatcaataattattgtgagaggtgtgagactaatcacgaaaaacattgctcaacccgcccataaccgcgggcacagctattcgaatatttttactctggccagaggtgtaccactgtacccacaagacacagcctcaacatcatgtctaccatgcgtcgcgatactggaaagtacccgaatagaggctgtgacaataccctctgcacaacataactcaccacagtgcaccattcctggatcataatcacccccttatgaaacaaggcatggactccccagcgacccccgtgggcttatctccgccacttcttagtctggtgctccgcaatgaaccatgttatacaaaaggtaaagccgttgcccacgctggcttgtggttggcacggttaatgtttcacaacaatagctcgcgaaccggtccttaattgccatgagcacgaccttcaaaaccatgtgctcacaacccaccattaatcatattttaattaccaattaattatcataacacgattaaccatcgtgagctaccattaaatataaccataaataataatgtagtatatatgattcatcccattagtgagctaatgtttctaagcatggctaagcaattatatctaacatttagttgaaccaatatatataaagctcaactagtcaaattataatatcccaaggtatcaaggaatagagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaatattcggtcttcaattaatcttcttgaacactcccgacgcactcacgaaccttcgcaacgacggaaacgacaagctaacacgcaaaacgaagaaaaagactaataaaaactaaataaacagtaaaaaaacaagcataaacagtacatgtggatatttttaacatgtagatctcgattttagatgaatttagcaacttgaaccagtcaaaaccgagttacgatgatttagttatgaatttccgaagatttaatcccaattaaacctattaaagaaaagactattccaaattaattaaataatttacaaatgatttataactgagataaaagattaaagcaacctccgaaatagattagattatatttggtagatgacatatattaaaaagaaataatatgccactgaaaagagcgaatggatttatatggctgagattaatcttgaccgagtcgaccaagattggatggcttagattgatctggcaagcgggcctcacgagataccgactcaacgagtcaattctacgtgacacgggatcacccaaatgatta

SEQ ID NO: 51933 - DNA, 11223 bp, Oryza sativa
cggcggaagacgggacttgaggggatgagtagaggacgactagggggtcctttatatagcatgggaggccgggatcgagcccacaacgacgggaaaaactcgggaaagtttagatcttcgccggaaaaagaaaaggttgaaccgcgaaattggaaaggatttccatataaacttttggggatttcttggggacaaggaagaggagattgagaggattccattcccgcaaccaattcggaaataagagcaacggagaggttggattttggaaggggatcggcggcaacaggcacggcacggctcggctctggctctggctctgtccaagctggaagatgaacagtagctcagggagagaaagtagacttcttgccgggcttttcttttctcagcctgattagaagagggagcaaaaccagactttggctgagagaagaagagaggatgcaggctcgggttgggccggcggaagagagaggaaggaaaggaatgggccgattcagcctaagacaagggaggagaattttattacttttccaattaaaataatcacttaaatgatctttgaattgttaaaaatacttccaatgctcaaataatttcaagaaaaatcctgaaaatacttggacactcaaagtacttaaacaaattataattagaccatttaatgattaatttaatatgtaggtaattactgaaatgctctttgtatgattaaaattaggaattgagctccgaaaaatccgagaatattccagagagtataattaaccatggagaatttaataaaaattaaatccatccatgctttatatttaggaaattttatttcccacatttaacttcacttgtaaattaatgaacatttaatataacttctaataataatttattaaataatttataaatcctgaaacaaaaatcaggatgtgacaatctggatgggagaaagattgtgcgtgcctgatgacaaagagctaaaagatcttatactcactgaggctcatcagactcaatactccattcatccgggtagtaccaagatgtatcaagatctcaaagaaaaattttagtgagccagcatgaggagggaaatagctgaattcgtcgcgctctgcgatgtttgtcagctagttaaggcagaacatcagaggctcgtaggattgttacaacctcttcagatcccggaatggaaatgggaagaaattggaatggatttcataacaggtctgcccaggacatcatctggccacaattcaatctgggtagtcgtggatcgacttaccaaagttgctcatttcattccagtgcataccacttatacgggcaaaaggttggcagagctctatctctcgagaatcatgtgtctgcatggagtacccaaaaagatagatctgatcgagggagccaattcacttcaaatttctggcagaaattgcaagaggaattgggaacccggctgaacttcagcacaacctaccatccgcagaccgatggtcagaccgagcgggtcaatcaaatattggaggatatgttaaaggcttgtgcgcttgattttggtggagcatgggacaaaaacttgccgtatgtggagttctcctacaacaacagttaccaggctagtttgcaaatggcaccgttcgaagcgttgtatggccggaagtgccgcacacctctcttctgggatcaaaccggcgaacgtcaactgttcggaacagaagtgctaactgaagcagaggagaaagtcagaaccgtcagagaaaggctgagaattgcacagtctcgatagaaaagctacacagaaaaccgccgaagagagctcacttttgaagcaggggattacgtgtaccttcgtgttactccgctccggggagtacaccgtttccaatcgaaaggcaagttggcaccacgcttcgtaggaccatacaaaatcttggaacgaagaggagaagttgcttatcagctagaacttccatccaacatgatcggtatccatgacgtgttccacgtgtcccagttaaagaagtgtttgagggtacccgaagaacaagccgactcggagcacatcgatatccaagaagatctgacttatgtggagaagccagttcgcatccttgagaccagtgaaagaaggactagaaataaggtcaccaggttctgcagggttcagtggagccaccattcagaggaagaaacaacctgggaaagggaagatgagttgaaggccgcccatccgcacctcttcgccagctcttccgaatctcggggtcgagattccgtttaaggggggtaggtttgtcacaccctgaagttcttcttccaagcctaaattgaatttataaatcacctagagaaaataccggtgtcaaagcaagagaaaccctaataaattaatgcaaataataatcgaaattggcatgtgggatttttcttgagttctacatgtcgaaatatgctaacaagatttttagtggaattttcagagctctagaaataattttaaccaattaaaaatgagcacaagcattatttaatccctggaaattcttctcctttttctttttcttccttttccccctccttttccccaaatgggccgccggcccatttcctccccctcccgcgcctttgctgggccggccgaaggccacggcccagccgctcgcccgagcccccctccccctcggacgctgacaggtggggcccacctgtcaggcccatccctaacctccggccgcccgccgtccgcagccgccgcctcacaaccgcccgcgcccgccttccccgcgccacgtcggccacgcccgcgcgtgcgtccacccctcccgcacccctcaaacccctctcccgctcgcccgcgtccccgagacagccgggattcgaattttgaatcccgcctctctctccacctccacctccccacgtcggccggtgaaatcgggccactcccggtcgttcctgacctctccgcccctatataatccatccccgcatcctcctcctcatttttcctttttccgccggcctctcccgagctctccatcgctcccgcaccgtgcacccacccgccgctgcctctttcactactccggcaaagtgtgggatatcaactagttacatgtaatggctaatgaccttcttaagtggtagtacctcacatctgtcgaataccaggcaatatctttcttacacctgatggttcaaaaatatgcagtgctaatgatttatcaggctttgttttggatttaatataatgtactctacatacagaaagtctgcatatttataggcacttgagtgggggccttcttccgctagcatctacaagatttgatcgttcacgattaagatttccagatgtgtgtatgtcctagttgtttagtaattattttatggtggctagctagcatcatatgttcaagtttgcagttaaaaagttcagtttgtaccattgaactgaagatgttggctcaggaaaggtgttcttttgctgtatgatgatgcttgtggtgcatttctgttcttctttttataatgcagtgcaaccctttattattactcccttctgttaattgttattctgacatgactagtctggtttggctacctatgcaatcatggagtcttaaacattattctgttaaaggaagtagaagtagcttcattccacattcatcccaatcgcaatggtttggttgtttgcaaattaatgagatgcctccagtagtcatgctattaataagtaatctccatttattttcttttattgtcctcagcagcttcattctactagtatgcatgtcagaaatgccatttatgtcttacgggtatacaatggtatgctgacgaattctctttatccagcttgtagatatatcaatgcgttatcttaaaatctgattcaaaaagccatttcaaattaatcagatactgaccaaatcaaacaaccgattctgatcaaactaaacaaccagattttgattctagatgatttactgccacctgatgtcttaagattaccggcgttgttccaaatatcagaaaataccaaccatagtccatagaaactcagaatagccttaacctcaagctctgtagtaggcactaggcagtaaaacatcgcccctcgccaccatcaccatggccacggccatgagagaagaaggggagagggggtaatgacatttgggtcccaccactcactgacatgtgtgggcccaatatatttgtttttattttttaccttaccagattcccactgacatgtgcatcctattaggggttttgtttttaaattttgttggtatagtgccacttaagccgccacatcggacgaatacaagtcaataagcgccatgttagtcgaaaccgttggtaattcaattgagggacttgatttacacccgtattagaagttgttacccttcatacctagttttacagttgaggaaattaaactcaacttatagtcgaggaacatccaatggacctttttcctttaccaagccaatctgtgcttgcaaacatgcatgcccaacttgagaagccaacgccgacagcggacccctcttgctccaccctctccaacctccgccgtgacctctcccggccggtcgctgtcgccgggcctcactccctcccttgtgcgcgtatgggaaggggaagaggagccaaggatgggaggaatagagaagaagagaggaggagaaaagcaagaggtagggggaagaaagcaagatagaaggggagatagagaagagagaggatgagtgaaggaggtgggtccattgacatgtgggtcacactattttcttattttattgtttgactaacatattggcctatgtattttgttttttaaaaaaaatgttaaatattacttcatgtgccacattaatgccacgttaaatgaagacggagtcaacttagccacgtagatgccacgccggctgaaaccactgtgcaatctccaaacttggaatctatattgcaccgattttgaccattgagagacgtattgcagtttaagaacgaaaatcaaactagcggtcaagttaagggacctaaattgaacttattccttaaaaacgtgagttcctcaaagctgaacgggccggattccaaacaaggcccaacacgatttttttttcttttctctttttacacaaggagaagaaggccgggacccgggacgtatctttcatcgactcggttctctttccttttctacccccaccgaaaaaggaaaaacaaagaagaaaaaaagctatggcttcttcgtcgctgctccgatccgccggcggcgcgctccggcggtggatccctcggcgcctcttccccagcaccagctaccgggtttggttcgggaggagacaatctggctatgaacaggcgttcgcggagagcccgcggcggcgccatctcggctccgattgcggcggaagtaccgacgacaatcaggtataaatctcttcctcttcctcctctgggaaccctaattccctacggcctatgttctttttttcctcgaacatcacaaaaggattgcacatcaatatattagaagaaaataatatctgttacacaacgcaattagccagaccgacttatgctaagaaggaaaaaaacaaaagaccaaggaaagcaactggtttactaccactctaaacagcgggaaggggcagaacccactactctcctaacaaaaccccaaaattagtaatgacagctaacgaccatagatggccctctgagaggattgaccgtaggacctccgagaccaaagatacggcccatgttcggttaatcctcaagtgggggtgattggttggaggggattattccacacctaaaccaaacaaggccgacatgtgtgtgaattcatcattctagtgagttttgttatggggaatcagggccaggattaaacagatttagttttgtttgttccattcggatcaacttcgaattataagatgtgggtgagagtcaatcgatagcctaatgcgagcttatgagagtggtagcatacagcatactagcacggcctgattcacgaaaaggaaaaaaaaacaaaatgaaagcattgcctgtagttaaaaaaaattattcctgctgatggggagcaaaggttgtgatattcaccatacgccagattttagtgcaagctaatgttttgttccatctgtccagaaacttttctcaatggatggcttgatgaagcatgtacttttaagcaaacttgttgtagatccagacaaacttttcgtaaattctgaaaatgagtaattctaagaaaaacggcgtcactctaaatgtcctgaaaatgttatatgtatgtccatcgtcctgactagtctttttgtttttgaaaattctttttagataatgtcctggctagtcaattaaaatgcagaaattaatgtttccacaaatcctttgcacaaaaagaccttccactgtttgggtgtggaattatttaaactgcttatttagttcaaattcgtaaggatttgaatccaaatccccagtattcaaacatgccgttagtggataaaatatatcactccttgtacttcactttgctaatttaaattacataagaaaaaataatgggagtagtgggcactaccaaaggagggagatatcttgttgtggacaatttcaaccatttcttgcaaactatcatgttcaaaacttcaaaatgaaaatattcaccacaggtttttattgtctccaacagctgaaaagatttcacaaccaatgtcaacaagaaaaatcctaatcataaagtggtcttagcagaagaacttggcagccttatcatgctgatagtttaacagtgagccagtgattgacaaataaatcttactccctccgtttcatattataagactttctagcattgcctatatgcatatagatattaatgaatctatacacatatttgtctagattcattaacatctatatgaatgtgggcaatgctagaaagtcttataatatgaaacggaacggaagaagtaaaacagtatatgcgcaactaccttcaattgaacaaaatgatgtttgtcacagaaaataaaaagtacagtccgcacatgaaaatgccacacgaagatcgtgattaatattgtagcacacactgtcaaagcgaaaaattgaactcttagatccttatgctgcaactgtttctttacaacttttaacacattcttcatttgccttattcaaagtggcaaattttctagtaatcagtgttcagatataacttaatctggataacattccatctataaattgttttagggagaaaatgtggcttaacaattcaaatagtagattttactaatatagtggaataaataaaacatatgttgtgtttaatgattcagtgtcttgcattgcactattgcaagtgaatttccacatttgacatagttaaactatatctgacacagaagtcaaaacgtcaaatgcatttttttaccatgaacagtaacttgaatttaaactggtataccttcagaccttgttattttcattaatggaaataggaagcgcttaaaactaaccactaaatctatatatttacatggaaaatcttcctgacataggtagcatggcctgattataccaaaaaaaaaagaaagaaagaaagatagcatatgctgatattgtgtacaccagatgcaagttaatgtttttttattctatctgtccagaaacgttactcaatggatgaattgttgaaatgcaaaaggcaattagagaagaacaaggagggagcttttaggcccgctgacattccagaccatgaaagcaagaaagacgagctctatagaaagatgagatcgacttttgacaagctgtgccactgcttagatgagcaggaacatatacttcgagaaattgaagatcaagttgacaatgatgaaaagtgtgtagttcagttcattgttttggacacatgttttttgttcccttttcctaataatgcttctttttgtacatacaggtttgatcaagtcaaacaatatctggtggcgatccctagcttcgtttgtattggtcttattcttgataggatgcatatgtttggttgagagattgtgttatgacttttgacttttggctagttagtgtacccgaggtattgaccacgctatataggacttggttgtggacacagcaaatcagcaatatactctgtgatgtgatctgattgataaaggtgtaagtgggtaacccgtttattttgacttataggtgggttcatgggttagccacttatccttaatgattgacctcattgatgttagagagaccgctactacttgtatgatcgttttgaacgaaggaaataaggaagcgcaattcaaagggatcttatgattgcctcgtttcttttttcctttggaaagcagtgtcttgtgattttcgaatgctgatttccacttttctgccaagcataagtaatttttttggcaaaaaaaaaatcaaaaaaactgcaagttgatcaatgtctcaacaattgttcatgctcactgcatttcaatcgataacaagtgttaatctgtggttttcattttgccttgtggatcaattagtagttcctagaagggctccatactagggctcaccggctaccacactgtcgagaagtcagccgcggggtgtcctatacattgtaggagtagaatgttatccagtataagatgattttgtaattaattggcgtctagcaaaactaaattaaaataaagaaacaaacttaaaaaaattatccaaaacaacaaataaactgtccctgcagtcactgcatcatacctcatgtgggctgggcctgaaaacaaggtcaccgacggttttctcctgcgctgcggaggattcaggcgataagagcaagttacaattcatctatagccaatctaatagccaattcatacaataattgcttactatattattaatgtatggtcccacctgtcatacccacattgcgtcttagagtccgtgctacagttggctacagatgtgtagcccgttgctcttctctctcatcgtttatcttattaaaatatgtttatagctgattaatagcctgatattgtacctgctctagtgccgtagagcccttgaaaagaggaggggagaaggattcgccgggttgatttgaataactgctacatatcgggttcctgcacgacgctagcgctgcctcttctgctaaaagtagcacttacacacgattttttaaaatttgtttgctttaattaattttctaggtttagggttaggtctcgagactccaagaacagcttcgattcctcagtaggaggaggaggaggatggcttcgtcgtcttcgtcgtcgttgctccgatcagtcgcccgcgagctccggcggtcgatccctccgccgcgcccgcgcccggccatgtcggtgatggaccgactcgccccgcgtctcctcagcaccgagtcctctaaccacaagatgaacccctcctcctcctcctcgccgcttctggacaacttcttccgctccgatcgcgctaagaggatggataccagtaaggtataatcatctccttcttctccccctttgtttttcccaatagattgcaccgtagttaatttcccacgatttgtctcttgcaacaccaagtgtgtttcttcattcagtcttgggaggagctcccttatcagatgaaaaaaaagacaagtacatagaaaataaataagcgcatttggtcttctttaattaagatagaggcaaaagaaaaaaaaagaaagatcaattttgggggaaaaaattacttttaaagctcagctaatgtaatgcctaatgatatgtcaccttgttttaagtggtgcctcgacttatctcacatttgtctgatacatggcaaattcttctgaaaaagatattatgagtttatgtttatgacctacaggatttgatgatactaatccatgttttattctgtcttcctaggttcaattctcaaaggacgaccttaaggaatttgataggtatttggatgagaggacgaagcaagctgagaggaacttgttgctgtctctggacaagttctgtgatgcctgtgaaagacgggcttctctgcttcgagacatcaaagcgatgttagaggctagaaataaacggtctgcccaaaagtaagctttgactttatttatttggtcatatatgctatgcacatatattccattcattcctttatatctttcttcttttgacattgcaggtttcttcttgttaagcaatgggcagtgttaatttcttactcctctgttcttggttttgctctttataatctgcatttgtttagttgagaagaaaatgtcagctgcaagctctatgaccctttgctattaaagtatgattgtgttatgagcttgtggtcaatgtcttatcaggctttgctttggatttaatgtactccgtatactgaaaatctctatatctatagagatttgctccggtccaacaaaaaagtatctcgagataccagtacctcgaggtacttactttttgttggaccggagcagatctcatatctataggcacaggagtgggccttcttccgctagcatctagaacatttgatcattcacgattacgatttccagatgtgcttatatcctagttttcagttttttttttttggtggctggctagcatcatgtgttcaagtatgcagtgaaagaaaaagtttagttagtaccattgaactgaagatgttggctcaggaaagaaggtgttcttttgctgtataatgatgcttgattgcttgtggtgcactactgtacatttaatttgttttgttgtcctcggcagcttcatatgcatgaaagaattgtcatttctgttttatgggggtatatacatatatgctgatgatattttttatccagcttgtagatatatcaatataatgcattatcttaaatcctgattcaaaaagccacatcaaatcaactccgtcgccagattcatagttcgactatctcaagtgaagttcttttaatagtttactgtcataattgcttttaggttgcactgattaagattttgttataggctctgtttattttgttaatgactagtatcaataattgtatttttatcacgctgtttagtttggttaatactatttgattggaattttctacgcttcacctttttttttcgaccagcc

SEQ ID NO: 51934 - DNA, 3214 bp, Oryza sativa
ccccctaaagctgtaatgttttccttcgtggacaatttctgtacctgcgtcttactctcgagctgtgtgtaaaatctcggaatttctggctgtcaacgtggtgcgtactgtgatatataatcacatgtttggaatttacaaatcagctgctgccttttttttgtttgatccggtgttcttagatagcaagagaagcacatgatgattggtatgcattatatatattgttgggttgccatgttaattaagtgatgggctcttgattaatcatgtgacaaaggatggtgcgcacttggtatattaaggcccaaatcgaattcttgttggaccttaatttagctggtgaaaggattaaaatgtagtaaaatcgagtccaattcatcccaatccattcagatacattctctcaccaacaatttgcctcatttaaatctctcctttccccaacttgaagagtcactggtatgtgggttcatagcaaagagaaccgatatgacagtgaaagtaagtcggcttaagtcaaagtatctgaatcgcatcttgagagcttggtgcctagggtggtagctagcgagctacaatgagtagggtagggcaactaaaaggttcaaaatgattttgtaaagtattgcaatcacttattagattttgagtaaaatgcaccggtggtattacaacttgcaaggtgagggtagtttagtcactcattttgcaaattgcttaaataagtcacttatcttccttagatggtgcaaatcctaccaaatacattgtcatatggattgtttgtttttaaattgaaagttgtattgacccaatcatgcatttttttagccatgtgggcagggcaagcattaaaattataaattaacactcgtattttttatgtatatgctattacttctactttcaataaacaagatcatatttttagtcgcattgcacattggcttatttatggatcgtgtgatcatgtttgtaaacaaattgacatagcatataacttcattgcagacaccccacatgacacatgttctatgtgatttgcacccctaaaacaagataagtgacttgtttgagcattttacaagatgggtgactaaattacacctatctcacaagttgtggtactaatggtgcattttactcagcatgtaggaactttaacaaaaggtctaccgtgcatatataaatggatgactttttaactgtgacgatatgcatccatcagaatatcagattgacagcaccactgcatgcaccaagtggagagcataaatcctcaaatatatgtcacaaataccagaaatcatgacctttaatttgattccatcggtatcattcccctattataattagatcccagcatacaatcaaacacagacaacagtttattccattggatgctcctctacttcgttttctcaataggaaaaaagctaattatttgggcttcagtagtaatgcagcgacggagatttgtctgatgaacaatcaaaacagacaggaaccatgtgtccatgtattcttctctgaccatcgatcacgatcgatcgccaagtggttcgtcgtcggaactccagcttcggtcgacggcatcgttgtcggctgcgatggcgattcacataatgtgggcaaaagatgatgattatgaaagggcaaatatatggccatcgaccacatcgcatatagctccatagtgccgacagagttcatgtctaaaggtatctcaggctccgttattttcagttttattcatctgaattattgccacggattattttcttgatgcttctgaaaaaaacggtttgtccaaataaagtttgatttgatttcctgttgttatatttgctaagttcatttctcaaaatattgaatttatccatataatcgagagtagataatccgcgataataatctgatgaataacaagtttgaattttgatatgttgttgttgctgcaatgcatctgatcaagccactgtcctttttcccaaatcatggaggcattcattatgcatattcctctggaaacaagctagtagtatagcttagtagtcatggtgatcacccatggatccatcaccaggttcactgaatctgtctggaaatgcggggcaagttcaatggatctctgcacggttcagacgttcagtttggtacattccgctgtccacccaccgcagtgtggatgcatgcatggtcggccaacgacagagaagaagaccttacattacacacacttaataaccttttgaaggaaaagtgctaattaaggaggagataacacacgctaaccttagctacttcctccgtttcacaatctaagtcattatagcatttctcatattcatattaatgttaatgaatctagatagatatatatgtctagattcgttaacatcaatatgaacgtgggaaatgttagaatgacttacattgtgaaacggagggagtacttggcatttctaaatttcttattgcaacaaaattaaccttaaaccatcagtgccaaatcatgttcctattgtgtatatgtacgggaagttggtcgtggtgagacacctaggcccaccctcttttggattgctcctagcttcacctatttcaggatcttcagctcttctaaatagtcggctcgacattacaagtgaactaacatatattacccattgaaattatatagtgaatggttatattaattcagttgttcaaaggtgcttataggcatagagggtgtgattaattgtaccgcatttctaaatgaattgaatccaagtattccaaatgggatacaaatacacaaatgcaggaattaatcccgagttaggtatatacctcgtataatcgtattattcacggtacagtgactctaccttaagtgtgggctgcacagtttttatgccaagaacaggtctgaatctgataagttcgattgtgcagtgaggataagagcacgtgttatagcttatcttcaacgtgattgaacacttaactttactttgttatgtttcaattcattttaatgatattaagacaaatggccaactataaccaaatcttgtaggcaacagaacaatattaacaaggtactatagtagtgcatatcttaccgtgatattatccaaaatcttttttactgcacgctctccaaatagctccctatatcccaatccttctataatttattatgccaacaacgttcggtcaaatt

SEQ ID NO: 51935 - DNA, 2012 bp, Oryza sativa
ttggcgactgcaaggatgaaacccagacgcaggagctgctagggtttcaattttttttgggagtttttttttgccatttttctttttgcagtcagacggcttaagcgtctgcatgtggaaatacaattttcgcatgtggttgctctacccgcataaaaaatactgatttttgcagataccagatgcagatgatgggctacccacccgcctgcgagaatcaattgggactgcatggaaaaatcatttttatagtaatatactcctttcgattataaatatttaaatatttggtgtttagcacaagatatgatcactttaaaattttgatatcttttagtaattttcacgaaacgataattacagaaaataagtttatcacaaaatgtaactttatccccctatgtgtgtatgatatgcgagcctgacttacaccggcatgagtattacatgtttaagacatgtgggccagaagcttttggacaaataaagttacaaatttcttataaaatcatactctattattacaactcaatgaaatgtctagttaaatttaaagttgaagtaaactaataattttgataaaatagttacaataacctgaaatttactctaatttataattattaattttaaattattttaatattaaattgatttttagaattttatagatcttatcttaaatatcaaatatttatgattggaagagttttcttttactttattgaactgatactgatatttttctggaaaccgatacggatggactatttatttttggaaagtgataatgatggttaggtctccaattattgtaattaaggtgctaaaagcaacaaaaatcttagtacagtgttagatcaagacctgcctcagtgacaggtaataatactcttgcatctcaaaataaaaaaggtcttaatctagtctctccgacgaccagagctttgcaggcaaagtgagagcattgatgcatgcacatgtagattaattggagcatatcttgattcaataatataggcatatccacgcaaccctaatgcacattcgctaaagtgtgtctaataatttatttccatattttaactaagttttggagtaatcaatgaaagtacaatggtttgtccaaggcttaaaaaactactccatccattccaaaatataaagcacaaccacccttaaccttcaaagatcaagaaacaattattatcatgttctagtatggatcactctaataaatataatgcatgcacctaatagaattagatatcttgagggtgaaggatttaaaaataatagtttagtggagaagatatgctaattaattgcatgcatgcatagacttcttatattataaaacatcttaaaaaatagttgtgccttatattatgaaatggagggagtatgacatgatgaatctgtggcaacaaagggaaaactacattaaaaatttcacaatgtttgataaattgtgatagcaaaacaaacaacccctgttatcttttatatctctctttcttgtataagaatctggaattttcttggcggctgaaactgtcaagaatacctaattttcttgcgaagtttcttggtggttcgacaccacccaaggtaaagtgtattcttattgctctagatcaccaaggttatactttgtggcttttcgaaagtttaatattctccgtagttttttttggcgattagacagccaataaaacttttcctcacggttagcagtcaaaacaaaatctgaatttctctatcactctagacttggcagtgtccgtcaaaatatattgccttggcggttttcatactatccttgacggtttttttgccaccaagaaaattccagattcttgtacataatgatcgagtctacttcctctcgagatcttcgggcaccaaaattttctaaaatgagggtttccatggggttatgcatatatatcggggcagaggaaggagccatatcgcacatttctttttcagagaaatagagattatctcct

SEQ ID NO: 51936 - DNA, 1585 bp, Oryza sativa
ttagtaaaacttaaaatagtttggttttgaccaaagttaaaacgtgttatgaactgagacataggagtcccaattaagggcccatgctgccacgtgtcaaggacgaccagtagtcaacgtcgactccaatatctttcttgctcgctttctatccgtcgtgaaagtcacgaaacatacttttttgccatgcgtatatgcatgcacgactgcatggattaataatacggcaccttaatttccttccattatctcatgtacgaactaaaccgcttaattagttaattaatttgtttggcaaagtggctgattggcatgcatatatatatttttggcctttggagatatgggacaggtagtactagttctaatctcagtaagacaaaatgaaccgaacaacttttcatccttggtgcgtctgttgtttaatcgaataattaatcaagttcggagcatgggtggtggtctaacctacagattgatagccactaagatatatatttctgtcaaacttttgtgtttaggagatgttctagttgtttctttcttcttttttttggctttgtgcattttatgcggaggccggggatgactcagtttgattgtatcatctcgatgtaattaactgagtctaaataaagcttctattatctaaaaattaatcaagttcatctcgttggtagtaatggtgggcatccaacttatgcagagctctaaaagctagctatagctatcatgcatgcatatgaaaccaagtgttttaattctcatgtagatattgggattcaatttattcgaggatctctttagcctcaattgaagtaaaggtattagtccctttcatataagtaacacaacaaaagcggattagattgacagatggtaatcaataatataattagaatgcaggcgctggtggctttgttaggtcggccgttgttctttggtttaattctggtcgtatgcattgttataattaagtgattaactgatctagctctaatattttaattaattccaacacatacaacaaggtgtaaaattgtgcacgaaatttgaacatctccttcttatttcttctcttagtgatactgcccaacataaagttgcaatagccttggttgttcagaattcagccaactgaaaaagattagcaacgctagtagacagatgatgcccaaaagttataaaaaatagtattccatatgaataaaacaatttagaaaaaaagagacgttgtaatgtttcattagaattacggaaggaacatttagtgacactttcttttgtatagaattctctttgattaaaagtaccactttcttcgaatacaagagaaagattttgattttaaaaaaaattctaagccttcaaatgaaagctttccttggtaccctctatatatgagccttattgtacatgacattaagatcctctttttattacctttgcacctccaaatatcttttttcccccgaaaggtcaactagcactacctttgaaactaagtcataccaagccgctagttatcactataaataaagagccacctaaaagagacatttaaaaacagcacttatctaaattc

SEQ ID NO: 51937 - DNA, 5240 bp, Oryza sativa
  unsure (1)..(5240): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacacagacgaactacggtgtgaaaaaaagaggaaacaaaacaaccaaacaccgtatgaaatatctgaatgtatgaactctctacatcatccataaattttaacttatattctatgtttctgtgttactgatttgacttacccttttctagtgtacatcgagaaggaagatcttacccaacaaatcatagacaaaggcccaccaaagaacgccttaagaggtcaaaagaagacaaaaacgaatggccagacaccgttaaaaaattcagaaggtaatgcctaaccatttaacatttatatagatctattactaatttgtcgtacctatgtagagttgacttaaaaaagaagagcctttcattacctacattaataacaccgaggataacaaagtgatggtgcatattgaagaagtggaggttaaacggaaaaaaatgaaagtactaacacaaccagctttcttgaatgatgatgtaagttcgcctatttaacaagcctactattcttttataactatatttgttatgtaactcaactaaactcaaatttaggtcatggatgcatacattcaatgcctccgctataaagagaaaggaatcaggggagatggcaaggccttcctagagatggccattaaaacaggtctactaaatgtagagggagcgcatgtcgaagcaagcgaatctcgagataaacgatggattagagatatggcacgcgactatctaccatttgacatggtaatacttatttaagctatctatgtaatgggtaattcaatttatgactcaatcttactgttgaacatctgcagattttcctcccaattaatattaaagatacacactggtacctagccgttcttaacgccaagcgacgtgaggtgcaaatactagattcgctcgcaaagccaatcagtaaagatcgacccgatctaaggcgtgtggtaagcgatgcacttccacttgtataattcaaatcggttttgctatattttaaccgtaccaacgttgcacaaaacttcccagctactagctatcgagaggggattacacgggacagagaatcagcacccacagttaaaacacgattggcctgatttcaatattaccgaatgggagtacaacaaagtccaaaaattgccaaagcaaggagacgggtgggtgactcaaactcttccacatgatattcacattattcaattatagaaacgtgttatcctaacgactaaattcttgtagcgtctcgtgcggcctgtacacccttaagttcatggagcattggactggatcttatctcccaaaaattcaactacaggtaactacaacaacctctattcatattttgcaccactgcttcctaatacgaaaaaccatttaaaatgcactccctttacattatgcagaaggaagtaaaaacatttcgacaggacttagccggaattttgatcaactccgaactgaacaacattaaagatcgtccactgctaccaaccacgacataaatggatcatctgtcatacatttaccacaattaccttactatgctctcttacccttattaaataatttatatactacttgggtattttatggatcccaaacattgatgcctttttgagataatattcatagttcatatttcaatccatttgagaaggagcggtatatgaaaccttacgcttcggggtgactcagcgcagtcagctgtcgacgtcaccgacgtgcgtctgctacaatgtcgcacctgaacaacgataaccccttcgccggcatgcggatcccttcgcgcatgccacccttcgcgcatgccaccgtcttgcaaactgaccctgctcccaaccattcaatcaaataatcaatatacaatacaatggattcaagaacaaacaacctgtgaaatttgattcctacaaacactgtggaatttgattgctatcatgctatgatcaccacctgtatatatcatagattacatccttccagagcctggtaatcatagaagaacatagaatcaaaattccatactcacaacgactgatcaacccagaaatctcagtgctaatttgcacttggaaggtgatagtgttatggcaatccacaatatctgcacttgaaccataatatgaaaaaaaaattaagtgcaatgttgtcctgtctgaacaaaatggaccaactttgaaggaaaaatattcatgcaaatatggtgatctggacaaattttaattttaaaatgctattagttcacatatatcttgatctataatatgctccacaaatataccaaataaccaatgcagattacctgtcgtggatcatgtacaaaattcaaaatacaaccacagttttttgtacacagtgaacattaatgttgtgcccattcaactataatttttaagccaaccatagattcatgcacgtctggaaaagaaaagggactgcataatcattttgaaagactatttaacaattgagcgcttaatttattgtactaaatcaaaccgaggcactaaataaaacagaaccaagcattagctttcaagcacatatgcagaatgtgagataggtcagaatgcatggaagcaataccgaagccatatcaaataggaagcaacggctgcagccaacatgcagtcctcaaacagtccattcatctggtggatcaatcaaccattcaatcaaataatcaatatacaatacaatggattcaagaacaaacaatctttatctgcaaaatcataacagtagtggttggtatattaagattggaggattcagaatgtacctgaagctcggctgtctcctctcgattccttgcatagtatctgaacactgaagagggaaaaaattgaaacttaaccaaaaaaaactgcaattcaagacaatagaattggtgaactgtgattaatatgacccagttagtagtactcctactaactaatggagtatcgcttacactgggttaaatcagttgccaagggcatgttcagacttcagagaagggggcggctaggtcgatggcgacagcggtggagtggagaagggtgcgtcggtccatggggaggataacgtggcggtggtggcgcggggaggcgacgcggcgaagaggactcgtcgcccgccggcggaggcgggtggaggggcgactacgtcacgcgacgagctggacaagggggcgggggaggaggacggcgacggtgggggctcacaagccggcgctgagacgcgggcggaggagaaggaggggagggcgatgaggaagggcttcgacggagggaagccgccgatatcaggggaggcggggaggcggacgtcgacggaggggcgctggcggtggagaaggcggcgaggaagggcgagtgtggcgagggagcgtagaaggcgacggcgctggacaggcgacggaggcggcgagggagatggacggcggcggaggtggggatggggtggactggtgacgggaagtggtgacgagaggaatcggataaggatagggtgagtaagagaccgaaaaaatacgataatacccctacgagattttttttctcttgacgaaaacacccttccatatttctacttccactaatactggtgggagtagaattagatctcagccctacaattaaatacgaccaatggcccatattaatttctactccgagtagaaagcaccggagagggactggactacacgaggtttggctcgatgtgcttgactcctttgtgtatgctcacttatactacctttgtgtataacgttattgattttttttctaatatttgaccattcgtcttattaaaaaaatttatgtaactatcatttattttgttgtgacatgattcatcatcaaatgttttttacgcatgacataaatattttcatatttgtacaaaaattttgaataaaacgaatgattaaacgttggtcgaaaagtcaatggcatcatacaatacggagggaataccttctagaccgatcaatttgggtgacttatgttgcaaatccatggttcaggtttgggtgcgggtggaggaattgtgcggccaatgcatagctgtagggggtggatctggtttttacatgataccacttaattatgagaaatttgcatgatgccacttagctatgagaaatcgctccaatttctctcagttttatacataaaaaatatctacggcccatttgcaattcgatggcaaaaagaattaactgattttcagactatttttagtctggtggcacatagaccgtcccattgtttttatacctgatactcccttagagcaagttcaatagtatagcccactagtaactccaattcatatatagtcaatctaatagctaattcatacaatagttgcttactataatattaatatatggtctcacctgtcatacacacattacgtcttgaagtctgtgctgcagctggctacaaatctgtagcccgctgctcttctctctcatcgtttatcttattaaaatatgtttgtagttagctaatagagcctgctattctacctgctcttaaaaaaacttgaaatatatggatgaatttagactcaaatcaggaatggaagaagtgacaacgccctcgtttggcttcccaagtggcgcacgggcagagaccaaattttctttgttttgttaaagactcgcatatcaattccgtagcatgtgttggttggagtaggctttgccactaaaccctttctttaatgcgatcgatgggactagacattggtctcttaacaattgacagagattctctctctttttactacagtataacaattgacaaaagttcatgtcctgtctgttgacaaagatgccatatgttctgcctcgtgtgtcgactgtcgagcacggtttggatttgcacgacgactattttggcccgatcctgtagctgtacgcggctcgatgtcaatcaataatgtaagcgactcagtttttttttctctttccctcgtcttgaaaattagcgaatgtaggccgagtctagttccaaactt

SEQ ID NO: 51938 - DNA, 2608 bp, Oryza sativa
aaaaatgtagtaataattcgtgaactgaaaagaaaccgtgcagcagtggcagccggatgaatattgtgcagtctggacaaccctagctgaaaccactttagctcggaatttattctaaagtgaattgatttttatcctcttacatactactactcttttacatactacctccgtaaaaaaaaaaaagacgaactctggatttccgtgtccaactttgactgtttgtcttatatgaaatttttttataattcgtattttcattgttgttagatgataaaacatgattaatattttatgcgtaacttatctttttgtttttttttcataattttttcaaataagacgaacggtcaaacgttgggcacggaaaccagggtttatcttttttttgggacaaagggactaggctgtgtttagttcacgtcaaatttagaagtttgattgaaattggaacgatgttacggaaaagttggaagtttgtttgtgtaggaaagttttgatgtgatggaaaagttgggagtttgaagaaaaagtttggaactaaacaagtccatactcttgatttacaaatcgagaaatttgatctttttaatatttctaaccaacactcttcactattacattttatatagggatgtggccatgtgggcaatgtttttattttagaattgagggaatggtaaccaagcaaatcctcagtgtttttcaacagagaatggcaatctatctgcaatgtagtgaaaagttcgtatgtatcagtacaagctctgatcttgtttcgtccaatcggaaactagcgtgtttgccctgttttatccgtctattttactagattatttttacaaattatttgcttcccgctcctcaaattacattttaaaataaaccttttctactatatttgcttgaatcacttgttttaatgctatttgttaaatttggtttttaattatttaattagtcctacaataaagtgaataatccggtcaataaactacctgaaacgtgtcctatagtaccggggtgatcaagctagccctacatagatgcaacacaaacacaaaaataaaaggaaacccaatgcgcacatgcagacaaaaaacgagcaaaatgatgttgcattgttgatttcttgtgctgtcctcattgtgaaccagctgtctctccatgtatatatactgggagtaacaacaagtgtagtgataaagtttagtctatgcataaagtaatttgcacattgcttaggatctagcttaacaagcatatttttttagcgagatgcatcgatcagggcttgacgagtaattttatatgtcggcaccgaaaagttaccatggctttccggtttttcagacctctcgcttggatgctctcactactttattcagacatcatgttgagaatatacatgggcatgagtaactcggacagtatcatcatgtcataaggctctcgcctagcgaaaaaacagagctcattgtttgctcaaaacttgttagccacggtcaatttttaaagctaggtgagtatagctcaattagttatttttttcttaaaccaatccacataaatttaaatcctaaactcgatgtggtgctcgtatttacagttaattatttttttttataaatgatgttcatgtctatagagttgtttgtgtttacttcatcaacttcaagatatgccggctgagttttccgaaggtgttcataagaatatggtgtgcgtgtgtgcgtccacaaggatgaatgtgcgtgtctcgtgagcgcttgcatttgtaccgtgttttttaaaaaataaaatttaaaaattgatttttattttttttatcaaagtttatttttcatcattgaactttgagtcattaagaacacatgtagagaagttttatccataaatattttttcgctaaacaaactatggacgaaacgatggggatgatgttttaaagggcaagaggctatcagagttacaagcagagaaacacgttgaggtgattgtgaattggtggaagagacaccgagaaactaacattaccttggcagggtagcgtcgcttttgactcgtgtagtaatagtgtagcttgagcatgagagtgagagccatagacatgactgagtcaagtggtcatcagtggtcgtgatggcaagctgcagtgcctcgtgtgcaccatacctcctggctcagtcccaggcctaaagcttttggaaaacccccttttttttctttaaaaaaagatactacaaattaagaaaaaccttttcaatagctaaaataagattatttttacactattttatttttcctaaaataattttatttctaacaatcattgcattggggttcatgacaatagccatcccaaaataaatttatttttttatccatggaacacatgccaatacaaaagtaaaaagattagagtatctctactttagcaaatctcaatgcaactatttatcactttatctacttctaatataattattacatacttttacaaactccaatgtaatgattactctataaacgaacttatttgggacaaatgaagagatttaaaaatatgggagtacttaatatgggacggaggaagtaggaagaaggt

SEQ ID NO: 51939 - DNA, 4210 bp, Oryza sativa
ataacctgcacatattccatcaggcattatccgcatttttattgtgcagctccaccctgactctctttgattcctgaaaaagaaaagaaaaaaaaagaaaagaaaaagaaaaaccgagtcgtctcgtctccattgcggcggcgcgagctttggactcgtcgtctccgtcccgcgcgcgacgagcgcgaccagcggccgccggcgtctgctgcttgctcgcttgcttgcttccgccccgccggcgccctcgcttcgctgtccgctgtggtgagcatctccgtccgccacgcgccatcccacactcttttttttttctcgaatttgcgttagccttactagcttctctttctagatctggaagctgtttgtctctcaatttttgccttaaaccctccctagtactaatcgcattttagtttgttcccaaaaggggaaaaaaagagagaaagaattgactatttgggaacaaatgggagtaggtctgcccctgtaaaaatgtgtgttttgtatacagtttcagtgcaattacgcctgcgagatgaagtgatttcagtgatctgttcaagaacggcaggtataggagagcagccgatggttcagttccgaattggttgtggcaatgctagatggcaaggtagcaactagcaactgcttgtttagtttcttctgaggttggagcttcaccgtttggaagacatttatgctcttgattttgtggtcactggtcaggcttgcctttgcagagacgataggcatctgatatgtgctatggctttcagacttttgtactttggtgcctatgtgtagttagtgttgaacttggataacgttctcgtcggttgaaccccagcattattaggttacagtaagtcagtaactagttgttttttttgcattctgtgagattctattgtttggtgagttgttcactgcttaataaaatctttagaacaattattgcctttctttttgaaagaaacaatgagattgtggttcttaatacaacatctgtgcagataagaaaaatcatatggttcttgtttaaatttgttcagggatctgacattttctactgttacagtgttacagatttttgtgtgccctgttgttaacttttcttcatgttgtaatgcttggacccctatccttggggcagatgaaactgtctgctatagtttcttctgcttgcctgatgcttaagatttttaacaagttgtacatcctcaatgacacgcaagccttttacgtactcatgaaaaaaatttggtgttcacatcctgctttttgtctggtgtagtttatgtcttactaatccatttgttgatctttgttcagttcaggattttgggataaggctatttgttatttctcaaaagtgtaaatgggttcagaaggaccttcagttgttactgtacatgtgactggatttaagaagtttcatggggttgctgagaacccaactgagaaaattgtgaccaatcttaaatcattcgtggaaaagaaaggattgccaaaaaaccttgtgcttggaagctgcacagttcttgaaactgcagggcagggggcacttggcacattatataaggttttggaatcttccattgcggaaagggagaatgggtcatcggctcaggggcaagtaatttgggttagtatccacctttcttgattccacatcagatactgctgtaatgcagtcggcaccttgcatattgcaatgctctcctgtctgaaaaataactatttgccttcaatgccactcagacagttgaattaattatcattcgaaaaatgttcagatccactttggagtcaatagtggtgcaacaaggtttgctcttgagaatcaagctgttaatgaagccaccttccgttgtccagatgagctagggtggaaacctcaggttgcgggttcatccatttactcctctctgtctatatatatcgacactgtgttttaccggtttgatggttccatgcagagggctcccattgtgccatctgatggaggaatctcacgcacaagagaggtatatgttaaaactttcatctgaaaattaatgatgtttgaagtatagctacaaacagcacaattacttgtttcttttttagtttccacataattctatggctatgagcccacaagactccctcccattgaaagaaaaaaaaacaaattgcaaagtagaacaccaaagattgttaagtctgctgcaataaattcacttactttgcaaagtagaacaccaaagattgttaagtctgctgcaataaattcactttcttcacagttaccttgttactaccttagagccacaagggcgagtttcagaagcactattgaatatttcttttgttcatttttctttccatcaaacaaaatcagttagctgtaaattcaaaagaacaatggtaatctgtgattgcctgattacagcaaagtacaaacttttatacagaaataaatcacagatacccccccctgttcttttcaccagatgttcagaacacccatcttttctgtttacaaacttatcataaaagaaacgaatgtaagttcagtttgttgcctgcacagtaacgcaagcatggatagttaatatccacattatattgaatgaatgcagcttcaatcatcagatatttcatgtcttggattgagagcattgtgaatcttgagactaatcatgttcttctgaactcctcatgaatgagcagactacccttccggtaaatgagttaaccaagtcactccggaagacaggctatgatgtaatgccatcagacgatgctggtcggttcgtatgcaactatgtgtattatcactctcttcggtttgcagagcaacacggcatcaaatctctgtttgtacatgtgcccctgttcttgacgatcgatgaggaggtccagatgcattttgttgcttcccttctcgaagctctatcttgaattaggaagaaaaatacaatttaaggttggaagcggactgaataaaattgtattgtcatcgatgatattggtcttgctccaacgggtgtatttaaggggaaatggctgcttagagtgtgttcttggtgaaattccacttgtatgtatgccactacataacatgatctaaacatgcatgggaacttggttttcagatgctgcggttccatcctgcttttgcatttctgatgccaatacgttggtggatcgtcagtaaacaacgcatgcacccgtcacttcaaacttcgtatatttgtcattattttcttctccattttgctttgatagaaacaggagcaacatttcttcgtcttttgcttcagctttcaccgattgtgttcagtcgtttgatgctaactaaactcctcaaagaatcagctttgccttttggtcagacaaagaagcgagatcagtgcctccttgaattcagttcaggttcaggttcagggttcaggcatcagaaattcagaatctccagaacaatttgctgcagcagagccgttctgacgttcttccgaaacaaaaaattctactatataaatgtgaatatgatgttctaatctcaattttgaatgttatttatttaattctaaaattagtaattatcaaatgtaattgatatagtctttttttttaaaaaaaagctattccattaaaaaacaatttatttactattaatattaatattataatgtttataatattaataatagtaccgaatattattgtttagtttggaactagcaaatatgatagtagctaaacattattatgtttctaaaataaaaatatttttcttgcaaaaaggaatacaataaaaaatatttgataaacatgttgggttaaagatgtgggcctaaaattgaagataagtgtgctagatttttgtttccgtataactattcgaaaattatccggatagtttccggttgttttctgtttctgaaaaaaaatccaaattaatttctgcttcataaactatttagaaaatacccaattgacacaatctatttctgaaaaaacatcgggatcacagaaactatccgaatcgtttttatatccctgcttcatactttctgaaaggacgtaactacgtagctagtggtagctgatttgtctaaaccagctaccactccatctataagaggcaccatccagctatatttcaaatacaattttctcttaaactacttatctgatctacgatccgattacaccgttg

SEQ ID NO: 51940 - DNA, 1757 bp, Oryza sativa
tgcgcatacaaatgcttatttgcatatatatgatacgttttcttatcctacaatactagtagatctcttaatttatactccctccatttcaaaatgtttgacaccattgactttttagcatatgtttgaccgttcgtcttattaaaaaaaattgtgaaatatgtaaaactatatgtgtacatgaaagcatatttaacaatgaatcaaatgatatgaaaagaataaataattacttaaattttttgaataaaacgaatggtcaaacacgtactaaaaagtcaacggtgtcaaacattttgaaacagagggagtaattaagagtttcgtattacttatgcagatgcttgagatatcataatttatgtactactgtataaacggagtcgtcctctagagtaaatttgaaaatatactgttttttttagttttttcacagtaatattcgggatgcaaaaacttgtgcagaaatataccgtcggtgtcgcacaaccattgcgcgaaaatgacgtgggaatgacgtcgtggacgatatcacgaggtgaccgcgcgagaccgcgcggtctcgcgcagcaatggtgcgagactgcgtggtctcgcggaatggcacagccacatcgtccagcgcccctgaagcaatcagcgaccctgtcgaataggctccatttgagtagtaattaattacttaattaacaattaactaataataattagcggttaattatcctgattagcgattaattaatcgctaattaaatcggccagtcacggtatcgcagcttgcaagagcgatagcgctgcttgcttgagcggtctcgctgcttgcttgagcgagaccgcgctgtctcgcgtcatcatcgcgcgataccgcgcggtttcgcacttccactgcgtgataccgaccacaacgtcatttccacatcattttcgcgcaacggttgcgtgagaccggtagtatatttgtgcaaaagattttacatcccgaatatttctaacaaaaaattgaatgaacaatatattttcaaatttaattcgtcgtcctctttccaaccatcatacttatgctgttcccatgctaaaaaaaaacacacattcaaaaaactcgtgttctaacaagtaaaacgaaaaaaagaaagaccatgtaaaacctttcgtcaatctccatcccagatcccgatgtaacacacaagcttggcactaatttagtactataagttttcgtattttttgtcttgatacttaaaaaacaggatgtataccaattgagaagtgcttctatgctccttgaaaaaaacctgcatggaaattaaagcacatcaatggttcggattaaaaggtgattactagtgtaaaccgtcattagcaaagggcaatttcgaccaggaagtaaaagcccacatccagcccaggccgatcgatccatcgatctgggaggtcgacacggcaacagggctagatggtgaagatcaccagatcggccgggcatgtgcgaggaatgggagggcgacgagctgtgagggctattgtcgacttgtcgtcgttgcgctcggcgttgagacagattatacagtatgacgagatataggaccagttctcgaagggcagtgtggtgtggaagcggcagaccagatggagaatggccgcatcctctacggcggcggccgtccatgatgactcaaactcctgcatggtagaatacccgcttcttgtacctagtgaaacctagatagaaatcccaacgattctcctattttttgatt

SEQ ID NO: 51941 - DNA, 16496 bp, Oryza sativa
  unsure (1)..(16496): unsure at all n locations
caaccgggagtaaaaataattggggtctgtcttgaaccccacaacttcttgaaccgggattaaaaatgatctttagttccggttggtaacaccaatcgggactaaagattaaaaagtacccctcaacttttaaactgggactaaagatgctttttagtcccggtttttattagaaccgggactattgtggaatttggccgaccgaccaaaaatgatttctccaccagtgatacctttaaatcgaatggaaccgacttatagtgacaatcggtatgatgcaaggctccgctttcagtagtatgtgtgcttgtgtggttgacacttggttcctggacatgtaccccggtgcacaatcagcctaaatagtcctatgctgcgtctcttgtaaccattttccccttaatcttaataacatttgcattaccctctcctatggccatccgccaactcaaatgaaacactaacattcgatgacaaaaagacttatgtataaacttattgtagaataaccagcctatatgatgtaattgtggtacacctattaaacacccctacatattattgccacatagaaacaccaaaaaaaaaagactataccaacaccaaaagttgattttttttcacggaagccaactactagctccaaattacctagagtcaacttaaagctaactcatacaataattacctataaacatatactacattattaatatatggtcccacctttcatacatattgtgtcttgtaatccgtgctacagctggctacaaatatgtagcccgctgctcttctctctcctcttttatcttctcaatatgggtttatagctggcttatagtctgctattgtactgctcttagtttatataccaagcacggtaataaaactcggtagtaaaactcgtttatactcaaagaacatcttcaaaaattaacgttgctgtgcctgtaatcaagtagtgatcatgaattcatgatcagcccatgtacggttcaagattaagcacacgtagaagtgagaaaatcataattaaataagttttaattattataaacttaaaaaaagatttataagatattttgaaaaatacatgaaattcatccgtttgaaaaacgtgctatcgagatgaaataacggggacatgtcttgtaactcaaattttcctggcataaaaaacccttgcatttgaagcttaattaattagcctaatcaaacggcttaattacgctaatgtttccacacgagctaaccgaaacaaaaactgccacagcgaacaaaaaaaaacttttacgagttttcaaaagttttttcccctgaacgaagtgtataatttacactgtactagccctgcagaaatcaatcaaaattaatacttcctctaaaaacaatcaaatttctaaaaggaaaaaaaaaatcccccgtctctccattcccaatctggacgaggtgaaggctgtcactcggggcccaccggtcgcgtgtgtccggaccgccagctggcacacagcccccggcgcacgtgacgaggcggcccccggcgtccgacacgtgtcgtttcgcacgtgcgctccgtccgggcccaccacgcccacctcccccccgatctaatccgacgcggacgggtgcaaccccccgccgtccgatcgcgatcgtacggctccacgcgcgcggcgcaagtggatagaggcgcgaggccagcgtggtcatttcgctttcgcagataagatcgtggggagtgtctgtgagtacggcgaccgtgagtggatgttttgcggctaaccccctgaggtttcctctaattatgttctaacggatgagattatccgtaagagagattttattttgtttttttttgcgtgtgatttggtgtttagataagatcaagagagaggcatcgttggtgtgagtgacgcactcacgcacgtcattatcgtccaggacatactccccctcctgttacgttttggaaagaaagaaagaatatatgtttgacaatctatgttttttttattataatatatataataaattatttttttatttatggtagttttttttaaaaacaaatttatgtatattgttttaaagtctttaaactaaatagttttaaagttgttgatagtcaaagttagaaaaaataactttaatcctattcaaaacgctaaaaataataaaatcggaggagtatataataagatcttgagattttttttctcttttgcttaacgatgttgctatcgagggaggaaagtagtgcagctgaaaggtgtttaaatccggattaagaaagtcaaggagttcctaccggaaaagcaatgttttgatagtcattatatcaggcgtggttagtacataagtacactgggacttcatgaagaagcagctgggtgctggattttctttgctaattcacgggtaaaagtggaggatgaaaatttggattttcatggcacacttttcaaactgctaaacggtgcgtttcgtgcaaaaattttcaatatgaaagttgctctaaaataccatattaatctatttttcaaatttgtaataattaaaactcaccaatcatacgttaataccacctcattttacgtaaaaaacttaatcttcatcttcatcttcaggagaaatgaacaccgcctaaatcactataaattaaaattactcttatatagggatgtattggtaatgccatgtatttataatatcgtagttatacttttccttctttttttaaaaaaaaaacttttccttgaatctgcccctgttgattccttgtatgtttgaggacaagtgaggttcaaaatccatgatctcatcttaccacaattttacttttagattgattaatttccaagcatgaaatttatttcatgagatcctagaggggatttgactcgtagcaacccttccttctgatgtaaaaagcacaatagtgtttgattttgtctctcatgtttagatggctttggtcaatgtcatccaacagaaaataatagtttcgcagcctcatcgtttggcatattggaggaaaaaacgaaacgacatatttgtaaatgaaaaaataatttgtgaataaaacttttatatatgtgttcttaatgatctaaaagtaaagattgaaaaataaagtataatgaaaaaaaaaccccaaaattaactgtacatatataaggttaaaattttaaattttagcttataaacataaagaaataagatgaggctgtcggtaaccaacgaagcccggttacctggagaagtccattccaattggacgagtaatctccttgggcttttatttctccattttgcctttggcattttgagtgttcacttcgaatttacgttccataagtattacttttcatttagtattctttttcttcttacgtataatttccttacaatgtattggtgtgttgtaagtatcaactctaccaaagtatgaaaacatgacattaattaatttttgacatagacgttaacggttttttaatctcattcaattcatttatgttttaattttatgtctttcagttagctctattcttaatactagttagctctattcttgatactttatgcttttacaagaggagcataataccatacgcagtggagctgcattcttggagtcggtagccaggggtctattttttcactttggctaacatagttcctataaaatattgttatagattctacgcgttttctttttacttcatccgtttcataatgtaagactttctagtagtgaacgtattcatataggtgttaagtatatatgactagatttattaacactcatatgaatatgggcactgctagaaagtcttataatatgaaacggagggagttgtatttttgctgcatatgatcaataaaaaaataggggtttttccatatccttgagtttttttatttataatgagatataaatcatttccattatatataaaaaatacacccacgatctaaggctgccgcttaaatatcttaaaaaaacgtggttttatttgtagagtgcaggaaatgcaatttgacaactataagccggcaagaaaatattaacattggatcggcagtttgggagtagcaaacaacgcttaattatataagtactgtactactactaatcatcaacgccttcttcgtcctaaaaaagtattaggacataaacgcggggtgttctccgcaaaatgtgattattttaatcggtgttgcgccagaggccgcgtcttgagcttgctctctctctctatcactctgctcagctcaagtagccagctcgaacaagaagaagaggagaaaaaaatcgcgcagcttctctccctctctcttacttatagcagcagcagatccgcctcccgaaacccagctctttgtgatcctcaagagccgcctccaacccccaatccacgcgcgacccaagaatccgagaaatttttctgtccagaataagagggtttggtttgattttgggagctccagttgttttcttctcctccttcttcttcttcttctttcttgcaatttgaggaggtttgctctggtttggtttggttctttgttgttgctgccgctgccgcggcgaatggtggcgacgcgaggaagggaatgggttcgttctcctgcgccgcgggcgatctgtcgtgtcgagatagtggcgcgccctgacctgagagatgtttgttcttgttgatttttgtgtgtttgtttgactgaaaggtgctcgtccttttcggaaagtgagggggtttgttcttatttctggttcttgattattattaggattagtttgttcctttgtgtgattcgattccttgccgcgccaaatcttggtttgagatttttctcttttccttttctctctcttggattggatcctttgcctccctcgccgcccattcctccgtgcgatttgagtacttcttggagtgagttcttggtgagtgagatcgagtactttgaggaggatctagaggagatggtttcgagatcctactccaacttgctggagctcgccgccggcggaggaggaggaggcggcggcgaagggccgctgccgtcgctggggcggcgacggattccgcgggtggtgacggcgtcgggcattgtcccggacctggactactccgacgacgacgcggcgtcggcggcgtcgtcgtccgaccactccttccgcccactcccacgcgccgcgcgagcgcgccatcatcgtcgccaaccagctgcccatccgcgcgtctcgccgcggcggcggcggcggcgggtgggagttctcctgggacgaggacagcctcctcctgcagctcagggacagcctccgcgcccacgccgaccgcgccgacgacatggagttcgtctacgtcggcggcctccgcgacgacgtgcccgcggcggagcacgacgaggtggcgcaccacctcctcgagggcttccgctgcgtgcccaccttcctccccgccgacctccggtcgcggttctaccacggattctgcaagcagcagctgtggccactgttccattacatgctcccgctgtcgccggagctcggcggccgcttcgaccgcgcgctgtggcaggcgtacgtgtccgtcaacaagatcttcgccgacaagatactggaggtgatcagccccgacgaggactacgtctgggtgcacgactaccatctcatgatcttgccgacgttcctgcggaagcggttcaaccgcgtcaagctcggcttcttcctccacagcccgttcccgtcgtcggagatctacaagaccctgcccgtccgcgaggagctgctccggtcgctcctgaacgccgatttgatcgggttccacaccttcgattatgccaggcatttcctgtcctgctgtggaaggatgctcgggttgaagtatgagtcgcagaggggctacattgcgctggagtattatggtcggacggttaccatcaagatattgccggtgggagttcatttggagcagctgcggtcggtgctcaatcttccggagacgggggtcaaggtggccgagcttctcaagcaattctgcgatcagaaccggctgatgttgcttggcgtagatgatatggacatctttaaaggaattagcttgaagcttttggcatttgagcagctcctgatgcaacatcccgaatggcgaggaagggtggttctagtacagattgccaatccagcgaggggacgggggaaagatgtgaaagaggtgcaggatgagagctatgcaatggtgaggcgtatcaatgaggcatttgggcagccaggttaccagccggttatattgatcgatcggccacttcagttctatgagagaatggcttactatgttgtcgctgagtgctgcctggtgaccgcagtgagagatggcatgaatcttatcccgtatgagtatgtaattgctaggcagggcaatgaaaaactagacgggatcttaggtcttggcccatcggcacggaagaagagcatgcttgttgtgtcagagttcatcggctgttcaccttccctaagtggtgcgattcgggtaaacccttggaacatcgatgctgtggctgatgcaatggactctgctttagagatgcctgaaggggagaaggtgctgagacatgagaagcaccacaaatatgtgagcacacatgatgttggatactgggcaaacagcttcttgcaagatctggagaggacttgtctggaccatagcaggaggcgttgttgggggataggattcgggctaaggtttagggttgtagcccttgatccaaacttcaagaagcttgcagttgagcaccttgtctcagcctaccggaggacgaccacgcgaatcattcttttggactatgacgggacgctgatgcctcaaacatcatttggtaagagcccaagctctaaaacgatagatatgctgaacagcctgtcccgtgatcagaacaacatggtcttccttgtgagcacaaagaagcggtcgactctagaagaatggttctcatcatgcgacaacctaggcttagctgctgagcatggatactttctcaggtaattattttctctattttacgtaaattcataatcaatgagccaatgacatcaactttattattggactaaaatcagtatgattttgtacttctcattgaattccaactgaacactaatttacacttgtaactgctgtaggctgaagagagatgcagaatgggagacgtgtgtcccagtgacagacagaagctggaagcaaatcgcagagcctgtgatgaaaacatacaccgagacaacagatgggtcaacaattgaggacaaggagaccgcgatagtgtggagctacgaggatgctgatcctgattttggatcttgccaagccaaggagctccatgaccatctggagagtgtccttgcaaatgagccagttacagtaaaagctggcctgaaccatgtcgaggtgaagccacaggtaagctggctcacagcaaagctgtgctgttacctcactagtgttaacatgacccatttctggtacctaagttttaaaccttgaactgttctacagggtgtaagcaagggccttgtggcaaaacggcttttgtcgataatacgggagaacagcctccttccggactttgtcctctgcatcggtgatgaccgctccgatgaagacatgttcgaggtgatcaccactgcagcacaggacaactgcctaagcccagacgccgaggtcttcgcctgcaccgttggtcgcaagcccagcaaggccaagtactacctggatgacctggccgacattgtgaggctgatccagggcctcgccaatgtctctgacgagatgcacagcacaatgcccacacctgtcgacgccgcagacaccgccctgaggtgaaaacacacctgccccagctccacccccaataaggcatgccatcttggaagaagggatcatcgatcgctgctccccccaggtgtacatactcgaagggatgcaacaaaaatgcaatcaaaacacatcatccaccatcttcatccctgcgtgttttcgcatcaaaataccaaacctttcaccggtgtgtacagaaactcggccgagaaattaaccccccccccccccatgttcttctatcaaaaactcagatccatctcaccatcacagtcagatcaggctccaaagtttggccgggatgaatccgcaaccactggagccggagccactccttttgctggcatggtgcaggtgtcaaatggttggtgcgtactaccctttggtggaggcgctaattatttcatcttctttctttcttttctttcgggctcgtgctgtactgtgcccatgtactgctgctgcacattgctgtggggctttggattggattaggtctcttccgttccagcttgtgtggtagcagcagtagttcttgctgccaatgatggatggcaatagtggaggcttgtgtttttcttggtgttatgccgtttgggggttaaaaaacaaagaggctatgatcatgctggtgatgagataaggctataatgctgtctatgttgaattgtagtaaccggctgtaaagagattaatgtgttcctggctgaattgagcaaaaaaaacatttcttcgtctgctccggctgggctaatcatcttctgatctctccgttctgtttgtgtttagttggccaacgtgatatgatgatggattttgatttttgacactaatgctggtcattcctcattttgtagtagcatttagttttctgaaccttggcgatgatactcccttaattcaacaatatatcaatctaatattggataggatacagcgtaattctacgaatctaatatagataatcctttatctagattcataagattggaatgtgttccatccatatcccttttttttcttggaggaggatgcagttttacttcctatttcatggcttctcaacaaccattagttgcgtcattttctagcttaattagggctccgtttgatatttcagttttaaacgcatgtgtaaggcatgcagcgtcgactacactagtggctaccccaagctttgtgtagggtaagataaggactggcttgtgaaaggattaggttaggtctacctgatcctatttttgtttctctccttttcttatctttttgaaatggataggtcgaacctgatataatgatcttgttcatttgctggggtaagggattgttcggtgaaaggattttttttttcatccttctttgaggaatagggtagctgtccatctgtcatttgtcgaagagatataatgtcatcaatttgtatactctcctgttgaagcttcagccaaatggaagcaaaggcagtttggcccttgccatccatgaggagtcttctggtgacagtaattcgcaaaaggctcaccagtaatttggcaaatggctatgcaaagggcttgctcagatacacaaaagttgatggcaaactgttgaactttagagtatattatctttattttttcatgctggcattgtccaatccttgacaacctattatcccctcataaacccataagtttggtaaaaaccataggacttgtgtctgtatttcatttatttgtttagcagcacaggcagatttcacttcaataggagaaagtatatataatccacagattttcgcacaatggacagatgccatgtttatatttcttctggactatgtataaactctacaatgattacatgaaacttttcaaatgttacaacatctgaaatgagattgttgttacaggcataaaacaagaattctaccttaaaagtataagagcatacagcactttggtcaacttgcatgtgtgtatctaaaaaatatatgttgcacatggtaaactgtggactgtggtagcattttactcaaaaaaaaaaagaaaacaaaaaatcgatgtacctgggggactactctataaggctctgtagcagcatctagttccatatcttgacttgagaaaaggctaaataatctgaaccgaactttacactagcatcatctctagtcttatgggtgcatactatcatcttgaaattgtcgactgcttccatatgggtggccagaagttccataattaaatgctacgctaaaacagcttctgtatagaggagctcattccacatatctgtgctatctgtgcagaacaccaaaggaactcttcggattgtgtaaaaaaaaaaatcccctcactgaagtgcagcactaaatctgtgcaaagaggagctcattccacatatctggtataccaggaaggcaccagtgcaagcaatcgttaatccctgttgaagctctacctttgaaagtagaattggatatatgcccctcatctcgtagctgtgaaacagcagttatatccaaaatcttaacccgagttccattcacagcactctccacaggtaagtcgcttgaatgatcctgcaatacctcacttccgttagacaagggaacggtattgccacagcttcccccagtattccagtcaccatttacaaaatgcctgggtgatattgtcctcaggaaagctttcacttgaggatatcgcacaagttctgaatccacccatctggcaatgctgtacaatgtaagattttttgcacggttcagatctgcaagtctacctttgcctacaggtttcccatcagcgtacagttcccagtgatttccattgaacttccctctgttccagtgatgacctgtgttaagtactaacacatcaaaactgtggagatacttcttcaaaaatgtaactggacgatcaagatgcaatgcataggatgtcactgaatctgttgtattcagaagttccagttcagatagactagcagaccagtagaaaaggattgtggaattagtccctggaaaccagtaagcccatccgtcaggtcttaaagcacctggagctttaactaggccatatttccatccaacatcttcaacttctgggctgtatttaccacctgtagctatacacatcatggactgaaattgctgtctaccaagagaatcaccaacaaaagcaagagttttatgcctcaacctgcaagcctcggaaaatgctaaaataagtccagtccttaaggagatccagacgaaaaggaaaattgaagtaaaataccttttcaaaatgttaggccccgtaaactcaggcatctgacatccatgcggctgccaccgaaaattctcgtaagagaaatctgcgcgttgcatcattcgacaagcccacattttcgatagccactgtttgcactcattgccagaatagagtggccgcttcttgtctgccacccattttccctttgcataattgcaatctataaggtaagaagaagattttatcaaaatggaagataatcttcagttgttaaaacaaaagttgataaatgccatttttagaaaaaaaatcactgtcattaggaattgcttccagtaaatgagataaaaataagcatataagtcagtagtgcaaaaatgacaaatgcagtgttaaactcattagaagatcacacaagcaattaaaattactttcgttctgtctggctgtactatcttcaagatgttcctgctcctgctgctgtaggaaacctgatgtcagaagggccatacaacaaacatgtgagcaaacatagcatagggtaacatctacatttcaaggggggaaaaaactaagggaagggtggcgcaccttgagataaaactttcaatttttctggcgttgagctgaagattgtgaggactggagcttcttccagtgacatgataacaatcagggcagtgaggagagccgcgaagccgaggcatagtttactgacaagaggtctctgtagacaaccacctttcatcctacaaaggtcttatgtacaaaatctcggcaaggtagcataggacttcagtggtctcctccaaaggaactcagataccgctctaaatcgatagcaccaacatcacacctgcaaatgcagatgaaccaataaataaggtccatgcctgaaaacagttcatacaagattggcaaacgcacgatgcatggaaatagaaaacaccaagagttaagcagtaaaccgcaagctaagaatgaaattgttcttcccccatttagaccaactacaagatataaatgatattcatcagggcataaatgctatataattcaaaacgtggaaacagcccaaactgatctacagtaacatgatcaaaagataagcagttcagatcaatctttctccggcatttgcgaccaatcatacagccaatgagggagccagtggtgtacccaagactaagcctctttttgctaattgaacaatgagtattaaaaaaaatagcgaccaagtctatccaccattggtattctctgctaagcgagaaactaaatctccaaaacgcggggcgcaaaatcgagatggcgtgtacgaatcgcttcagttttgatccaccaacccccaaaatccagaccccgggcattgcgtccaccggcgccgccgagcgccgacgcgggggaacacaagccgatctagctagctcgaccgcaacgctcccgatagatccaccagcggatcgcccgccgctccgcgggcgggacacgcgaaaccagcacggggccctgcctgcgctccgcacgtggaacagaagaggaatggtggtgggggaagagaaaacgaaccggcaaacccagcaagacgaaacgggggcaggcgccgcgcgtagcagcgccggtagccgctcttctcggccgccgccgccgctgccggcggcgagggaagagagggggagagtgtgtgtgaggcgagaaatccggttcgcccggagacgacgggctggaattggattcggcggtgtcggtgacgcattgcccttttcctttctctcactattcaaaaaccaactatgataaatacaaaacgaaaaacccacataaaataaaatataatgtttttataatgaatttgacatgcatcgtaataggaaatactattttatcataggagacgtcatttctatatgtcctataataagtttatttttaagcttcatttcatttgtctcaaaagaaatttattttaatttagagtaatcattacaatagagtttgtgaaaatagataactgtattcagagtagatgaagtcagaaataatcgcattgcgatttgataaagtagagatattataatctttgtgggttttttattggtatgtgtgaaatgggtgaagaattaatctttgtggttttttattggtacgtgtgaaatgggtgaagaattaacttattttaggtagaggtagtaactctaaacttttaatttcttattttccattaacaggtttttaaaattaaataaatttattatttaaatctataatatttaattaattactccttccataaaaaaaccaacttctatccatcaatttgaacataggcgaaagttagttttttatgagacggacggaatatgtgctaatgagcttccttcgctggaaatctctctcaaacaagagggaacaaacacaacatgattatctcaatttgctgtctaacacttttttcaaattactaaatggtatatttcttactaaaactattatatagagattgttttaaaatctgagataaatcaatttttcaagttccaaataaatgaaacccaattaatcagcatgccttaattgttttttcgttttaatattcatctttgtcactaccgaacggggtagtagtagtagttacgaatgcttgtttgaggagtaagttcacgatttcgttcgtattccttcgcctaaattttgatattccctaaacagctcggtcctgtcgaattatgaataaaactcacagaaatttcgcaaatttcatttgtaagcaacgaaattcgtagtctcgcagatgaatccacttacagccagctttgcatcttttttggtcactcctagctttgcttcagaacgccgaagacgatcactgccaccaagaatcagatcacggtaggcttaagcaaagtaatcaaaactgtttaaaaataaaacgagaatgttcgtttcttgcaacgtgagcaatgcttcgcttgctccaagagccaaaatgatcacatcctgttctaccctacctaacgccgcaaagcaaagcatttattccatagttgtttgtacccttttcaaccaacacatgagtcagctgcttctcttgtcccttcccttccagcctaccgactacttctttttacttatcttgtaagccaaaatttaaattttaaaccttaaatttaaagttgattttagggtttttttattgtagtttatttttcagcctttacttttgattactaagaacacatataaaaaaaatttattcgaacgcaaaataggtagagcggttgactgggcccccgtgtcgctctagggacagggggcgacatgggtggcgaccaccaccgccttcctccctcctccgcctcgccaccgcccgagtagaccaccggaaaccgcgcggctgcgaggaaggcggcggcagggccttccttctccctcgagggcgcaggtcggtgcccacaaccccgaccagttgggggtggcgacggtgcggcagcatcggcgtcgacgtcgggggcgtcagcgtcggggcgtcgggctaggcgcgcggaggcgaccgggtgggaagggagatggcaggcggcgggaaaggtggagcagcggcaacgactctccctcgcgtcgcctctccagatctaggctgggggcgtggttggcgccagggcggcgcggagaccggcaggcaggggcggcgtcgcggtgggcgggcgtcggcagcggcggctcgctcccgtcgtggtcgcggcgccaccgtcggcctctgtcaagcgtgttggcttcagtaatgctgcggcggcgcgccctagctagtcatcaaccccgtacctggctggatctagccgtccgcggccagatccgtcgcctccacaccggatggcagctggtcggtggggcggctgcgtgtggactccagcaagcgcggcggcggctcgctggcggccagctcctgctcggcatggggcttctactgccattggtggatctcgtcgtcgttgatgggcggcgatgtgtggatgtggagttggtgggatgacgacttgtgctggcgtgaagcaggaatggggcttgacgtccgtgacggtgacttcttcattgtcggccgagtgttctccctcccttcggtttcccccttctttggccggacccttttcttgtcgtggggaatgctagggggagggtggaggcttcggcttactgtagaagtttacggcggatggatggcgtttcgagggtggcaaagggtccgtctttgccgttggttacaatcaaggtatgattgcttgtgaggcgttatggactattttgcggccatcgatgtgggggtgcttgtgtgggtgatgtgaagatgctggcgaaatccttgccgtgcttttggccggttcgacaacgacggcgtccgtgggtgtcttttccctccttggaggcattgtcatggcgctctttcatatccccacaaatctccttttttaaaccttgttccgannnncggacgagcggcggcggcgncacgcgtcgngtcctccttgggggcgtcgcttctgagaagttccaatgcatcgatgaccgccgatggtccttttcggttcaaaagctttcatatcttgtgttcggcgaggcttcgccttcttgggtccgcttctttcttatggtgggcgacatgctcttcggttgtttctgctgatgaagtcgaagctgctcgctgatgggggtgcggcgacgcttggcaacgatgacatgttgcagtctcttctaagaagttctggtgcaggccgtgtgaaggaagtggctcctcggtggcttggttgatgtctattgctagatgttggagccccttttcgctttggcgactttcgtcttcagtgtcgttgtggttgtgaagttggcgctgctaggtagctggggcggctagctcggcaacgataacacctcttctgtaatgtgaaagctgttgtgtcgcttttgtgtttagcttggtagcgacgtcctacgattgggctccgccgtcgttgttagttgtgtagtggtgggtttgtaattaaccgtgcagttgtatggttttcggacccggttttccttataaactgggtcaattctcttcttctaaatataaaagtggaactaagttccgcctcaggtttcaaaaggaaaaaattattcacaaattattttttatttgcaaacatgctgtttagcgtattcacgatggagccgcaattcagtcggcagcagctgtcagggttatttccactttccacaatgaaaatagttttaaccatgggcaatcattttaagcatatggcttccaaacttggcaatttagcatttggacaacggcttccacaaccacaaacaccaagtttaaaagttgctcgatccagtgaga

SEQ ID NO: 51942 - DNA, 11308 bp, Oryza sativa
gtcaggtcatcagtattagtaactagatcaacacaaacacgcaaagaaagaagcttcatcagtgcatccaaatcgtcagctatgagcaaatcaaagattttttccattgtctaaaaagaaatgaacaaaatcaatggtgccattcctcatggcaggttctagaggaggttgctgatgcatcactgtccagcaataaaaacctgatgtgcatagtgatggtgctttgccaaattgggcatgagaattccaaagcatcgatcagatcatcaactgttgcagtgttcaagcaatttagaatgcactgtagaaaggaacgatggaaaggcatgtagcccctgagtggcactttgccttctcaacgaattctagcagtccaacggtgaagttgagagactcaccgtcttttgagaaccacatcaatcttgagtggttactaaaggatgtgctaaattctaggtggctgtgcatccaataaggaagaaactagaaaaggctgtagcagaaaaatggcactgaaaacgaactgaactttagatatacggtgaatgaatatccatagagttaaaaaatgaccaagtctaaactggaccaaacagttgcaagagctacggcgatgtttatagctttgtttgttttaatataaggaatgaaatgctttgttacacttcctgaaactgtttcatcctaagattgtgtgatcatgacagaaaatgcagtaaattgccaaacatttttctacctattatattaccaatttgtaactggaaagaagttgattgcctgagcatgtgcttaataattaacgaataattagtgtcttctgatgacacatgactgggaccaactgcacaaatcccctttacaggcaagtgctcttgtttttgtttaaagaaatgaagaccacttcctttctcccaatcacccacaagttccacagagtgataaaccaggaaagcttgcattagatctccatttggttgtgaagcataaaggagagaaccataaaggggctaaaaaggcttcaacgagtttgtgctcgaagaatatgctaagtagatccttcccagcgcgagcctacaaaaggcctagcaatgctaatccattacatcctgcagcatcaccatctgaggcaagactcacagaaggtctagcattcccttgtcatggccttcctcgtcgtctgttggtctcaaatccgttccatggcgaccgtgcgtcagagaagccatggctgacagaaggtccgcagcctgaaggaacgttgcatctgaaaagcctccggcgcagagggcaaccgagcatctttggcagtctcctatgtctccttgaatcgattataggtagtacggcatctccggaattcatctattcatcggaagttctatgctgtagagtagtgatcagttgatcacctgttcaatctcttactatgatcctatttcttccaattgtatgtcaagtatatataaaagcctattcaaatgaataattctatgtctcttgtggtggttgagctctcggtgagatttccatggcatttcactaatatcgcggctatcacccacacaggataaacaggaatcgcacatctgcttttgttgattgctcatgaatttcgtacacattggatatacaccacacgaaagcatatcctcatatccttcttctagtctcaatttcattttaagacagtcgaattgaacatgagaaagcagcaaattaaacatccaaatcaccaattgcaacacagatatgtagttaattaacacatattgcacatatctccatatcgattggtgtttcatttattatcacataatttttgatactaaagaagctcacaatacaacagaaagggggggagaggaacttacccagcgaccatcaccaccggagcagctaggtcttactcggcggcggcggcggcggcgccttgggcttggagaagtcggagatgtcgctcctggagaaccacttctcccagttcctcccgtcggcgtgcctgtactcgacgtgcgccagggtgcccgggtcgacgcaggcggcggtgacggcgacgccgtcggggttggaccgcggggtgtagaaggaggtgatgccgcagaccctgcagaacgtgtgcttcgccgtgtgggtgccgaaggtgtaggtggtgagggactcgccggcgccggcggcgagggtgaacttggaggccgggacgacgaagtgggcgttcccgcgcatggcgcagtcggagcagttgcagatccacaccaccacgctcgccggcgcctccgcccgccaccgcacccgcccgcagtggcagccgccgctgtgcaccacgtccgccgccgccgccgcgctcatcgtcgccgtcgtcgcctcgtggaaagaggaaaagaaaaaagggaaaattcggagaagaaagaagcgggtgggattttctcgatgaacaactggtccacgtgggcgcgttgactagagtgagaccaaggcaagcagtggctgggcttttttgtgggccaagattgatatgggcttaatatatggactcgagttgactggcccatgggctcacactgatatgggcttactgagcactgggcctacggcccacaaaagcccatgaggcagcccaaccagctcgcgacctcgtcggcggcggagagagcaagcggccttcgtgcgggtggcggtggcggcggcgcggcgaggaaggcggcggagaggcaactgaggcgtggttgagggattctggcgtggagcagcgccgggggagagggtagaagcggcggcggcgccatggacatcgagtgccttgtgctaggtacccttcgtcgtcctccactcctctctctccctctccgcttctcgcacggatttgattgattgatgggaatgatgcgtggattgatggcgatggcgatggcgcaggggcggggtaggaggtagggaagagctgtgtggtggtcaccttcggcggtgagaagcgcgtcatgttcgactgcggcatgcacatgggccaccacgacaaccgccgctacccggacttcgaccgcagtggcacccgccgctgtgcaccacgtcctccgccgccgcgctcatcgtcgccgtcgtcgcctcgtggaaagagcaaaaaaaaattgggaaaattcggaggaggaagaagagggtgggattttctcgatgaacaattggtccacgtgggcgagttgactaggctccattcgtttccacttaaaaaaagtggattaagttttggatattcgtggcacgctttttaaaccgttaaacgatgtgttttgtgcaagaattttctatatgaaagttgttctaaaatatcagattaatccatttttcaagtttgcaataattaaaactcaattaatcttacgttattatcatctcgttttacgtgaaacacttaattttcacattcatctttatattcatcattgaatcccctgaagataaaaatgaatattaagtttttttttatgtaaaatgatgtggtattaacgtatattcgattgagctttaattattacaaatttgaaaaataaattaatatgatattttagagcaacttttatatataaagtttttcgcacgaaacgagccgtttatcagttgaaagcgtgccgcgaaaatcttagggcctgttcactttatgccaaaaaaaaccttactaaattttagtaataccaaaattttggcaacaacttgctaaaattttagtaggatttcttatataattactaaaatttgacaacaaactaaatgtagccacttttttagtaactttactaaaatttggtaaggttaaaaatggcttcaaagtgaacatgccgttaatcttcatccaactcttgtcggagaaaagaacgggactagagtgagaccaaagtaagcagcggctgggctttttggtgggccaagattgatatgggcttaatatgcagataaagcgtttgactgggctctgacaagcagggcccatgggctcacactgatatgggcttactgagaactgggccgaggcccacaaaagcccaactcttctagccggcaagcccaaccagccgcacgccctcctcggcggcgcggcgaggaaggcggcggagaggcaacggaggcgtggttgagggattccggcgtggagcggcgccgggagaggggagaagcggcggcggcggcggcggcggcatggccatcgagtgcctcgtgctaggtacccttcgtcctcctcgagttcctcttctcgcacgggttgattgatgggaaccacgcgtggattgatggcgatggcgcaggggcggggcaggaggtggggaagagctgcgtggtggtcaccttcggcggcgggaagcgcgtcatgttcgactgcggcatgcacatgggccaccgcgacagccgccgctacccggacttcgaccgcctcctcgccgacggcgccgccgactacaccgccgccatctcctgcgtcgtcatcacccacttgtgcgtctgccaaaaatcgaattgaattgaatcgaatttgatctgtagcagcatatccagtttgcttgcacggttaatagctttgtgaagtttgtgcgttgcagccatttggatcatatcggagcactgccgtacttcaccgaggtctgcggttaccacggtccagtttacatgacggtgagttgtaaccactaaccagttcatgtttatttgttcagtattatgattgcgcagctttggtgtatccgttccaggtagaatggggtttcattaaaaaaaaaggggctatagtgaggttgaatttcaaattaacttgtcataggttggatttttattcatcttagctatcaaatactaatatccattgagcttgtgagttgtggctgtcactgcagtacttaatagtggtcatggtcctgcgtaaatatgtttgatggtctaggggttcagtgaacttgttgatcttattgagatgatcttgtcaaagtatataatacgcaaaaggagatgtgctgtgaactgatattgtccatcggtagcatgtgaaagcttgatttctcttgctgagtgattgatcttcatctcataacttaaatcgttgtacctcaagcagtacccgacaaaggctttagctccattgatgctggaagactatcggaaagtaatggtagatcatagaggagaggaagagcaatatagctatgaagacatcctacgctgtatgaggaaaggtaaatgttctgtgttcacttttcacatatcttttactagtctacttagatattgtgctggcacacaggtatgcatgtacgatagttctcatttggttatttcattggacatttcagttataccattggacctgaagcagaccattcaagtagataaggacctttcgatccgtgcctattatgctggacatgtatgtgctgtatacttttctgtcccatattaactgcagtgttattttttaaattcttggaaaattaatattaatgttgttctgtactttcttaattagtcatcattcttccacatgcaaggttctaggggctgcaatgatatatgcaaaagttggagatgctgctattgtgtacactggagattacaatatgacaccagataggcaccttggagcagcgcaaattgatcgtctgaagttagatctgttgataacagagtatgctacaaattcaaattatagttatgctcttgtgcatcatgttttccttttgaaatgttgacccagtgatgtagttgtagacttgtagtgaatcattgccactcaggattaggttctttggtatgttttagcagtaattttgctgtcttgtttcttatagctcttttatcttttgtgtgcgcttgcgcgcgtgcttgtgtgtccattaactatctttatgatatcaggttttccacacagctacgtaccagtaaaccagtatccggtttctgttgttaacctctgctttgacctgtatgtagttggaaatctcctttgtagttaatgattaggtaggtgtattttgctaaatttttcttgtgatgtttcgttttaatataatccatatttggtttttatggaattatggtctaccttgttctgtactgttgtcttaatgttttaccaatacggaatttgaggtgcagttctttggtgtatctgttttatgttcaatgtgtaagtattaaactgaagttttatctgcagatcaacatatgctaaaactgtgcgtgactcgaagcatgcccgagagagggagttcttaaaagcagtatgaaacctgaaccttcacactaccaattttattggggctttttttatttggtttcttttgtaacacttatgcaatccccttggtgatgcaagatatgtgttacatttatcgatgctgatggttgggcttgtagcattgtgcaaacttaagtagttttgtacatttctatggcatgaatacctccagggagttcatgctcacaaaatactaagtacaacttgttattagccaagagtttatccctttttcaagttctgatacttgaatcatgttgattgtgttgacacattgaatctttataatctttacttgcaaatttctacttagtaaattcatcactttaatgagagcgtattttatctaggtccataagtgtgtttctggaggtggtaaagttctaattccagcatttgctcttggaagagcacaggtactcaccactcctctcttaattatatgtgatgatgcatttaatttaatggttaagagtaggatccttttggaaaaatgtcctttggagtatgctgtttgaaacttccataatcagaagtgatacactgctgtaatgtggaaaacaaattaagattgccttgaaactccgaaaggggcaaaatatagatgtagctatgaacagagtggcattttattgaacgcaatctccatagtgatattttatcaaagcctactttgtggagtggcatattaccaattttctcctctaatgtgtgtcaggagctatgcatactactggatgactattgggaaaggatgaacctgaagattcctatttatttctcagctggtatgtgtctttgtccaactttaacttgctttcatgtatttgtccactttatttattgttgtatttgtttgataggtttaaccattcaagccaacatgtactacaaaatgcttattggatggactagccaaaagatcaagaacagctacacagttcataacccatttgacttcaagcatggtatgtccttgaataaacatttcatttgaatcatatgtcgaatttcgtagagtgtatctgtttagggaaaacttataaacctgcagtatgttttccttttatttgtatataagaaactatgtggcatgcattcatgatgcaccttctttaatgagtgttgataatactgatattgaagatatatgccattggctcctacattgtactccctccgtcccagaatataagaagttttaaagttggacatggttattaaaaaagtaggtaaaagtgaatggtagagggttgtgattggatgagtagtagaggtaggtgggaaatgtgaatggtggagggttgtgattggttgggaagagattgttgatggagaagttgttatattttgggacaaatcctgatggctaaaaattgttatattttgggacggagggagtatctcttaaattagagttctaatgcacatcatttatgtttctgactttctgttatgtacagacagtactgaatattttttttcctcacgttgcagtttgccactttgagcgttctttcattaacaatcctggtccatgtgtgctttttgcaacacctggtatgattagtggtggattttcccttgaagtgtttaagaaatgggctccatcagaaaaaaatctggttacacttcctgggtattcctcttaactcttgtaatttattctttcttctatattttataatgttgtaagacattatatgtttgcttgctgaataaaatatttctgttggtactggagaagcctaatcagccttctggattccttggacaatttgacataaaagatggtgtttgcttggagttgaatgcttctttatcattcatatatgcatttttctgcttcaattgtgacttgtgatcaaattattattttttctcgtcctgtactaaaagatgaacaggaggaaaaaggaaaatttgactgctttcttaaaatttttatgcagtcatctttgtgttttttatatgaccttactttgttgttttcaatgtagatattgtgttgctggaaccattggccataagttgatgtctggaaaacctaccaggattgacatagacaaggacacccatattgatgtcagatgtcaggttgctccacttaatttttacttttgtgtaaaatgttgttttcatggatcaaggacgcaacaaacaactggttgcaagaagttgcacacttactgattactgtcggtggctatacgttctagtgttctgcttagtgcttaccatagaaattatatggtgccttgaatattatcctgacctttgtttatacaccttatatcataactaaagctaccttagtgctttattaaatgtccactattgtttagatcttgcttaaagtcagttctttcacctctgtttatcgtgcaatacgacttctcaaatttctgaattttactatattcaagttttagaatatttagctctagagtgaaaaacataatattagcaactttagatcctttaacatcttaaaattttcattttgcccctttgattatcttgcctacctgttcaagttcctattactaacctttgtatttctttactatactaagtttccctctttgtgcaacagatccatcaactgtcattcagtcctcatacagactcaaaggggatcatggatcttactgaatttctttctcccagtcatgtaattctagttcatggcgaaaaacctcagatggctttcttgaaggagcggatcgaatccgagttggggatgcaatgctgttacccagctaacaacgagaccgtctctattccgacatcccagaacttgaaaataaacgccacggagaagttcattgtgagcttctgcatggatgaaactgaaaatgatccgcagaagcagaacctgaattttggtggcgacatgccacaaggctgcaggactgaaggagtagctgagggcgttcttctgatggagaagtccaagactccgaagattttgcgcgaggacgagctgcttcactcgctgggcatggaaacgcattttgtccattttgaaccactgcatccgtccagcattgaggtaaaacatactggtgagtccgcggtgcagcagagcagtttagaacatttagactgcgagtgaaatgaatgaacaattcttcttttcaactactctcgactttggagacttttgagaggtatagccagaaggggaagagttgtgtagttagactgttggaaaaaaagaacacttttcatccgtcaattgttattttggtggattaaaccctagtcttttctcttttcttctggggcgtcaaccccaattctatattctttggaggtgcagcgggtgcttatcaaatctgtcacccccaattctatattctttggaggtgcttatcaaatctgtttcttaggctgaacatataattccaactttgataagtcttttatcgtggacgatcaaatgaactccaatgctagcgaaagaaaatttccagcaactaagttgaggaccaatgcccaatacacggactgatcaccattgaccacaattatgcatggttcacagcacactgtgagctttgcagctgacaattttcaccttaactaaacaaatacagattataaagagcgacggcgaaaacagcggagtacgaaattaacagtgcccgttgtcgaacaagacgatacctgcgcacgtcaaaagaaacacataatttttttaaaaaaggaagagcatgtgctcatatataatataaccagataaataaagttcaagcttacatttcggcagactctttatttttagcctcaaatacctctttggtttgtcgaagaatagaggaccattcttccatggtatcactgaactggtccaaagtcaacaagtagtccaggtcactttccttcttcttcttgagcaaataccttttgtatgctattacttcatccctgcagacctgtagtttctgggcgaatggaataaataaaacatgggtttgcatcagaatcatggtgttataccgatcatcacaacgttttactttccatcaaaagaatatatgggttagctcaaattagaggtcattaattaactcaagttacacttacaggtcatcaactcagaatatctcagcaggaatttgccatgattaatatatacccttccaataaagaatacaggtgaactcaaattataggtcatgaattcaatatgtttcttcataggaatttggcatatactaacataaattctaacatatcccttccaatatcaaactaataactttcactaataataataatctatttgcagattctgaatcatcggacgcaaggaagatattcgacacaagcgagataatttgaggtaccacttaagaaggttacttgtcattagccaattacatctaaagtcacttgtttttccccaaccattgcatctaagcattgtatagtcatcttttctttttctttttttttgtttttgccacagattcattaattttgtgctccttttcccctcatattggcgttgcatcttgcaagacagaaatatgtatgcatgtatatgtatgtacataaaagaaagaaaaaaatatccccagaggaaacgaagattataattaatcttgatggtttcaacacagtgagcgtactcggagcgcaaggccaaggcatcctccagacgaagcaactggaactgggtcgcattgggagtggaggaggagggcggtgtggtgttcttcgcggcgccatcggtggtgaggagacgcgagccgggctccaccggaggggcggccaagcgcggtggacggaatatcgaccgccgccgccggagctcgcgggcggcggatcggaggagcaacgacgacgaagccatcctccaccaccaagaaccgaagctcttctttcgattttgattacgccggtctaaataatcaggtatccgatacgtaccaggagggttcactgtataggtttagggcttttgatcaggggtcaccgaaatcccgaaatttcagaaatttcgatccgaaatttccaaaattt

SEQ ID NO: 51943 - DNA, 3475 bp, Oryza sativa
tagactaccagtactcagcagtgcgagttgtagccgcagccgatccgtgcggagagagagagagctctggtcgctactgccacggctgcagcggtcggagaaggaggtgggcacgacggtagcggcgacggcggccggctggggttgggactgggtacgttgtaggagcggagcttcttaccttggcaaaaaaaaaacttaaattttgatttgcagaaaaatatatgaatttcgaaggattttaattctatagaaaaatttcctatcaaaccctttaaaataaatgattaaatcatatccaatcctttgaaattcctatggaatggacaatcctataaagattttggtggaaacctcttggtaactttcttttgagtatatctctttcattcaattcctatgtttttccttgtggttcaatcaaacggtaattcctctgtttttcctgcattttataatcctctgttttacacttacattcctatattaaaatcctgcgttttttcctatttctacattttctcaatcctgctatttaagggctcctttgaatcgtagagttgaaaaaaatggaggaattgaaaaaaaaacacaggattctgataggaattgaagcataaaacagatgattgtaaaacacaagaaaaacattgaatgatcatttcattggactacagaaaaaacacaggaatcagatgagagagatagacttaaagaaaattttccaagaggttgaacctcttgctaagtttcttccaaaatccatatacaatacgtcattccgtaggaattcaagtttcaatcctttgaatcaaagggccaaataggaaattttcatatagaatttaaatcctatgaaatttctacataaatcttttgatttaaaggggccctaactctctatcaacaagttataattgtagaataaaaaacgaaatataagtaaaaagcatcagtttagattctcatgagttagctatcgaaaagctatttcacagaatattaatctcccaaacattttctctgggtgaaacgaaaagggacggcttgttttccaaatactttaccttatccactcatatgaaatttgagaaattgacactttacattatgaggattcctttgaaacaaacaaaaaactaacaataaaagaattttaatgcattggatttctgtacgagcaaaggaatatgtcttacttcgatatttttatggaatggaccgaagtgcatattttttagagaaaaactagcatgaggttcaatctcatgtttattattcctatatgacgcaaagttttacgtttttgatatgtgtcatccaaacattagttttggaagtctagtgtgtttttaatccctatggacattcaatgagtataatactttgttctcgtattttctttttctgtttttacaatcctagtatgctcatagaaaataattaaaaaaataaccgagtgctaatcattattcactcctaatattgtacatttaaaatagcactatcatctctctctgtcattttaggagtttcaaccaattttaatttatttttcacatctagccacacacacaaacaaataaacaaacaaaactaagagataatccattctatgcgattgacaaaacatgaattctataatatgccgctgacaaagctcagttctataatataccatcgaacaattagttttcttcctaacatgctatcgccgctagtcaacagttagtcaaattccgttaagagcaagaaaatatatattttacccctagggtatcatgcatcttcatcgatttcattggtcatgatccactatttcttctcatcgatgaaaaatagaaatacttgtcttttcatcatccaagattttttagtgcgacgtggcattgtgcaaaatctcaattttatcctaggtgtaaaatggtcatttttcctctcttaatggcgtttgactaacgacgatgacatataaggaagaaaataagttatttgatggtatattgtagaattgagttttatcggtggcatattgtagaacctacgctttatcgatggcataaaatggattgattcaatccttagagtgtgtttagttcacgtcaaaattggaagtttgattgaaattggaaaagttggaagtttgtgtgtaggaaagttttgatgtgataaaaaagttggaagtttgaacaaaaagtttggaactaaactcggccttaattaaaaccctcatccatttgtgatgttcttcttcgtacctcacaagtatggatatctgccatcaccccaccaccaactccgtacccttttggagtgaagaaagaacatgtggggccaaagaacatacatgtcaactaccctcataaccatctctacttttcgtggaaaggaaaaataatattgtgaggctataggacctatatgttagttagaaatatatataaaatttaagagataatgtataaaaagtaatgataatagtcggttaatgatcatttttagcaattaaaatcctgttacaacacacgagagtaagttattaggttggttgtagatgatctattaatttttaaaactggtagttgtcttatactatttttttatgaacgcgcaaaaggattgcacgtcaatatattagaatgaaagagtttttcttacacaatacaatcagccagatcggcttatgccaggggaagggagaaaaagcaaagcaaaatctgtctacggaggctaaactcaactccgatcagtaggaagggggcaaaacatgctaaactcccaagaaatctccaaaagcagcaacgccagttaaagaccacatatggccctctgagagaatggactccagaaccactgaaacagaagaatggactccagaaccactgagacaaaagagagcgcaaagtcgaaaaccctggagttccgttccttccacaattgccaagagaccaggagtaccagggagtccaagccgacacagagatgctcaggcaagtaggccctagaggatgatcaccagtcctggagccagctacctcgggggagggggtgggtaccctagccaggaagcgacaccacacggagccagacctaccgagcgaacacgcagtcgagaaggatatggttcgccgtctcaagatgctgagtgcaaaaggggtaggccgagtgactatcaatgccatgcttctagaggagatcggccgtccagtagcgctgctgaaatgcaaaccaaagaaagaccttgcatttagcaggactcttcgtgtgctagagaagatcagcacgtacaaatgagtgttgaccaaaaaagaacgcctggtatactgaacgcgccgagtagcactggtcactcatccaacgccaaacaagatgatccccgactcctggcgagagcttgtatgtgaagcaccacatcctacacaagaaggagctgggaaattaccgggacagtgagggcatcgcggatgtcagaaac

SEQ ID NO: 51944 - DNA, 4874 bp, Oryza sativa
gccccccatgagccgagtccgtatccgtccataggaaggcacgtcgcttcttgtcaatagctttaataacttagactggaaggccgattgccatagacacatggatcgcaatggaggagagaacaaactagaccaacacagagcggctagccagagtggtgagtcgtcccttccgtgggggagggggggggggagtcgatgggaagctttatccacaagcggttgcagggctgccttcaacaacatgcgaacagacaacgtaatgccgaggtaggtgtaaggaaagtcaaaaatcgagcaggaaagcaggactgaaccaactccaggtcctcagccgagcaacgcatcagagtaatcaagcatttggcaaagctgatgcgcaacccggacgctgcaccaaagacagaaaggatgccctggatgcacaatatacatacatacgagttgttacattagaggatgagtttccaatcgaaaatctatatatacataaggcttccgacaattttttttcgtccgtgcgttttttttcgccgttttccttttttttccgtgtctttttcggttttattcccatctgcttcttttcatgggttggcatggctgttgggcccgaggatggtggcccaagaaggaggaaaggaagagaggtggctgctgggcccaagtggagatagggatgacggccaagaggaagggatggcagcccaagagggaggagaagaagaatgggccagatttgacctagacttaggagagggcttttagtttgtttttactttaaattaattattaaaattatatttgtattattaaaattagcaattgagctttgaaaaattcaaaacaattctagatagtgtggttcattcatgaagaatttaataaaaatatatttagtattttattttaataataacatgttatttaattctaattctaatatatacctctatacctaataaaaaaatatgtaaggattttgggtgatccgtttaattgtcgggtcaaaaccgtggttgatatagtatatgtatcttccatgtaatcacctctctctcctttttacacctatattacttgcactgtgtctataggcctctcggaataagtctacctttttatgggcctctcctggaataagtctacttttcctccctcctgtcaaatcatatttgcgcgcaattttttttttctctaccactagcacggaccatgcacatccggttgatgaaaaatcaaaactatagtacctctttcttcaacaaattttttgttgattataaaatcttataatgaacccgtttttaatttaaaaattaaagttaattatattatgtgcacaaaaatcctaattgcagctcatgatcttttaaaaagtatatattcaagcaaattcccacggtgaatctcaccttaactaaaccgtataacaacaataagattaaaatacatttcatccgttacaacgtatgggtattttttctagtaatatagatatgacattgttgtccgactcctgtgtacgaccaaagcaacgttgaaagcttcacacccgatagatgattcagtctatgatgaatcttggtgtgcgcatgttagctgtgcccacgccgtaacacgatcggacagcaacgtcgtacatatagtagggttcgtttccaatatacttgatcatgaggtggaaccattaccatatttttttcaaatcctgttgcaacgcacgggacccttttgctagtactagccaaaagtcatgaccaaaatataaaaatgggtttacacttgaataagagttacgttggaagttgcccttctttttggagtcaaccaaacacatggagtttatcaagaataagaccgatagaaacgaagctagggattaacaccagaaagtatttaacttgatcatacatacaagaaacatgattaggaagagtagcaaaaaaaagcatatccaaaacagtgaggtctacgcacttattattgttttctatttgaactccaatttctagaattagaggcttcttctcgtgtaagcaacgggacaactttttgacagtagatgacaatcttttacgaaggagcttctcctcccgcttttcatgttctgaaatttctgcatctctaaaagtatcctcctccccgttcttcccgaattgccttctgtgctccaaaaactcatccattgataaaagtttctgagagatggaataaaacagtaacttgcatcagaatctggtttacaatgattaccataacctgttgctctcctttaacagaatatggttaaactaatctgtttttattacaggcatgctatcttctttctacttttcttttttgttgcaaatcaggccgtgctatatctgttgagtaattcgccatgtaaatatgttgtagctttactggttgctttagcttgctactttcgttattgaaaatacaaggtctgaaggcagtttatacttttagtctaagttgctgttcatggtaaaaaaaatgcattcaaagttctctgtagtttaactatatagaatgtagacattcaatttgaacagtacagtgaaaaatactgcatcactaaacacattaaatgttctatttatttcttattggtaaactcgacagtttgaattgctaaaactgcattgtctccaaaaaataacttgtagatggaaggttacctctgaatctctggtcacccagaatactatcagccactttgaatcaggcaaaccaaggcgtggtagaaaattgtgaagcagttggagcataaggatgccagagttgaatttttcacgttgatggttcgtgctacaattttaatcacaatatctacccttgtgtaatattttcatgtgagaacctccagtttttatttctgtgactaacatcaatttgtttgtcaatgcccatttacttatctgtcactgactcactgttgagctatcagcatatgataaggcagcgagtactccatgattatgatttttcttgttaatattggtcacgaaatattttcagctgttggaggcaatggtgaagaactgtggtgagtatgtctaatttaaagttgctgaacagaatagtttaaaaaataaatggttaaaattgtgaagaagaaggtatctacctccttaggttattgccactactctcgccactactcttatgttgtttaaattagcaaaaagaagtaaaaaggagtactgcatttttttaaaaaactaatggcctatttgaatacaagggatttggatccaaatgcttaggaatttgaactaaataagcaatttaaaagaagttgcatcacccaaacggtgggaggttttggtatgttaagaatttgtggaaaagttaatgtccgcattttgattaagatagaagaccgatgctcatataattttgtcaggacatttacagtgacactgtttttctgagtattcattttccgaatttacaaaattgtaagatttatgaaaaacatggaatccaagtttccaacaaatcatccatcacgggaaaaaaaagaacagatggattaaaacattaacttgcatcaaaacctggtgtatgacgattatgacaacctattgctatccataacagagtatagttaacatgttttctatgctaacttatttttttatttttttacaaatcaagccatgctatctctgtatacggaaggttaaatatacagtcccttcttgtagcaggctattgattgattccccccaccatatattttggaataaacttgttccgaggtgtgttctgtactccctctacccaacttctactctcttttcttccgtgcccacacttcttgaactactaaaaactttttttaaaaaaaatctagaggaaagttgctataaaaattatattaatctattttaagtgtttttgtagttaatacttagggccctcattgtttcgcttatgtttatgcttataagctaaatttgaattttagaacttagtttttattttgatttgtttggttttgtcatcgtagtttagtttattctacaacatttatttttgagtcactaataacacgtatataaaaaaaattactcgcaaacgatgatttttttttaatttgctaataagcgattcagatgagcatacgaataagcgagataatggggctctcagttaatcatgggctaatccaccgccccattttgtgtgcgggtgacgggttaccaaccattagcttctaacacagcctaattaagatgatgtgtatgccctgataagcccaaaaccaagaactcaaggccagtggaggaagaagaagaagaaaacagcaaggctgtagtatgagatttcacagatgtaacgggatcccagaggaagggggggggggaggaagagtattatcacctcagcgggctccgtcctcccgctgcaaccggaggagctgaagaggcgccgcgggtggtccgcgaccgcgagcgatggccgggcgaaggaggaggaggggaacgccgcctgcttgtagacggattgtctcctcccagccaaatcggtggcggtggggaagaagaagaggctggattgctcccgcgctccatggatcgaccgccggagcacgccgccggcggatcggagcagcggtgaggaagccattctcaagaaaggataaaaaaaaaagaagaaaaaccttggtttttgttttttgttttttttcttctcgtgggacgcggtcccgcagtaataaaagggaggagtaggagagtaaatagcgaccgtgtcggatacgcctcatatttcgtcccggccttgttctcctttacggccgaaaatcgtgctgggccttgtctgcaaccctggcctgtttatgtgttccttatctatcc

SEQ ID NO: 51945 - DNA, 3738 bp, Oryza sativa
  unsure (1)..(3738): unsure at all n locations
gcggctgagtcaatgtgggacccacatttaggatgccacgtcaatctctctcccttcctactctctctctctcctcatctgacgccgcgaggagggcagcgccacgacggcggccggcggcggagaagcggcgcgcgggcggttggggagcagctggcgcgtgcatctgcccatgtcaaggggatagcacggcgagccgccgcccatggcgagcacgccgtcgaggttggagggcggcgcggtggatggcggagacggggtgcggaggacggcgagcaggttggagggcgccgggaagggcggggacggtgcggcgagcagcgtccccgagagggagtcgagttcggcgacttcatgcaccgccgctccttcttgccgtcacttcactccacccgccgctgctccgcctcgccgtcgctccactccgcccgtcgccgctccgctccatcccaccaacttcgtgcgccgccgctccacagcagccgcgtactcctgttcccatgtgcgactcctcctcgtcctcgtcctcgtcctcgtcgttgttgttggcgttggccatgggagaggggaggagagcgcacgcgatactgttcccgttcccgtgctcagggcacatcaacccgacgttgaagctggccgagctgctgcactcgcgcagggtgcccgtcacgttcgtcaacacggagcacaaccacgagcggctgcggcggcggcggggcgctgcgtgggcgggacgggttccggttcgaggcggtgccggacagcacggtgaggctgtacctgtcgttgcggaggagctgcgcgcgatgctggtggaggttgcgaggagggtggcgagcgacggcagcagcggtgtgctgcccgtgacatgcgtcgtgctcagtggcctcgtcagcttcgcgctcgacgtcgcggaggagctcggcgtgccggcgttcgtgctctggggcaccagcgcctgcggcttcgcgtgcacgctccggcttcgccagctacggcagagagggtacacgccgctcattcgctcaaaggtccgtttcgtccggtgagcgatcactccgtcgcacgtgtatgatcgatatcgccatggatgtgtttgttgtcacacgtgcttgcacacttggcgcgtgctatattgtatgcgatggactaaatcctttgcttttgcttcccctgccatggcagacgagagctacctgacgaacagttacctggacacgccgatagactggatcgccggcgtgccgacggtgcgtctcggcgacgtctgcagcttcgttcgcacgctcgacccgaccagcttcgcactacgcgtggacgaggacgaggcgaacagctgcgccagggcgccggggctcatcctcaacacgtacgttcgacgacctcgagtccgacgtcttcgacgtgctcagggacgagttcccgcgcgtgtacaccatcggcccgctcggcgccgaccgcgcgaacaacctagtcggcggcggcgccgctgggctgagcctgtgggaagaggacgccgcgtgcatggcttggcttgactagcagccgaccgggtcggtgctgtacgtcagctttgggagcctgacgtgatgtcgcccgtcgagctcgccgagctcgcgtggggcctcgccgacacccgcgcccattcctatcggtcatccacccaggcctcgtcgccagcggcggcggcactgatccgctcccctctgctcggctgatcctttgggagagagtggatacatacagagaagagaggggatgaggacagttnaggagaggagaggagagaggaagagaagtggagaggggagggaaaaggaggctgacacatgggtcccacgctgaatcagctgccacgttggacaaaacaggagtcaaaaccgccgagggacctagtttgcactagttttgtaagttggaggacgcgttgtatctggttttacggttgggggatgattttgtaactcgatgacaagttgagggaccttcggtgtactttttcccagtgataatagcaaagagtaaagttcatcaccggtctctaaacttgtaccgttatgtcatcccggtctctaaactcgcaaatcgaccgttcaggtcctcaaacttgttcgactgtgtcatcccggtccataaacttgcagatcactcgtttaggtcctctaacttattcagttgggtcaccccggtccctaaacttggatttgaatatcatctgggtcaaatatgacggtctaaagactttatatttaaaaaataattcataactttttcatgtgaactctaatgaagacaaactttatatcaaacttgtagccctcgacgcgatctacaactttgtagttgaatttttttttattttaagtcattttttgtcccaaaatgtaattttaaaattaaaatttcaaaatctataaacatgcaacaatattttgggaccctaaacggttttaattcaaaaacttttcaactacaaagttgtaggtcacgtcgagggctacaattttgatataaagtttattttcattagagttcacatgaacatgttatgaattattttttgatataaagtttttagaccgtcctgtttagggacctgggtgacacaactgaacaagttggaggacctaaacgagtgatctgcaagtttagggactaggatgacacagtcgaacaagtttgatgacctgaacgatcgatttacgagtttagggatcggaatgacacaacggtactagttcagggaccggtgatggactttactcaatagcaaaggtataagttcactttaggttcctcaatttgtctccgagttcgaaatatgtccctgtaccacaaaaccggatataacgcacccccaacttacaaaatcgtgcaaacgaggtaccttggtagtattgtccccggttttggctgatgtggcgcctacatggtgctcctttgactaagtcttcgtcccaacgtgacattgatgtgatgattacatgataattcgattgaaaaaataataaaacccgtgggacccatatgtaagttacacacaaataataaaaaatggcatcctcactactcccctcttctctttatcctctctctctccggcgtagcgggcggcggccagctaaagatggcgatctttagtcccggactcgtgatcccggtttgcaaccagggattaaagagggttgcaaaccgagaccattatggatttctatagcagtgcatctttttcatgagaccattcggttcgtatggctatcactggtcacacccttattattcactggtgctatttttacttattcccccatctgacattaaggactagatgaaaagacctaaatgcatctcccatttaatcctcctccccacttctccctctcatctattctctctttcatcttgtgcatccgtcaccactagccatcgcctccgattgagaaccttcctaagcaacgtcaagatacatcaagatggaggccaacagtaggccaagtggcccaaatcgacgacgagggaggccgtgcaatcaggaggcggaaggtgtcagtgaagttttcgacaaacgaggagtcaaagaagatgatgatacaatggaatggagctgccccttagcttagggaggaggaggccaaccgagtgttgcccactagtgccattggtggcttagagcaggtacaataaagattcatccgtcggcgatagtgtatccatgttggctcgcatgcatgctgtgct

SEQ ID NO: 51946 - DNA, 4510 bp, Oryza sativa
cctgcagcccctatttcatacgtattaagactttgaaagaccaaaccttatcatccccgtatttctaattattagttttttaaaagtcacatcaggtgctaccccttatgtcatctcttctttatttgcttgctcgatctaccactatttaacgtggtgccctccttttaaggctgtcttaataatataacaagatgggtggcccgcgcaattgcgcggttagcaccaatacaaaattatatatttttatatgattttacttaaaatttattaaatagttatcttgttgtcttaagagtttgaaagaccaaaccttatcatttccatgtttctaattttataattttaataagttacatcagttgctaatcgttacttctgtcatatccatatccttctttagttgcttgctcgatctataacggtttctattcattcattggatcttatagtatttagagtttattgtccagttaggtttcatttttataatttttagaaatctcgtcgaatgctgccattataaaaatcaaacataattatcatttttgttttttttactttctagaagttccgctaaaacgtcagcgactttgtcactatactccaatacagctcacctgctgcctcccttctttattgtcattgagattttaaaatcaaacatgattatcattcgtgtttatttttttttacttttcaaaagcccgaaccttttaaaattggatcttatagtttttataatttattgtctcgttggattttcttttttataatttttagaaatctcgtcaaacgctgccacagtactcctgccacagtactcctctacgacccgtccgccgcttattctttattgtcattgggattgtaaaaacgaatataattatcgttggaattcattttttactttctagaagtcccaccaaccataggcggctcttccattgtactcctgtacgacccgcccgctatctctcatttttattgtcattgaaattttaaaaatcaaatatgattatcattgggttttactttctataagtcccgccaaccaccttgaccggctgcttcacgacctgaccatcatcattctatttggtgctttattaatagtttttagatgtcctatcaaccgccaccactctaattatttatagacctattacttaattaatctcgtcatgtgttttagatggtcttttcttccaatagtccttatttgttatcaccaattttagttatttataaattgtattcctagttgaaatcttttttctttttctaattttagatttttttttcaaattttaattaataccgtatagtgttcttttaatatttttattttttatttctgaatttcagttgtttcaaaattgtattcctacttgaactctcttttaatttttctagttttggatattatttttattctgaattttaattaatctcgtattgggttcttatatggattcttctttcaatattgcttatttttaattcctacttgaactcttcttttcgttgtgctaattttggattttatttttatttttattctgaatgttaattaatctcgtattgggttcttatatggactcttctttcaatatttcttatttttaactccgaatttcagctattttcaaattgtattcctacttggattctccttttctttttctccgattaatgtgggaatttctagcccccatagcgaacgtggtgccttctttcaaagctgttttaataatataatagatagataaatagatagataaatagatagatgtgtatagtattagagcccagctattgtaccacatgtctcttaattcgtatgaagatgatgtggaagaagttggagccagaagcgggcggtactattaaacctgctcttataggggcatgcaagccgggaggcgacctttataagttgattctcctcttactaaactagcaatatttcacgaaacatatcatcacagttttcatgggccacgtaggtcacatcctaattggataggatgtcaaatgggggtaagctagcttgatctgctaagtgctcaacgtgagaaggaaggggcacgggagcattattgttcatacacgaatcttgatgcaatcttaaatgttaaaaaaactgcatgaaatttagggtattttcatgtgactagaaagataatatcccatgttgttgcatggatcgtagtctcacatgttcatcatggttctgcatagattatttcaaaaattgcatcattccgattcttcacttgtagtactgaagattttgattatttattgaatttagaaaaataaagatttacttttgttattcattaatttaaattctttgactgtcaaccctttttttagctccatcaatttctcaaaagtacttgaaaatcctatagcctctccctctctctctctaaaggttaaatctagtatttcaaaatttcaccatctcttctattaaaaattcttgattcaaaatgtgtattccacctcccttccattgaaataagccgagtcaaagcttcctcgggattccgcttcctacgaaacatacgttttatgaattaacggttaccaatagcaagcgatcctttcctacaaggtaaggccatggacaaaggttttttttatctaccccagcaggggcaattttaggagtcttttcaatccatcttactttgaatccgggttcgctttcactcggtcaagggttgccctttacctcgttctatggtcctttatcccctccttgctttcctagtttgtttcctttccgagacccaaaaccatgcatcacaatcagagggttaatcctccaaccagaaccaacttaacctatggatagtttctgccggcagctcctgacctcttctctcataccggcttgaagaagataagcacgtaaaaggaatgtaggcctcgctttgtagtactcgtaaaaggagctcactatcatgccgattacgagcagccgttcgcagcaatggatttggatctatatatgagaaatatcatgtggagggactattgctttttcctctaatccgatctggtaatcgaattcgcatatcccaacggtttggttcctttccttgtttagttttaaccagttccccctttgcttttgccaatcgcctgccttgttgtttttcctattcaaccaccccaacttgtgacgtataacgatgcaggtatttcagtggttttcttctgatgcttctatgaaattggattatatatggagaaaacaagaaaataagtaaaacaataactccaaaaacatgaactggtaagtaaaataatattgagcatatataaaatcaaaactcacacatacatacatgtgtaaaatacaaggggaaactattttgatctctcgagagcatgtcccgtcgtgtgcttaaaaatcatctaaacagttatgaaaaattctagaaaaaattaacgaatacgttgcctgtgactgaaagaataatcatcagcctcaaatgcaagcacctatgttaaatctaaaacttaaatcctagcggataagtttcaccactaaaattctagacaattaaactatgctcactttactcgttgtgtggggagtccaaaagggaatgagatcctctgatataagttatatggctttgagccaaaattgtctcctttgttttttgtttcacagctcaaggaaaaagcatacctacatgattttccatcacctccatcacttctgcattaattaattcctagtagaatacccccgaggttcctctagctgacttccaagaccaagcatagctcttatttccttggaaggattttaattctctatatgaaaaactctcctttttgtttcctgtatacagaccaggtctacatctctatctttgatcacctctttcaattaccttttttctggctatatttcccaaacctctaacattccagaaaaagcatttatttttttcctttgttttttggagccacctctcttcttctgcacaggacccttaattaggagagtcatcatttgtgttattcacctcttcctcatcatacacttctttctgtcccccatcatcattaccaactgcttgagtttgagacatctctatggctttgttctcctcctcttttttccatcttaattctgcaagcttagcctgggccaactctttgactttaattgtatccatgtttcatttatctctacagagttattaccaagggaaatatttgcagcaacagcaatcctatattcaactcatcatgatcaactaattggaaaatagcaaaagggttagagttacctggggcttccatgtttttcttctgcatgcgtgcgccatcatcgagggcgggaagcgtgtggccgagtgacaggcgatcgagaggattaattcgcttcgacccatcgtcgacacatcgccggcatcgtcctagctactaggagtagttttgacgacgtgttcatgccaacgtgtgtcatcgcgtc

SEQ ID NO: 51947 - DNA, 12145 bp, Oryza sativa
cagcacaggcacaagactcaagtgggcgcaacgtacgtgtaaactcgactttgacgaacgagttgatatgaacagcgacggcggcatggccctgtcggatctcggtcgagttcatcagtttccactacaaatttgtgcccattcctttgtatagcttcatggcccaccaaagaagattgacagtatagcttcgccggctagcttcagagcactgcaaaacaaatatataattaggcaatataattcatttattattattattattattattttaaatactattatctcaaatagatactaaccttgctgacatccaggacaacttgattctgtttttcgcatattccttatcctttgcttctttagctttggttctctcggcttccatagccctcctcttcgcatcttatttccttggaaggattttaattccctatatgaaaaactctcctttttgtttcctgtatacagaccaggtctacatctctatctttgatcacctctttcaatttgatactaaccttgctctttaagaatagccacatatgctaccctttttgtatcggcaagttcagccttagtctctttcagttcctcttttctctcagccataccctctttcagttcctcttttgtttcaattgtgttcttctttaccagtctcgacctatttgaacataaatgttgtaaggggatgtgaaagatataggatacatatcctttgaattctatatttgtgcaatctcgaccttaaaagcccattaaacattatacaaacacactacataaataccctataaacgctcttaaaccatcacacggcattataataaattaaagaaatcctaaaaattttgagaaaaaacaaaatattcgacctttgattttcacttaaaaagtgaacacattattttaggtcactagatctattatagataacaccgattaaatatatctcaagaaacaatctctcctcccaccctttggccgtacgtacgcatataaatacgcaacgtatgtactacctccatgcacaaatatatgacgttggttagctcaacaacatcaaacaaaaaaatatggagggagtacatgcttatccctcccctctgaccctccatactcttatatattttttaattcactataataataaaaacaattaatacttagatagcttagtaatttaagacccatataaaaataatgtaaaaatgaaaatacgttatttgaacagatctatgttttggagggcaatcaaataacatccattttttaatttatttgaactatagttttatttgtaattaaaaaagtaatttaagatttatattactcatattttgctatataaaattaaaatatataatttgaacatagtccaacaatgaaacaacaatggaacatttgaaatttagcaatatgtattgtgtcatcttaaatcattctaagtaataaagatccattaaatattctttatggtgttattaagtcaacacatgtcatattttacaaatcagagaaaaaatcttacaaatttaaagaaaaaaaataaaacatctgaccatgaatttccacttacgtcgttgacatattattttcaaacattagaaacatgtcatgtctttaaaaaatagaaacaaaatatctgagaaaaaaaaatctgatcattagcttttacttaaatagcttagaaaaaaaagctccctccacctcccttgctcacatgcacgcaacactacccaccccctcctttttggctcgagctctacgctagctattcatttgttataagctatcaaggtgaaagaggaacaactaatagttaatagttaatagaagctacgtatatgctgtctaatcttaatgctgctctattataaccaaaccaaaaatttaagatccatatgcatatactacctccgttttttaatagatgacgccgttgattttttcttacatgtttgaccattcatcttattcaaaaattttatgcaaatgtataagatataaatcacacttatagtactatgagtgataaaacaactcataacaaaataaattataattacataaatgtttgaccattcgtgcctccgccgtcgctgaccatgccgcccagtcgctgccgcgccttccgacggccagccatcgtcgccgtgagctctgccactctggcctcacctcgcgctgcgcagagccggccgcgccgcctagtcgctgccgcacctcccactagccaaccactatcctcgggggcggccacctccgccatcggccacaaccatcgcgcctatgccggctaccatcgccgcgggcttccgccacctccgcccgcctccaccaggtctccatcgcattgagcaccaccaacatcggagtcgaccactcttgatctagccgggggggggggggggggcagatccgcgttgatggggggggaccggatccgtctccagcatgaccagctccgtcgccctgccccgttgaccgcctcggccgttgcctcccacgccgaggaagagctttgccatcagcttgttctccccgccgccacctttccatccggccttgcggtttccaacggcgggctccggtggcggcgaggcggctagaggggaaggaaggtggtggcacgggcgggtagggtttccctcgagccgctcgcgtgacagcggcacgagggcatatgctttgctagctttttggttctctgaataatggattctatcttggcctatgttgttatgtgaaatggtgttatatattgattctgagcctatatgctaccattattatatttcattacaacccaaacattccaaagtttttctgccattcgatacattacaagttgatgtaattttttttctagttagcaggttcattcttactcatacctaatggaatgtaagaagcgttgtgaggacaagaagaaacactatatcgatctatcttcatggatttggaagagtttcaatgatttaatggagaaaaaatcaactatgattcaagaactcattgatcaattggaggataaaaacagatgctctatccaaaagttagtccacactaatgttgtttggatgcatacaatatattctgtcatgtttttctaaacatggctattcttttaaccgactaccgccgtgtcaagcaactaggtttgttaatttcttacacatttgtctttccccttgcccttcataatatgcatttctttggtgagtaatttcaccaagaacgagtaaatgaagagattaattggaaggcatagaattaatcatatgtattttgatgatctacatctgtcattatgtatatggtgttatgcagagtgcgatgccgacagatagatcgagttacatctgtcattatgtaacgcagacagagtaatttttttttttatgttctgaaaaaaaaagtatatctttttagttccacacacttggaattgatccaattctaagtctcctgcagattttggcagcaagttcctcatacgtcattcagtccacacgcttcaagttagtcagattgacctgaaagacaaagccaagcacgaagagtctaaatttcaaccaaatgaattcgttcggtcatcaaatgaccggtggttaaactggcacatataagtacaatctgcctgcatgcaatcttcagtcagctcttgaaagttgaataatcttcagacaccatatatacgaattctgcctgttaattaatccgtcaagaacgtcccccctgcgtaccggcattgtcgttcaggaaacttcagcttaattttcttcttctcgtttgaacagcgagagatcgatcgatcgagctgggagaaactattataagtagctcgtatcctctgaatctttggactcacaccattcctatacagcaacctagccagctcagttaagctgaaattaaacaaactgctgcaagctataactagagctaagtcacagttgtacatccgggagcagaagatgaaaagaggaggctcgtcgtcgtcgtcggcgactgcggtgacgatgacgatggtcgtgctgctgctcgtcgtcgcagcggcgtcgctgcgtgccgccgacgccgcggcggcggcgccgcgccgcctgctgggagctgacggcggcggcggcggcgggtcgccggcgctggtgtccgagagcaaggcgtcggcgggggcttccacctgcacgcacgaccccaacacgccccctagtggcactccttgcccaccgcataattgataattaaatcagctgcacgtcgtgcaattgcatgcaagattttggctgattaattctttcgtggcgttgattgaaatactacaggagtatatgtctatgtttatacatatatatgtacaacaagtatacatgttaatattgttcgtcattggttgtcgaaaataaaagtagagttaattagtttcatatatatcattgatgcacgcaacatatatagctctgaaagtagcttgtaaacattacagagtatactgtaatttattttgttcagtccatttacttgtgtgtgtatatatatacccccaggatggttacacgctgaaagagcatcagatacgaatttgtcatattcgttcaatagcgaaatacaaagctaatcttaaatttgttatggggtgtgtcatctaacaaatcatgtttaacaaatcacatttaggatataaatttaggatatccaaatacaccgctaatcatgttttattttatagaaaacatatacaacgttatcccgttggaacaggataccgttctatgagacagtacttaatacctgacacctgttgtggtactagctgcatggtagctgatacctgtgatatctgctaccagtacctgtgatacctaggacctgatacatgtgacactcgtgcaagagaatagttaatatgtctatcctgttgcaatgggatcccgttttgtagcaaccctcatctggttaagaattttgtattgagccccctcttctatagtatatccacaaatcaactcccagcactcccaaatccactctcacctagagacggcaatggaccccgttcaccgtttccctgcggtgaattcaccgtcctcctcctggtcgtcgtgtgcgtcgtcaaggcagcgatgtggcggctggcggtgatttttgcttttttttttggtttttttggttccgtgcgggtggtataacacaaccgcatgggataattgattattctgtgcggtcggcccgcccacacgcgaaaatgccgattttcccagacacccggctgcagacaggccggacaaccgcacggaaaaatcaaaatgcccgcacagaaaaatcttgtatgtagtagtgactatcgatctatcttttaaggattatgaagagttcaataatttaatggagaagaaatcaactatgactcaagacctcattgaccaattggaggagaaaaacagatgctctttccaaaagttagtccacactaatgttgtttggatgcataaactatattctgtcatgtttttctaaccatgactattcttttaaccgacagataccgtcgtgtcaagcaactaggcgtattaatttcttacacatttttgtctttgcccttgctcttcacaatatgaattttttggttaggaatttcaccaagaacgagtaaatgaagagattgattggaagacatggaattaatcttatgtattttgatgatatctgtcattatgtatatggtgatgtgcagagtgcgatgccgaagcaccagtaacacagacatagtatatcttttagttccacatagttggaattaatccagttcttaagtttcctgcagattttgtcagcaagttcctaattttttttagactttttaaattttttaattttattaatagatctttcaaagaaatattttcgagaactgaaacttttttgactatgcggccaagtggctggcgtggtaacgttgttttgccacgccagccacacggtggcgtggcaagaggctggcatggcaggacaatattgccacgtcagctgcgtgtggtgtaacaaagttattacaccagtcaggctggcgtggccaaaagattcagatttgaaaatactttttaaaaaatatattaataaattttaaaaatagaaagtctaaaaaataaaaaaaatccaagttcatcgtacgacattcattccacacgcttcaagttagtcagattgacctgaaagacaaagccaagcacggagagtctaaatttcaacaagaaaaaaaattcggtcatcaaatgaccggtggttaaactaacacatataagtacaatctgcctgcatgcaatcttcactcttcagtcagctctcgaaagttgaataatcttcgatcagacaccatgcgaattctgcctgtttaatccgtcaagaacgtcccccctgcgtaccggcattaatgtcgttcaggaaacttcagcttaattttcttcttctcctttgaacggcgagatcgatcgatcgatcgattgaactgggagaaactattataagtagctcgtatccctcctgaagctgtggactcatcaccactcttcagttaagcttacataccagctcagttaagctgaaacgatttagttcgaagccagaagcaggccggagctgaagatgaagggaggaggctcgtcgtcggctactactgccgtgatgatgatggtcgtgctgctcgtcgcggcggcgtctgacgccgccgcggcgccgcggcgcctgctgggagctgacggcggcggcggcggtgggtcgccggcgctggtgtccgagagcaaggcggcttccacctgcacttacgaccaaaacacgcactctaatggccctccttgcccaagtccaccgcataattaaaccagctgcacgtcctgcagttgcatgcaagattttggctgattaattctttcgtggcgtcgattgaaatactacaggagtatatatttatacatatatatgtacaataagtatgcatgttaatattgttcgtcattggttgtcgaaaataaaagtagagttaattagtttcatatatatcgttgatgcacgcaacatatatagtgctgaaaaagtagcttgtaaacattacagagtatactgtaattttatttgttcagtccatttgcttgtgtatatataccaccaggatgatttcacaaagagcatcagatacgaatttgtcatatttgttcaatagcaaatacatgctaatccttaaacttgtaatggggtaccatctagatccgaacttgtatttggatatcctaaatcatggtttattatatcacccgatatataaagtgcagatgtaacaacttgaacgttgttgtgggcgcgtccaggcagtttttgttttagctatctagttgagaattttgtatttagccccctcttctatagtatatatacaaatcaactcccaccgtaccactcccaagtcgactcccatcgcacccgtgggagaggaggcaaagagacggggatatattagtgttgctgcggtcatctattattgaaggatgtcggagccaagatagagggtgatcctacgagttcaatgtggtgttattgtacaatcgcgcgctgtgatcttcccgtaatatgtagtcaaacgtttggcttcaattgatggtgacaatcacgccacatcaagctcgcgagatcactctcttcatatcatacggtccatcttggtaggggagaaaatgaatcgaataatatccgatctggcctgctctgaatccgtccaaaacgaggatatgaaatgggtttatagaaattcgacaagtgtggattatccgatagtatatttgccggataatccaaaattatcaacctacataacaccatatttgttctatacaacatgagctgacttatccaataatctaactcatcaattaattctactctttagtttgaggctcctattgtctcatctcacacttacttagctgcatttttatctatactactttatgagataatctaagaaatgctgttgacaagcgtccaaatccaagaaataccatcaataagtgtgagtttcaagaaatgccatcgtacaaatgactttgtctcaaaaataccatcgtcgttagggttccgttcatctcgcgcccatccgcctctattctattaattaagatgattaattaagtataacaaatttttaatatatatttattcaatttttaaaaagcttttatatagaaagtatttgaaaaaacgtattgtttagcaattcagaaaatgtactcacggtaaataagtgagtaggcaatccaataagcgctttaattagaactcaactcatcagggagctacagggacatcttcacatcttcagttatatattcacgggctccatgttcagtcagctcttgaaagttgaatgttagactcaaaacttcgcaagaccgtcatccagataggctatcttagttcttcagacaaccatacgacgaattctgctgcctctttaatccgtcaagaacgtccccccatgcttaccggcattttcgtgcatgaaacttcagcttaattttcttcttctcgtttgaacggcgagatcgatatgatcgatcgatctatcgagctgggatctcttataagtagctctcgtatcctcctcaagctttgcactcaccattcctgcagcaacttagctaatacacttatgcacctctgcttagtaaattaattaagcaggaaactgcaaaagttacagtagtgcagaagctaagtgcagtgactagtagtgtgacatcgtcggaggcgaccggccggaactgaagaataatgaaggcgaccgcggcgatggtggtggtcgtgctgctcgtcgcggcagcgtcgttgcatgccgccgacggagccgcggcggcgccgcgccgcgtgctgggagctgacggcggcggcggtgatcagtcggagagcaaggtggaacataaatccggctgcacgaacaacgataacacacccccttctggtgtctgcccgccgaacgcgccggggccgtgattaatttgttcagctacacgtcgtcgcccgcatcgcaaaattaatactcctatataaattaattaatcagtataaattaatactcctatttggctgatgaattaattccttcttggccttgatgaactatattttttccgtaaataaaagtaagttcaggtgtgtacttgttgcatcgcgtttgatgcacgcaacacgtttaattgattcaacgaatgttgatttgttcagtatactcattgggctcttcctgtaaaagtaaatgatgaattttgttttggtgttttgttttgtgtgccccgcttgaatctgcacaatacattttggaataattatattaaggatgtcggtctgaacaaacacccatgttaaatacagtaaatacaaacgtcatctctctctatctaatctacctatctaaaaaacgagaaaaaacaaacagagacatacaaggatttgaaccgtttagacgtacacattgttatctagacatgtggccacgatcctgctttcttatatactccctccgttatgagatatatgacatttctgacagcatcgacgaaattaagtatacaacggtgaagtgaacatggcttaactagttaactagttatgttttttttaaacaacccacgtacctaggttcatgacctagactagaaatggattctcgtatttacgactaattattttttcagcgctagccgacatacccgtcaacatcgaggtgcccatggtgacttcgtcaatctcaaaatatctcaacatagtctttcggatgtgctaatagggtagggtgtatatgtgtgttcatatatatgagtgagcatgggcgtattgtgagcacttgcatttgcactgtgtgtgtttttttttaaaaaaagtatagagcgaatttactattttaccctttattcctcttcatcgatgtgtttgtccatgccgctgcgtcgccaaagccttggacgacgaggaggaccgagggggtttccgtctcccttcacgccggctcgttcgccatctctcccaagccacctcgaagctggctcactcgccgtctcccacatgccacttctcgtgaccacagtgtttagaatagaaaaatatggatctcacaatgcttagagagaaaataaatgtgggcgtgccagtgtatctaaatacacaaaatataaaacatgtacaacatatacagatacacgtgatctttattaattgaattaataagatatagttttcgtgtataatataaaaatcatgcaccattgcttgtcgttgggcagatcttgacatcagcgatgtgatcttctggttctcaggacctcgagaggctactggttattacctccataggttagaacctattggagaacctccgaataaactgcttgtgatcatctttttgtcttaacttcgtgttcttcatgcataatgataagatgggtgttgatgtagatgtgtgtgggtgccaacaacatatccacggcttcgtcggttcgtgcgccggtatcggtgacaagccttcatatagtctcgatccgcccgccattattgttcaacctcatcggtcttgaacaacgtgtaagtgtagtttgttggtgaagacatgatttgcgtagcttgaatagctcgatgtcacaatagttgcatcgagattatattagaaagggagaagccattggagaccgtccgtgttgatgatagcctaattaatcgtggcttggcacctcctacggattacgacggctctataattatgtaagaactagaggttggttgcattgaaattattacttcacgactgttaactagcattagcatatgaatctaaactgcaattttattaattatttgcatgcaatacattaatatgaacaatagcatactgaaattatgcactgccttgcaatatttgatgattatttaaaaaattaaaatatgacacactcaatttccaattgtcagttcctcattaattatttgaatagagaaaaaagtataaaatggatttaatatttacctgaaaccagcttgacctgaatacgcctgtaggtggtagctagttctggtgatcgatcagattgtgtgatccaaatggccgctagctcaggttatccgtgacgtcataggaggaaacttcatatgcattacatcatcagattaattaattgatcggtcattctatattatcccaggcaattcaacgaagtcacgattcaattcaactattcaagcagtctttgcgtcaaaaatgaaaatattcaagctgtcaatttgatcaggggctgtcagtatatttactgtacatattcttgtgacaattcagttctcaactggtatcgtacgcaaagaatgctagctggcacgtacatacatgtgcgaccgttattccaacagacatggcagtcaaccgggtcacatcatgtaaactagctgcatttaattgtatgtttagttccatgctaaaattaaaagtttgactaaaattgaaagtttgaagaaaaaagttgaaagtttatatgcgtagaaaaattttgatgtgatggaaaagttagaagtttgaagaaaaagttaggaactaaacaagggctaaaaactggatgaaagacttacaaaaaagagagagagagagaacatttgtatgtacgtagagagtctattttaaactctcaggagacttcccttggttacttgcatgttactcgaatagttatgaaaatttttttgagtagatgtattaatatgtgatattaatatcactctacaaacattcaacttttaactctataaacattcaacttttacatgtcgccacgaaaaaaacattttgattgtgaacatatcactgctagagaaaccatctttggtcggtcggccaaaatttacaatagtcctggttctaataaaaatcaggactaaaaacatattaatttagccccggtttaaaagctcaggggtactttttgacaccaacgggactaaagatcatttttagtcccggttcaaaaaaaacagcaggcggggttagacacctatattttttttagtcccggttggtgttaccaaccggaactaaagatctatttgtagtactggt

SEQ ID NO: 51948 - DNA, 7735 bp, Oryza sativa
catgcgcacgcggtttctatctcctcttccctcccggttctatctcctcctcctctcctttatctcttctcctcactcacccttctcttcctctccttctcctccccctcccccctcctccccctcctccccacttctctggcaggcggcggcggcctcgcgtggcggcggtggccgggcggcggctggcggtggaggccggcgcgccggcgaggaggccatggcggtggccagcggtggaggcgggcgtggccctgtatgattttttcttttttcctttttgattcgatctgtgtgattcgatgtgttgatttgatctgtgagaatgaactatattgttgtgaatgattttgagaatgaactatgtgttattgtgaatgatttgagatgattatgtttttgtggatgatttgagatcgatggtgagagatgatattttttaatgatttggagatattgggtgcgagatatgaaaaaaagaaaaaaaacctgttaccaactagaattaaaaataggcatctttagtcctggttgtataaccaggactataggggattacgaaccgggagtagaaagcctttctccagtatgttaactatttgtagtttaatttgctttttttcattgcgacatgcagaaagctgaattttaagtttgtcgagtgatatatcacatataaataaatcttcttagagcttttattaactatttaaaaatgacatgcaaacaactgtaagcatcctctgttcagaatagtttccctatgtatgtacatacattacagagcttatcagttcggctttatcgtgattcatgatttcaaagtgttaaacggaatattttatatattagtaaagttttttcttaaaacgttatataattttatttttgaagaaaaaaaaccatcatatagctacacgaagatatatatagttgaagaaactttgaagctatatatactatgcaaaatgaatcgatccatgcaaccatttggattttcaacgtagaaaacggagaaaaatataaacaaatgctatcgatcaatgttggacccgcagtctcgtatgaaatgaacgattggagaaattttacaacgtttttcccacataatctattgcacgaaaaagctaaggtaatctcctgcttcgactcgagacacaggagactagctagtcaaacgtttcgcagtgaaaaacaaccgctgggaaaggagtgatgctgaacattctttgtttgactagcttgacgcgactctagctagctagctgaacgatcagtacacacgcgttttgttcatctgtgatgcgatgcttaaattaaacaggtcgtctcttagctaccctccgttttaggttataagataatttgactttggttaaagttaaattattttaagtttgactaagtttttacacaaatatagtaatatttacattaccaaattagttttattaaattaataattaaatatatttttataataaatttatcttggatcaaaaatattactattttttttataaagttagttaaatttgaagcagtttgactttgaccaaaattaaaatatcttatacgctatctcgatcagtacgttgcagaccaagcatgcacaacgtttattatattttcgcctctttttcttacgtaacatccatgtcatcatctagccttagctttcatgaattaatgatgaattcatcagtgtttttcttcatccggctggccggtggtctcatcattaattcatgcatgcagcgtacccttagctttcccagaaattctcggtttaattcctcgatatatcgatctcaaccatgcgtgcttcagaagctgttttttagatgacagattcagctttgaaaggaaagcccaagaatgaaacatatatatagtctggccgaaagcgatcgagttgatctcatcaagacatcaaccatatatagggacatcacgtgttcatcaaattaatcttcagtcagttcttgaaagttgaatcttggactcaaaacttacctccaccgttttacaatgtaagactttctagcattgcctatattcatatagatgttaatgaatctaagagaccttttgcagcacttggaaggtacccaaggtacctctcctcaacttaaacatccaccgttgattctcaaagagtagattaggaattgaattaacataaacatgggcagtttagtaattgttctttagccatcgtaatcaaccgttctttattcttttgctatatctttctgcacacctggatgtaatttttcgatccatccagccgcacacatacccctatataatggatgactcaaatttcaaaactaggttttatacatccatccatctttattgtctttagaaagtaatccatacaaagagacggaggcgcatcaatcaatttttcgtttggaaatcttcagagtcacatgcaaatctcatgcggatatatggaaagacgcgtggatcaattacttagttctaatcatcaattatgtggtcttcaattagcatctagttacacgatctgcaaacattaatcaagtactcctagacgccgtagttagtttcttcattagttatacagattaggtgcaagccgtgtgcagtggcatcaacagactgaagacgttatcatctctctgcgctccggccgccggagcagcagaaaagtttcccgtttagttcttcctctctttatgaaatatagaaaccaaattacatatctaacctttttcaagtaatgcctggcccacatatttaagtaccttttcacatgtatgtggatcgttagattggaagccatgaacagatttgacgcactccaaacacagtagaaaatctctgaatatatatatatatatatatatgtctagattcattaacatttatataaatatgaaaaatgctagaaagtgtcacattattaaatggagggagtagtacttcttcatcagaaaccatgcataccaattcttccagtttgatccgtcaagaacgctgtcgatcaatcgtgcagctaggaaacttcaccctattttttctcttgatcgcgtttgaacggcgagataatctcgatcgagcttggactgggagctactagtatatattataagtacatctcatatgctcgatcaccacacctgcagcaattaataacctagcgcatatcaacaagcttagccaagctgaagcgaactgcaagatagctagctaattaaggaagattaagccggaactaattaatcaagattgatgaaggcgaccgcggtgatgatggtgctcgtgctgctcgtcacggcggcggcgtcgctgcatgccgccgacgccgccgctcggtggcgccgccgcgccgcctgctggccggagctgatgccggcggcgccgttgagtcgccgccgccgccgccgccgctggtgtctgcgagcaagacgtcatcgggggcttccgactgcacgcacaaccctactaagccctccactggtccatgcccgccgaacgccccgtgattaattaactaattgaccagctacacatatctattaattaattccttcgtggcgttgattgatacagtagtactacattatactccaaatatttactcatatatatatgtagtatatatattatggttcattaactatagttggttgtcgtaaatactattataggttcagttcgttaattaattagttgttcttgggttgtcgtcaataataccagtaggcaaacagtgccacacatatatacaagtgtcaccgtgtcgtagcttgctgatgcgaaccttagatattgctgtagtttgatttgttctgttgatttatgtacgtatacctcacaataaagacaaacaaattagtccattaatttgttcagtatttgttgggttctgtacttctgtctgtaaattaagagcatgtacaatagtaaactataagccaactataaccatatatcgagaagaaaagagaggagagagaagaaagtgtgctatagatttatagccggctgcaacacggactccaaaacgttgtgtgtgtatgagaggtgggaccgagtattaatggtgtaatatatttttatagttaactattgtatgaatgggttattatattaattatagttgttttggagccaacagttgactatattattaaacttgctctaaatgacgatgaatattttttctttcgccaccacgaattgaattccctgatgatttttgtttggtgtcgtgtactcgtgttccccgcataaatttgcacaatagatttgggaattattaaggatgcctatcctgaacaaacacccatatgcatatatactagaatcagtataaatacagtcgccatctctcagtctccctctcggcatgcatgtggacacaacccacggctttcttgtgtgtccttttcccaacattcaaatagaatctgttttcaagttttattgtatttttatttacattcctacatttttttggttagtcaattaatttgttttatatgacccaagtcaaagcaggttgcataagcaaccactacccagaaattggactattcctgatggcaggaaaaccatcactactggagaattgataattctccggatggatggtaaaaattacattagtttcggttcaaatagaaagcaggattaatttttaggttcaaaagccaacgaaacttttttatctttagtcccggttgataacatcaatcgggactaaagatcattttaggcccggttcaataactgtcaggccgtgtcaggccatatatttaatcgaatatctctctcacacatccttatctttatttctcgtccttatctaccgggcgcgcctctctcgcctcacctctctcgatctttctctcttgctcgctctctcaagaagctagcggcagcggcggcgccctggcggcgaaagctgtagtggcggtggctgcaccctcccctccgccagatccagctggaggggaggcggcacgatgggaggccgggcggcgtccgggctgcggaagtagcggcaatgggagtttcctgtcaggagacatttgtcctgatggccacggttaacccaagcaaccataagagataaggtccgagatgatatatatacagctatatacaatactcggtggactataatcctcaaatatcctctcatttttgcaggacgagatagaaaaagataaacatgcaaattgaaattcaacatatcctcaaatatcctctcattcataaaatattaagaaaaagataagatagattattatgttatatatcattctataaacatgcaaattgaaattcaacatatacatgtaggaaaaaaataaatttaactgtgaatagtacttgtgtacactactacataaatactcatctatgcaggatgagaacccctcatcagtaccggttcctcaaccaaaactacaacgttgacactgatgagtgggtggcaccaatgctggtcttggacttggcactcattgtttgttggttttgttatacgatgaatgaatgaattactccttggtcttgatgcaaaaagaaatagggcttagacttttggacggagggagtacttgttgaatggaaaatttgaatgagattattcatgaattaatgatgaaattcatcagtgttttttttttcatccggcttggccggtcgtcttatcatgcattcatgcatgcaaccccttagctttcccagaaaatctcggtttaattcctcgatatatctcaacgatgcgtactttagaagctgttttttagattaacagattaggctttgaaaggaaaacccaagaatggaattaaacatagtctttgccgaaagcgagtcgatctctcatcagtcatcatcaaccacagggacatcacatgttcatcagcttcatattcagtcatgctcttgaaagttgaatcttggactcttaaaaaccaagtatagttcttcagaaaccatgcataccaagtcttccagtttgatccgtcaagaacgctgtcgatcaatcgtgcaggaaacttcgccctaatttaattttctctcgttttgaacggccggcgagatcgatcgatcgagcttggactgggagctattataagtagctcttcatatccagatatacctgcagcaattaacctctagcaagctgatcagttaattaagctgaaacgagctgcaagctaatcaagctctaagagagtgcgacctgcgacgtcggcgattaattaagccggaattactgatgaagatgaagccggcggccgcggtgatgatgatggtggttgtgctgctcgtcgcggcggcgtcgctgcatgccgccggcgccgctgccgtggcgccgccgcgccgcctgcttggagctgatgcatgcgccgccaccgccggcggtgtccgagagcaagccgtcctccggctgcacatatggccctaacttgccacctggtatttgcccgccgaacacgccgtagctaattaaccagctatacacgtacgtacgtcgtcgacgtcgagcatcgcatcgcatacaagcaaaagatttgggctgattaattcattccttcctttgatttgtagctagcgttgattgatatatatatagatcatatgtgcatatatgttactacctgtcatgaatatattggttgtccaaaataaaagttttagttagttattagttagttgctgcatattgttgatgcacgcaacaacgcccaagcatagtacgtggtagtgctggcagtagcttgttgaccttacagactactgtagtattttaatttcttctgtagatttatgtatgccccaggagggtggtttcacgatataaataagagggaaaatgctgatttgtttagtcttcattaattgggttctgttgtgctgtaattaaatgatgattttttttctttcgccacgaattgaattccctggtgatgtttgtctaggtgccgtgtctacatgccccgttcccgtggcatgaatcttgcacaataaagtttggaataattgggatatatgtcaagttttaatcaactattcaaaatagattattaaatacaccgtaacactggatcatggaggagcgtccatatataatttgtgtcatagggatgtcggtttcggctgaatcttgttaataatatcgtgccctagtgtgttgtcgtgtttctgttcttgttatcgatgcgctatcatatataacagggctctagtggacctactctaaaaatacactctttagggggaaaatgtttaggttaaaattacactccgagggagagtagaatttatctaacagtatctctttaaaataatagaatttatgatattcgctttaaagaagctacaaccaattattacaaatgttgtagatcgagactgtcacctataaaatcacaacttaaaacaagagaactacatataactccaacaaaaaatagataagaaaaactttcatctagagttagtgaggaatcgcataaaacaattgtttcgcagaagattacaagttatgtagcatcttcctcaaatcaggaaatcgtatccccgaaattagcgtccgatcatttttccgattgaatttcgctcacatcaccatcgatgactgaaatcgaaccgaaacggaagataccgttggagagaaactcactaatcaatatgtcattcgcatgcagttgccactgtaatagccatcaaagtcgatcca

SEQ ID NO: 51949 - DNA, 1569 bp, Oryza sativa
  unsure (1)..(1569): unsure at all n locations
agacatcgttacgacttgtctgaaaaaatgccccagctagcggtggtgagtcgtttgcacgtcgtccatggcgcgcttcgtcaattggtctctgtgcaaaaaatgttatacgttgatcattcttggatgagatagtactactcaaaagatattcagactgaagatcagttatgctgcctcctgtcctgagtgagtaagagtgcgacacagataaataaagttaattgttcatttataccaacaaattaacagatgaatcagcgcatagctaattaactacatatatacatacattattctgcaacttgctagctctgaaacgatcaattattctacgcgtaaaatttatactattataatttataaacatcagcaattcatcggaagtgtacgtgtagacagtgtagtgatatgtatacatatcaatcacggcatttttggtggcgcgcagggacgtccagaaatatgggggtcgttgctgcagccagaaggccctgacgacgccttgctgacggacaccagcggaggcggctgctgacggcggccgccgccatcctctccgagacggcgcgccgccgcgaccgcgacgccggcgttcagagacgccgcgacgagcagcagaaccagcagcgccgccgcaccttttcctcctccctccatgtcgcaagttcagcctgaaattaagcctcggttcttcgttgctaactaataagcagctagtagctagattgaatgcttgatcaagttggtgtttctatggatgcaaatcaaactgtaggatatgtgggtatttataggtttcagatgagtatgatcgaccaagttgatgatatttttccgcgaaattaactgtgcaatctgacgcagaagacgtttttgacggattaaactggtgtcttattcaatttatcggtgaattttacgcgcattgtgcagatctgtgatgtcctgaaatcaaagttctgctggtttctgtactggactgaagattgatcattgaaaatgaacaaagctgcgacaaaattctttacgtcgcagctttgttcaagttcacctgggtaatggacacatgatcctcttctggaaagacaattggctgcaagaaggttgcgttcgatctattgccccttccatctacgtacgatcatgttccggcccacgtgcgctggcatcggacggtggcagaagcgctgctggatcgcagatggatcagagacatatgtggggcgttgggtatccaggccatcccggactacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 51950 - DNA, 895 bp, Oryza sativa
tcctgcagcccgacacgggattccccaaatgattaaccgaaaccggcaaacggaaccggcggctctgaacagctcaacacggacgaacgaacgaagcacggggaacacctcattcgaacgaacgagtgaacgactcaacaacggctgtgactaaatcggtgagctagacacgactcacgataaagccccggtatgtcaaacgataggccggtaggaatttaaggatgcacctacggctagacaacttggctaccgagcaacggctaaagcggcggctgggttaaagcggcacatagctgcgacacggcggcactagggcgacttgactcggctaggcagcggcgacttggcggagacacgcggctagggttaggattacggcacagcgacggctaggcggctagcgcagcggcgacgctagggcagcagctaagcgtggcacggcggcggctactcgacgacaaaaacgagagattaaaaactaaaccgagggaacacggatagaagtctcaccgaaccaaaatgatcggagagagagagatgacgatggctacccggcggcaacatacggagacgactactacgctagacagacagcggattaggtcagatcggattaaggccctagggaaaacctcacaggtgaacggcataggagcggcggttgccggcgaaccacggcacaataatgcaaacggagggcaccgggaggtagagaaggcgacggcgatttccggcggcaacacatgaagatgatgacgacactaaggccaaattagattagattggatcaagaccctatggataaactacaccggtgaacgacatcggagagaggaaagctcactgaggggtggcgcgacgatggaagatgacggcagacggccggcagcga

SEQ ID NO: 51951 - DNA, 1672 bp, Oryza sativa
tttgactactcgttttattcaaaaaaaatttgaaattattatttattttatttgtgacatactttattatctacagtattttaagcacaacttttcgttttatatatttgaaaaaaatttaaataagacaaatggtcaaacattgcaaataaaaactcaaaatctattatattgtgggatagagggagtattactctgcctgtctgtcatgctgtgcaagagtcacaaggtctgacgacgatctgtgcaatcttagcagccttgacagatgaccttctgcaattgtttaaacctcccaaccaaaagtttgggaaagcttaattatatattagtgacatgcttatcactactgttatctcttacacctaaatggatcttattgtctacgagtgatgcatcatatttaagcatgcacttgccctaatatatttacatatcctcacaccacaattaatacacatatatttgttctgtcatgactcatgatatgattattgctagtagctattatatgcacacatgcttataaaattaatactgatcacaatgcctcctgccttgcttaaaatcaacctagatggatgatggttccatggaccaagaaggcactaccaccaacaccaaagatcaaaatcatagcccacaggaagaagatgaaaaacaaaaggcaagaaaaagagatcaattcaaattaatcaaaccaatcctgataggttacatgctgcattattggttttttttggggttggtaagggttggtggggcctggatgccatggctgagctaagccagtagctgaggtagatagagggagagaggggagtgtggctaccacacgcctcatgcccttgtcctgctgcttttgctgaggttgatgagaggtgacctgacactgcccatatcatcacggcaagctttggggagaaaagagcaaggctacaaaacaaacggacaagttaggctgacctggagacagatttaaagatgatttggaaatgttcaaagaagagagatggagagattctagttcatattcacctttttttttttgcttgatcccttgtgtggtgatgatggctcgcatgaacattgatgcccactagctgctgtcgtctctccatgcgtttcagacaccggtgtggtatgtttgagcttggggggggggatttttgttgccgttttggctgaatttttataacgggataaattctagatataatgagaggtacaaaatacctcataagtatcggcttatagagaaaaaatggtatcaatactataggtgccagttgaaaaaccggtacccataaaaaccaccgctccgtcctcgagccgagccctctccttatccaccacaccgctctcgcatactatcttatcctctccctaccactctttctctctctctcaacgccacctctcctttcactgcctctcctcctcctccctctctgtccgccgcctctcctccttctcctttgcctcctcctcctcgccacttcctcgccgcctccaagcaccggatctggccgcctggaggttagggcccgctggatccagccttcttcaggtcggggctcgccggatccagccgcctccaacctcatcgccgtagatcaacgcctccagttccaccatgtccacatcgtcatcatctctgatgccgacaccg

SEQ ID NO: 51952 - DNA, 1035 bp, Oryza sativa
ccttggtctaatggcttgcacaaaagaacacatcccctatttatattcccactgcaaaatacattgggcaaaatatgtgagcattagtcttgcttgatcagggacaggagtatacgccttggcatgccaggtgcaaaagaccgctttggtggggtgatattatatggagccctcaagtcctaaagggcaaaatgtaatgtacagtcagtttttctataacaaatgagcacacaggtaatatatagttggctaacaacgtttacttacattttgggggctgcgggggcagtttgtctacgaacagcgcacgcacaactgatgctttctgacaatcatgttcacgaggagatgaactacagatgcaatttgtttgagccatgagaaaactcaaagaaaaaaaataaggaacgtaaatatgaaactgtgcattgtcacttacccttcctgagcaagatcctcatcaattacagaagatttatgttttttgtctggttgtgccatagccaggacctgataaagcattagtggtcagttaggtttgataagggacagacatacatatttgctctaagtacagaatatagtgctagcctctgaagtaggcggtgttgtcccatgctgatcatcacggctatcagttgtggcctatgcataagcaatattaatataagaatttacaattgtttatatgcaagagagtacacattgctgcagaatgaagctattagattatacctttggatctggaagcaccagtggtgtagaaggtgtcatagattggagagaagagccaattatcgtgtgcggttcaattgcatcagctggtgatgagccatgttgagaagatgccacagaagcatcatggctgggcagagtacttgtgtgggctgcatctagtgaggctagcataagggaatccacttggtaagatatccgatttctttgcaatgagccacgtgacacactagttctaatgacatattgttttccaaaaactgctttgatttctgatggaactatatctcgtgctccttg

SEQ ID NO: 51953 - DNA, 1757 bp, Oryza sativa
aggtacactatattaccaaggcttcgtggggattaaggtcacagatatcaaaaacttttacatgcacagcttctttctgaccaaagttcggctctattgcccttaccacctgtgggttaccatggaggcttcaaatatgaaacagattagtgttttggtctgtaggctagggaaatatggttgatccatataacagataaactaaggaagatataagttgaacaaagaagaagcatgtttatgtgaatggaaagagtgcagaaacagatacctgcttatgagagaaattgtttcctagattggtgcattgggataccacctacaaacagtgctaccttgtagggctagctggtctggcaagcatgaaagagtacattatttaagcaagaacaggcaaatatgtaaatgggagaggtgataatagggtaagaatttatttcttaccgtctcggaatttaacagttaatccaacaaacaatataacaacaggtccatggtctggttgctgctgtaagttttcagcgtggaactgtgtagcatgggcaccccacaatgcaacgacagcagtttcgctgtaggcacatagaagaatgaagaggtggaaaataatgtgcatgaattaagctagtattcacatttgcaaataagagagttgtgaaacaatgttgatattataaacaaaaaagaaggattgtacatgtgtaaaaagaaactgacaatgcatgtgcggacaattaagtcattttgtatttaatacaaaagcagctggaacaattagcggattaacgcatacataccttccattggttatgtggacattaagcaccgctttcataacacctccacaagaaacagtttgcactggtccaatggctgtcattatacctatagcatctacaggagtagtataagggataaaatttgcacatgagtaagtgagagcagtaagcagggaatggacaaagctaataaggaatgagatagattgatctggaccaaacagagtcacctgaaagaatatctttcctgtaagcacgacctctgagttcatcaaaagaaagaaccttgtaagcatgagatgggaatgtggatggtgcctcagtgtcttctctaacggttgtgtgggcagtgaattttgccatgaccatccgatcaataggcctgtactgggggcgcgcctcagcaacttcgaagtacttgatgtaatacacagcatcctccttcagcaaaggcttgaattgagaaacatgacgtcctgggatctgcgcatccatcatgtacccttgttgatgtttggatgtgtaagagacaaatagcatggaggtaaaataaggcatgaccatgtgcttattgctatacctgctcatcaagcaggactaaatcaagtcgcagaatcttgtcaggttcatttgctgtagtgaactgcgagaagcgcgtgacccgcactcggacttgccaatggtgtgattcctgtgtcacattccttagcatagtgtaatccatctgcaacacataaagaaggcattacataggttagagggaaactataataataataatactttgcatgatatgaagatataaagtcctaattgttgaaggaactgtggtgcaggatatatctttttctttttcgaggtgggaaatgtttcccaactgacagtgtttcaagcaggcatgtttaaaagcaactgattgcatccaagagaagaatatgcaaaaataagaaagaacaattaataagcagatatggaaga

SEQ ID NO: 51954 - DNA, 2367 bp, Oryza sativa
agtgacaaactgacaataagattaatctatagcaacgataatatttcagtgtagacgatgttcctggtagtggaacaaggcttgccatcatcatcctctatcaacaacttgaggccttgcttcgatgtagcgcgcgaaacagcgacatatagctgaccatgtgtgaagacagggtttctgaggtatacaccaacattccccaaagttgcccttggcatttgtttattgtcattgcataacatagcctaattgggaactgccttcgctggagcgtgaaaggccactttggactgttcccacttaggacaatccatggaatacagaccagctggccaatatttgtgccagtcatgattttggactcgaaaacataatcactgagtcggatgaccatcaatcttgtctcattgcaaaggccgagtgattggttaatgttgcgaagcaggactacagctgaaccaattttgagggatatgcgatgttcctggaaattgtttatggatattgagtttagaaattctatggggtacaatagatcaaaatctacaggcttttcaagtgtatttgaaatagtgtcgctgctaagatagtcctttgcatccccaggcactttagcaagcatattatcattaatctcatcaacaactgtattgacaggacagacaattgcacgctgagaaaggtaaggaatgcagtcatagttcaattcaaaatctgggtacacagcatcaattatagctgtaatcttgtcaccgcagggagtaagcagcaactccttaggtatctctatccatgtcctctcaacctcaccttgtcttttgttcatgggagcacgaccctcaccaatgtcaagaacccatttagcaaactctgccaattcacccctggcttgctgcgacagggatggattatgtagcctcatgttagtggtaaggtgtaagacttcaacatgcttccatagtgcagacctaaccagcgaagcatctaccacatcagctcttgtacctttctcaatcaccggtaagacttgcctaaaatcaccaccaagtaaaatgggtttacctccaaaaggcttatattcattagctggttcatcagcggattgaatatctcgtagagttctatccaatgcctcaaagcacagcttgtgtgtcataggcgcctcatcccatataatcaatgatgctttcctaataagatctcctaggattgtccctctacgaatagcacacatcgaccgatcatgtatatctataggtatccgaaaccatgaatgagcaatccttccaccaggcatgagtagagctgcaaccccagaagaggcaactgcaagaacaatttcacctcttgatctcaggtttgccataatagcattccacaagaatgtcttccccgttccaccatgtccagatataaaaaaaaatacacttttcgtgatggtctatcctgtcaaaaatcttgtcatatatcatcttctggtcattgttcaagctggcatacatggacaaagattcttgatggaggctatgttggttaaagctaagatcttctaagataagcctgtttgctgcactggatcctgaacaatcaactggtgtggcaaattgtatgatgagattgataagccattatttgagaacatggcatccaactctttgagcaaggtatcctgcaacataacttctggaatagctgtgcgctgtactccaagagctttggttaacttgtaagcaaaatcatctaccatgtatctccagtacttatcaaacaaaaccctaacatcacctacatcacagtgtgctagtacagtcatgaaaaggttcctgagctggtatgaagtagcccagataactgcctcctcaaagaggtgatcccattcagcgtcatcaccaatgagaccacgtgcctgacaggcttcacgataggtgccatacagcacaccttcatatgtcctaatatcttcaaaactcatacatcctcgaactaccatgagcaacattctaaggtagaacggctcccagtacttggatggatgtgccttaatctccctatcttggttcctcttttacgctttgtccaaactttcttctcaggatcccagctaaacttggtaggaaattcacaataggtgagatccctggcaaagatgtgacgttggttggtagcaaccattcagtaagcattgttctagaggaatcagggtcttctatgacctcttcaaggtcagctccatcatggtatgtcacgaactgcatgctcggcaagtgcacaatgaggcgttcaacagaaggactccttccatggatctcaaaaccatataatctccagaatgattcacaagttgataggtatctggatttgatgtgt

SEQ ID NO: 51955 - DNA, 898 bp, Oryza sativa
tacatacatgaccatgcattctatcaagagagctccagaaatacacattccattgcaatctttctcatgggagatagatggagaaggaagatggcctaaagttatatattgaacatcagaagtgatagagctgcatgttcagcaatacatcttctagatctcaaaatgcacataagccccaggctcgctcaaccatacgagctggctggcaataacttgcgctaaatttcatgagctcatacatattgtttgtcgagacctaagggaatcgaaatgtgatgcatattgacatattgtcaggcaagagctaaagataatctgttgctatcctaggaccatcagttatgatcaactgatgctgatggtgaggccggtctgagagcgttactgccattctccattgtagaatcatccacaaactggctcgtgccatgtagttgctgctcgccaatttgaatgacgatatgatgtgttctccttgctacgctgggtattctggtactgacctcctgtttgcctccctgcagcatacacctgttgattgttctggttctggtgatgaactgttgtttgccgctgcgtgttatatgcctgtggatgattattgttctggtaatgcactgcagtttgccggttggtagtatacccatgtggactctgacctgacctgcttcctcctctggctggctggtgatgatgatcatcgtatgggttaggtgccacatagtcaagatatcataaaaatctgtcatgaggactcactaaggtatttgtataacggctggcactggctcttccaccaagttttgatccaacatcaggtgtgcaaagcagtgacaataatccatttcggtcagtaagcgcatgcgcatcagaaacaaacttattgctcgcgttg

SEQ ID NO: 51956 - DNA, 1291 bp, Oryza sativa
ttaccaataaaaccatatcaccaaagcgatcatccaaagtattgatccagtagaagattttcgatttaattcgaccagggtaattgctaatggatatatcacaggaaataccatattggttgctcacatactgaaggactggaactcttgcattaggaatgaactccatatgtctagcaatacctaaataaggaatgaaaacagataagaatatcctgtaaattcaacaaaaagggttgcattgaatgaagtacggaacaaaaagaagatcgtgaatagcttgatcaaaacttattcattacagtgacttcacctctcacaagatatattgctttcctttttttttttagataatggataacctggccgctgcatcaaagacgcgcaaagcccacttattgctttccttggtgcatgtatatgcatatagtgactatttgtttgatcacaaagaacacacaaccaaaacttctatcatttcggttaaagctgttttcattaatcgaaaagaaagtttacctcgcttttgcaaagctctccttacttctctcagggtatcttgcttctttctcttacttatagggagattcaaggcattgaacagctcaactgacacatccaaatcacctgattttgcataaagttgtgatacgaaggatccaaaaggttttacagaagcacctataaaggaaagttaagaactcagaaaaagaaacactaaaataattgcactggtgactttctctaaacagtacccttttccaacatggcaaacttcataaataatatatgcattgaggaagacactatccattgtataacaagagaatgtaaccaaaaaaaaaatccagtaaaaacattatgtgacatttgagcagctccattctggctatgggtaaccattcggtttgaacaattaattcggattgattctttggttttctcgaattttggccatccgaaaatcaagaccgaaattcaatgcaaaatcataaaggccaagctatttggttttggtcattttggttcggtcctaggtcatgaccgaactgattgatcaatttcaggacatgtttcggtagtaaaaaatttggcagcaattccccagtttcaggacatgtttgacagtaaaaagtcacaaaataaacaacaaatgatatagaacacaaagatagcacttgcaacttaacatcaaaattcaactgttcaaacatgatacttaataggcttaacaggttgattttgcgcttattaactatatttcggtcaattcggttaacccaggcctaat

SEQ ID NO: 51957 - DNA, 896 bp, Oryza sativa
cctgctcctggacaacgtccggaattcgcccagctgtacatatatgacaccgccaatgagctccagaataggcttaatatttttgatcacactgataatcctggggatgtccctgatcctgttattgtgcaagagcttatctcgatgcttgatcagttcaatcctcttgtgcagcagttccgtcttgctcgaaacaagctgctttcttcaagtgctcctgagattgctatcaagctcattgggtcaggccattctcagagtgaccgttacagccttcccaccacctctgagttggcagcactgattatacctagtgcatcttgtgaggtatcaaagtttgatgtcattgtgcagaagcattcaggtgagttatgtcagttgtcacctattcatccagcccttatgtcattgcagtacccgcttctattcccatatggtgatgtgggttttcatactggtatcaagcttagagaggtagatgatcagccacccggtagtcacgacgaagcatcgatgcttgaattttatcggtacgagtcccactatcgaaaggatgagcccaatccattcacctgttgtggtaggctttctgatcagctcgctgtgaatgctttctcatgtatagagacatctcgactcatataccatgccctcaaccagaaaaaacttcgctctgagacacatcaaggtatatctgatgctgttgctaggggagacagtgatggaaaggatgttggcaccaagtaattttgccatcaagtttcataggaggaaggcgatacatggttcaaaactaccatgattcaatggcaatctgccgttcttacggtcctcctcaaatattctcaactttcacctgcaattctaaatggccagagattattgaagctattcgt

SEQ ID NO: 51958 - DNA, 991 bp, Oryza sativa
  unsure (1)..(991): unsure at all n locations
tggcgatgaatcctgcaagcaccaagaagtgagccccacacttgaggactcggcctaatgtgcattccctgtatgagctcaacggcttcgtccaaatgcccggcacgaccaaggagatctaccatgcaggcatagtgctctgcacgaggggtgacattataatccaccatcgactcaaacagcctcttcccctcatccacgagtccagcatggctacaagccccaaggacactgataaatgtgatgatattgggtgaaacgcccatttgggtcatgtcttcaaacacctgaaccgcttcatggccaaatccatgcatcccatatccagatatgagtgtattccatgacacaacatccttccggtgtcctattaaatcaaagatatgccgcccagcttcaagacatccacatttcatgtacatcgccatcaatgcgttcagaactgaaacaagtgagtcaaaacccctccggaggatatacgcatgcaacaatttgccctgcccgagagcgttaactccagcaaaagcatgcaagatgcatactattgtgactgaattgggtacaaggtcttcatcagaagccaccatctcctggaatagcaaaatggcatcacctggtctctcgttcttggcatagcacccaatcatggcagtccacgacacaacattcctctctggcattgtagcaaacacactctcagcatagctgacgattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 51959 - DNA, 3885 bp, Oryza sativa
aagtactgagcaatacttacagagaaaagcggcttatgaacaacaatgtcgtgaacaacagagcgactggcgggtgttaactatggcactccctccatgggaagcccgtccaagatgcaggtgtggtgatcgttgtcaggttcttcgttccataaatcctacaacattgggtcgaaggttctttgtttgtccaaatattcttgacgacgagttcatggtaagaatattttgattacatgaatccttattttctcacaacatttactaactttgcttgctttacatctattctttcctcccaggaaccaccaaggagatgtcaatacacagaatggatagacaccagaagggttctaactccacctagccgtgttgtgcagcttgaactaccagagaaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaggcaaattattatcaggtattaacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcaccccctcaaaaaccagaggcatggactctccagcgacccccgtggacttctcgccacttctcagtctggcgcactataatgaatcacgctatacaaaagataaagccgttgcccacgctggcttgtggttggcacggtaaatgtctcacaacagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccactcggtgacattcgaaaataaatgcacagttgaaataaatagagaatttaaatataggatcaacatgctcaaaggattgtgtttaggatctgtgtgacttgccttgcaataatcggccttcaagtaatcttcttgatcacttccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgaaccactcaaaaccgagttacgatgatttagttatgaatttccgaagatttaatctattagaaaaaactggaaaaggagaagatgatgacgtcatgatgacatcatcaatggccggaccaagatggcgacctcgccggagatagagcgaccggctgcggatttggaggacatgaacacgtagaggacgacgagacgaacccaacgatactcaccctcgtgccaaacgacgaccgacgacggccggcgacgaggaggcgacggcggcggctcgggttgcacggggcggcggagctccgatgaccggcgacgaaaaagaaagggtggccgagcttcccctcaccacggcgcacccaacggtggtgacggcgaccggcgacgacgatggagacggcggcgcggcggcaccggagatggccggcggcggcggtttgcttggcggcggtggcgacggagctacggagcacggcagaggacgggagagggggcaaacgaaagtggaggactagggggtcctatttatagccttggattgaagagatcggactcctcccgcaagaaatcgatccgggaaatcaaaaactcggttttggagataaactcgaaaacgagtttgattcggataagatactcaacgatttgctccgatttttgggggtaaagatagaggaggataagaggaatatttcccctcaacaaaattggagaaaaagagcaacggggaggcgagaattggaaggaagaggcggcggcactgtgcacggcacggctggctcgggctctgcctgagttggaagatgaacagtagcgcagggagggaaagtagacttttccggctgagctgagaggagaggaggcggctcaggttgggccggcggaagagagaggaaggaaaggaaggaatgggccgaaaatggcccaagctgaggaggaggattttattactttcccaattaaaataatcacttaaatgatctttgaattattaaaaatacttccaatgctcaaataatttcaagaaaaatcctgaaaatacttggacactcaaagtacttaaaaaaattacaattagaccatttaatgattaatttaatatgtgggtaattactgaaatgctctttgtatgattaaaaattaggaattgagctccgaaaaatccgagaaaattccagagagtataattaaccatggagaatttaataaaaattaaatccatccatgctttatatttaggaaattttatttcccacatttaacttcacttgtaaattaatgaacatttaatataaattctattattaatttattaaacaatttataaatcctgaaacgaaaatcaggatgtgacaatctatgtaaccgcaatgcaaatagttgtatcatgttcaaattgtactactatttcttcatgttacataattctcctagtttaagtccatataatgtttctacgacccagactgcgataagcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtactttttcatctgggtcctttgccgcccagggacccagatgaaaaaagtacggccgcaagctctttatgggcggccaaaattgcaattagccccttg

SEQ ID NO: 51960 - DNA, 1329 bp, Oryza sativa
caggtacttgacttccgtaagcaaaagaattatctttggttatcaagcacccacctccttagtccttaccttaccatatgtatctttcatggccttattgttattatatgtgaatgcatgccgcagcaaatagccaaggtcctttttaaagaacatatattaacaggtactgatcaaagaagctaatattaatctcttggcagctttctgatgtatctttacacacagttactaaaattatgcttttacccactaaaactgcatgagagttaagcatttgtgtgtccttttccctttttcttttaggattaatcagaactatgcttattaactttgcaccatggatattctatttttaacttgtgacagttgcgtgcatcaatttttctagcacctctcatgtttatgcggataacttctatcttggtttatttatcagaaggttgtgggtcaaggcttgacaagaacagcatcgattgctgcattaaatccacagctacctggatcgtcgacaaatgggccgatggcacaaatgtcccttcctcagaaacagcagcaggcagcatggttaaaacaaatgcaatcatcgctgggatcacctgtttctccacaacaatttcagcatcaacaaaggatgctattaatacatcaacttcaacagcagtcaggattgaatcaacaccaaatcgcacaaacccaacaacagcatcttcatctcaatacccagcttttacagcagcaacacattctacagcaacttcagcaacaacaacaatctccaaggatatcagcatctggttcccagaagtccatgaacctgacaggatccgaaccgggcactcctttatcaggtggaactatgactggtggaagtgcaagtcaaggagcagaagtaactaatcaacttcttgggaagagaaaaatacaagatttggtttcacaggtaacaaataaccttctgggttcattcttatgagcttctgtatcactggtatgatgtgatcgtatcatgatctttgagatttttcttgaaatattagaatcgcattcccatttttcagaagcatattctctttgttggttgaataataatattttgctcttttggtcgaataatactttactcttttggttgaataatactttgctttgtctttgaattgtgaactcctatttacaggtagatcccctgggcaaggttgatccagaagtggaagatttgcttttggagattgctgatgacttcattgattcggtaatgtgtttgttgtttgtaaatcatgcttttacagcacacttgctcttagtgaatttctatttggttgaaaa

SEQ ID NO: 51961 - DNA, 860 bp, Oryza sativa
gagctgaaatacgcacctgtccgtacttgttccatccccagcagaagacctcgccttcatctgcataaatgtcaccacattttgtcagtagatgttagaccaggaacagcactttctacgggcatgtttaaacaaattgtcagggaggccaaagattaacaagaatttaagtacttcaatcacacatggaacagcttattgtagaattccaactttccaagcacaagttactgataatacgctaataactacagtgactcataatatgattacacatcagaatatctaggaagattcaatagggcttgcttatatggggattaggctcagtacgttcggttggcagacagattaaactaaaatactcatggctttctaagggatcgagtataatctctacctcttcaacaaaccctaaaggtcttgtttggataattgggtttattcaacaaacccttgccagaaatatttccttgatttaaatgagcatgagaagagcattttattaatatgcagttatattagacagataggatagcaaattccttctaggggaaaaatactagtacagtcaaaggtaccagttattattgcactatgacgagctccacaagaaacagctcgtgcattcttattctccaagcttgaggcatctaccagttttggtacagtctgcataaaaaaaaaagcaatatacttatggttatcacttactgagtaaacatgcacctcacatacagctaactccattttgggaggcaatcattatgttaactgtagttattttccctaaacttactttatgtaattaacctccattaacatcgaaaagaatagaattgagtaaagtgtacgggcgg

SEQ ID NO: 51962 - DNA, 1080 bp, Oryza sativa
atgtctaaatgtgcgaaccggatagtgatctgtgcacatgtaattcagcgtgctaattcgagttctatgaatattaggttgcgacgacgtgccaggacaggatgcacgagattgtcgccgaggagcacaacaagggggcctccggcgaagtggcgccttggagggatgtgatggagaagagcttcgcgcggatggatggggaggtcggtaaccgggcgtccacccgcagcgacgacgagcccgcctgcccgtgcgagcagcagacgccttcgcgtcgcgaccacgcgggttccaccgccgtcgtcgccgtcgttagcccaacacaggtcgtcgtcgccaacgccggcgactcccgcgccgtcatctcccgtgccggcgtccccgtcgcactatccgttgaccacaaagtacgtatatgctcgcatcacagggccggctgagcctttcccgtccatctgcaaaaaatcgttagtttcttgtccatgagcgtgtgcctgacatggttgctacttgctacctcggaacggttcagcccgatcggcccgacgagctggaacgaatcgaggcggcgggcggccgcgtcatttactgggacggcgcccgggtgctcggcgtcctcgccatgtctcgagccatcggtgagctgatctagttttaccttcttctctcgtcgtctcaagaattttgatttggcacccggatccgaaactcacctgcgtatgggcgcgcaggggatgggtaccttaagccgtacgtgacgtcggagccggaggtgaccgtgacggagcgcaccgacgacgatgagtgcctgatcctggccagcgacgggctatgggacgtcgtgaccaacgagatggcgtgtgaggtcgtgagggcgtgcttccacaacaacggtccgccggcaccggccgcgcggccgagcggcgtgccctcctcggccgaggcggcggaaaccgagaacggaggagccgcatcggtgaaggggataagcaaggcggagtcctccgacaaggcgtgctccgacgcggccatgctgctgacgaagttggcgctggcgcggcggagcgcggacaatgtcag

SEQ ID NO: 51963 - DNA, 1441 bp, Oryza sativa
aagggaggtggcgatagctcctcactcatcggcgccatgggcaccgctgccaagaacagctgcattgacgtcgtcatcctcctcattatggcgttggccctgtccgcgcagctcgcacctgttaggcccgatcgaaatcacagcaccggctgttgctttctcctactgcccgacgcctaagcctccgatgccgcctaatccttaaaatataagtatttagcaagatactaagtacaatgacttagtaaagtggaaaaaaatatatcttgatcgtgtaaagttgtcaaggataatgacagcataattcatgctttcatctgcctctccaaaaaattgagacacgtacatgacttgtgtaaaagacaaatacaacagctggcgtaagtgaacatgctgaacgggctggtgcacacggtagtcggcaccaaggccagcgacacatgctgcccgctgctgtccggcgtcgcctccctcgcaggcgccctccttgccatccgccgaatttggctcaacaagtggtggagattgatgaaaaaaaaaagaagagaaagagatgatgaagaaaaaaatgtatttgacgggtgggtctcacttatagagaaagaagatagaaaacataacggcagtggcacgattataattttgtaaaatttcagtgacacggctacaaatagacgcactgtaataatatttatctaaaatgttatattttcaatgacatggattgaattaaacccttacatctaaacttgcgtgtcagtgtctcacaatacatcagtagtgctacagacaatctccagttccccgctgccaggaaccaatgctggattgcgggaatcaaccaaaaaatggctatcatctcgggtgatcatattactcgatctgacccgttgatctatagaatgggcggtcaaaaaacgggtccagtactccagtcatgtaccaacccttcgtcccaagtgccaactgcgcctgtccgatcggttccgatccgaccaagccacacgtcgccgaatccgaacagctcttccacgaaccacttgcccctcctcacgccctctcctcgtcggtttcgaaccatctagaagcgtcgccgccgactcgccatctcctctctaggtcaccggatttcctagccggcggcgagctcgtcggctcaggcggcggcggcggcggcgatggactggagctccgtgactgcggaggatctggtggacgcgctgcgggaggtggactggtcgacgccgccgcgccccgtctccgagttcttctcccgcttcaccgccccgcgatcctactccaagtggaccagccgcctcaagtgcaacctctactagtaagtagtacggcttctatctcgaatctacctcccacctctgtgcctctcctcacgaatcgaagaatgagtgagctagattggttggcccactgtgatttgggt

SEQ ID NO: 51964 - DNA, 2548 bp, Oryza sativa
attcatgtttgatatgcagttttgcagttacattcaatgagaaagtcacaaggacagtcagacaattttcaccacatttagcagcaaagatgaggccacccttaaggtggggatcctctccccctatttcttctataacattcttctttttttaaagagtctcagaagaacgggctaacaacattgctgatatttgcagacctgtcattcgtggccgaccaagctcaaaaagatcaattcatatttgtggccggcctcgatgggtttttgttgtattattttctgtcggttagtataaagcactgacctccatacatactattctagaccatagttttttttttataaaaaaaacaactaaataaataatgaactcaacatataatttattttatttttgcagtaagctgcttcctctggatgacctcatgtagtctccttacggttctgtgggcactaattgttgtctgcttggtaaggccaaacttgaggtttaaaattttaaaattgtgcatgtgtgcctaatatataagtttgtgccttgcagcaaccttgcttcacgccagtttcagaacacctaatctgaaagcacgcctgaacacattcagggaggaatttcgagcagtatggcggaattatagcgagttttaaacgccctttttgtctaccccatgtgagtgccttcatcgctgtcttatggtcgaaaattgaatctagcgaagggcttaaagtgctacctgttctgtcagtgcatcattgtggagctgcttattggatgtctctgcggtggtgcaatgtagaaggacctacttcagtgtgctttcgaatttcttgattttctctgcagatttatgtggtaaaaatgttaccaagttccatatctctgctgcctcttgcgactctttaattgtgggagattaaaaataggcatgctattttctccagtttatggatttggctttagattgtggattattctagtcccccaccacatggatctccatagttttagcttctggtccaaaacttctactgtattttgatacattggggaaggaacagcatgtaaaagagacagctatcctgaagagaagaaaaaagatattgttgtgaaatgcctgttatttttcatcgttcttttacagtaatggcacattttgtttcacataggtgatttccattcttttagatttctccatcaaaaagctcctcgtaggttttgtagacactctcggggtgagcaaatccatctcctctgatttgcttaacctgtccaacatgaacaatgcattttcagttattacaattccaatacaaggcctacaactacaagaaacccttggcgtatccactatacttgcattttgttcaatagtacttttttctgtactggttactaacttatcggaagttcagaactgtatgaagtttattcatccggaattgcataagatatgaagacagaagtgaaactgttttctgcacttgagacagctgaaaggttggatgcacttgcctgttcgatttcagagagcttggcacacagttcctcaggaatagaccaaccaaacagatccatgttctccttcaacctcgcctcactgacgctcttgggaagcacactctgaccctgctgaagaccccagcgcagagcaacctgagccggagttcttcctagcatctcggctaccgatggcaacaccgaatcaacggcgatgcccttcatcctgcccaatggagcatacgcctgcaagaatcatgtgagcagtgaaccacagcacaatgctactactacatatcaagtgatcgatgagctcagaaacatgcaggacttacagagagatgaacgccactggtgtggcagaacgctctgagcttcgcctgctgccagcccgggtggcactcgacctgatcaacggccggagggacgcgggcgacgcagagcagatcgccaagcttcttggaggagaaattgctcacgccgatcgcgcgagctttgcctgaatcgtacagctgctccatcgctcgccaggtgctgggtatgtcaggcttgacgaagttctctggactgagctccgtgcctttcttgatctgaaacggccaatgaatctgcagagattgcaccgttgggcacctgtcagaagcagagcaaaatggcaaacctttcactgtctacgtttacgctgatcatgatgagcttaccagatacagatcaacgtaatccagctgcagatctttcagtgtactatccattgcgagtgggacatcttcaggtgcgaggtcgctgcacctgcagagtttgggacgtcttcaagaggaagggatagaacataattcgaaatagcagaataaacttgcactactagtagcgttcagaagttgaggtcggtcaatagaaggaacaagacagcagcagtcagcaccatatcttggaggtgatgaagaggtcttcccgcttgacaaccccatcatcgaagagcttcttcagagcaccaccaatctaggagcacacacaaaaatcactctcacaagttaaaccggtgcaatt

SEQ ID NO: 51965 - DNA, 735 bp, Oryza sativa
taaagaagacaccatttaggagacttggaaagcgtgcgaaaaaaatccaaaatatggaatcgggaaaaaaagagagggccttaaactccctttatcacccttgtcgtactaagagttctattgatattcgtcaatattgcactcacatttataacataatgattcctttcacctgtacggataaatagtacaaaatccaaatacgacataacacaaatacattataattattatgtaatcaactctcggtttcaacttaaacagagctaattagtgttgagaaaaacacaacccatggtgcttaattattctctcgctgcatcacctttaattttatttttatgttattaacaaaattaatcatcttcatatatgatttgatatgtggcaaagcggtagcgctacagcggttgtgatcaccttagatgtcttagacactacgctttgtcacacgtgcgaaaggccaaggtgcagacgtgcgttgtgcagcaggcaaaaagagaatttcggacgctttatttattagcaaacaatagatccaatgattataataatatgtccaccagttctactgtaagtgtaaattagttaatatagattttaaattgttaatataatggatacacaatataatggtgtagaccttattttgaaacagtgcattacctgagaataatagaccaatgtaaaaaagtagatccgataatttatataatggggccatcagtttaagtg

SEQ ID NO: 51966 - DNA, 1683 bp, Oryza sativa
ctcccagcacggaaaccgcccaccaactttcgccgcatggcgccggtcgccggggcggcgtctgagagggcgcccgcacggcgcgcggcgcgggtcggaagcggaggagggcgatcgagatgagggagctcgccggcagccccgggacgtggagcggcctctcgctgcgggtggggcagctcgtcttcgccgccgcgtccgtctgcgcacggcctccgccctcggcttcgccgcatacaccgccttctggtgcgtgccgtcccgccccctcttctccccacccttgtctcgacgtcatcccgtacgagtagacgagtagtctgtcgctcgattgctacgagcaaccctcgctgcgtgccttatgcgtttgcaaatcgattggggatgctctggtgacggcgtttcgcgtgcttgggcagagtgatttagtgcggatcataggcatcatagtatcatacacgcttgaacaatcatgattgagtcggccaatttgctgattgatagagtagcttattaaaatttggccggcatgtcacgccgccctgcaatttgctgattgatatgcagctttgttgctggataatcattgttgtggctttattctatatccgactgcttgcttcctggagccgtctgctactgtaattggggatggaagttttgtggcaatgaggtttcctttgtgcattatattattcacaatttcattgacagaacgattcatttcgtaattcaagtttgtgcaatttggatcatcaaagtaaatatattgtcactgttgctttgaatataagttggccttaggcttttggtctaagtttgtagccactgatagctgtaagatttgaatagacactccttcaaaattgacaatcagttaaaactattcagtgactgaggcatctgtttcaagcagtagaatggctttgttcatcttcgggtgcagcagccggggatgttgttattccgttatctaaatgtttgaagcactaggagagaccaaaggtagtcaatataatgaaatttaaaatttttatgttgctggaacattgagcaactttactcatatccaacattcattgtttaagtagggtaggcatgccaatcattcatgataatctgttctttgtttgtttgtcctatttattactctatttaatttgatgagtgacataggaagtctcagtgttgtctgtgctgttaagattggtgtgttcattttgtggaaggaatctggcagtcgtttgcatatgtgaacattcgtctatgcatccatcaaagcaaaaccatttgatctgcactatgacagaacttgcagattgaatagtatcctgttaagtaaccagtttttggtgaactctcaatttcagttacttgattgcatcgatgggactacaggcactctggagcttgggacttgcttgccttgattgctatgccttgaaattcaagaaagatctccacagtgctgttctcctgagcttatttgttgttggcgactgggtaattattaatgattttttttcatctcatgtattattcacctcagtagttcccacaaccattgaaatggataaatatttagaaacaaatcaagtaaaaatttaaatttctgaaaatttctctgccaggcctgtcaaagcataagtattatactcagatagaactcattataaaaatatc

SEQ ID NO: 51967 - DNA, 2991 bp, Oryza sativa
tttctcttggccatatgtatatggctacccatttcagggagctattttgtggagtagaaaataatatggaacactctcgtcctcacaatggcttgcaagactgaggctgatggaagaacaagaagcatggcctaggatggtttctcatctcgttggcttcagttgctccactagctcatttggtttattgattgagatactgaagaacttcagatccataaaccatcactcatcggtatacagaaaatgacaaggcttgaattgccagtacagatcgaaatcaccaccacaaatcacaaccgcaactgcgaagctcagcacagcagcatgagcaaattgccgtttcatacttacataccagtagttctacttttattttttctttttctagtttttgcgatgagcttgtacaaataattggcctatagtttatatggatctgcctgatccttattattatccactttgcatcatttgctacaaattgtgcaatacatcatgggtctgttccatatagcagtatatatttgtttcaaaaagaacaaagtacaaggctgatcctcttcttttataggaaaaagagtttcttctggtcctcttggtgcagggttgagaactttactggatggtccaaatgaaggtacaatcaaatatggcacactgaattctcattgagaagcagttttcagaatgtgagtaacacacatgctaggtcaacatcttggaaggatcacaggtataaactaaagatactgcataaaagaacttgagtataccataacataaaaggagggttagttcacatgacaatctcaggcttcaggatgcttgacttgatctctttgtgcgggagaacaacaccgccgttggtatagacctcatcacctacatgtacgtcctctcccaggatagtcatattttctatccgtgcccattgtccaacagttgagtgccatccaataatgctgtttgatatgcaagcatgcttcttaatgtgcacgccacgcatcaccgtgcaacgggaaagcctcacaccatcctccacgacgcatccaggaccgatagcaacatcaggaccaatcagacagccttcgccaatcttggcactctcgtgaactagcacattcccaacaatgtgtgctccagtggctaacctgttggttgatctcttcctaagtgaatccagataaaggcgcaagcctgtaatgtaatcccttggttggccaacatccatccaaaaacctggaaggaccagagcaaagagctttgcatcagatgcaattcgaggaaagacctctttctcaattgaagttggcttcagctcgatgcggtccaggacagatggattcaacaagtaaattcccgcattgatcttgttgcctacaaatatttttggtttctcaacaaatttttccaccattccagtgacctcctccataaccacaacaccatattttgatggttcgtccacctatattgaaataatagtcagtatacacagtacacaagtttacaattcaagagagtggtcaaagaaaggatctaccttggtgaccataatcgttgcctcaccaccatggctcttgtgaaattttatgagctcagcaaaagggtattcacttatgacgtcactgttgaggacaaagaatggctcaccagatccatccacaagcttgtcccttgctagagcaagagggccagcagttcccaagggctcagtctcttgggaacacgtgattgtgatgccaagcttatcctcaaagtccttcaggaaattgagcattacctaaaagacggatcagagcaaaccaattagaatgtgaagttagttatacttataccatgagacaacagtaaaagattatctcctttttacctccggtcggtagttgatggctaaaacaacttctgttactccaacttctttcaaggcctcaatctgcataaatcggaaaacttttaattcagagctcattactctcctcaatcctcatgctcatgtttgctggagccaacattttggatataaatcaagtactcttgataaccgattggaattttcgaggacagagaaaatttggtgtgataccaaaagagttttccaaaatcatgtaaccaaattgataactaaggaaagaaacaattgaatagtaaaaaggtgcattcaatcacatccaagtgcaacctaccatggatttttagttgttacaccatgtttatgtgggagtaataaacaaatcaaatagtattaatgttctctgaccagtttagcaccctctccctcctttcatggagaggccagtgccattgttggactgttggtaaagaatactgtactataattaacttgtgcccaattcatccattggcactgcaaataagtactcttattactccatcagagtactagcgaaaccacttattacctgatgcagaatcatgggcttgttcgcgaaatcaacaagaggctttgggaaactgagcgtcaaaggccgaaggcgagtgccgaagcctccaacaagaatgagcgccttcatggtgaatcgccgcctcctgttctcccctccctaatccctactccggcggggatcctcaagcgggctcgggaaggagaaagctgccattgcaacagtcaaaatcaaatccgacactaggttggagcatcaaagaacaaagaaagaaagatttcgatttgatcgctcgcggccgcggcaaagctccgatgagtttagggcttccgtaccaataggagggatcagcctggaagatctctcttccttctccacgaccagcggaccagccctcttggaggtaggtagcgcagctgcggtggaaggaggagggctttgtgctgcgctggattgggaatcgagaattgggtgggactttatagagacgaagtggagaggcgacgcgaggggaggggaacgagagtacgagacacgacgagaggttcaggctttcagaattcagataactacagtagagatg

SEQ ID NO: 51968 - DNA, 1571 bp, Oryza sativa
  unsure (1)..(1571): unsure at all n locations
taagcttgtttttgttattgaattcttgtcactaaatattactagtatgataatggttatttattttgcataaactaagcataatacatttcctttttttattatgatatacattgaatgaatgttttttttcttctacagacggtatctgccatgtttatattgacaaatcagctgacatggacatggcaaaacgtattgtattggacgcaaaggttgattatccagcagcgtgtaatgccatggtacttctctaatttacaaatttattagcgtgtgcccatatggtgatacctctctatttattgtacttttttttaaaaaaatgtatattacgaattgtatgtgtgttctacatcgttgctggccactcatgctaacttacaagtattgttgtcgaacttctggctaaaagcaatagttcactgtggaagatgccattctattcaagtctaactttcctatttgtccacttaanttatttcttggaaaattttatcatttgagcacagatatctaaatattttttatattctgtgcaggaaacgttacttgttcataaagatctgaacaggacagaaggccttgacgatttattggtggagcttgaaaaggaaggtaaaatccacacccttgtagttgaagtattgcagccatttgtatcttgacatgtgttctgcaaaaagtgctacttcctccgtttcacaatgtaagtcattctagcatttcccacattcatattgatgttaatgaatctagacatatatatccatctagattcattaatattaatatgaatgaggaaaatactataatgacttacattgtgaaacggagggagtatttcattttattatgagaaatgatgaacagttatgtagctcaacatcaaagatttgatgttcttaattactttcaatgcttctcaagggagcatattacagattttacttattatgttgcagtcaatccaaaattgctttgcaacacgagttcttgtgcaaatcagcaaaaggggatcagaagagcactaatggattttaattgatgtcatgttgcaggggtagttatctatggcgggcctgttgcacatgacactttgaaactaccaaaggtagattcatttcatcatgagtataactcaatggcatgcaccctcgaatttgttgatgatgtgcagtcagcaattgaccatataaatcgctatggaaggtatgcagtttttctccatactatatcctcatcactttttttttttggaagtatgcagtttttctccttactatatccccatcatttcttttttttttttttgaactaaacttgattgtgttaaatatatgttcatttcagtgcacacacagattgattatcactactgatggaaaggcagcagagacttttctacagcaagttgataggtgtttaactaatttcctttgcacaactattatgtttgccgcttttagtacataccttaattaatggagttattcttctataaattgcaacagtgctgcggtattccataatgcaagcacacggttctgtgatggggctcgctttggtct

SEQ ID NO: 51969 - DNA, 924 bp, Oryza sativa
ggcgtatgaattttgcattagtaacatgggtgataataacagaagaaaggcacaaaaaaaagtatttggaaacttctactccttcatttttatatttggcaaagaagattcatccattttatatatatggacagtgaactattagtactttagaagggagtacctatacatctttcgaaagatttttataatcgtatcacacagatttttaatctttggattaaaatccgatagatataataaaaagcaaaaagcaattaagaaacactataatggacactaaattaccatatcctcaagaaaaagaccaaatccaatacaaaatttaaaatttacatgcgaagattcaaaaattacagtgtaacttacaaaagttacagtgtaagtttcataaattacactataacttacaagaaaatgcactgtaaatttgagtgagaaaatcgagtgagagataagaaaaaatctttcgagtgagatatagcaaaatcgctttagaaaggttgatgacaccttcacaaaaaagaaggaagaaagtaggggcagatccgctctacttttagggcatgtataatccgcactactcaaaactaagtagcacttacccttcttgcttactaccacgtgctttacacctggtccaatattatctcgtttcaagacaagtaatataacaaacaattaacaaacacattttgggttttcaggtagggttggctctgaagaagctatttgaagagggtgtggtcaaacgcgaagatctgtttatcacgtctaagctatggtaacctcaaatttatgtgtgattggcctgtaattatgtctttgcagttgaattggaattccagtgcttgcttggagctttacttcaactgatcagaggtgatgggtatgtttgtcaggtgtgatcatcatgccccagag

SEQ ID NO: 51970 - DNA, 735 bp, Oryza sativa
agtattccttgaactttataccattgaactctacttggacgtataaatatttttatggattgtttgattcgactccaaaacttgccctaccgaatcattgataactacaaaggtaataactcttatgtatttggattgcaaccaaacatgtgccaaataaatatagtcgaggaatcttatcctacaaaaacgagagtaccgattcctgcctcgtgcaagaaatttgaacattccaacagggataatggcgccgcacacataaaatcttctcatgaatcaattctggttgaaacgaaccgctgctacaatagaaaaaaaagaagattatggtttactaaaggcatgcaatgatgattagtactttgtgtctgatggatcattgtcatgatttatttcgaagcaaacgaattagctctgccgccatgagtagtactactatcaggtactgttaatagtggcattgtccaatttctgcactgaaaacaacccataaaaggttagacagcgccactgatacacacttagaagtcaagattggatcttgcctgccagaaaaacacggcggttagggggcaaagaaatcagaattaacccccaaaaaaaatgtcaaactaggcagcatgcctaactagacacggtcgcctgcacggattcactttaatgatgatcaaaatctctctgcaaatcttcagagatcgatcgagacataataaaaacacaggtggtgcatgtttc

SEQ ID NO: 51971 - DNA, 731 bp, Oryza sativa
agcatcttagttcaaatgtaaattaaacctacgcacttaaacgtacctgaggttttgattcttgtttgaattttgtcggagctgacttctgatttgcagaacatatgctacttcctccattacttttgtcactatctatgctggagtttagattggtaattttgctattgttgctagatatcccaagcatgtaacgtgaagctacaactgccttctgctctttgatgactaccttcctctgagagttctccttttcactttcagacagttcagctgactttgtagccttccgttgatgagccaatgcttctgaaatcccagtgggagttgacatctgcatcaaatcctttggatttccaatgcaagggttccttcctggaacaggtcgaaccccaacaagaactgggacagggatactagattggaccttttcaacatatatgaactgtccaagttgaagtttgtttgataagatgagttcattatcctccttcgataaagaaacatacgttgagtgcgacgagtctgaaacttttataaagaaaccatggtctggccaaagttctgaaccagtgattgcaggaactatgctaataacttggagaagaatggaccgatattctccacatactttcacatcagaatttatattttttagtacttttaacagtacccctggagtaagagatgccatatcttcaagccagcttactcttctgggctgcaggaat

SEQ ID NO: 51972 - DNA, 713 bp, Oryza sativa
aaaaaaacatggtaaattatgatgctgacaagctagctagctactacaaacaaaataatattgtcaaagtcttgagcatgcacattctgaacttaatttctgataagatgttcacgtgaaatgagtagatcgagtgagtatgtacataccaatggggtcatgaggcggcagaggagtgatctgaagatgccctggttgggcctctcgtagaagagctgggagaagcgagtggagtagaagaggaagaagggcaagccccagattgagtaggatggcaccacccaatgcagggtcctcaccagcatcgtgcacggctgccctccctcacctgcaaccaaaccaatcaatcagaactgaacaagcttgaaattaaaggattaataattcttcagaattaatgacagatagtttttgttgctgcatgatcaacttggaattaattactaacttgatggccaaacaaaaggaattaatatactaagctagcactttgatatggtcaagtacacagtcaaaatgttggagtgatcatctctgcgcagtttcagagtagaaaaaagagattgacaagtggaacgcgtagctagcatataaaacacttcagcttgaaaagtcagagcatatatgcgtatgtgttgtgtttagcgtactttgaacctgtatagagcaagaggaggcttggctacatgtggcataaaaagaaataaaattct

SEQ ID NO: 51973 - DNA, 1137 bp, Oryza sativa
gcgtggtaacgtatatacacacgtcactgcatacgtaacatcgtactcatacacccatgttcaatgaagcagaaactagcgagacatcctaaaattttattaaaacttgaaagtccatcagtttcaaaaatattttggggttggaacggaaatatgctagggccatatggtattatggcaagtcgtctcgtttccattttaacatttttagcttacttttaattcttataggcatatgggacaaggagctataaacttgtaacttggacgtttatagcttgatcataacattggtgctaagaattttaactataaacattatagttttatgataattttattgttaaatatgtggttttgtaatacttaatcttaaatcaatagttttgtgacaaattcagtgttaaatctataatttaataatacaacatcttaaatgtgaagttttgtgatagtttgataaaaatatattaagttttgtaaaaattactctattaaaaaaaggaaatgtgtgctatgctccctatcttgctagtccagggaccaaataaaacacatatacttgaacaactatcagtccattgcagcaacacttaataaacagccaccaggttaattcaagtagcatatgacagtataaataatagaatcaaacgtagataagttcacatatcaccgaactcgcgtacactggttcagtacacatgtctcgcacaacttttatggtagtctatggctcataaaccgacttgctaatacaccaacacaaattaatcaagcttgaaccttaaccggcatcgcatgccgatcccgtcttttgacgttgcagtaattttccgttcattagcctctgcatacttaccactgcagcttaagcgttcatgcgagccgggtactgctcgacgcagtccagccacgggctgcgcgccgggcggcgcacgcggcggacggcgcgccacacggcgctgttgcacttgaacccggagccgaaggcgagctgccacacgcggtcgccgcggcggacgcggcccttggcctccaggtacgccagctcgtaccagatgctgctgctcgacgtgttgccgaagcggtggagcgcggtgcgcgacgcctccaggtcgccgtcgcggaggccca

SEQ ID NO: 51974 - DNA, 1983 bp, Oryza sativa
ggcgagccccgcgccgctggcctggagcatgtcgcgggcgaggtccaccgcgatgacgccggcgctgcaccccatgccgccgaggttgtagctgaggatgttcccgcgcatcttgtagtggttgacgatcatggcggacagcgacggcgtcgggttgaagaggctgcagttgacgacgagcacgccgacgtccttgggacggacgcggcacttgtcgaacagctcgtccagcgcggcgaacatggcggcggacgcctcggcgcggccttccttcatggtggcgcagttggtgcccggctcgaacacgcagcgcggcatgtaggactcgtcgccgatgccagacttggccagcagccgcgactggaacgccaggctatcctcgtcgaacttgcccgacttcctcgccagatcgatgaactccgccttcgacacctgcaagcaattgtccatgcaaaatcacatccttgcttacaaatcaccagctagtaccataatgcatcaaactgattacaaactgtaagtaacaagtgaaatcgaagaaatttcatgcatgcgaaccgggtaaacttggttgtttgactcaaatccatcgtgcgtgcaaggatagtgcaggttgtggtttgtgtgctcacgcaaaacatttttcgaaaagaaaatgtgtgctcacgcaaaacatttacggtttaataatacggttcggctcattgaatgtgtgtgccaagtcgcccaaccgtatttgatgacccgaccaagtgaaagcgatcgactgatcgagtcaccggctggcctggccataaccgaaagcatcctaccagctcgtcataacttcgaccctgccctgcccattcacttccaaggactggggcccaaccaaaggtgcctcctaacttgcattcaagactccaacaaaataatggtagccaacaaactgttttccaaaacttagtgatgtgtagcatataagggcctgtttagttcgtgaaaagaaaatttttatatgtcacatcagatattttaccggatgtcgaaagaggttttcagatacgaatgaaaaaactaatttcataacgcggtttcgtgaaaagaaattttttatatgtcatatcagatatttcaccggatgtcgaaggggttttcggatacgaatgaaaaaataatttcataactcgtttggaaaccgcgagacaaatcttttgagcctaattaatctgtcattagcacatgtggattactgtagcacatatggctaattatggactaattaggctcaaaagattcgtctcgtgatttcccccctaactgtgcaattagtttttgtaatttatatttaatgctccatgcatgtgttcaaagattcgatgttatgttttagggaaaaaaaattggagaactaaaccaggcctaagtctgcaaagatataactagagtttcttttggagtatctactaaggaggagcttcttatcaattttggatctaatatatcatgtaaatactttataatattcagttaatattttattaccattcctttagtcaacatagagtaatcagggaaaaaagcagtggtcaaagactttacttgagaatgatggcagtatttatactaaaagtaacatacagtacaagataacagaggcactcgggcacaaggaaaagcatctatctagtgtaaacttattaggtgtagaatcaatatatgataaatgaatttgattcatacaaaatagcactacctccgttcttttttttttgtgcaatttctaagatattgctttgaccattgcacattttacaacgttgtgttaggatataatccctccgtttcatgttataagatgttttgactttggtcaaagtcaaactgcttcaaatttaactaagtttatagacaaatatgaaaaatatggtaatatttaaattagcaaattagttttattaaattaataattaaatatatttttataataaatttatcttcggt

SEQ ID NO: 51975 - DNA, 720 bp, Oryza sativa
cagcacatcgaaatacacctacagctagctggagggactaagctttcccaatcaaaacaaaacagaactaatatgagatgatgggtttgggaaggggatcaatacctggttggcgagggagagggagtggtactgcatgcgcgggctgcgcccaatgtctcccagaactaccaccgccgctcgcttcctcctccctgcctctagtgccacggccattgcctactagccttccgagtttggaaatttcagattcaaccgccaccaagaagtgaggttcctgaaaaggcatttaatttagctaggtattagctccaaacatccaggaagggaggagtagataaaaaatggacaacggttctcttggttatttttctgttcaccgcatttatgctcaattagagaatacgtctgtactattttacatcaatacaacaatgttctgttgacggaacaagaatgtagggatgcaatatatgctagtgagtttatactcatgtaaattaattcgttgtttcgcatattgttgaacgcaactggagattcattagtttgtacgaatgattggcaaccaacactcggatagtatcggtactgtgtattccacagttctacaagtagcaaaggggactagtcctaatcatcagcaatcgcttaggaacatacatgaatttcattgtcctaaagtcaagtcaggttgttctgacattgatctggatgggc

SEQ ID NO: 51976 - DNA, 1720 bp, Oryza sativa
tagccttctggtaatttacataggcgctaatctttagttgtaaactagagcatatcatagtgttgacaccgttaacacttaacacatagataccaatctaagtgtaaaatattaatcttagaacatacgtagtagatactaaactttaggtgtaaattagcacttggcaaactggttttcccaaaggagcaatcaaagcggtgtgacatataaactgattagtaaccggtggtgtgacaagcaaagatgtttcagcaataataacatagctaaagcatgtataccttgcagtactttttgggcaaaagaagccagttctattactgaagtacactcttcgatttaactgttctattactgaggtactcttcgattttgtggttgactgtaacggtaatgctaatacttgacataattaggtagagctctgaggagctacatgagatgtcaatactttgctcttatgcccaccatttcacccgcggcaacgcgcgggtcccggctagtttctctagttttcctttgccttaaaggagccctagatcttgtttgggatggttcaaattactgccaattcccgaggatgtgcaaaatcctgaccgaactggcgttatgtagatttattggtgattttttgaggattaatcatctcaacttctcgagtcagcgaaggcctcccacatgattttagattttcaatgacaataactatatcttgattgaattttaaacataattagtaccatcaagtactgactccccttagtaaataaatatttatatttctaactccaccgctgttcttatgtgtggctttgactgtttgagctacagataatgagcccaaaaaaaaaactaatagaggagcacctctaaaaaaagtctttatattctgtgaccgagcaataaccgaagcaactctatatacttcatgagtacaacttttgtatttatattaccagcggctttaaagttaatataaaaaactcaaaaagtatcacctgtatttttttaaacaacccatacaagatagtatgatatttttatttatatagcagaaaaaaaatacaagacctgggaaactatatttatggaaaaaaatactacaccccacatatacgtctgatcctgctactgaaaacaaaataacatcccataggaaatgtaacaacataacaattatgcctgacaagcttgagacgctaattaacctacaccccccccctcctcaaacaaaaaccgaagcaaaggccagattatccactccaacgaagaaaaatatgtcaaatattaggccttgcttagttcctaaattttttttctcaaaaatatcatatcgaatatttggacaaatgcatggagtattaaatctttacctattataaaagtttaagatgtttttgtccagaaaatttcgtacgtcactcgcctgatttttctccctcgcgcgttccgtccaatttttttttcacacgtggtttttttctccggtttttttccgcccgatcttttttggtcgtgacttttagatccgttttttccatcgcctgttgcacacgttttttttcttttttttttcaatccgaatatcttagatccgtttttttcctttttttccatcgttgctttttttttgtcaatttggatatcttttctgccacggtttttctattgcgcatgtgtaaggcttccgagcttttatccacctggtttatttttt

SEQ ID NO: 51977 - DNA, 883 bp, Oryza sativa
tatagggcatggttctcctggttgttttgggttgtacatgaggcactggatggtatatcagtatgtttagctctgtttgttttaactcttagggcaatggtagaaagcactgccctttttcttttggggactgcgaaaacaccacaaaatttggatcaaatgcaagcataccatattaattaagctctttcatatttgccatcagtttccttatgaaggctcttgctttctagtagtatatatgttgtagcattaggttccacataatttgtctgctagtgataatttggcattgagaccatattttcttattttgtttgttcatgaataccttcattcttcattgatcataaactttgttttcctttttctgtttttcagctgatgcaaggtccttagtctaccaagcaaggaatgaggcagctgaattccgtttcaaatggggctacgagatgcccgtagacgtatagcaaaatggtatcatgtctcatccttaagttctctatttgtgaaaatagggttgtggttgaatatatgatctttgcatttcttataacaaagtgatagctaacttttctggtttatgtttcaggatagcagacaaagcacaagtctacacgcagcatgcctacatgaggccccttggagtaggttcgtatcatcaagtgacctattgttccattggcttctgttctatagttaatgttaaaccaatcagcttggatcttatttgccctccatattcattttcttttggtatattccacagttgctatggtcttgggctatgacgaagagaaaaacgctcaactattcaaatgtgacccgcgaggtcacttctttggacataaggtatacacagtttctgtatgcttcattagag

SEQ ID NO: 51978 - DNA, 765 bp, Oryza sativa
tcatccatgtcgtttaagaagcactcacttagttgctttcagaaaagagttcaaataaaatcaattgcaaaaacaacagcctttccttgaagcctgcattaaacacttatttcccatggcttgctgagtactcccgtactcacccttgctctatataaataatctcccccccagttgctgaagaagatgaagcggatcccgctgacgaggagttcttccaggagcaagccggctacgatgagttttagggtttcggcctagttcccaagtcgcgcctgtgttgtttggtccaagtcctggcttccgcttcccttttgtaatgcagttgtgagctcgggatctgtccgcagcccgacttgattgtactcctactctataataaagagacctctattgctgtgatattctgtcttcctgtgataccagcactgtttcctgggactggtatcgattaataggttaatttggagcgtcacgggctagttccggtcggtactagttctgggcgtgacaacattccataatagatgacacgagttcatcttttaccatctatctttttcagtgttctccttttccggtatttatctaaacgtgcatcataactttttcatagaggaagcacacacaactcaacaaaagctataaattgctcctaagcataatttaacacacgatcaattcatccaaaaatagatctcacactggattgagaacatcgttcaaaaaaaaaactcaaccaagacacaccaatcatattttaca

SEQ ID NO: 51979 - DNA, 1269 bp, Oryza sativa
ctttacccgcagtccacgactgccaaatattcattagcttagtcatggcccagtattaggttattaacaattgtggtacctgttccatgaacttatatcctcatgcgctctgaacgtgacgttaactgcagcgagaggagttctggcgttaccggggtctttagagaggactgattgtatgacaccatgtcatcgcaatcagggttcacaaacgtgatcaaatatatctcaaatacatatttacctgtgcctcggtaaatatcacaattgccctactcggcgtaaatttgcctcctacacgaggactttaaaatagaaccactgtacagaggtaccacattgctaattaacataatagctaggtttgtccctattctagaagctgcggtcgtactcgttcgtttgacataagtatttggtataaacttatatcgactgagacagtactagccacccggaaatcaaccatttctaccgtactgtcccaatctaagttcattaaattttatgcataatctaactaggcagggctaagcaaaagctagcatatctggtttgctatatgttcaggttatgcattgaaaatcatgaatggctaatgcatgagatatcagagatatagaatacagggcatttatgctcaaaggagatgaataataacttgccttgctccaacgcaaataaatccgagataggcaacctgattatccgattctcgaaataccaaaggttgccatccaaaataaaatagactctactaagaaagacgaagaaccaatttcaataaaatccatagaatagcaagaaagagataaacagttaggagggctagggtttagggtatagtctatctcttttatagggtatatggattactgtgctaatatcttatgcggaggttctagagagttggaggctagaggggattaagcaactactatcgcttatatttcatatgtgggtttgattagtaggaggatgggaagtaactagtttggataatggtattggttaaaagggtatgtggttggtattcattggcggtagctaggtttaggtcgtatggaaactaaggtctagttgtcctcgagtcgatactgaaataggatagcatatcagctcggctctataattttatgtgtaggttctggtaggtggagagtaggtggtggagagtatggtggataggcgatactggtgggtgtggaatttggatgacaactggaatttgactgggaaggtattagttagggtttggttatatgctag

SEQ ID NO: 51980 - DNA, 1047 bp, Oryza sativa
gccagaaacactccagtgagggagatcgacgatggccggtggtggtttgacatgagaagagagagagagagagactgagctcacggctcggttgtggaagaagagagggggcttcaccggctatttataggtgtcgagaggcggtagagtaggtcggttcggatggagaacaacgaaggatgcacggcaatggcgacgtggggaagagacgacggcgccggcttcgttctccaattggctgttagtggcggcgcgtacacgcggcgaccgcgggaggagttgggcagctgggaagggaggacacggcacggcgtcggcgcgacttggcggcgaaggaagggcagcggcgacggttgcttggcggaggaggagggcaaggcaccgcagcggcggcgcaagttggcggctcggctgggtgttgggccggcttggactgaggaaaggaaaagaaggaaagggagaattcggcccaaacgtagaaggaagaaagtctaatttttcctggggctgaataatttgatttagaggagaatttttatttggaaggaatttgaatagaagattttgaaaggaaaatatatttggagataatttgaatagggaaggttgaaaggaaattatatttggatctaatttccaaaagagatatttctaatttgagtgcaatatttttggaagtggaatatggtggaatttaatgcactcaaatgagaggggaattaacaatataattcctcaatatatatatatgtttggaggagaatggttggaggtaaaataaataggatttgaatcctaaatttgatagtagaagtatttgaagaattatttgtggctaatagggaaagttgagtgaagaatataaattggtattttcttagcacaagagcaattattcacaatatttgcaataatactattcttgtgccgaagaggaaatcaagccacaggaattaaatcagtggctagatcaaaaggaagaatttggatcaagaatcaaaggatgggtttaagatcaaaggatgggttaataattaattccaataa

SEQ ID NO: 51981 - DNA, 5385 bp, Oryza sativa
  unsure (1)..(5385): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacttagatgtgcttatattaaggttagagatggttgtaattacttgagatgagcatgtagattgagaagtcctcgtattatatgtgctttatattcttgggcggaaagaaattatggaaaacccataaaagtagcataaaactttagtattgtaaccgatgacacataatccatatattattgctgtatagttttacaagaccccattgaagatgatttttttaaaaaaaaattcaaaatataagacaagtatattttttaaattattaattacttgattaaggctattagttttagtcttcactattaaaaaaaatattgtaccagatgtgttggaattaattgggatttactaagggtgaaggttttatgaaaaagataagccataaaacctatgattatgtcatataatataagtcataacaatcggtgtctttaacttaggtcataaaatatattacctccgttctaaattttagatatattataagatatacttactctgttctaaaataaattaacctcgtacatgatgcgatatacgagtttatatctcgtatgagattaatttattttgggaccgacggactagatattagtgtgaaatttgcacagacgaaaaggaaatactagtagccaatagaagaagccacaggtgcgctagtttaagttgggcgtggatggggaaagcaatagatgcggccagtccatttcatcaggacgcagtgtcgcaagttccaaagaggcccaccaccggattggattggccgagaccatcatcaccgccatgatcaccagctagattcattcatttgattccgcctagtcgagcttgacgtggtacggcgccttcaattggagatgacggccactgtgatcctgattgatccccagctacagaaatacagtatcatatcttaccctctcgcaatacagatcttgaaccccactagagtacatagctggaagaaaaaaaaatgctacgagtagcaaaaactcttcttcacaacgcagcgaagtggatggttgttgcttttccaaaaggacaaagctttgcttttgaaccacccgccttttccaggttttccaaaacttaaaaaaaatgcacggaggcccctgatggcatgatctctcctccttttgcaaaaaaggcccggtgaaaaatatccaaaaaactcaaaggtcaaaatgccacacatttgtttaccgaggctgagtggcgcaccacaccagaacgaacgtttctttaagcaccgtgcgcgttatactacaccgaagaacaaagatcgagagcacagcttagcttattattagtagcaaaccgcgaatgcgatggttcagcagcagaatcggccactatccttgacaaactctcccataatcatgcccgtcatgattggctcgaacgcccgatcacttgtttggcacgttgctacgtacttcgtactagtttttcgagatttgtacgcttgcttcaacgggcacagtggcatggctcccgagttccccatgccagttagtagcggcaatgcatttgcacgcgcagcctcgccgtcgcggcgtatggttggtggcgacctcgcgatcccagcgcccatgcggccagcgcttcttgggcccggcgtggcgtgggcgcggcgcggcgcggctcggctcgcgcgcgcaagcgaagccatcgcggaatagcgcgtccacagcgaaaaccactggattggtgagcgggattcgatgccaccacccacccgatcggcgcgcgaagccgtcggtcgctgttgcgggcggcatgggcgggtggcgcccgcgtgaacggcacgagggaaccgggcgctcccaccacaccacacgaatgtttgtccatgcacgcagcgggcgcatggatgcaggggctctgtcagggaccccatgccacacgtgaaacggatcctcctcctctcctctcctctgaactgtcctggctggctgctgctttcacgtcaggcgccagttgcgtttgagccgctcgatcggaaagctggaaggtgagcccgagctacggtcgggggaaaccttatccaccgatgggccctttatcctgtattaattcgatccttctaatccggcagattttgctctgtttaatcataccgaaactccatccagggcgcttggaatttcgttctcgtcttcgtcttacccgtccatgactcgatcaaatcgcgcctaccgcctagcgactcatgcatggttgggtccagggcaattcagcgtggagagctcatcagcctgcatctgcaagcccggactatgccatttgatgattagtgctaggttggtgcttgccctttggagccgtgtgcatcatgggcaggtgtcccctaagctgactgacctgatactacccccgtttctctaccggcaccatcattgggtacctggaaaaaggacgctgaaaccctggagtccaaacactcaaaaccacaccatttttttggttcttgcttttggtacactactgctgctagtacgatttctacaacatttcctactcttttgtaattattctcagtccagcacacctgttaggtatagtcatttgcaattagggcagtccacagatgcgtctgagattgtgttcaaacccttgattatactataggtttatccgtgaatagtttgttagtcaaaagattcggggtgtgattattggtctcccttaagatggcatgcctagatcagtccaaagtaccaggactgataataatattagtaggccaaatctagcctaattcttctaattgagaacatgctgaaccttgtctggagtgaaattacttgattaacagtcgttcttcaggagtagttgtagtacatgactaggtcatttcttaactaagaagcgatataacatcccaattagtgagttggagtatatttctgagccgatcatcatggccccagatgtccttgtatcttttggcgaggcgcacttttaagctaaagattgggacttgctctaacagaaaaattgacacatcctcttttggaatcttttcccactggaacggcttaaagactactactggtcttgttggtagatgaagactgaacctgatggctgcaatgaaaagaataagaggaaaacaagcaatatgagtcacgcgtatgaatcattttactgcatcaatcgctgacatcatgacatcgccgaactggtgctactgtgctagtactccaacaaacgggccacaatgtgagtcagataagacggcccagttagtgttgtcaaccgctaagaagaggctcttggtaaaaagagaacaaaaaactggggccacacccattcttgcaccaaaagctcaaaacattctccgttaattttgtgattgaattgacagcggctgttaaatgtcaaaattaggctgctgtcataccaaacaccaagtcccaaagctcctctatacatcggccccgatcactgtcacttcatttggatccccattagctcttgcttcctgggggttggttctcatggcaggatatatctcactctcctcaatcaaatcctgctgctacttggctgtacacaggccatggcatgtatcccccgctcttgacatatactccgtccgtcccaaaataagtatagttttacactatttatctccaacgtttgaccgttcgtcttatgtgaaaattttttatgattattattttatttgttattagatgataaaatatgaatagtactttttgtgtgactattttttaaaaaaaatttataaatttttcaaataagacagacggtcaaacgttggacacggattttcactgctgtacttgttttaagacggaggtagcgtgcgaacagatgatccaagtgtactcgatttgggctacacgctgaattgcgttgcttcacagcttaagagttcagacttcagtgggcataaatattttctcaatcagctgcagggatcagataccttggaggattcgggacgttatatgataaccactattgttatccaggcgtggcagcaggcaaacaaacatccatcagcttttgcaaattattttcttccgtgcaaaaacagtgttttcaacctttccagttttcccacggatgacaacttccacatcaagcgagacgttaataattaggagatcgaactctcttttgttgcgaatatttggagtttttctcgtcgacgatgacccaatattcggcacattcttctaccagtcactaatttcctttcattttcttcattcctcctcttttctccaaaacaaatcgcctcgtggattgataggaaatgcgttttcacgctgcccagttgctaattagggcacgtacaaagatagagtcgtatataagctctacgttatttagagactagcatcctacaacagttagagacaatatggtctctaatcattaatgtatcaaaataacttttcttacttttatttcctttctttcatcaccatgcaacaaaatttgctctagtaaatgctaagagtcgactctgagccgttgtcatgcataacaaccatactcctttctctttcctccatgtcaccaaatttacttgcatggcaataaagagagaccactaataaacaccgttgtacatgcccttagccaatgatgccaacacatgtaacgcacacgtatcagtaaatcttcaccgcgatctgtaaagaaggatgggccgacacacacaccagccagcacggcggccctgccatgatggccgccggattatcgccggcggatacgagaggcaggggatcgtggagtggcctatctccccctgctttggtgcgccggtgcaccctaaaacgagcacagccaccggcctgatgcaacctgatgactggccggccgtgcgtccatcgcccggcgccctacctgtggtggagccaacaacgagctagcagctggtttagttttcgtgtgtgggcacgtatcgatctcgtcactttactactactttggcgtagcggtataccctaccagccactattggtgctacccaaagacgacccaggtagtagaaagatttggagtatacaactagaggtggcagtggccagccagggcatgcagtggaggtgacatgttgttgtccggtgagtgcaagcaatgatccatg

SEQ ID NO: 51982 - DNA, 15563 bp, Oryza sativa
gtggtgtcttctcagtgtgcgccactcactctcgctggctcgtaagtgcatcgtgcaatgcgtcgttgtaggtttgtagccggagcggcagcagcgcgtgacatgtttggtttttttgcatgaaacgcgtatcggcttgggccaggtgaggatgagatctaggcggctccagaagccttttttgagggtgcattactgagatactgctgcatggtgcaacggagaaacaaacaaatctgcaccaggattaccagcctttggtgtgaagtcaagtcacccggatcaaagtgatatttggatgggtgtggaggggcactggttcatgtaaaatggtcacctctctggtgtacacggaataattgcatgggtcgattggccatgactttttattcgtgttaaccataccccatatggtttttgtgatgtcgttgtttgtctgtcagatcatgtttattgcgtactactatacagtacatgtcatgctgctgaaagaaacacagaaatatttggtctgatcatctggttcccaaggggaccttttcaagcctaatcgatctccgaaggttggtggagtgtccccataggaaatggttgaaaatacggagaaagttatctcaagcaagtcaagtcatcaaagagagagagagagagatggttatcaaataattagaaataaaataaacgcgttgagaattaaacgcgagaccgtagggttaaaactatacacctcttaacactgcaatatcaaatacatgacacacaatccgtaatatttaggctttattttttaaaacaataggcttcaaaattttcctttggaggtaccaagaaaagaatcctcaactgtttttactgctcttcacatctcaacatctcaggcacggctagtactcccaatccgcctacgtgtgggcgagagagattgtagccagggtttgcaaaaccgccggtaactgcgcggttaccgcgctcgcttaccgtgggatacggtaaaacaaaaaccgcggcaacctccttaaattcaaataaatttaaaaaataatttaaaattttgataaattttgcacggttgcgtacgattttccacggttaccgtgcttattgccggggtgtggtaaccacgtccctggcagttggggaaaccctgattatagcaccagaggaaggccaagcgataacgcacgggagggggagcgagcgatctcgcttagaaggaggcccacttttttctattattttagggatcaattttggtcatctcttggaaacaagtgtatatattttaaatccttaaatcttcattagaaattcttaaatccctctattttaaaatataagatgttgttatagcaacattgtaaaatggatgggtagaatattggacaacttttttaggtatgagttaagtttgggcgtctggctacctatataggagtggaccatgagttatttttttcaaaaaaaaaaacgtatatagtcctgtcggatactacaaccctatccggctaccttacccgtgaccatgactccgtgagttttattttgggtacatggcaaaggcgacggcaattggctgctggctgagacatgcacagtaagcatgcatgcgcatgcgtacatgcatgtacccatcgtccatgtaactcgtgcacccaagggtaccccactactcctattttgtagtaagctgggtactcgtatttaaatccggtccgatccgttcgttgacttttggagcccgtaaaacttttccttctgaccgtatattggtatactgcatgtgctaattagttccacgctaaaattggaagtttgaagaaaaaaagttagaagtttatgtgtataggaaagttttgatgtgatggaaaagttagaagtttgaagaaaaaagttaggaactaaacaagcacagtagtaatacctattcgccagatagtgtttagttgcaggtctagaatagatcaatgcacaaaaatatacaccggtcattctaatttctcccgcaaaagagacgttacatatgcaaacaagctattgacccgcgtccaaaagtgtaaggacacacctgaattgaaacaccggagagatctatcacatcagtagttgccccccatgtgtgtccggctacggtccgtcggccttgcatcagacaccatagcatgcggccggccgtgtgccggggtgcgactgtgcataccgaaaccgatcgaagatgacttgcgcgcaggggaggctgcgcacggttcaaacttcaaggggtgaactaaggccgccgccccgcgatatggccgtcctctggctggccaaggccgcgtatctcacacgatccgcgaggaccgcagagcagagagttcgtccgcgtccttgtttgatccgtctcgtggcctcagaaaccgcgaagcgcacatagcgcaccacgagcgccgccgcctttgtcgcggtctcgaccggcttgtttaatcctattagttcgttacaactgcatgtgcacgagcacgacaccgatcgatctcagcaggggatcgagttcgtacggaatttggtatttctagattataaattgtatcgctagtaaacaaacttattaggtgggtgttatttagagaaacgcccagggttttttggctagctccacaatcggtgatgggttagatgatctggattcaaagcctcaccccttctaattatttgatattaggtcatttattaatattcgtgtttttttaggtaggtgtaatttagcatatgaacttgcaaattgctcgttttgatgcacaaacttatcgacgtgcaaactaaggcaatgaaaaacactttataactaatttctctaattaagttgcattctgaataggatattatgcatacgcttaatcagtaaaatggctccgtagatcggtaaaatgaatagagttcgtgtttttggttgttggctccgatccgattcattttagctccaattctttttaggatattagcccttcatttcgttcatgtctgccttggcgtatgataatgctatgtaagtttgaatttttctctccttctaccaattgaaatagtagagctaccgcttgtttaaaaaacatatactcaatggataagttatgttaagtgtacagagaaaaagtatataaaataaaaggaagatgcaatgtataaaaataatggataaaagcaaataaataaaaaaactatatgtaaaggttatttacacatgaacatctctcgtgttctttgattatgcatgtgacatcttaatcaaactctatattagtatgattagtcataatatatcgttttagacttgatccgcatagacgcactagacaagttcataatgagcattttacaagtttgtgtactagtaagtttgtgtactagtaccatggattaccgaatatcactagaatcagggtgtgtttagttcacactaaaattaaaaatttaattgaaattggaacgatgtgacggaaaagttagaagtttgtgtgtgtagattagttttaatgtgatgaaaaagttaaaagtttaaagaaaaagttgggaactaaaccaggcctcagtagtgcatgcatgttcagaaagggaatttgattcgctgaaacatcttggtcgcggccccggttttttatttacgagaaacaaaaattgcagtgcaagtagtcaactcctgttgtgtaacggccatctggtgatctccctcgtgcatggtcaactattccgcgtcagttggtcgatagatttcgattccaacggattagtaatgtcgtcaagaaatagtactacagggctgagtcagtaatgcctaatgaagaaacgaaaatagctgatgggatctcgtcgctacataattaaatgagaaaattccctatatacccctgaaaatttactcaatcctttcaatacccctgaatttgacattatcccttatatacccctgagttttcattttgatctcctctatacccatctccgttagttgaccattagttgaccgttaaatattttaaaatgactatattacccatcctatacatatgtgtggtacctacccaataaattttcatatgaaaaataaacttatacaaaatacaagcaatataatcatttaatgcccaacttaaaaaataaaacttattattttttattttttaaaaattatgattaaatccatacattagtttcaccagaaaattaagagcaaaaactaaatgttatttaggtttaaatttttgggaagatatacgaaattcatcaaatttgatctgaaatttatttaaaaattttaaatttgttttctaatttgtgataaactaattatatcccctttgttttttcacaacgaatcttttttcactaaatatttgttgaaaagtaattttcaaatcttatgcagaactttttttacaataaatctttttttattttaatgaaataatgttttattttcaaaaattcataacaaatatttagtaatttattccttattggttttcacaactcaaataatttacacataaaacatttctagcttttaacaatataacaaggacaataaagtaatttctacaataactaacggtcaaactaatggtcaactaacggaatgggtatgtaagggatccaaataaaaactcaggggtatataagagatcaaacaaatttcaggggcgtagaagggattgggtgaaattacatgggtatatagggaattggccctaattaaatcggaaatgtcaccatagtcacgttactatatggggaaaaattaaagtcattgttgatcatctcattaatgcgctgaacttaactggttaattaagcttcaaggctcaaatacatatattctggccggtgattcatcagttgactcacgattagaattagcataagatagttcccagttgggttacatactctgctccgtccgttccaacgttcgaaaaatgcaatagaaatcggcctttgctgctcccagctgccctcattttttaaccaagttttaatgaaccagtatcgtatatacaatcttattaaattacagttagggaggaataagaatcatcgctatatttatctgtcaaatctgcatgtaccaaattaacactgcaatactgcaactcactgagatcgaactgagaaataaggagatacatattcacgtattttctagttttattttgggtatactatacgctctcgtatgatggcatgcgtagatccaccaaaactgtgaagcaaccgcacgtgttaggaattatagtatatctaaaggatgtatgaataaaattacacaagcgtgatccttcgccacctactgccgtgcaatacccttaaaccaaggaagctgaccgccagaaataatttttcaaagcatatagaatcccattcaacatttccccgttgcttgcaactacaaattctccggctaacctgcaaaacattttcaaattaaggagccgttcttgctggtgcaagacagtcctaggcaagtggccttaattaattcgtcaaacatgttacaaattaatcaaacactaactcatgtttgtttttaatacaatatactctgaacagtacagatgcgtttaccaaccgtttggattgttcagtcgagcggcgccacctcttttttttttcctctcacttgttgacagtattgtacattgtacactagtgtaagaggagaaggttttaggtggccaaactggtcagtactttccatcgtttttgttccaagcacttagtacggactacggagtatatggatattgctgtacgtgcgagtgatatatgttagcaacttgacatgtaccaggactaaaactaacacctgggcttccaagttgaagctaagcctgggaagtcacgttggtaggaaagcgaggctcaaaatcggattcgccggccgcgcgcaccacatttcatcggatctcgcgttgcatcgaccgatcggttcccgcgttcccaaggaaatcgctcgatcgtcggcaactctcgctgcccgcgcgtccaagcaaaccacgcaccgtcgtgcgtgcgcgcgcgcacatcgcgtacacacgaaagctgtgttctcttctctcgagagctagcgatcgagagtagtacgagtacgtcaatactagtagactgtatcgtgtgcagggagcgaaaaagtcttcgctgctactaggggttggcgccgaatctgtgaggttatcgcagtccatgactagacaaatgtacgggcagtcagaacagtggcccacaataatggagctctgcttgcaaacatatgaaaacccgcattttttttcccttcacggaggatgttaaaatcactctatttgctgcaattttacagtagagaagatcgtggccaagtggtcggagtagaacaactacgctgaaagtagtgctccgtaatactccgtaggagctattgctcgatggatctgctcgattgccaaacagaaaaagacaccacaagccacccgtgtgcatctacatgacatgatgattaagtttcgttgcttaattacgcagactagctaggcctttcggatatcgatcgactgattggactggcagcgccaaaagtccactctttaatcattaagagccggattaaactgcaaaacctggccgggtgtgtagcacttagagcacccgcaatgataaagtaaggtgctctctataaaacatgtacatctcagcaatagactcgattaatagtaaaccaccttaatagtatgtccacattggtatctatagctctctcatacattgcctcgtttttctctatagactatctctaagttaatagatagctttgctctctctcttcatttaataccttctaagtaggaaaatatgctgacatggatctcttgtagagagcctatagataaccattgtgggtactcttacaagtcgggcaagtatataatcttactaatataccagatctaatccaatccactagttaaagcaaaggtggttactttccttactttttgtttggttggatcaatcagctcgctacatatcgattaatatatcggcggtctccactcactacaatatacaactgcatttgccacccgtagctagctagctataggtctatataaattctcccagcttgcctataaatgtttgtttagcagctggttaatggaccaaattgcatgtgcttagacaagtaaacatgtatttgacttagtatttaacgactaatagcgggtcgatatgattcctcatttgaattaattttaaggtacacataggagagaggattataagggtctatctgacaacgtttcaattcctaaaattaacttcaaggattgggtttgaagtgtagttatagagcagcctaaccccgctccgatccaattcttcatttcatttcatttcattttgtgagggtacttccgcccgctcgaccccctttttgggtgtaactaaaattgttcggttggactttaactaaaaaaaaggtggagttaaagctctgttaaatataccctaagtttgtgctagtttgcagtttcggcctgggtgagcataattgctagaaactgaatatttcaggccgtaaattcgatcatcacttctaagtaaccaagtttaatagaagtaattcgcccataagccttggttgaccgaaacagaattaattaaaattattatttacaagcctgttaagtagcattgcttctttctcaataatataagttgcacatattttcatattcaacccttaaaatatttaaccaacaattattctaatgtaaattaaattttattaacaaaaagtagttggattgatatttaaatgtactttcccgtcactacactggccaaggtcacctgtgacgggctcaaatcctcatctttgacggcttcgcgcatggtcagtgatcagtggtcactggtgagtccaatcacctttgacgggtggccggccgtcacaggtgacacccacctttgacgggcaagttactagaaggctgtcagaggtgttggtctccactagcctagggcgagttaggacccgtcacaggtgacttatctctgacggccctttaaataaaggccgtcagaggttgtggtctccgtagttagaagctgtcacagatgatctacctgtgacggccccaaaagtaaaggcccgtcacaggtaggtcacctctgacgggccttacttgctagtccgttacaggttagattacctttgacggatttttgttccgacccgtcaccgatgagttaattctaacaaaaaaaataaatgctaaatattagctagcctcaggatttgctagccatgccctctgaaacacagatacatcacagatatattccagtcacagatccatcacagatacatcaccccccaatataacatcacagatccatctcaaacatcacagatccccaacaacacatatatgcagttcaaatgccacaattttgcacagcaaattcacaccccttgaaagccacaatttcggtcgttgctcatagaaccgcatatatacttaccaaatggattaaagccataatgtcatcgacctccacaacttgtcaataaggaaaaaaaaaggagaaaatagatgaatagtacaacgtaaatcgtagttgatcaaatgtgatgacaatttagtaaactaccataaatattgcacatatgaaagtaaattacattgcactccataaaaacataattttttacatcgcaaggaattataaaaacatcttttttacatcacaataaattagctagccaagttcatgagtctatttgacatgaaaacgtcctttcttgttcattatttctgcaagaatgaaggcgcacacttcgcctctgatagcgggggggggggggggggggttgatgggtgagatcttgaagccagctctacctttctgtttaataaataagaggttaattagcatgttttgaatagcaatgtaggtattgaaatgagctttttctctattagcaacaacctcagggtcgaaatctttcacctctcttagaagtgttgacatgttgtggcacacgtggaaaccacattggtctccgatctgttgtgcgcatgcaaacttggtgtcatgataaagttcgtccttgccctccctgtgtctaccacccttttctacatatgggccacaagccatatttaaggccttggtgatttcactgaaatcataatctttggacttattggagttaaggtaggtaaccctactccacttaggtacgatgactaggagaatccaatgttgcctgcgcagtggttatgtagcgttagtactaagaaccttaacttcaaaaatagtatacacgaagggtattggcctcttactcttggttgtgtgcgcacatgatgtactccttgtcttgatgggcccataaacaccggttgacatagtcaaccatctcagtgaagctctgttgtaaattaacctcgttcaccatggatggatcaaggaatccaacctgattaccaaggcgacgactctcgatccaacacaaccttaaaacatttacgtattagaactaatttaattaggagatatagtccaatcatatcacaagtatagaaggtatgcacttacaaggtgtagcattttagaagaccagtgtccaacttccggatcctgaaaaggtcgaagaggtcatcaaagcccatagttatataggcaggcgacaataggaacggctggtggtcgtgatgtccaactatggatgactccctcattttccgcttggcattgcttagctctatgtattgcttatgtagctctcggcaagcaatacccatcacggctaacacattgtcctctaccaatggcatgcctagctcaaattgggctggcgccctcacgaccttccccgctttgctcaccggcatcgacgtcgcagccttgcccctttttggctccggcgccaactccccgaccttccccttgccgcgttcacgcttcttgtctttgacaagtggtggggagctatcggcctttcttgtggtctttattggagccaagctttgagttatatctgccaagtccatatcagctccaccaggagaatgaggtactgataatgccggtccacaaggagcctcaattgatagcttagacttgggaggtgtaagctccgtcggttgacttggacgaggagtcatcttcacaactatgtcttctttgggccattgtatgaacgtcttgcgtgcatcgcccaaagtcatgatttcatcattggggggcacgggcagtggatagcctgaccaggtgtcctttactgtatcgatggacaccttggcatacctagctagcaggtctgcgccgtggaccttgtctgtaaccgagggcttgaaagccatgccctcagcgacttcaggagcgaaagttgggtggactctcgctagtaggacacactgtgctgcgccctgcataaggtgaaagtttgaatttaatattgaaacgtgtaaaggtttttttattagatatggatcggataacaacaattacctcgatgtggtccactgcagctagtggtgcgatcgggagaccaggggccggcacctctgtggatgcacaactactcctatgctgtgacggactcgggtcgtgttgtgcacgaggagttggatgcataacaggtgttgtgactcgggggtatattcatgtcggcgaggaccttattaaccctttcttccaccctagcattcatgctagcttctgccatttgaatgagcacatccttaacaacggccttcatacgagcgtccctcggtagcttggagactttgcgtgccctgtgttgggagctacactggaggagttcatgctatgcgccgcgcatatcgaccactgactgcaggccgaccaggatattgatcggttccgagcgcatttgtgaggatgtcatcttcatgcctttcccgagcggactgagcctcgatttgtgaagcatggccaacactcaagccgaactacaaaagaaaatagtcgaccatgcgagcttgtactatatgccaactgcaatgactgaggttaaggatggaactcaccaggttctgaaagaccacggcgtcacttttgtgctcgaatgagacatagcaatccgggtggaccttaccccttgcccgcgcccagttgcgagctctttgttcagggatgtgtgaaaacggtgcagggacattcgctgctgcagcggctgcatcttcatgggcccatattgcctccttgccgatgtaccctgcggtgcccagccgatgcgggtgctcattccgctgttgcagtaggcgatgtgcctcgcttgattctctaaactcttgggtgttcttgagagagcagaattcctcccacaccgcttcggttatttgagggtattcatcgaacggcgtatgattgccgggcgggttgacaaactcggtgaagagcttagacttccaattcttccaagctttgcccatcttttggaatgccttccgcttgagcctatcctttgcttcagccggaaatgtgaaccatttctccattgctgtccaagctcgctctttctcggcttctgtgaccttcccgatatctttatggaggatcccgaagttctcacgtgccgctagcccgcagcagttagaccatcttccaatgacagtcctaggcgccgtgggcctaccactagcgtcaatctctcttataacttgcactgtggtcggccatatattttgtgaccggggatttctgctagacctacttgcacttgtcgcgcccgacatcaacgtatgttgttcctgcggcaattctgcagcacaaacagaaggcaatatttgctaaggggtgctagctaaaatttatgtggtcatgtggtgaaaatttatcctataaattaccatgaatttcgggttgttcgaccgccgttgtcgaaggatgaccttcggcaactgtccccgtggctgggtttgcttcttcctggatcctcgcaggtgttggggtgggcgggtttgcgccgggcgttgccatggtctaatttttgcgaaaaagcttataaatttcctaccattatactaaatagcattagatccaatgtaatacggggtatactatgaaagatatggcctcagttttgctcagaaatatgcatcaattacaatcatttgcatgaagggataaaaagaggaaatcataacatcaaaagagcaagtgcagaaaatttgttcttatgcataaaaaaagaacaagtgtagatactctgttcttatccataaagaacaagtgtagaggtatataaccactgaatcaatcatgcaaatttaaaaaacagcagcagcaagggtacagatagaatgttattgacataaaacagcagcagcaggagtatatataccacaggggtagcaacagcagggggaaattcacataaacagcagggtgaacaagtagccacagtaagaccaatagcacggcaaagatagtcccaaggggcagcaacaacaggggcaaattaactaaaacagcatgtctagatagtctcctcttatcaatccagaagaaaagagcaagtgcagaaaatctgttcttatgcataaaaaaagaacaagtgtagatactctgttcttatccataaagaacaagtgtagaggtatataaccatgcaaatttaaaaaacagcccacaataagggtacagataaactgttcttattgagcaattcatcacttattgagccacagcaggggcaaaaagaagaatagataaaaaaatgacagagtgtagataatttgtccttattgagcaattcatcactggccatttaacaaggaatacattgggcagcagaagcaggggcaaagataatccacagggacagcaacagcataaaacaaggaacaggtgtattaacaagtagcccacaataacagcagtagcaggggtgtagataaaaaaggagacagtactactaacttcatgtaaacagcaattcatccattcaattcaagcaagtgtagataataaaacagcccacaatcatttatgtggcagcagcagcaagggtatatatatcatgtatataaacaacaattcatgcaattgacctattcatagacaaaaagggtatataaatcaacaagtttagctacattaaactagctaagattcatgctaagatccagtgcagcaaaattcatgtaagatcctctatgaatgctaagattcactgcaccaaaaaaggaggaatgggggagggtgccggcgtacttggagaaccggcatatttgaagccgccggtgcagaccgtagtcgtccaaggcgccggcggagagccagcggcgaagaggtcgatgtggtcggcggtggtcggggatcccggcgtcgtggatcccggcgtccgggaggcggggtcggggaggtcggggaagtcgatggacggacggcggagagaacgaccgccggtgagggcggcggtggagaggccggtggagagggcggagatggcggcagagagaacggggcggtcgagagagtggcggcgaggaggcggtggagaggtcgaggcggcggtggagagggcggcggcgaggagggcggtggagaggtcaggcggcggtggaaaggtcggcggtgagaaggacggtggagaggtcaaggcggcggtggagaggaggacggcggatctggatcgagagagagagaggcgaggcggcggtcgagtgagtgagtgagagtgggtgccggatctggatcgatctagaagatgtccaaccctaggtcaaccctagtcaaactcacctgtgacgggcccaacactatgggccgtcacaggtgaggtcacctgtgacggccccacagatagagcccgtcacaggtgagtttgcctacagtaattttattttattttatttcacttagttcttttattttccttaacatatttccacatacactatatatttttgttatacttaattattttatttcactaacagtagtaattgcacttcattattatactaattttattattttatttccaatggttatacttgcttaattattttatttcacttctagtgggtgcttcacttaattattttatttgactatttcataagcaatatactattgatcattgcgaacatattagagtcatacagataacagacatgtacacaaaaactacgtacatatattacaaaaataatccttcctcatggtcgacacgtgcatattgaacttcatcttcttcttcctcctcttctagaggtatttcttgacctatgccgtggacgtgctggttgtaatcatcctcgtctgcaatattttccaatccaacaattctccttttcccttcacgaacaacatgtagtttcttgttacacgggtcaactatgtagaacacttgaacaacttgtttggcgagaacgaacggttcatccttgtacgcgttgttagccaagttgacagtggtgaaaccttcattgtcaacttttacattgcgaagatcgacctatcgacaacgaaacaatgggactttgaacttcaagtaatctagctccaatatttgctcaactctaccatagtattgatcacgacgaccaccgtcactagcagtctcgatgcgtaacccactgttctgcactgtgcatttgctgtcttgctttaccgtgtgaaaggtgtatccatttatgtcatatccttaccaggtggtggcactccattcaggaccctgtgacaaccacttaagtgtttcactagacaagttctgcaacctggcaattcggttcttcagccactcgttgaaagaagacatgtgcttgtttctgacccaactctctgatcggcctaggttctcccgtcggagaactgcaaggtgttcgtcaacgtacggcaccacctcagtcatatgctgcaatactgtgaaatgagctttatcgtacaccttccgatccaacctaatagtctttcttccaacagtaccaacaccatcaagcctcccttcgtgatgagatcgtggtaatccaattgaagatgtttctgacatgtagtccacacaaaaatcgatgacctcttcggtggtgtaactctcgatgatactccctcggggtgtgaacggttccgtacataacccttaaggatccccaggtacctttcgcaaggatacatttgcgtcatgaatggtggaccacagcactttgtttgcctcacaaggtgcaccggaagatgttccattatgtcaaagaaagttggaggaaagtcgtctcaagatgacataaggttctcacaagttctgcctgtagttcatctagtccctcgggatcaatgatcttctgggcaattgcatggaagaaggaacacaaccgctggatcgtgtgtcgcaccttaggaggcaaaatattccttattgcaacgggcaacagctgtgtgataagaacgtggcaatcatgcgacttcattcctaccaacttaagatcttgcagtgaaatgagcctactgattcttgatgagtaaccagatggaacctttaaaccactcaaacatgttagcaaatcaattttcttttt

SEQ ID NO: 51983 - DNA, 856 bp, Oryza sativa
acagttcaagaagttctgtaaaactcttgtctgaccagccattactagccttaagcttcatgaattccaacacgcatgacaacttgctgtgcttcgacttgcatccatcatacaacggcatctgacaatcttccaccaacttactaaacttctcaaaatctttgtcgttgtcctctgcgtcttcaatgtcatgcaacattgtagatagacattgagtatccaaatctatggtctctccacctaaaggagaaggtacgaacatgccttctcgagctgcggcggtgttctctacatcctgatccaacacttcttcagctgcgacatcaggtgcctcttgctctccatgcttggtccagcaggtatatttcttcatgaatccattcattatcaaatgagcatgcacttcatccttgtcttcgatcatctgttcattcttacagtccctacatgggaacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaagaaaaatatatgatgatcgatatattgagaataaatggagaataatgtgttttttcccttgaattttagcaaaaaatcgccccccttgccctcccaaccgatttgtgaatagtaaaatggtcgggatggaaagcagttggcggtttggaaggtatttatagacccaacacacctcaaacgggttagataaaaaaagcccgtcaaaggtattggtcatacctttgacgggcttcaattcagtggcccgtcactggtatacct

SEQ ID NO: 51984 - DNA, 4852 bp, Oryza sativa
tgtggtttttctaccattgaaacatgctatgaaatagtaaagtgtgttgccaaaatttagagaaatttgataatttgacactttttcgttgcccatttgtattaattgacacttgtgaggatgacatataggatcatctgagtgaatgaaagtgggtcaagatgtcaaataatcgaaacacattttaagaagtgttaaattatcaaatctctcccaaaatttattggtgatttctgtgttttgttcccattttttaaaattggttggttatttcggtcatgaccaaagaacgaaccaaaatgaccaaaaccgaaaagcctgctctgaccgtatgccctactgccagtatttggatcttagtttaaccgtgtttttaaaatatatttttaaaaaaattcaatttaaaacaagtcttataaaagtacagtaggtacacgaattgaagttgtttgaaggtccggatcctaactgtcgtaggtacacgaaggtagtactaattccttgggtagctgtagctcgagtggtacacgtaggactaatcatcacacaattattatttgctatatatctatctattatattattagaacaactttgaaaggaggcaccacgttcgctgtggggactaaaaattcccacactaatcagagaaaaagaaaaaaaaaagaaaaggagagtccaagtagaaatacaatctaaaaatagctgaaatttagaattaaaaataagcaatattaaaaaaagtttccatataagaacccaatacgagattaatcaaaattcgaaataaaaataaaataaaatccaaaattaggaaaaaaaaagagagtccaagtagaaatacaatttaaaaatagatgaaattcggaattaaaaataatcaatattgaaagaagtttccatgtaagaacccaatacgagattaatcaaaattggaaataaaaataaaataaaatccaaaattagaaaaggaaataagagtccaagtaggaatacaatttaaaaataactgaaattcagtattaaaaataagaaacattaaaagaagagttcatataagaacccaatacgagattaattaaaatttggaataaaaataaattaagtaacaggcctataaaagagtagagtggtggcggttgatacgacatataaaaattgttaataaaacatcaaatagaatcctactgacgattaaaaaggagggacgtcaggcaggccgtgaagcaaacgagtaaggcggttgccggaacttcttagacagtaaaaaaacaaatcgtattgataatcgtattcgatttttaaaatctcaatgataataaaaaggagaagcagcgagcggggtgtataagagtatagttgcagagccaccgacggttgacgggacttctagaaaataaaaaatgaattccaacgatagttatgttcgatttttagaatcacaatgacaataaagaagtaggtggcgaacatgctgtagaggggcatagtggcatcgtttgataggacttctaaaaattataaaaaatgaaactataagttatgttcgattttaaaatctcaatgacaataaagaatgaattccaacgatagttatgttcgattttaaaatctcaatgacaataaagaaggtaggcagcaggcgagccgtagaggaggacaatggcaaagctactgacggtttggcaggacttctagaaagtaaaaatgaacccaaacgataattatgttcgatttttaaaatctcaataacaataaagggtagagacaatggatggcccgtagaggagtataatggcaacgtttgacgggacatctagaaattataaaaataaaacccaacatgacaataaactctaaaaactacaaaatccaatttttaaaggttccaagaagaatgaataaaaatagtggtagatcaagcaagcaaataaagaaggagatgatataaggggtagcaactggtgtgacttttaaaaaatatataattagaaacacaaggatgataaggtttagtctttcaaagtcttaagacaatgagatagctattaataaattttaagtaaaatcatactaaaaaaatatatgattttgtttgggtgctagccacccagctagttcttattatttcctcgaaaaaaatattgttagttatttagcgcaggaggatttgacttctgaaatcccggaagattctatggtttgcacccatgcattcgttttggtttccccctgaaaataaactcgagataaacacacacacagattttaaaataccggtaagctgggcgcatacgcacacgggggctctaaagaagacgcacaaacgcgacaaatcccgtatgggcaggggcccgtgcgtggcgttacggagcatggcttcacatatcggggacctgcatgccgtccggcggccacttctcccatgccggcaacgaccacacaagcaaagcaaagccattatccgtcatcgcccaattaaagcgttttttggatgtggttttgtcttagattcctacaatctgtccgccagattaggcttcaggttttgtgcttatctatcgatcccttattaatataccctgattaattaagtgcagtactttgacgaccaaggaatgatatgtatgcaattttgtggtgatatacatgtatgctgagatcggtgcccatgtcaccgggtgatcccggcagctagctgcgtactgtggatgcgcgtatagtatatagtatcaccaacgtttgcatggtggatgcgcgtcgttttccgcttggaagtgagggcgaaagtgcgatctaggagggatcgatcgaaccggttcggaggaaagactgcgatcgatcgagccgtaggatggaaaactagggaggatctgatcgaaccaaatctcgaatctgggaagagaaaggttaaatcttgttcatcacatattgaagggagaggcccctaagttaatactccctccgttccataatagaagagattttgagtttttgtttgcactatttgaccactcgttttattaaaaaaaattagaattatttttttacttactttattatccaaagtactttaaacataacttttcgtattttatatttgcacaaattttttaaataagatgagtggtcaaacagtacaagcaagaactaaaaatcccttatattatgagacggatagagtatatgtgggagacaagtgggattgataatgcgaaggatgatatgagatcgatcacctgcgaattctctagattgggaatgttgggaatattaccccaacttaaatataaagatcagatggtgatggaaatctctgatgggatataaaagctgaatgggtaggggggagctatgatgttagtgtgagtggtcaatttagggtctacagtctccccttgttggccatagaaaatggaaagttgtgtctcaaaaatgaataacacaagagaatctactacacattctaaatgtcagagcacttacatattgcggtgggaaagaatgaataatctataacctcatcagtattttttggaggtgtataaccttattgttcaaaacataccatgtgatttttacatcaaacacgtaattcactttttatttacacgagcaattgataaatgtttacacatattaactaattatgaattttaactcatataaaataatgatttttagaaagctaactaaaaagagaacaatgcatggaaaacattaacatttcaaaattcagtgagcaagacaaaaaaaagtagaatgacacaggtggtgtgatagcatatttgtcaccacgaccattatattccttttaaagtagcatatagttttttcttcgaagaagtctgctccatcatttgcttattattttatcagccgcaactgaaatttaaattttaaaacataactttaaagttaatttttttcatcgtagtttttttaacattttcttttaaacatctatgaacatggatatgaaagttctttactcacaaatcacttttggttagttgtttcatttttttcatggtttatgagccacacaagtatacaacaaatgatgagaagcactagtatttctattgaaaacacacattgtatatgttatatttatgggcaccagtatttgaatcggataggtaaagccaagaagaatctacaactccaccaccggactacctgattggctcaataatatataatttatttataaatgtagtttttcccctatggagaatttcttaataaaaatatcaaacatatcttggaagcaaataatatctggtgatacttttcttgtgaaattatgcttttcagtcactgtccttattttattttttttattccttcatctatttggataagtacggagtacctaacatagttttagggagacattatttaccaaaactaaagttgccaaactcgaaatatactcaaatggcattgggtccagccagcccttaactaaaaattactaggcctactttcttaaaaaagggaaggatagctagccggcctaaacgagccaagcatttcctttattccacaaaggaggaggaaagaacatcttcgatcgatcgagcactcgatgataccttgaataaacctagccaaggagtgaatgattagcgtgctaatcctctcatttccgcctatccttcattcctcaacctcttgctcgtctcgctggcacccatatattaaataaggacgggtctttaagcctcctatctaatcatgattattatagtgtcgccggtatcaatctaccaccttactccatccgtcaaaaaaaaaaaaaaagacaaaccctgattttcgtgtccaacgttggaccatccatctt

SEQ ID NO: 51985 - DNA, 21018 bp, Oryza sativa
  unsure (1)..(21018): unsure at all n locations
ctaatcaattacctaaatccacactcccttttggaaattcgaatggaatcaagagccttttttgcattgcatggcgacctttgctccggagcaagcgctgctgctccaattctttttgctgggaattacgcgcgccaccaacctcagcttctacctccatcattctctgctttagttgtgaaagggcaaattaccttaaatataagtgcgagagtccctcacctcaatggttagtttttgggggtaggaaaggcccttttacgatcctacaattcgtatcagagtctggctagtttaacatctctgacccgatagacagtgtgtgaaggactgatggaccgtgggtgcctgcgggacccgtatacctgagggaccgtgatgaaatgatgaagtactgagggacaccaatgtatgaagggggagattgttgaatagtcccatatttggtgattgtggaccgtggtgaaacggtgaagtaaggactgagggacaccaatatatgaagaggaagattgtaaatagttatatattgattgtgaaagggtaaatgacctaagatataagtgtgagaacctctcatctcaatggttagcttttgggaatctgcaggccacatttgcgtcacactgcagcgaacgccctgatccctttccgcatttctgtggtgctgcatgctgggaaaaaaagagaaaaagtccgacggaagggcaacaagacacaccttcaccccagatatggtacggagtagagttcgaattggacggttatttgagttgaactggcaaaaaagtgagttatatattctgtgcactgataatgaatccgtattgaaatcattaattagattcacacgttgtatttataattctacattgactaataatgaagacttgctttgagtagaatattataaaaaaatccgaaaaagaatcccatattctaaaactggcttaacagtcctttttaaacatgcattcgggcaacacaaccaagatttgtaagatgtcaagttctgcttaggtaataatatctggtgatgttgatggtgtcacaatagaaattgccagtaaatttgttggataggattgttaaaattgtgaggtaaaaacgtcatatcacataggtttttttatttaaaataattgtgtgaagtgagtgtagctcaactggttagcatctttgtggtggaaccagcatacccggattcaaattctagatttgacacgagtgttcatatttacgactaattattatttcagtagtaggtgatatatccgtcaacaacgagacgtctatggtaacttcatcaatcttaaatattattcggtggtagacgacatactcattaacggcgagacatctctatgatgacttcgtcaatcttaaatatgcctattgtgaccgtttagtgatgagggaataaaactcatagcttattaggacaattttgttttgaagccaaaacatgccttatctaaaacattgcatttaaaacagtatttgatcatgtttgtttcattgtttgctaacataacttgtacacataaacgttgccaaacttacatactaggatttggccatgccaatctatttttttcgaantttgatacaaacgtaagtgctcgtttaaatgcgcgcacactcacctaagagcaaggttaatagtatagcccactactagctataattcatctataaccaatctaatagtcaattcatacaataattgattactatactattaatatatggtcccacctgtcatacgcacactgcatcttgtagtccgtgctgcagctagctacaaatatgtagcccgctgctattatctctcctcatttatgtccttaaaatatgtttgcagctgccttatagcatgctattgacctgctgtaatacacacatatatttttacaagcacatcagaaacagaactgatataccacgaacccagtgagtccagggacatttattacatggatgaaaagatgtgtcgtgcttagctgtgttcttcgtgaacaagaatgtacagtaaatgaaagtgaaataccttatgagcttggtataatatagtactgtgtacaacagcaacaatattttgttggagatcgattttctggtggatttgatctcttcaatattgaccagacaagcacctgaacagcgaattaagaatttaggacttcgattcagatgagagttccaacagttcaagagctgaatgtccatattgaaatacttaatcatgcatggtgtacaggtatataataaacggacccataatcatccataacatcgatcggtttaaagggaaaaaagctccccaactacttctaatgcaaccttggtgagcgaacccatggggccctaaatatagccatgatctggtatttcactacaatttctgcaattggcaacaagtactacatgcatggaacttttcctttaaaaacccaacgtttttatagccttgatttgctgaatatatgctgatgacaccatcaatttggaaccagcttgttttgtttattccttacttttcctcctcctgaatgacccccacagaatttatgcaggattattgtcaggcaggttgtacaaaaccaaagcgttcaaggaattttgtggagatgttagtattgcatttataccactcgagatgatacggagcatcacttgatgaacagcagcgaacaggtttgatttgcaccagaactcgaccttgcgaataaatacggcaataactctactggagtactggtctactctcatcttcagttttgttgcaaaagcatactctttcccttccaaaataaacaaatttagcacatgacacattttgacatatatataatacaaaatctacgatatatcacattaccaggttttgtttgttttaagacgaatgtattacgctacaagctcccagtcaagcatttactacatgctaggagaaacattaggatttccgtgtgtttatttaaaatgattttttttcatgtgtaggtatatttattttttcttttcacatccatattaatttatctgagattagctaaaaaatttaggcgtcataaggttttttgggacggatgtagaaaattttaggctctgtttttttccctgtaccgtgtaaactattatggcattgcattgggtagtagctgatccatttctagttgttttagatcatacgaattggttattgtattacttaatgacaatttaggctgtgttcttttacatgacttcgcagctcttcttcttcgttttccgcgcacgctttataaattactaaacggtacatgttttgcaaaaagtttctattgaaaagttgctttaaaaaattatattaatccatttttcaagtttttttatagctataacttaattaatcatgcgctaatctatcactccgttttgtgtacggaggggaggggttcccaacccctccaaaagaacacagccttagagcaggcacaatagcagactctaacacagctataaacatattttaagaagataaaagaggagagaggagcaacatgctgcatatttatagtcagctgcagcacgggctccaagacacacgggctccaagacacatgtgtgtatgacaagtggggccagatattaattgtgtactatatgttataggtaactttagctattaaattgactataaatgatttagagccagcagttaactatactattaaacttgctcttatgtgtcgagaaattctagcattttttctatctggtttggattatgaccgaggtttgaaattttaaagtgattttttttaaaaaaaaatagatttttaggtgagaagacgctgacttaatagcaggtacaataacaagctataaaccagctataaatatattttaaagggataaaggaagagggtagaagagccagtgggctacagatctgtagccagctttagactccaagacgtaatgtgtgtatgacaggtgggaccaggtattgatagtatagttagccactattggtcggattgggtatttccatgtttaacaaatgatttagagctagttgtgggttatactattaaacttgctctaatagtaaaaaaatcaaactcttaagtttaaatcggctgtgagcatgtcttcttgtgtcggcgttctaccttatacaagttgaccacatcggaggttctaggggaaaacggttttattattctctcaccctctcgctcagtcgcaaagaggtggctagagtagagtttggtgtcggttgttagggttagattttggacgatcttggctatagttcctttattcgcttagcagcgatcagtcatgcttagtagcgaccggttcggtgatagatttctcccgagtatatatttggtgttattggtgcgtgaatggtggttattttttctttgtttttctgtttacgacctttagagttataatcttttttttacactatcaatataaactttacactgttcggtaaaaagtcgttaaaaaatcggctttgaggcttaacttaatcgtgtgccggtgggtgggacccggtttcagtcccctcaccaacccaaagatggcaagattcaaccttgcaccagctcagtacaagcaccagctcagtacgcgaagtaagcctgacacacacagcgagggaatagccgagtaaccacgggaaacaacggggttctgaccttgtagggtggagtaaccacgtgacaggggctaagacttttgagaagccagcagtaacttcatctcctagccatatcgctcttttttttaagggtgtgtttagttaacgctaaaattaaaagtttggttgaaattgaaacgatgtgatggaaaagttgaaagtttgtatgtataggaaagttttgatgtgatgaaaaagttaaaagttttaaaaaaaagtttggaactaaactcggcctaaatcaaaacaagccatcgcttttagttgtgtttagttcacgccaaaattaaaagtttggttaaaattgaaacgatgtgatggaaaaattgaaagtttgtgtgtagaaaatttttaatgtgatgaaaaatttagaagtttaaaaataagtttggaactaaaccagggctttatggcttaggctcaccccgaggaccgagtttgagcaatctctccccggaagtgtagaggcgtaattgctttatctcaaaataaattcatttttcatttgtcctatagagtactccctctctaaaataacgaatcgaacctaatctaaacaaatatgtactaataattatgatgtgttatactctagtactatatcggtttttcttacgaggcagtacataccaatgtaaaactaaaagatcatattgttctcattttatcaaatctcaatgccattattttttacttaatctatttctattacatttattcattaattttacgaactccgatgtaataattagccaaaaaaacttattttaggataaatcggagaagctaaaaataaacttattttgagacaaatagagtagattttaccttgatttttcgttagcacgtttttcaaacggttaaacggtgtatttcattaaaaaactttctatatataagttgttttaaaaaattaataaatcaatttttaaatttgcaataattaaaaccgactagtaattaatcgtgtgctaatggctttcttgttctgcgtgtgctaacttaatcttcatccaaatgtatctcaaacgggacctagctgctttcgggagagaaggctaagaatttttctcccatgcaagtaaaatgggatagtttatgagcatatggttaagtaaatattagcttaaaaattaaaaaaatagattaatatacttcttaaagaaaacatatatatacatataaattttaaaaacttatcatttagttgtttagaaaacatgtggatgaaaaaacagagaatagaagttcacgtcatagtcacacagacttcatttcctacttcgcccgagtttagttccaaaatttttttcaaacttccaacttttccatcatattaaaactttcctaaacaaataaactttcaactttttcatcacatcgttccaaattttaccaaactttaaattttgacgtgaactaaacacacccttcgttaaaaaatgtcaagtttatttttagtcaatcaaactaagaaatacatatttaattggagcctacgaaatacaactaaagtacgaataaggggcatagttatttctcttcactgatagtttgtctgaaagttgctagaaacaaaatctttatagcacctgataaacatatactgtactaataattacttcctccctccttaaatgtaaaagattctgactatgaattacatgtttaaattatgaatctggatatgcacaatctgcatatgcacatagatagatttatagatatggtccataacatttagagtcgaagaaaatagtacactatggccctttttgaatcaatgagttattttttagcccgcccttaaataaccccaaatagcctaaaagttccaaacacgtgagctatttcagggctatttggaaataacccattaaaaaaactatctccctcaagggctattttaggtgggacttactgaaaaagtgtcttttctctccctctctcttcatgggaaagtgcattaaaggccaaatagttctcaaaataacccttagatacaaacaacttacagctattttcttatgctaaaaaaatatttctcaaaacctggcctacagagagaagatgaaaacgtaaaaaaaaaaaaaaaactgaaaggtctttgcctcttgcctcctggaaggccagtccaggccgctgagccgaggcggagtgttcgttattataaagccgcaagcgtttccatttccctccccatcttcctcttccctcccctctctctccatcaccagctcatccctctctagcgctcgttcgcccgcccctcccccctacggccctacgagcgccgcgcttctctttctagccccctcttccgcattactccctcataaaggaggaacagaggaaagactgggcagaggagaggacctatagctgagaagaagcagagcaagtgaaggagaaagccccgtaatcttggccatcctcctcctcctgctgctgctgcaactccggctctgcctttaaacagtgcagcccgggcggcgccggccacgacgctcgtactcctagctagcagcggagaacgaacagcgtgcagggactcgcctcgatagcacagtaaattccattccatatcatataccattccagccatcactctccaccggcaccctgcatttactgctcccccatcactcgccccggcttccttgagcgcgatctccagatcatcttttgtgtagcgagaaaggttggtgctcttcttcttcttcttcttgctgctgcagctggtggtgttgttttttttattggcggggtcggtttcctgctctgttttgttaagtcatattgtgctgtcctggatcttgatccgacgtccgtccgtacgcactcacgcagctgacgacggggaagggcggcgtggtcagcatggtgccgcgcgagcaggcggaggaggccatcgtggctgacagcaacggcaaggaggaggaggtcggggtgatgggcgtcagcgccggggagcacggcgccgacgaccaccacggcggcggcggcaagttcagcatgaagaacctgctctggcacggcggctccgtctgggacgcctggttcagctgcgcctctaaccaggtataactcatcctgctccgccatggccgccatcgcggccatgcagctcgctcgatgaaggaatcatatcgagacgaatccgaaaggcagcgtgactgaatttctgaatttcctggtggtgggtttctgcaggtcgcgcaggtgctcctgacgctgccgtactccttctcgcagctcgggatgctctcgggcgtgctgctgcagctgttctacggtttcatgggcagctggaccgcctacctaatcagcgtcctctacgtcgagtaccgctcccgcaaggagaaggaaggcgtcagcttcaagaaccacgtcattcaggtacccgccccgccttgtcatgccatggccgtgctggccttgtcgcttcttcgtatcctcctcctcatcagtaacggattgttacagcttcttatccccgtctttatgtggcataatcgaaaacacatttttctcgagcacgcattttttccccttccgtttggtcgttttcgatccttactggcttgaaaaatgcctccttttcttttgtgaaaatggcagggggtattggatcccctgcctcccatggctctcttctggttgcttgccgaaatgaaagccgagcctgaatcgagctcatccttaatccttgttcaattaatcacttattactgcaaattttgcataactacacaactatagttactatactaacaactggggctaatgggagaagcttgtgacgttgactggtggcagtggttcgaggtgctggatgggctactgggcccgtactggaaggcggccggactcgccttcaactgcacgttcctcctcttcggctccgtcatccagctgatcgcctgcgcgaggtcaaattcctttcctccccaactcaaccaaccaaccatcactctcccactgtcacttcgcagcgccagtgtaaatatgtagccgtgctgctgcgcaacagtgtgtcgtggtgacagattgggtttgtgcggatgggctgaaaacctgaccgataatttggtggtgttttcttcagtaacatctactacatcaacgaccggctggacaagcggacgtggacgtacatcttcggcgcgtgctgcgccaccacggtgttcatcccgtcgttccacaactaccggatctggtccttcctgggcctcggcatgaccacctataccgcttggtacctcgccatcgccgccctcctcaacggccaggtgagataagaagagggaaactgtccttgtcactttctcgatcatccatcgcgtctactacatgtccatttagcttgggtttgcagtgactgatgatcgtttgcgtcgcaggccgaaggcatcacccacaccggtccaaccaagctggtgctgtacttcaccggcgccaccaacatcctctacaccttcggcggccacgccgtcacagtgtaagcaaagcagaacttgctctgtttgtccagttgttaatactgtacagtagtattagtactaggactacaagctaatcctcctgaggaagtgaagtgagggagaacttttcactagctgcagcttttgcctgccaatgtggaggacatgtcccgattggaaatcaggttctggtttccattccattggtccccctccatggtactggtactcgcacctcactggtcacagtgtagtatagtgagtactactactactactaagcttaattaaaacacacgtagctgtagctttgcagctagttagctctatggcgtacagatcccaatggatggataggggcacttaaaaattccaagcctgtgcgcggtgggaaacagctgcgttagcttgcgaccattagtcggctgatcgattgatatcggtcgataaaaatttataaagatcgatccagctgctaaagctcggtgcgttcatgtgcatgtgcgatgtgctgaactggtgatgcatccaaaaggtcccctgctagtacacgcgatggtttaggggagaaaagaatgggccactatgcattagaatagactccttgagcccctttattcccattgctcgtttatgtgcctaatctattgcttggattattgagtgtgtttttgctttggcatgattagaggcccatgcgaggaataattagcgtttcagtgcgctgttccttcaaaatgcgatggtcgttagtgccttagtggtcgcatgcagttcggattggagatttgatgatcttatagtagtatatatagtatctcctagcttcaaaaatttaatgtagtgctaccagtacttgttccatagttgtgaaaattgaaaatgcttttgatgggttggaaatggaatggaatgataaggggggccagcttcattcaattcagctagtgcggagttcacatcaagctatgcaattccgtgctagttgccctaatccaacggggtgaaatgatttccatcatggattgggacatcttggtgccaaatcatccaatgatgattccatttatatcttactactactattatgctgctaggcttgcatgggaaagtttagcttagtggggcgaaggggacacagacctgctttgagaattgcttcccaattgaagaatgtgagtgtctttgtccatcttgacaatgcccctcaccacttctggtctcaggctaattcaaagcccagtttggtagcgacatgagaccattagcataacatgcatgggatgggatcttcgctagctgtggagcagagtttttaggtgattagtactcgtatttagtggtataaattattattggcaacggccttatttggccgtatttgtcggctcctccatcatttgaccggtggcggatacatgtgttggtgaaagaaagaaagcaattgcgagattccccctgccgccgcgatccttgcatgtatcctgcctgcgtgactaggagaagcagcagctgtagtagtagtcctactttttggccgtatcatttgatcaagctgattaaagtctcagcatcattgactcgcatgtgccgaggccgttttgtccgttgatttgttgattaataacctgcaagaaaagaaaataatgactgattgggggtggctgttttggattggtgcagggagatcatgcacgcgatgtggaaaccggccaagttcaagtacatctacctgctggcgacgctgtacgtgttcacgctgacgctgccgtcggcgtcggccatgtactgggcgttcggggacgagctgctgacccactccaacgccttctcgctgctgcccaagaccgggtggcgcgacgcggcggtgatactgatgctgatccaccagttcatcacgttcgggttcgcgtgcacgccgctctacttcgtgtgggagaaggtgatcggcatgcacgacaccaagagcatctgcctcagggcgctcgcgcggctccccatcgtcgtccccatctggttcctcgccatcatcttccccttcttcggccccatcaactccgccgtcggcgcgctcctcgtcagcttcaccgtctacatcatcccggcactcgcccacatcctcacctaccgtacggcctccgcgcgcatggtaacctcaagaacctctctgcacatgccctaactatgccccatcatcatcgctgcatgcatgtttttgttccggtacaccgcctcgtccatccatccacgcattcaatggcaggtactagtgcaagctagggcgaatgcaacgtgacggccaacttatactaacaactgggtccgatggatttcatcgacgcttcctccgtgttgctatagctgagcagcggatcggtcgagccatcatcaacagtggcgagactggaacacacaggcaatagaatagacagtggagatctgtgcgcaggcagcagaagcaagcagcagttcgtgttgaatgcaaaagcacagccgggccgtgcccggggcccacctcatacatgggcaaatccccaatcattgaatccagccaacaaccacattaattccaagcagcgcccccccccccccccccctcccctttcgattctggccgctgctttggcagtatcttccccaagagaggttagcttagcctagtcactttggtttagtgaccgtgcccagttctggtgcgctactgctcccatgtatagtgtctcagattaggagcccaaccaaaggtggtccctgcttatctggctggctgctgccgcgcggctcggtacagcggacgaatccacccgtagactctctgtgcaccgtgcgcgacgacgcgaagaaacgcgcggaaagcaacggttgacgccgcggtggatgaggtgggacggacgcgctgctgatgttttcgcgccggcgctgctatcgcgggtgggacatatgtaagacttccgcttggcgcgtagccggaggcgatggcgcggtggtcgccgtcgcgcccgtcaggtcagggggcgcgcgcggctagcttagcttttttcgcgcgtggggggaggggtttgggagatttttgtgcgtgggtagcctttccctctcgatccccttcctttttccgcgcctttccgaaaggcgatcgaccgaacgtgcgtggtagtacggacgcggcacggcgaataaaaccagcaagcaccaaccatgttttatgttgagaatctacaatacgcatctcttttttgacgagggtttatgttgttgtttgcaacagaacgcggcggagaagccaccgttcttcctgccgagctggacggggatgttcgtgctcaacatgttcatcgtggtgtgggtgctcgtggtgggcttcgggctcggcggctgggccagcatggtcaacttcatcaggcagatcgacacgttcgggctcttcgccaagtgctaccagtgtcccaagcccgccccggcgttggcgcagtcgccggtgccattgccgcaccactagcgcgcgcccgttccgcaccaccgccgccgccgcggcggaccgtgacaacgtgcaccgccgagcccggagcaaggaacctcgctctcctggccggcacggctgcaaaaattcagtgttgcttaggttttggtcgccttgtaatatacaaagcctctcctcctgtgctagggtgtcacaccaaaatggtagaagaagaagagggcatgggtccctacgatcttgccccgggccgtccgctgccgcgttgctttcccccgatcctcgatggtgtccttgtgtttgtttggcttgcccctccctctggcgatatatatgtgatggtcgtcatggcttataaagattttcagctcatgtcacattttcatatgatatgatgtagcatatcactatagggttatttgttttctacctggatggagcttggtccatgttgtttagggngagcaattgtaatnggngattcntngtgntagntaaaggcaaaacacggaggccctngcccactccccccccccccccaccccccncccccccccccccccccctnnctccccccctctctcaccccctnnntnnctacctttncnnnnngngccaagcgattaaagtttcttgagaaattttatgggcttctttgaaaggaccacaaagcaagggagaaagatatggagcaaaaaaaaagatgtgctcgtagtaatgaatggtggtcgagtggggttgtgatgcgggtgcggcgcgggtcggcgcaagctataatgactcgcactctgaaacttgcttgtgaggctcaaatgctcatccagagttctaaagatggaggctaccactactggctacactggctttgcatagttgacacagcgtgtcacgcagcagacggccctgattagcagcccatcttatcacaccagcatactgatacaccggcggttgaggctaactttataaggattagactccactacttgtactggtactagtagtagtacaattcatggatgcattattgttggcttgtgcttcacagcatcgatacggactttggttagagagaagattgtgctttaattcgcccatgtgggactcctaggctctccccaagccgttgcaaatgggattctctctaatccctcactccctcgggcatcagccttcacatggagggggcatgtgcttctattgacaggtttctctttccagatttccttttgctggtatctgtgttccttccaaccatccatgagagggggggagcgaggtgctaactgggggagcatgtgctttcgacttcacagcatatagatgttttaatctgacagcaactggccgttgatgatagtttttgtttgatttgatccctgtgttcttaagtttgaagtgtatatggtatagtacaatatacttacctctgctcgagtcccatcttgcacatggtaatgccacttgccgttgaatggaatcccaagtggaaaagaacatcaactgatgatctaaagaactatgcttagtgcttacttctatttgcaagggaattgttggcgatgctaagatacgcctcaaccatgtggagcatatgcctaattttccgataactttcgctatctgacaggctacatgtaccaagctatgagtttgaggtaaagaattatattatctttcttgtataggcgcaatcttgatctgataatggcagatcatgaacacgcgccatgcacaagtagttaggcgaacatatagcatgtagtttagaaatgcaaatcgtgcaatcttacaggaccccgaagctttctagtgcaactggaggacagcgatttgagattacaggatcgcaagaaaaggctcaagatatccgctggtccctggtaagaagctcataaggcgtagctcaattgatgcaggtagccaggtacttagcccacccaacgcatcatatagcatctacttttcagctcaacagatctgaacacacctggaaccaataatgaacggtatctcgcaaagcctcttgtttcctcgtccaaagaccaaagtgagttgaaacagttcactgattgctgaagccaatgtacgcgactgttacaaggcattgttaacatcagcagttaaaatcccaacgaataacatcagttcggtacatcatgtacttgaatgagaggaacagtgaaacttttgctggggggcaacacatccaccgaaaaatagcatgtttactggcttcgatcagaacaagatgcaaatgtccatccaggattggatcatcagcttaaccaaaaccttggcattccagagtcacgttcagctgcagcactgttgttaggtagcctctgtattctacttgagaactcattagcctatgaaaaatggacaaagggtcaattacagactttgcaaaaaaagactgaaaactaattccaccaaataatcactatgcaaaacatgtggcattgatacaccaaatatcacttaaaggaagaaaaaaacaattgggatcaagtttctctggttttgcacttttgctcaaagcaaaggtaagattcaccaaaccatgcgaaaagtagagcataggtaaaaaaaaacaagattcaacaggacagtatataaaagcagaaggatatgctttcattatttggtcaaaggcaagattctatgtaacagtgcaataaaaggggatcaagttcctaagccgaaaggattctactaaagcctagcataaaatctggaaatatcattctgcgtcaaatcaatattattgcttgcagcctagcacagtagcacaaataccctcacaaactgtgaggctgtaagcctgcgataagtaactaaagccacctcaaaaatatgagcataaagtggtatacttgagttaccaaccttctcatcgatccacattaaagaacgcagttgattatccagtatccggacagcaacatcaaatggtgtcatactatcagcagtctcaaactcagcaccctggattggaggaggctgatgtctaagacacaagtcatcactagacaagtactgcaaccagaatacttacctgagtagcattcaatgtctgaatgatggacttcacttgttctgtcatatgttgcaattcattctccacagtttcagattgctcaaaccttggcattgcaaaattattctgttaagctgatgatgtatattatgatataataaaacattaacataatcatttgtcctcacaaacaaaaaaaaacagctttgtcagccaatttggcaattcctcaaaaaaagaaaaaccaagctaagcaactgagtggggcagaatagattatgcacatatttcgagtaataacaccactattgagacaggccactcaggaaacaaagaatatcgtatgttattcgattcaggaatatttttaagcaatgcacagcatttacttagcttaagctgcatttattttagatcatgtgcagattattcatgccacgtttccaaaaggaacttctccaaaactgtcgccttcagaattgcttaaatgcctaggctgtgttcgtttgttatctttcccaactcacctccctcgttttccgcatgcactcttttcaaactgctaaacggtgcgttttttgcaaaaaaaaattatatacggaagttgctttaaaaaatcatattaatccatttttcaaaaataaaaatagctaatacttaattaatcatgtgctaatgagttacaccattttgcgtgcacaggagattagttcccaactgcaacaaacgaattcagccctagacaacttgttctaagccatttgttatctttacaatatataatatttaaattcatcccgataagcaatcatccataatctgtccaatcaaacatttcaatgcatcctaaatcgttttaaagcaattgtcttaatttttgttcccgaagtgtggtgcactatttatttgcattactgttactaaatacaaacagatggaagtagctgaatccaaatggtgactaacattgtatctcttgcagaagcagcctcatcttcacgaagcaacagccgttcatcctggaatacccgctctgcttcctcctccatgctctgcagagccttgtcaacctgcaattatataacgagttgttcactagccagtacctggtggttaatatcggaatagtcacagtttagccaagtaccaaattatggaacaccaaaattttgattgatagttcagtttgtagcaatgaagttcaaacagcatatgcgattaatttttttcccacttaaagaggtcagaccaaagcatcatagtatggaactatggaagcaaacaacaaacatattactacaggctacagcagaacttttaaatggcaactgcaatcatcactgggtaaacaaccaaaacataactctgttagcactgcaacaaattattctcgaagaaatttctttgcacattaaaccatagtcagaatttagtcttaagcaaaaacaaaaaagcatcacatgtcatgtacaaggtttacattgcccccaaaaggccatacggacagaaatttaaaaaaactcaaccagtgggggaatgactgcccccatgggccacagcttttcattaagaagaaacctcaattcgtggatttcccatactaccagaatttcaaataagagttttgatgaatttagcatgtgatggtcacatcaaatctatgaaaccgtgaacattgaaccatagggaacaatcctgattgttaaggtgttaaagctagatgaggtaacatatcactgcctcaacaccaaattatgcgaggcataaggcaaagcgatgacacataaagtggctgcacagcctggttatgggagaaaatgggaaagaaattaacaagcgaaagagaaaataaaaggaaaaaaaaaccattggaccaaaagacggcattgagacatgtgcgctcccagctatgagaagagcactaggccactgacaagatcaatatgcactcttctgctggccaccttggcaagggagcctgacatctttgcctaccggtcgtggagcttcaatgcatccgcttgtctagctgtccaccactgccactgccagaaatgatacagtggcagcgatctagagctagtctgatggcactggtgcaagttctgcgacactaagctggagggagcaaggaagagatggacctgaactatcaacactcaactgtccttgaacatcttaccatttcaccctttctttctcctgcgaggcaaggcagagcgacaacacctctgcacatcttgccactttagtagcccccttaagatcatcttaccatccagagggaggataatcacgatgccatggaaaaaaaattcctccataccaataacccagcttatgagagacgattataaaatataagaattgtaatgtattctagatgacataaaacttagaaaaggcattccatattaatgcattctaaaatgcagcttggcagttgaaagcttgtcatccttaaaaaaaaaatcagtcaacctatcttcattaaccatattgtgcgcaattgtgtaaaaaaggagatgacagccgaaatatgatgcatccctggcagcatagcatataaataatgagcttacaggaaagcaattcactagtcaatattatgatgtcatccatggggatcagcaaatgaaagagcaaacaagcatgcaacaaaaacaaaagtcataactagagtatgcagaagacatgaaatatatgcatccatacccacctctttctggtgagtttctattaactcaagttgcctctccaagcttgtttgtgtttcaacaactttagccacctcagcctgcaagggacataaaatttattttaaatcacagcaaatgatctaattatataaagttcttttgagtaatataaacatgtatgcatgctaacacacatctatccagaaaagcaccagctcaagaggtgataatggtgggaagacaacatcagcactaacttaattagtactaaacgaagaaattcatgaaatgaacatatcttctcgcattaatctaatgtgaacgataggcagctgagagggagatcatcatagctatcaatatttaccaagagcatcctagaaaaaactataggagatatcacatgtgaagtatttgaatcaagttaggggagctgaaacaagttatttggatcagaggtagcattgcacatgtatttcgcaaaggcagaatattggcatagtttttacatcttcaatcacagtctgactagtgatagggcattgatatacacatttccctgctttacattcgactgataaagctcaccagtgaacagcaaggaaaaagcagttcgttcactttcagacttcctagtttttcattttcctaatttctcattccatcaataatcaaaactaaattacataaaatatatgcaaaagggtgaggataaataaaaaaaatcatgtacacttttaaaagcaacaatacatcggctttacatgaataagtcaaatcaacatgcattgcgcaagacaatcatctactagataatcaaataattattcatgtttcatgttcaatttaaaactactgctaagaatgaaacctccaagtctttgtaagtttgcattaccagtgataaattctagagtccatagggtaagcatggctattcaaatccaaccaggcttccttctaccctgctttcaactaattgtaatcatttttcataaatattgtctttatgcaaatgactttgcaaaaccaaatcagcaataaagaagtaaatatataaccatcaaatcttctgatattgatctagctgcaaaagttcatatgaacagaactagaaaagaagagctgtaaaatgtaaaaataagaacatacctcaagccttataagaacagtcctgttctgcagaattctcctgtcccattcagatattgcagtggcatgcttccggaacttcgcagtgcgatcttgaagttcattattccagtccctaataatctacaatatagataagttcgtcggtaaaatattactgtgttgctcaaggtaattaacaagacaatgcaaagtcaaactagaaagtaagtgttgcagtagaaaacaacaccttataaccgcaaagaataggtgcagtacctgctcaacatttttcccaacaatttctgatggtagcttaggtgcctgtgatgctactggagtgatagcagtagttgtaggactgcaccaaaagaacagggaggccatgaacaaggtcaatatcttgtagcccagaccctttaataagtatgctagagataaatcgacgggatttgtacaaacccagtgctgctagcttgaacagctgaggaagttgcctgactagtgcttgtgatggtggttgaagtacttgcagctacagtagaaacacctgttgaaaatacccgcttaacataaatctggacatcatcaaaatagactgaaaagtgataatcaaaatagactgaaaagtgatcacctcaagatttaggaaacagattgcaaggtaatgattatagtcaaaacagtgcgttacaacaacaatttcctgtattgcataggaaaggcaaatgcacaatgatcgggtcctcaaatgatgatacaaataagttatttgcgatgttatgagctaaatggttacttgcatgagggtgacatttaattgttcactgccggtaaatcaaggtatgtaaatggtatggtcaaattagactgaaaataaaacaatagttttaacaagaacatgagcactcaccgaatgacaatattgactgtgtctgtgttgatggagctgaggcagaagctggtgtagttctctgctggctaaatagtgtagcagttgttgttgctgaaggagccggcgttgtcatggctgcagatgtcgatgcacttgtgactgttgtggtagtagctgtagtagccgcagctgatgatgacgatggtactactgtgaaactgaaaccaccagcagaagaagcaggtgctggcactgagaacaatgaccctgatgtcgcgggggaagcagtagctgctgacggtgtggatgcgctcgttgcagaagcagaagcaaatgccggtgcagaagcagaagatgagccaaacggaaagctgagagaagtggcagacgagcttgctgctgcactggtgttagagaacaatgagggagcaggtgctgccggcgaagtggccaaggagaagccagtagatggagcagacgctggcgtggtgggagcagcagagctactcttcgtgaaggagaaggcgggagcggaagatgcagagagaacaaggcaggggcggtgctcgcggtcgtggtggttgcc

SEQ ID NO: 51986 - DNA, 2495 bp, Oryza sativa
acgcgccgaagatggatggggcggacgcggcggcggcggtggattggccgaacgagaagccggtggatccgaagccaaacggagatggggatgaggaggtggcaggggcggcggcggaggcggcgggggcggacccgaatagggaggagccaaaagtgggagcggcggcggaggaggaggaggagaagagggaggagccgaaggctggggcggaggcgggggcaggggaggaggcggcggcggcggcggcggcggcggcgggctgagagaaggagaaggctgatggggcggtgccggtggagaaggagaatggggaggagccggtggatcccgacgcggcggaagagccgaaagagaaggaggtcgccatggctgcgccggcgtgagcgcggtggcggatttgggggatcttcttttggcagattttttgcgtggttttgccgcgggctcgtcggccgcgccggcttgagaggaaggggaaggaggggtttggggcttggttccttcgtgggtaaccgcttttttgaagtagggtttaggagggggaaaggggatttgggaggaaatgttggttgttcacttgttcttgtgccttcctggtacgtatacctaagcatgatgtgtgtgttatccaccaaatttgaactagagaatggttcgttctcacttatacgaacctatcgtagtaggcaaaatttgttataggacacccgaaaatcgtgtaattggttgtgagacaccataaaattttggttttgcccatggacactatgaaatttgtgaaattggctgtgagacaccagaggcaatattttatagtttccgaggcaaaagaggtcaaatattttttaaaaaagaccaatctaccccctgcacccagctgtccatctccctccccaacccgatttcccagtctcgaaccctaaccctaggcgacggtggggccggcggcggtggcggcgccggcggagacagtttcgacaccggcgaaggtgttgaggacggcaacgggatcgagatcacctgcagttgcaatggtgactgcaactttagcagtccttgtgtgaccgttagatcaaagaaaaacaggtcagatttgaccagaacactgtagcacgcacacatagtcctgtagcgcactgtagcatgtactgtagcattggcaccttggttgtgacgtggcataactatctgtcgttatcagtttgatccgacggttgcgaatggatgtgactgcctaacttgcagtcaccgttgcaactgcaggtgatctcgatccacggcgacgacggcggccgctggagctgtgatgatgacgcagtaaatcgatccttgtggcaaacccgacgagtcctggcggcaagtgcacggtgcggcggtttcaagccgatagcggtggacggcggagctcagtttccaaatggaggacacgttctctgcacagccgtcagttaattaactaattaagttgtcctttggtgacaaatatttcctggtgccatagaccaattagcatctgagtggattataacagcaggtgcatcgtcgccgtgcaggattgaggaggaagaagcagccaaaggcaataatggcgcaggcggagaagacgagcgagagattttctctgtatgcggaatctcctgctcgcttgatgtcaggatcgcgccaggcaaggccctattcgcgtctgtgcgcggcgcggcgcggcgcgcacacgccatgccagcatgccatggcatgccaattgcgtaggggtagattggtcttttagaaaattatctgacctcttttatctcagaaattataaaatattgcctccggtgtctcacagccaatttcacaaacttttatagtgtccgtgggcaaagccaagattttgcagtgtctcacagccaattacacgatttttgggtgtcctgtagcaaattttgccgtagtagtaaaagtcagggccgtctctagaaatttagggtcccggagtgaaatgcaaagtagggccctataatttaaaaatcatgtacaacataaataaaatatattttcacttaattatatagatgcaatatgtgttctaatattatgaatttactatatatatcatctactcaatcactgtctaatcttacccgtctaaacctccgaggtcgagttatcgagggttgagtcgacgatgaatacggatgaggaggaggacggcatgagctagcagacgagacaaggtagcaaggcaaagccgtcgccgctgccgctcggagcgttggaatcgcaagtagcaagttgtatcgctatcgccgccacctcaatcgccgtgaatggaattgggatcgtcgtctcggtctctgaaatcggcacgtagaattagatcgctcagcaaccaacaacaggacgaaatcaacgatcgcacaacatcctcttgattttgggcaaggcctagcattgttgatctatccattgggctattgcctattagatgatgttgtattgcattgctatat

SEQ ID NO: 51987 - DNA, 15193 bp, Oryza sativa
ccatcaaaaggagatcaccggtgagagtgctagcaaactttttcatgggtggtgtggcggcggtagtagccaagataggggtcatgtcgggaatcctgtgctgtcgcttcacgccaccgccaccgcttgaaatgcacgttaatgttgttttagcctataactatcttcgtcctcacctagaagcgatgtgttactaggctttccttacttgcaaccgtcctaactatattacgtacatggtaccatctattttttaaaataaattgatataatgatttattatagacagaagaatgtgaaactaaatatacattaagagtacaacttaaaattatttctctcctcgtagaaacgattatccgtctataagaaagttaacggggaaattccggtgatcaatgtcgagataacgttccatctcaaagaaaaaaaactgagaaaaccataatactatggaaaagtctatacgtactaactttttcttactaaatttttactaacactgacatgccatgctataagtgtatctagatttttttataactttcatctacttgaatcaaacggttgagatgattgttagtataaatttagtaagaaaaatttagtacgtgtagcggtgctctaatccttttaccgagtagcaacaggctaacagattcagagtaggcagttggatctcaatcccatcccgtcctctaaaaataaaacaaaatcgggaacaggaaacccacgcacgaatcgattcccatctaggcatctcttcccagagagaagaaaaagaactctcccgcagccgatccccaaatccccacgcatctcatggcggcgagcctgtggcgggcggtgatgggcgccggcgcctcgtcggcggacaccgacaccacgggcggggtggagttctggcgttcgccggagcgcgcggggtggctgaccaagcagggggagtacatcaagacgtggcggcggcggtggttcgtgctcaagcaagggaggctcttctggttcaaggactcgggcgtcacgcgcgcgtcggtgccccgcggcgtcatccccgtcgccacctgcctcaccgtcaagggcgccgaggacacgctcaaccggcagttcgccttcgagctctccaccccggcggagaccatgtacttcatcgccgactccgagaaggagaaggaggagtggatcaactccatcggccgctccatcgtccagcactcccgctccgtcaccgacgccgaggtcgtcgactacgacagcggccgtcctgccgcctcagtcaccgcagacggcgacaagtgatcgatttcatcgattgattggtgagcaaaaggacctgtggttcctgtaatactgcagcatatccatggtacttacttaggttttgcgattatggttcatgtttcctgatttgcgaacgtaagtgtgcatttgtatattactgatgcttatcggggaataatttgggagtttagtgtataggatgcgctctgatactatccaccagttcactccatgtaactttctttaataaggtacgatttgtttggtcaattggtctgtgtttagttgtctaaattcttagatcaagtgtgttggtgaaaccgtagcaaatctttcaaggttagtcctgactaactctgcactcttgcccgtaaatagccaactggctttgatctatggaattataattcaattgtatatctttattcatgatcttggtttgctatagcaactgtatttgattgacagtggtgaacttataccagtgcttagtgcttatgcacagtaaaagcgggctacctcacttttgccttcatcagaagatgcaatccattccagaattcctttcctgtgaaatagatatatactttgttgtttaacagattcaaggtgcaaggagtgattttcaagtatagctgtatgattatgtgcataaagcacctaactgattatgaaaacagttgcaaccagtgatgttataacttacagtatagctctattggtcacaactattaagtcaatcaaatacctccatcatattgtcgaaacaccaaggctgtgggtttatgataatgaatattctaagctatagatattatttctaattggctggcctgattcataagtcccaacaactgttggccttcatggaatacatgatgagcaatattcagtatagacttatggagctaatccgttcatggttcattttggtgacacttgttgatatctttgtagtaaatattgttatttctctttcgttttatcatgacatgtgagtgctatctgttatgtttgtttaaaggaatcattctttgtatgcctagaaagatgcttcctgtcacaggttgtattatgtaactttttcattgtaacatgaagttaaaactctgataaactcatgctgacataaacttgccatcagtttatcatgctgacataaacttgccatcagttagatgtggtctttggagaagaaactttgtacttcctccgtttcacaatgtaagactttctagcattgcccacattcatttagatgttaatgaatctagacatatatatctgtttagattcattaacatctatatgtatgtgggcaatgctagaaagtcttatattgtgaaacggagggagtactttgaaatgggtaaacgaacatagtctgagatgcaaaataaatatctgaaaccaatcctggttatgaattatgaagcctatatgggtaaatttgtcaagaacacatgtttatattcaagtattttgttgttttgaataattactttttgtgttgaaaatccaaaattctattaagtttcagtaatatttttgtgtagtagataagtagaagcttattgctttattttactcaacctgtcaacataatttaaatctctagtgttcctttcttaagatgtctgtcgtctataaagttagtctgtgcttgctgttgtgtcatgtttttcaattacacaaccattattacctgccactttgggtttaactaaaaggtagcttgtggcagatgtgggaggaggctaatctcatgagattgttgaacactagaacttgatgtcgccattatcaactcaaaaaattatttccatgtcagttaaaagcgtgtagggtagaaagatgtactgtgaatgttacacatgcataatgtactgagccttgtggggtatatatagattacaaatgcaagagtgtagggtagagagatgtactgcgaatgtcacatatgcataatgtactgagccttgtggacggtatatatagagtacaaatgcttggatctcaaagaatcatagagacaaaaatcaatcacatcctaccataacaaccggatcatttccgttcatatccatatactcttaacatcggtgatacatgggccgtttaacactggtgcatagtaatatacctaacctttcggttttgcttgcaactatagtacatttttgtttgttttgagaaaggtatcgtctgattctccttctattgattcttttccgatcaagatgtatggattcatatgtctacatacctagattttggtcatgaattaacggaaatgtgcgagagctttatttgcctttgccattctatgagtcagctcatacctagattttattcatgaattaacgaaaatgtgcaagagctctatttgcctttgccattctattctatgggtcagcttgcattttgcgtatgacacccccaccctctttagcagcatctactaactcggaacttaatttaaaagccatattttgacccagacgcttttgggatgcttctaataaccaacgaatggcaaatgatctcccttatctatatcctattcaatcagaactttccgcatcgatcctttttattacgtcttgtttttactcctatattcttgtctagatcctattcaatcggaactttccgcgtcgatcctttttattacgtcttgttttcactcctatattgggatttaccagtaatagtccttcctttagtttcagatccttcaaggcttcaatcctccctcctagaaccctgttccctgcatttgtatgtcaatgaaatgaatgttcgggtgaactgtatgtctatcgttttatctactcccatcatacgtgtattgttggctgtatatatccacctatggatatagaggctggatttctatccattatcttaaaaaaaagatcatacgtgcattgttgtcaatgtctgcagtgcacactttcatttgctagagcaaataactcacgcggtcatgccctcgttccctccggtttgtttgcacttcagttccagctagcatccttttcttctgttgcattgatgccgaagcgagaaggcaagaaaccatttgccatggtgctcgaaggcttgtaagaaaacacgggcatttgttgtgacttgtacggttgattagacgagccgtacgactaggatgttgctgcctctttttttttttctcaacacgttacagtttcctacatacaatatagcacttcatcttgtaaatactttttcctcccctacttaatataacaccagctttgttggcttcatttttttaaaaaaaatatatactcactccatttctaaatgtttaacaccgttaactttttagcatatgtttgactgttcatcttattcaaaaacttttgtgaaatatgtaaaactatatatatatatatatatatacacacgaatcaaatgataggaaaaagattaataattacgtaattttttttaaataagacgaacgatcaaacataattaaaaaagtcaacggcgtcaaatatttagaaacgaagggagtatataacttttttttaacatatatagcacttcatcatctattaacccaccacaagtccacacctgtgcagtgctgtgcagagctagtctcagttggcactcccggacggcccggtcgcccgcacggcttcgctgccgtggcggatccagtccacggcagcgggcgtcgcaagtcgcaacgcaacgaacggcaggggcagacggatgcgaaacactcggcgcgcgcggatccgacgcgagaccagggcagctaggagaacggggacaggagggccccgcgggcgctaaccgccttgtcaccacggccacacacactgccgtgcgcgcgattccctcgtcccaccctgctgaaaaaggcccgcccggagcgcgaatgcatccgtgccgcgtcaagcaactctcggtggtgtggtgtccactgtgcagctcccgtgcaggcgttccgctttgatggaaaccgccgcggccgtggtgtgccgaggcggcgggctgcgcgcgccggcgcgtcgcggtggcagtgacagcagcacgacgcgcgcgggtggcgttgctgcctccccggcgcccgccaccaccgcgcgacggaggccgctgctcgtcgcgtcgctcggggagcccctcatcacggcgcaacccttgtcgtcgtccctgggagatggcgccgcggtacacgagacgctggctcgctccgattcggtgatcccgtcgctgaagccgtctcactgcgttgatcactcggtccaggttgacgccgacgaggagaccggctccaccaagacactcccacctcctgatgacggtgagctccactcaaaaattacaaaatcacaagacgatgcgattctcttaaacagctcatgatatattctaccctccagttcctacgaagacagtgcacgtcaaattcgtgctgcaaaagcggtgcgcgttcgggcagcgcttcctcgtcgtcggcgacgtcgcggcgctcggtctctggaatccggcgaaggcggctgctctggattggtccgaagaccacgtgtggacagtgaagaaggtgaatcccatcacgcgaatccttccattctccgtgtataatctcgtaatgaatcatccccacttctgatctgtccaggaattgccagcagaaagatcgatcgagttcaagttcttgctgcaagatcgatcgggacatgtcgaatggcagcacggtcgtaacagaatactgcatgtagctgacacctcgaacaccttgattgtctgcgaggactgggacgaggcgaagaatcagcaagtatcagaagagattggtgacgcagatgggatattttcaggaagcgatggcgtcttccaggaagatgagcttcaactgggtgaagaacaagagaccaacaagggtgtgactgtaggtgtggatgatgcaaaatcggctttagtcacttatatttacagggaaatgatgggagcaaacgacgcgatccagccacaggtaagttgcctggtgacagtattgttctgtgtaaaagggcagcaaacatttatgtgcaacaatatactactccctcagtattttaatgtatgacgccgttgactttttgacaagtgttttacatttcgtcttatttaaaaaatttatgtaattataatttattttattgtgatttgatttatcatcaaatgttctttaagcatgacataagtatttttatatttgtataaaaattttaaataagatgagtggtcaaacgttagttaaaaagtcaacggcatcatacattgaaatagagggagtatttaagatcagcttcttgttaatttaatcgtccctttttcttttctaaatcagttagcattggacaaacaccacaagattccagatgagcttagtggggaggcaaacatggcagcacaagatggcaatcacactgctactgcagccgcagcttctggttttgctggaagcaacggtgaggatgccatcttgcacaaggagggcgatccagtagagaataataggctggggctggccagcattttcttcaatgacatggcctggaccaggaaagccctgcagcagttgctccgaagccttggtttccaaatcggcacgagaaaaacatgaagtaagcatcagagacgctgacctgcagttttggctgatcacacggtctcgcggtgccttcattcaaaactcgaaagcttctacatgctgcaaacctacaaggaacaagtgtattgagaactgcaacaaaaaaccctttacgttgctaaggtctgcaacaccagcagtacttgttagcagtgcaaaaagagcaggaaagctgttagcagtgcaagtatgtttaggaccagtaatgactaagctaccaaaaaactcaattagtgaaatgcatattgtggttaaatttatctgttcgataaattctgtagaatacatctagaataagagccaggaaaagctgaaagtctggagatttggcataacatgtgctccataaccacaacgtataagctcaaccacatgtactttaatccaccagatttacgttcatttctcaatcatttcagttgtaatgctaatatgctcttgttctggtgatctagtaaaaatgatgtccatgatttgcaatgctttctttaatttacataagaaagctggcagcatttaaaacatgtaaacgtgaaatatcagcgtggacattccactttaattaaactaacttgtttacaaataactgtatccgtcaaggaaacagtcaatattcatgacatacccctacccctacctgtttacagctatccaactacgccagtatcctgtgaagattacagctttggttgtatggagcaaacggtccaaggtcaacagaatccacgatgcaccatgcccaattctctataatttatcaccttctaaactcggagaggcaaaaaacactttgcatgaaaatcatggttcaagaggcagccagccaaccataattggagaagcgcttccagtaataaaccaatggattgccagaatgccacaattttgaaaatggcatgttatcaacagctggcctcacatttcaacattatcaaactcacctctgtgggatataaggggaaattcagctgttgcatctggaataaaaataataagaagagatgacaagctgtaagataagagagacataaggactgaataatgattaatttacatcttactatccagaatacaagatatttttaggaagagatactggcaaaaatactcaatgaagtccagaacaaaacattattcgtaaataaaaatagcattcatctgcaaattaagatatgttgacgtgcaaaaacggcaagcatcaaatagctaccttactggtctcaaatgcttcttgatttgtgggtccgtagttgttttcaaggtcttcagcgcctcttctgcagcctgaaacaaaatgtttagtggtgagtatcaggaaaccgcagcaataaagaggctataacagtgctgttgccccctcgagacagaaccagcacactttgcaccaggcagttattagtggttaatgcaagtaactggatagttaggcaagtcctgataaagtttttactggccaaaatatttccattcagttttgaagtttaaatgtatcaaagtcactagaagacctacttttgttcaaaatgatatcctaataatggtaatgtgtggaccaagtggacagcattcatgggttcgaatcctgagaaggatttaatttgttagaaatcccacaagcccttttggccaaattggtaatggtaaagatggcatttccaaattcccacaaactcttttggccataacatatcacgtgaacacaagctctggtgcactcactgtgcacaccaactgacatatacatactcataaaacagagagtttttttcttttctttttttttccttttggtaaccgctgatatttaatggatttgaattccaaaacttatatataggtggagtaagattagaagtaaatgaacaattttatttaagattttctggtgacattggttagttgttgtgcacaaagtgcacctgaagcatgtgtgcataggaatgtccccccttttagtcgatgttaaggagtatatttacatctcatgttcatgtcagcagacttgaagctcacctgccattaaatatcaaacctagtttacgggggtgttttggccacttcaggaacaacttcaaatttgcacaatattatgaggccggctgaaacaggtagaattttataaggcagcttcttggttcaagcttgctagtgcaattaatgttgggacattaattttggacaaagtcatgctggtggagcattctaggagaatgtgattcgggcttgttgcaggcttgaggcagcaacctcgaaacacagaggcatctttagtattcccaataattgtgcaaatgtcaaaagtcagatcctagttagattagtatacacaattcctattagacagattttctgcaataaagcacaatatcatgtagatatatacatatgaaatgtacaacactacaatctttgcaagccagcaggtgcctcatttatcacatctgcgtgcaagtcagtgcaatgcctgatgcaaatataatttagaacgacagaactcaaaaaagtatttaaagtggcaatgcatcaacacataaaagctatgaacaaaaggcgagagcaatataaaatatagtacctgaagcttcgcaaaatctttgttcaaatcaatgcccctcccaagaatttgtcctcctaattcagcctacaaaggataacaacagttgcaacattaattgcattaacaagctcatataagttaattttaaataggcaattagcaaatatccaatttagtttagtttctaaacacttgccagtataatacaggaatatttgtcataagctaaaaaaaactaggtagcaaccagccggctccctctggcaagtagtaaccagctagttcccttcttcaaacaaaaacccaataccagacaggtgagaactggtctgctccagaactgcaacacccgggtacactgtggtataagccagaaggcccacaactatgctaggagaattctagaacgatgcgactatgcaagttaattaacctggaaatggtattctccatttaatgctgagccagaatcccgtacttgatcgcgaaatactacatgttggtcctccaagcactagaaatagcaattgcaaattacaattcaattaagcaaagttaagaaaagaaataacacattaataaggacactaaaatggaatataagtgcagcagcagcatctcttacaagttctctaataagacttataacagaggacaacctatccaaagcttttgaatgatcctgttcttttaatgtacttccagatggctcttccatagaaatatcctctgagagagtaatatcttcgagaaagccatttccactcccaggaggcttgttcacatctttattaagaactccagcaacaggagccatgaatgacaagtaattgcctgcaagtcagccagataacaggatttaaggcacatggaatttctcatcagtgaatgctttagaaaaagaatgacacctgtaaacacggaattgtaaaacaaacgtaacttttcaagcttgcaataatcaagatgtaaaggattatactcactttccaaattctggagagctttttcagcagctagtacttgggcttcatctcttgtttttccaatgccgatcccgattttttcattactaaatagaacctggaacatcatatgtataggtaacatgaggatcacatgattaagtagagatatcacagcattgctatacaaatctggtaatgcacccgcaagcaaacagcttcagagcaaaagcactggactgatgctgaagttgagagttgagacgccaaaggaaatgtgtctcaacattctaaatatatatttttctcaattagaatttcagcccaagctgttgccaagaccacatggaaacgaagtataatatgtaaaaattcaaaatgccaacctcaacagaaaattgcatgttttttccactgcttacagtagacctgaactccacctaatgaagaaagaacaggagattactctcagctcataagggcaatggcagaaaacaaatataatcttaaagatccaaataccctggattcgcacagccgtccaatttcttgcaacaccgtgacaaataatgagggggttgttgccaatgatcccccgttagattggatatttgtaccacctggaatgccacggagtgccactccgtcgtcatctacaaagattggtttatgttactcgaagcatcaaattacagatccaaaacaatatatgaattgtacttctttaataatagtgaggtacaattaggattttcaagcataatgttgatgctgctgcatttcatagtagagtactctttcctttacagggaaaaaatggtacagagaaaaccattccctcttttaatgtccgcaaggtaataataaaaaatgactaaagtgatttataaatgcaagggttcaagaaagcccaggaagaagaaccaaaagaaagccaataaagataatggacatgaggtaagtacctgacaaacgggttgatgatggtatttgtttctggtctctaggatatgcctgaaataaggaacacactagcatgatcattatatactagtctattacaaactgataaagaaactagtgatgattttgctagctaagtgatagaactgtggacttaattttgatacaaggacaaatccaattgtaagccaaagaaggatcaatttgatacacctacatttcttctaaaatgaaataacacaaagtagatggttataaataattgaaatcaagctacatgacagcatttatattatgctgtataacagcgcttaccatagaaataggcatcattagctgatttgatctaggtgaaaaaaaaaatcaagtccctaaaaatcaaagcaaagcagaaacgaagatcagcactcaccagcccattcaacctcttccctacttcagctccactcataccctcaggtataggggcaacatccttattgtttggtgcaaaattagtgtcctggaacaaaattagcagttggataaccatttagaaaataaacacacacaaaataacaacgattcaataatgttacctcacagactaagtagtcaccaacatcaggagcatatggaagatctagcaactcattttcatacattagttcaaacacttttctcaatagattttcatcgaactctctgcaatgcattgatgaacgcaaagaataacattacaacagtaagcatgatatcatcagaatgcacatacggtatcttatattttttaccaacctgaagaaaccaccacgaacattgcaagcaacatttcttgcaacacaaagcacaggcacagcatttgccatctaaaatatgcaaacagggtccagaatgagatattgttgaccaaaaaaagtgtaagcaataaaatacaaataaatacctcagcttgtggggcataatatggagtatatgctgggacaacatgaactcgaggttgatccttctcatcccaaacctgcagtcggtcatcaattaccatggccatcttcggatggcatcctttgtctttaaaaacattctgcagacactttttcgaacctgccatgaaatagaataatgaataatattggtggttatgtccatgaaattatggcaggaacatagtccagagctgagacaatagagatagtaaagcgaagatctatgttatgtattatccatataatgggcaatggcaaagcgcaatttctcattcacttaagcattctacacaaatattatattgtttaaactaagaataagttttatacaaatttaaacaatatttagtactacttatgcactatatttgaagttgtaaggataagaatgaaatacaatactaagggaatgaacgatacatgctagaaaaactatgggttttctctctgggacactaatctgcaataccgaacccattccttctcaataacttggaaacacaacataatttcattgtacatgaaaagatagataacacagaatattcgtgttcagtgttttaaagtagctactctgtgtttagtaacgatgtcaatataacaaaacatgttgagacaagaaagcaatgaaagatagcagaaaaaaaagaacctccaatttcttgaaaatttacctgactttacacatactacacgctctgcaaggttatgagagcttatcaagttggcttctggatcaagaagcctccacatctcaagagcataatctctctcagccattgtacatacatagacctcaaatcgtttgcgtcccttagcagtcaggtaacttctcaaatcctcccaagcaggccttagctttacaaaaacactagtatcgcgaacctgagcagagtattaaaatcagacaggggataaggtaatcacctcaaaaaagggaactaattacagaattctacaataattaaaaactctagttatctcaaaattttgaataactagacatatgagaattatactgagcccattttcagtccagaatgacttaatcagcttgattaatcgtctcagataagcattacaaaaataattactaaaatagaatctcttttttctaattggcagcaaacatatgagctgataataacacattgtgtgtaggttgtcaaactttgtgttaaatgttatttcatcatttcccaaaccatcaggctacaagttcatttctgcatctgttttattcataaacacacatgtacaaagcaaattatgtaactatgcagatcatacagacctgtaggtagaaacaatgagcctgaccaaatatgtcttatccgaggatcaaaactgcagcaattacaagtcatttatagaacttatttttgtaccatcgctaataacccaataaacctacagcatgccttttgtgggcagcaaattggaacccaattccatttttccaacccaagaataagtcccactgaattcaaagtggaattctagataaccccaggccaaaaacatgcacacaggcaaacgataacaacatttcatttaaatgaaatatatttatacatgatctatctgaattgtacctctggatttatgcgagttagaatcgcattcctttctggcagcctgataacaggccggagaacacgctcctgcccaccagagataggcagaacttcctccttttgggtcccaacgattctgccattatctgtaactgtatctgtgtcaatgaactccttgagcagctccctgtcctcaatataccgcttgatttctgcagacatccctgctatcctgacggggtcgtcttcaatatccatcctacgggaaagcatctcgatccggtcctcaaaggacttcattgtgttagcgacaataagggtttcatcgagatcaaatacgatagcaaggcaccgcaagttcagcatcccaacagatgctgcatagatcccagagcgtactgaacagcaccaaaagcatggcaccttctccaccttgctcggcattgccactaggtgtagctcctcatctccaactactaccactgcgctctacacaaacccaaggagacaaaaaattttataaatcctattatttcgtgcccctgatggaaatatcatcaatgggaaacatcatccgaacgaatcaaaccacatcaaacacacaacccatcgaagatccataatagaatgtgtaaaacgctttgattactggtgattgccccaaaatttagaagtggcgctaataccatttcccaagtagtcgctgtaaacaacttatttcgcttcgatttcgaatgggagtaccagctatactaatacaaagcgatggacatgagcgattgttgagaaattgcgtgggggcaaaccttgtactcgttgaagcaagtgaggtagaggcggtgtaggctcgggtggggaggcatcagcttggcctggagcttgcatcgcacggagaagggcgcgatggtctgcaggatggcgagcggcgggcaccgctcgctcgtcggcgagaggtggctgatgcggatctcgttgctcgggaacggcaggctcccctcggccccctgcttcatcgggaacacctccgcctcgccgaggaacacgtcgccgtggaacatccgcatggtgaccccaccggcggtggcaccggcccctcctccggggacggccgcctggggcggggcgcggggcgtcgccatcgcgggcgagagggaggaattggagagagagagaaggggggagagtgagagcgcgcgcggcgtggcgtgcgc

SEQ ID NO: 51988 - DNA, 16576 bp, Oryza sativa
  unsure (1)..(16576): unsure at all n locations
aatcttttatattttaggatgggtatagtatcgtattgaagttgatcattgcaaaactgacatatggatctcactttttctagggtccatgcctgactcctacagtcctacgcaggagttgcatccggcgtggtttgcaccgggagactagtttttgttttctgcatattggggaatctccttttctgttgaattgtactactgcggaccagcttagaaccgtgtgggaaaataggaaatgcttgtggaacaatcaggttggattggatttatgggtggattgggatcaaggataaatactctgtgaataaattttggacaaaaaaattggtatcagcattagtaataaacaaccaagcatgtatgttaaacaactttccgttggctgcttcaactgatatgtacaaactactagtagcattcagtgggagtaagtatgtatgcatatatatatatatatagttcactcttatcatatttcataagatttctcatgagctgtaatcaggcatggggtactgatgattatatcttcgtaccccaacttctataaaaaaaaattacggttacatagacaactagacaagcacaacccgtgaacacattagtacttattcactcacctgaactggacaccctctacctcttttacatgatttatgtgctagtactacagagaccgcaacaatggtaccagcatttatcatgccatcgatcctgccattgatcataatggagcaatacaaggacatgatatgcttaaagtgtgaagaagatgcaaaggacaatgaataaacaagaattatagagttgtatgcactctagggttcaaaatctcggcgaaatttgagcatctagagccggctcaaaatgcgcatctcgaatggttttattcaaagtttattggagttcattgaaattttgctaaaattcgttcaaaattaacgaaaaatcacttgtagttggcattagattatttttatttttatagtttgtataaccggtgaataaatggtctccagtactaatcaaatattatgatcagaaagtgtagtgaaaaaagaagatgcaggaatatgtgagaaaaaggaactgaaaccaaataagttggccaatctcatgttacttggccgttaatactagtactactccgtcgagtacacaatgaatgattcactgctatctagtttgtggttctaataaatcgaatacattatactcttcatatgttccttgtataaacctgtttgtttgtggttctgtgaatcaaatgccatatacatgacattcgtgtttgtgctcctcatcttgcaatttcatagcaacatttttctactcagtatgcctagttgtcatggtgttttcacttgctgaattgcttttctacatatttttggctcttcttgtactgtatgttcagacttgcctttaacatggataattgaagtattgaactaacatgaaaaatgtgatgtcctatgcttcttgatcaacattcctgcagagaaccaagtcataagcattgactgatatttacctgccaactatcactgagcattttcagacacatacctttcatgcttcaacttttgtatgtttgtgctacaattttcttacaccaaatcgcctgtctctgctctggaaggagcaaagcgcttcgaggtaatcagcctccccgaaatcaggccacagcgtgttggtgaagaagagctccgagtacgctgactgccacagcaagaagttgctcagcctcagctcgccgctggtcctgatgagaaggtcggggtacgggaactcgtcggccgcgcagctcgtctcgagctcgtcggcgaacagcgcctcgtcgatgtcctccgccgcgagcgccttgctctgcaccttctgggcaagcttccggcacgcctgcacgatgtccctcctcccgctgtagctgattgccagtgtcagatcaagctgtgaattgttcctcgtggtctcctcggcttctctcgcaatcttctgtagagaaaccggtagccttgagctgtcaccgattacacgtagccgaattccttccctgtggaaaaaaaaaatcctcattttgttgtccacatcaccacatgacatgtacacattagactttggcaggaaattatactggctcctgtgaaaattgaatctttttcctatgaatcttgcaagaaattcctattacaagctggtaattgagttgctggtacgcccggagcactgtgggctttgagcatctattggcgaacttccagttccacaaagccaagtgttgtgaacgcgtgaggcattaactaattatttaatttgcaagtacggatgtttacctcagaaactcggcgacgctatcgtggatcacccgctcgaacagcctcatcaagaagtccacctccacctgcgaattccaacatggcgaggacgcgtcaagctcggcgaaggcagagatttcgaaggaatcggcggcgaggcgtgtgtaccttggggcggctccagttctcgttggagaaggcgaaggcagtgagcgcgcggatgccccaggcgcgggagagacgcaccgtctcctccagcgcgcgccgcccggcctcgtgcccggccgccgacgggagcccccgcgcccgcgcccaccgcgcgttcccgtccatcaccaccgccacgtgccggggcagcgactccgcccgaaggcatccagggaggagagactcggccgccggggctgcgccggcgcgcgggcatgggcatggtggtggcggcgcggggcgcgtgctgcggcgaggggaggtgggtagctgatgggtagcagctggagagtgggagggcagcatggtgttggcggcttggcgcattgcccccaaactccgacaaaaggatgaaaagctctgcatttattaaccttttagaattgtttttttcttttttttatgatgttgtgatttcctggggaattctaaacaaattgcaagaaattgatttacaagaatactacgggacgatatctcgttcgaacggtatcgtgaccttagggtacggacaaatttggggatagacggggaagtatagtttcccgcctatcctgagagtgagctcaaaagcaaagtgagtgaaaagtatttttctctattgaacttgtccctgcttacaggatctaggtcggcttaaatgactctcaaccatacacttgagattacaagtttgcccctgagggcctacatattatcatactacccttataaagtttacaatcctaagagcattttactatattttagtggtcttcaagtaacatccagtgagagtagttggagtgatccctgttaccttcttgagacatgttcttttgtagttggagtgatccccagttaccttcttgagacatgttcttttgtagttggagtgatcccctgttaccttcttgagacatgttcttttgctcaatgatactttcccttgacttcaatcatccgggtagagtaatgtctctctcgtgagggcttgaatacatttttcccatcttctggcttctcacctgctaagtgaagagaattgtccaaacacgttgtgttgttagtaatataccccatcagtccaaaaatataacaacctttaacactcagtatttgttccaaaatataacattttttttcaccaacattctcttcccaacaattcacaaccctccatcgttcacttttcctaactacctccacttcttaaccaatcacaacctttccctatttaattctaaagaaaacccctgtgtacccctgaaagttcacctaatcccttctataccctgaattttgctcaatcccttacatacccctaaattttagtatggatcccttccatgccctttccgctagttgaccgttaaattcttatgaaaaagtccattttgccatttggtataaagaagtatataaattaatagagtatattgttggagcatagaaatttattatatgagactattatgtttatgagatagttatgcaccatattatttgcgataaatatacttttagatatgacataaaaaattaatacttatttatttttttagcatatgtgttctgatagtaataaacaaatctgttgtattactatgaaaacacatgctacataaaagaacttttaataactaataaataagtattaaatttttatatcatatgtaaaagtaaatttgtcacaaataatatggtgcatcacagactcataaatataatagtctcatccaataaatttttacattccaacaatatacttcattaatttattatgtttcttcgtagcaaagggcaaaatggactttttttcaaaagaatttaacggttaactaacggtcagctagcggaaaaggcatggaagggatccaaactaaaattcagaggtatgtaagggattgagcaaaattcagggatatagaatggattaggtaaactttcatagatacataanggattttctcttaattctatctactttcttaataactgtgtctaactctaaaacttcttatattctgacatggagggaatactgatttgagcaagtgaaactactcaaacgcactttccttggaataaacatttcttgggcaaatgcaaatgatcgatcaagggttgttacaggtcaaaactcattcagcagattgcatggctcaaatacgatttccttattgtgtgtgtttttgccgaacatagggatggcgttcaccccctactacaacaaatgggatgatactagttaggtataaggtcctgatatccctaaggtattagataatacttgaaatctgataactataaggtattatacctgatacccaaccggtttcatcccgttcgacgggatttcgtcgtacaacaacccctttatattcctttgtgaaggtgtcaataaaactgaaaccattgacacgtaggcctttttcctcttttcaagaaggaaagctctgtagtttaataaaaattgaaaagagtaaattgtattggtggtacacaaacttattaggtgggtgcaatttagtacgtaaacttgtaaaatgcttatttcagtacacgaacttgtctagttcgtgcgaacgaggaccaaaataacttagcaatgttaatttatgatgttcattaggatgtgacgtgcatacgtatagtgagtatgcataagacacgtaatatttataaatttcgtcttaactttatccttcagaatggaaataacgaatctcatatgtttctaacccttatattagtgctaagttttttaatctttctgatttttattgaatagatatgtctaatggcaaccttcttagatatatgtttacatagtatcctaatcaacccctaaattaataagattaaccatgtagtgtacttttcggttttctccgcacgcacctagacaaattcatgcaccaaaatgagcattttacaagttcgtgcactagattgcacccatctgacaagttcgtgtaccggcgatgcaatttactcaattgaaaaccattgacgtatataaacgctgaatagtgtatatcctgcattcttgctctgaacgttgccttggctttttgctccatttctgagaatacggacgggcagttaaaggggcgttcctagtatgtgcgtacgccgacgcggtagcctaactaactctgttagttaaggataatgatggtaattaacaatagattttttattttattaggagattctttttcctaatagattgaaaaattttaagttacatttgaaaacttttgacttaagatttaaactttaaactcaaattttgaaaactttcaactcgaactttgaaagttttcaatttgcaagaaaattttttaaaactttcaactcgagatttgaaaacttttaactcaaatttaaaaactttcaactcgagatttgaaaactttcagctcaaaatttgaaaactttcaactcgtatttgaaaactttcaactcgaatttgaaaactttcaactcgagatttgaaattttttaaattaagatttaaaaatttttaagtcaagatttaaaaactttttaaaaaataaaaacacttgctgctagaagattaaaaagtaatcaggaaaaaaagaaaaaaaaaggaaagcgaaaaaaatcagggaagaaaaaaaagtggaaaaaaaaaagagaaaacagcggtggttagatttcgcgggcgcacgccgagtgggccgtatggaaaaaaaaagagaaaacagccgggagtgcgcgctgccggcgcgcgcgaattaggtttctcgcagttaaagcacgtactgtgtgtgtatcgctagacagatgcagaacggctgaagagcagtctgtctcatgccaatgtgcaaacctgcacatatggtcgcacgcataatgaaacgcaaactgcgcatgtggttgcttactgagaaaccagaaacgggagaatactgtgaatacctatagctgatcgaatattctgccctccccacgggccaccggacaaaagaaaaccccgctgaaactgtatttagtcaaagtaaaagtcacgcatggcacgcctgataaatcatgaagttgttaggacatgcttttcaaacttttgcaaacctgattacaggggatcaaccaatacaagaaataaacaaagtcaaacaatcaattatcagccatactgataggagacgaagaactgcaagtctacaacagctgacccacatcacaagaaaatacaaaatgagaggggctccagtagaattcgtcagaaatgttagattgctaagaggagctaatggcctttaatttgatatttgtgtcatctgtcaccggcatgctaggagtacaagtttgttatgtgcatcagactgtacagagaaattcgtgagaccttatcttcctaataaagaggactcatacattgtcaacctgtccctgcaagttactagaagatgtcaatgttttaaatgtgactaccctgattttccatacttccatgtgcaagccttccatactaactactcgagaagctgtcgcatgtgtctgtttgggaaccaatagtgaacgggtggactaaattccatacacgattgacaactccatctgacataaaggaaaacgcatcttttgcggctctttgacatgcttccagagctctagaatcaccaagcagttgttttagtgcttccaaaagttcatattctcctttgacctgaaaaacatttgcattaatcctcatagaatgaaaggggctgtagctccttgcgatgtttaggtgtaaaaaaaaaaagaatcacccatgcagtaaagcagcatacccacattgcaagcataatttattgaaagagcaagtagaaggcaattcatcctgttaccgtccaaactaatttccagaagtagggacaaggccaagtcaataattaacaaaatacctcccctaagaaggccacgaaatagtagtaatcccactcttaatcgaacatagtgcacaaatgatgcggcattttttgtgtcagttagataaataacaaagtacaagacagattatcacctgcttgacagctaaaggatttatttgccacatttcgaccagcatatgatagaagtgcccaacactaggacctgaaagacaattaatgaaactctagacattccgattttgtagaaaaagtcattcaaaatagtcagatgtgtcttgcactcttgcgtaccagtcataacagcgcaaccaactgcagcagcctcagaaatattatgtccagctaagccgggcaaaaaagaacccccaataacagctattggagtaaccctgtagagcattcttaattcacctattttccatggtatttcattcattaactaacattcaaaagaatatacacagtccatactccatactgaaaaaatgtgcaaacttaaggcataagagatagcacaaacctaacgtatcaaccacatatatactggtgtttgaagacaccacttctcttgttgacctcagcacaaaattcactttctgtttcttcagggtctaaaagaagatgagtaaagaactaaagatgtggcccatacatattatactatcagcattgaagtgagaatcatatgctacatgctctagaaccataagaaatttcaagtaatcgtatacaaacagttataagcaattaatttcaagcttcatacagtgaactaagttagttccctttttttcattacaacaatgctacacctatagattacccaatatgataatgtattaaaaaaaactaaaagataagcagtacaacccaccaactacttcatcaactaaacaggaccagatataaaagggtaaggaagacaattgacatacttgagaaacattcttgctgtcctcaggatgccttgggacgagaattaaaagtagagtaggatacgccctggttaactcatcatgaacacggagaatgactgaaaaagagaggaagcttgtcaacattgtttttatgttgagaacataagcatagtaaggcaaggattcaattattcaggaaagcataaagaagtcagcaatgactttagggatatcaatggtgatcatcaccataggcaaaacagctacatatatacagttttagtcctgcacacagttccttggaagagcagataatactgatccaataaaaagaaaaggtgggtgtctgaggtgcttactttcatcttcccctttgtggatagaagctgccatccagatgggcctattgctgaactgctgctgaagatcttctattgcagctacctctttctccccagcagcaatgtcaccaacagctaggtaaatcacatgaatctctataaattattgagtttgtgaacctggttatctttcaagctcccaagataatccttgagaaatgcatcactcatatgtttatttcaaacatactctcatgaacataggaagccagagaaaaattggcatggcgcataccgtattttaaatcgccagcaaaatggatgatctgtggtggtgcatgaagtaattgaaaacgaacagcttgaatagtactctggaacagatagaaatgaatacaatggcaataattttacatcaaaataaggtttagaaccccaccactccataccaatgggataacaagtgatagtttggagagcatcaaagagactaactgcaaccctagaggcaaggaccaacggttgaaagacttcaatgacatgcgcgcatttaaaagaaccactgcaatctgaaaaataggaaggtcattcacagcagataattaaatagtgaaagaatgtactatggaccgaaaatatagctaatctgccattgcacatggaaaaaacaagggtaacaaagggaagcctaaccacttagtagaaaatagtcattatgagaaaaaaaaaacttacccctttctctgctgcagacaaaatgaggtttggccagagttcactttccataagaagtatcaaatttggtttccagtatccaatgaaactttctattgcatcaggacagtcaaggggtgcaaactacacacatatgtatttcagttatgtaaaacaacaataagctaccgtagatgtatatagggcatatcaaacatttaaactatccttctgttagcctattcgtgattcccttcatctaaacaagttccatctgttcccaaaactttgcttgatctgtgtctgtactatcgaatattaccaccttaaaggtttaatattacgaaaccttactatcatagttcaacgagtataatatgaccttagtttaagggatacatataatgaacagacaatatctatctgccttgacacagttcgaacctaaaatgtccttttttttcaagaacagtccatcagtaaaaatttgttgtgcatacgccatttctcagaaaactaaaccggccgtcacgacagggatctgaaagtacaagagcaatttccgagctcacctgatatatgacaccatccgggagcaagtctttcatcacttcgctgcattgaaatcaaaacaaccgaaatagaatatggccacattacacggaaatgagagagccaggcaactcgtatttgcggtaatgggggaagcttacaaggatgagagggtagtagtggtgaggaggatggggagaccagggtggaggcgggcgcagtggcgtacgaccgggagcgcggccatcccctcgccgagggatacggcgtggaaccacacgagcggcgagcccggacgaggccgcgccaccgacggcctgcccagccgctcgggccaacgcgacgggtgctccagtcctcgtagccgccgccatagaagcgccgccggcgccgccgcgcggctcgccgccctgtacagctcgtacagcgcccggccgccgcgcgccgccgacgccggcgtgcgggccgtccgcatcgagcctggcccgtccaacgactcacggcctgggtcgctttgggcttttgttagcggcgcgtgaggtcgcgtgctttcagtaccgagcccaacttacctctcgtttatacgccttcgatataagaaagcgtctccggtgttgagtctctccgtattcatagacagaacacacatttctgagcgaaactcaggctatatttctgcctcgattgatttatgcttatgcatataagataaaaattaaagtttaaaactcaattttggcgttgattttgttattttctcgttgtagtttattttacagtatttttttttaaatcactaaagacatgctataaattatttttagttgctaataaatgattaataaatataatataaacataagtgggaagatgacttcttttaaaaaaaagaaaaataaaaggaaaaaaaatcttcttcctgcattgatgttcctttgtcaagagttaaagcataataacatcacacgttcgcgaacagtttatagctattggcgtccagaatgatctgccggaccgcggcgactgacgcgacgacagcgagcgcggagaacacgacggcgatggtggtgttgagccagaacacggcgcccttcttggacggcttgaacgtcacgttgtagaacaccgccggcacagcgaagtcgagcgggaggaagccgaatgcgccgatgagcgcgttcatgtcgccgaagaagggcaccatggccgcgatggtggtgcccagcgcgacggcggcggtgcgggagagcacccgcggcgcgacgttcctcgcggcgtactgcccggccttggggtcggacaggaggccctccaggacctcgttggtcggctgcaggtacaccacggccaccgccgacagctgcagcagcgtgaagagctcgatgatgagcagcagccactccgggatgacggccctgccgcccaccatgaagttgctcaggagcgtgccctgcgactggttgccgaacgcccagtaccccgagatggccacgctgaagaacgtcgtcaccaccacggcgtagcacaggcacagccccttgaacatcttccccgtcaccggcgccgccaccgtcgcctgtatctcggggatgattccattgccgtacgtcgtggcgatgacggcgatggcgttgaacacgccgaacacgcggtcacgggtgttggcgccggcgatcgagtagtccttctcgggcgctccctttgagcttcctgcacaaaattcgtcagtccaattttaatccgtcgcgtcgacaggccaaattaaagcccaatagctaatctaaataatgggccgggtcgccgggaaacctaccaaggtagatgcaggcggcgacggcgcagaagctgtaggcgaggcacagcacgagggagatgaggttaacgtggcggagagagtggaacgacggcatctgcgccaggatcatcatgaagacgccgaagattgccacgaacacgtacagcttgatcgtgccgcccgggttggcaatcaggtagatagcctgcaacgcgatcgagtaagaaatgtggattcataccatgtgcaattgatgaacgcgatccgatccgatccgacacgaaatcagttcgtggactaagttctgatgaagataccttcatgctctgaccggctaggagagtgcacgcgacgactgccccgaagcagaccaggaactggatcggcccgatgtagaagcgtccccatccaggccctgcatgcatcaccgtggaaaaattaaccatgaatctcatctcagtgacagtgattttgtcgcggtgatgaagatgaatatccctttcgaaacattttttgtcagatgcgtgtgtaattaaactgtatgaatctgctgccagatggcactaaggacgattcctttttcccaacacgtacgttaaacctgtgcttatctgtccaatgtcgtatcagctaggatgctagtatatgactgattctactacacctggtacagtgctactccctccgtcccaatatataagaatctagaaccgatgggacattttctactactgtcctgtccagattcgtagtactaggaaatgtccaatccagttctaggttgttacatattgggacggagggtccagttctaggttgttacatattgggacggagggagtatttaagattgacatattgacaagaaacggcgcgcggtgctggtttttttccttcgcaagcagtatcaatcgatttagacaggcaatcaagtggaaagctggaatattaaattccacagcaaatacttgccgacaaattcgtcaaactcgaccaattgcatgatctgtagtactaatgtgggaatactatccctttcgaccaatcaagtttttctctatatatccgccaagcgctaactggagttttaattagtattatctaaccagtggggattctttccctcgtcgactcttgacagtgacaaaatacgagccctagcagctggacttttctaacctgtactgtaccgtgttacgattttattgaatgctgcttagtcagttactgaaatcaagcaacatgtcggcttcagacgctgcactcactccggttgaagagtttaccggtccgatatagtatggccatacccattgctcatgaatgctgcagacacgtacatgtcgcaaactcgcaaatgcgaaatgggacttgatttggccaaataatacagctgacttgttccgcacaagaaaagggggcgggcagctgactttcttgtgaataaaacaggacatcaatgatcagtcgctaaacctgtcacgtctacaagttggtgttccttcctcccttcctttcttttctgaaagaacactgcacttggcgtttctgcccctatattcaaggtgacgacataggtgttgatgtattgactcatcctcatgtctcgtttgaacgcaagaatatcacaaactatgtaaatgcttcgaaagaaatggtccattacagaaaaataaatcccgtgttataatcagaggttgttttctccaaattctcaattcgggcctttaggagccagggctaagtgaagacatgggcgagagaatcttacctgcctcgtgatggatactagtacccactactgacttgtacagttgtactgtattcgtttttttgggtgaaggctgaatgccacgtccgtccattgtgaacgcccttactattgtattgtaatgcttttggtattgcacgtagtatgagtttgcgagacagttgtcagccaatgcaattttatatgcagattctcctccatctaccaattagcttggagttgctacgtgccttccttttaatcacttatgtactcgagtttaatgagtatattagcatcaacctactacattatttccattttaatgggaacctaactagtaaatagtaatagggtgtgttcagtacctattcttgctatagcggttacggctgtagcagtactaaaaatggctgtagtttacagcagcgtttaggctgtgtttagttcagtgtaaagtttagattttggttgaaattgaaaatgatgtggctgaaaagttgtgtgtgtatgacaggttgatgtgatggagaaggactgaagtttggattcaaactttgaatctaaacacagtcttaattgtggctgaagcaacaatccctgtcgatcaatctcattgtttaactgtaattacggatagataggtatacgagtgattactgacctaaaatatcggtggccatgtccctgaagcggagctggcggcgtccttgctgcgcgtggtgctcgaggacgagggagatgaggttgtacgagtagaaggtcacggcggcgccgatgacgaggcagatgagccccgccgcccaccccagcgacgcgaacgcgaacggcaggctcagcagcggtggcgccacgatggacgtcgtcaggtggtacccgcagtgcagccatgaccctgcgcatttatacagcagcagcatgatcagtttttttctgttaaactagctaaaggtactgtgcattgcggcgaatatcataagagataaatataaaaataaaaattacaaacctactaacgtagttagttaattaggcatattatgtcatatcaagtgcaaaaatactcacatttgaggatcttatggtctaatatgttaacttatggtgatggggaaaactcagacaccctcactaatatcattcaaagtagtatatcatagatatagaaaaagaataacattactcctgctagtagttagctaatctgttaatcctactggtattttttctgtttgtattagtcgctggatgatgataagctgattgggagaggcttccgcagctccactcggtcaaaagttgtaggagatgaaggattggcaaaagaaagttcacaggttagctaaacgcttggaagttggaatatggcgagtaaacacgtttctatcagtcgtttcaaaaaaaaaaaacacgttgccatcggaagaaaccccatccctccatcaaacattgatcaatcctgcacaatgcccatacctactttccaaagctgtatgtcttacacatgtagtactcctcagtcactaaacttgctttgacaatcgaaagataaaaataaaagaaattttgcagtcattaaaaaaaagtacatcgagatacctaaattttacattaaaatttttggtacttctagatacatttttaaggatggtaaaattatcctaaaataaagttgttgatactagtatgtttcaggggtcagcaaatcaacagggaactatgaggcattgggggcagtgagcaatttgattttgttaagcctgcagtctcacacctaattcgattttcctttttccaaaatagaccaaatatgatttgattagtacattactcctaccatattcctcactccattccaaaataatcactacgatgagtttccgtgtacaattttaattgtccgtcttatttatttttttaaaaaaaaataaaaaaaatataagtcacgcacaaagtactattcatattttataagctaatagcaataaaaatactaattaaatttttttaataagacagacgattaaaattaaaaaaaaacttataactgcgcttattttgaaacggagagagttctagctaaccaacctcccgatgccatttataatttcctcgagtcaagagtatctgcgctagtgcgcatgataatcaacgagatggtgacctgtaccagttctcctatacgatacagacatcacgctaaagactgaacgattcatgcctaatttatttttttggaataaaaataacaatacatcgttattatacttttatagttcacttaggtccatatattaatatattttctgtctgcttcaacaagaccaaatagacgtgtaaccatttcatggagcccgaaaggttgactaatacgagtactgtatcgtgatatgggggatcggctgagctagcagcctagcagaacaataatatgaattgcccatgtttacaactttacatgcattgctattgataataggcttgatagccagggagcccatcatccctgaagtacattttctcttgtctcttctctgaatgttgaaaaagaatagatgtaggcgtgcaggcaacggatgtaggggaacggaaaaaagcgagcaaagaaagaagagagtttttgttactacatccaatcttcatagggtaaaactgtgaaaaagtagtgcaaaaggatagatgggcagggaccattcaaacatctacatctgtccaagaacttttaatcagagttcaggagacgcacccagtcattcaagtagaacagtaacgcagtacccctcacaatggctgccgggtacatgcgctgaggaaaattaaccgaaacaatttgtaaaccatcatttttttcccgttatcttggtagtttgtacagtttttgggtacgattattaacatgagccaaatcatttacatacggatcatatcaatcgggatggcatagccaaatcctgcacaacaacacttcatcaaaccatcttgatatagcagccagaacaatctattaactcgtacatgttagttggctagttgctactgattagttagccagctcttttgcttattaatagctggggacaatccatcaacagtcta

SEQ ID NO: 51989 - DNA, 3477 bp, Oryza sativa
cgattcggtcgctagctcttttgtcttgcaggtaaaaccaagggagcgccaaactacgggttgatggcctgaaactcttgggggactcggacgatacgatctacagttctacacggccgtacgttgtttgtctctgcctctgcgcggtgtttctcagcaggtgagcgggctctggttttgccttttgcgcttctactgctgaagctgaactgcgtactccatatatagagaagaagaagcaagcgcgctcgcggaccgggtggacaccgtatgacgcgcgggcgaaagggacagtgcggcctgtgcgcacgcggcacgtcgcgcgtgccacggcgggagaatctcccgcgcgctcgctcccgcgaccaggccgggcagtcggcagagaatcgctaatacgttaagatcacgaaaaaagtcatactttggaaaccaaaaataaaaagaaaatccgtcgagaacccaaacgaggaaaatttttattgtacattgtaatgcaagtatgagaaagtccatctagtactactaggattttaagccaaaggccgtccagtatcgtaaacataaaaaattgtcaacggactcaaaacttcacaattttattcgtgtacaacctttttgacaggcatggatcctctgcattacggcaacagagaagagctagtgctacacacactaatttgtgcctgctacattctttggtagccttggcttcgcccactggccactaccctctccttgccaatgtcacgtggccaccgaaaaatagaaaacatgtcagggaggggataagtacatactccgtggctccgtcccacagtgtaggaacctctaagacctattctagaactacaaatatggacatgagttttatcataggttgctatattgtgggacagaggaagtactacatatttaggtatgcataatgcatgtactagtagatcctattgtgtatgtgtaagttgtagtgctaaaaaaccttggatttttttatggtataaacaaagccattgtaaatctcattttgcattagcataaatgctactccctccgtttcaggttataatatgttttgactttgatcaaaatcaaactacttcaaatttgactaaatttatagacaaatatagtaatatttataatactaaattagttttattaaattaataattaaatatatttttataataaatttattttgggtcgaaaatattactattttttctataaacttgtttaaatttgaagcagtttgactttgaccaaagtcaaaacatcttataacctgaaacggagggagtaatatttgtctttcctagccatgttgaagaccggcagtttaggccggttagctgtatatagcataggtgcagcagagctgcgagctataagaggctgttcaattggtggagcattgcggtggtgacgataagtgcgaagagggtgttgtaggcgaaaacctagcctgaggtttctctgagccatcaacgccgatgcctacggacattattatcctctcttagagcattgttaagccatcatcgacacctttccactcattaacatcattcttcatgtcaaaacccagtccgaatggatgggcggtggtggcgtctaagatgtcatgatctctttggtggtgttgtttgggaagtttttttcctcgctttaccgtcttttcttagctttttcttggcaaatttttggttgacgtcatctggttaatgtgagggacgagcggatcttcttctctctcgccctcttcctcaaccactctacatgaggatgattaggaactcatcgatgatttgtctgagtaggatcttgcaggtctagcagcgatcggtcaaacttagcggcggtcggtttgttcctagtgtcttctccttagttgtgtagggagctgttagcacgtggtggttgtgttttgtttttttttcattggtcacaattttttcgtcatgtaactttgtaatttttctatgccatatcataagaaatttcacgttgtcttgtgcgggatcgttaaaaaaaaatcctcgtggctgctaggagtcacttattatcatcgaaaggcggttgatgtcaattatcgttttctaatcatgaaaatgacgttgtttccctatttaatgttacaaaatttaaaataaaatacaaaaaataaattcagttaattaaacttttgattttgattacattattttttgtttacactgtgaacagtactttatatttcatattgctttcagtttataattttcaaaataatttcaacgttttgaattgcaacagattctcacagtaaaagatggcattaaaatatactccagttttctttgtttcgattacaaactccaaatatactttctacacgattatttactttgaactatcggttccatgtataacgatcatagtattttgattaatagtctgcatacatttagaagacaatatacataattaacttagaaaaagtaaatagatttatttataatacgacacaactatatccctttgaaaataaatcaacaaaaattagttgctgaattttgccatatctctatctctgcaaagatgctcatccaataagccagatcgaactgttcctagcctctcatctcatcgtctgtttgttggtttgtttcaatcgcaaccaaatttgagttccgaagttaattttagagttgatcttttttctttcgtaagtttatttaaactgctaaaaataccgttatttttttttaaaaaataacatttttagttcatttattcgtttacgacttagccgaaactcaactaatcaaaggataacatacaaaacggttaaaaaaattccttcggattatcgtgtggtttgcaaggtgtcgaagtcgacggatcgagcggcgagaccgcgagatggacacggattaaatggtgcgcgcatgtagcgcggccgagaggcttgcacgagtccgtggcccatgaggccttgacgtacgagtggcttatatgctcgccaacttggccaccatatatagcacagaagtgctcgtagagctcagagtactcgttttccttaccgactgatgcacctaactaatccgccgattggtgtctcgttctcatctctactagtgctgtgaccgtgcacgtcggtcgtcggagggcgggcgccttcatatcgatcgtgatcctgacgggacgtcattcccgggggtcagtactgttcgttttcagaggagcaacagagtacttcctccatcccataaaaaataatctaatagtatgaaatatgacacacagagcctgcttaggccttgtttagttcgcgaaaaaaaaaatttaggtatcacatcggacgttcgaccggatgtcggaaggggtttttgacacgaataaaaaaactaatttcataactcatctggaaaccgcgagacgaatttattaagcttaattaatctggcattagtatatatgggttactgt

SEQ ID NO: 51990 - DNA, 9595 bp, Oryza sativa
tttattttatctatatttaatactacatgcatgttgtcagggttatggataccgcatacctaatagtagtcgactaaatctcggcaggacccaccaaatatcatgtcttatacggaaacaacctccggatatagaaggagtttcgtataaggaaggatgaatagaattctacatgtaaacgacatgtactactcggattgtatccatattggttttcttagttctatttggacaaggggacacctatgggtataaatacaaggccccctagaaggacaggggacacgaaacaatagatcaagacacaagatcaacatacaagccaacacgcctccaaatatcaacatcaaaaattagcttagacaaaccctatctggtacctgcgggggccggcaagaggggtcaagcactatctctgatctcgacgagttcgtgctcgaggaagaagactaccctgtcatcgactacgagttagttatctagccgtcaagtcgacgacagccagatatgttatcccacatgttgtatttgtgttatccagatgaataaagagcaacaccggtttcggccaataggatgtagggttattacctgacaattcaggggcccgaacctgtataaaaatcctcacatccgtctcttttacctaagtctcgcatatatcctagtaccaacgatccccatactatgcaaataccggaatcgcgacatcaagcgtcgacacatgtgtacaaagattcaaattgacgtttttgggaaaaaaaatttaggaactaaacacggccttaggctctgtttagggtctgtttagttcgtgaaaagaaaatttttaagtgtcacatcagatgtttgaccggatgttggaaggggttttcggacacgaatgaaaaaactaatttcataactcgcctggaaaccgcgatacgaatcgtttgagcctagttaatctgtcattagcacgtgtaagttactgtagcacttatgactaatcatggactaattaggctcaaaatatttgcctcgtgatttcctcccaactgtgcaatttgttttttaatctatatataatgctccaagcatgtgtccaaagattcgatgtgatgtttttgggaaaaaaattttggggaactaaaccaggccttagtttccatgcaaaaacttttcactttcacatcgaatgtttggacacatgcatggagtattaaatatagacaaagaaaaaactaattacacagattatgtgtaaattgcgagacgaatcttttaagcctatttgcgccatgatttgacaatgtagtgctgcagtaaacatttgctaatgatgaattaatttggctcaataaattcatctcgcggtttacatgcggaatctgtaatttattttgttattagattacgtttaatacttcagtgtgtgtctgtgtatccgatgtgacacgccaaaacttttcacccctggaactaaactaggccttagttctcaaacaaagttttttacgctgtcacatcgaatgtttggacacatatatagagtattaaatgtagaaaaaaaaaccaattacataattcgccagaaaattacgagcctccaatctcattcctagcgtgtgttagggacgcgcacgcatgtgtgtcgtggtgtgagtgcagtgtgtgttagtgtgcgtcctgagttgttcccttcttaaaaaaaagaaaattacgagatgaatcttttaagcctaattgcaccatgatttgacaatgtggtgctacagtaatcatttgctaatgatggattaattatgcttaataaattcgtctcacagtttcatggcggaatctgtaatttgttttgttactaaactatgtttaatatttcaaatgtgtgttcgtatatccgatgcaacatgcaggggcaaattttttttgccaactaaataggctctattggggagatactgtactctctccgtccaagaaaaaacccaacctagaagaagatgtgatcccgtccagatttattgtactaggtgggatggagggagtatgcacgtagtactataatattagtattagaatgtgttgtattcagttctaatatttattttttatgggacgaagagagtacaacaacatatatgtacggtgcacagctacggccatgtatatggatgcaattaatacgtcggaatcagaaggccataggttgtaaaaaaaaaaaaacgaagcggcacaaaacaatatatggttaaactttatatatatgtctcattaatagtttgatgccaatacttaaaaatatacaaatagaaaaatagaaatcaacttttaggtttcgaaatttaaattttggatgtagctaattaagctactctatccggtttgataatactctacttgttattttggacaaaactcatatcaaactttaaaatctttaactatagataataaattctaatggagatcatacaatatagattagtcttacaaaatactttaacaaaatcatatatttattgatgttttatatatattattaaagcctaacgattaaagttgttttagatcacgtttttatcccaaacgataaatactatcacggaagtactctctccataaaaaaaaactaaacttaggaggagacgtgacatctttacaatgaatctggacaaccctttatccagattcgttctactagaaaacattacatacttgtatagtttaagtttttttttaaggatggagggagtatggttgctttttctttttttttttaggggggcggggtttgatcgggctgtcaatctgtcaccacctactatggcgcaacagcagttgagaagttgagaattgttcagatgaagcgagtatcacgagtatcggggttttgtgatgcttactacttatataatataaaactgtatttttgggtagcagacagataataaactctttagaaaaacaacacctgaattaattattgcagctgaagatgacagcatatctgagccaactcgctgattaattagaactcaggatccaaccaaggaaaggattattaatccagaatacatgaatgcaatcgcagaaactgcgatgcagtcactcattggcaagtggcaactgggcatatcattgtatatttgaagtttcatatgataagtttttttttaaaaaaaggggaaaacagtaatagattgtgccttttcattaaatatagggagaatagctaatttagtccctaaagtttctctgtaggatcagtttagtccttaaccttttaaatggtccaaagaaatccttaaactttgtcataaggtctagaatagtccttgggtccaccaaaatcattatataaatatgccatgtcatcattgatgcaaaatctatgatgaattgtccaatttacctttatgtatatcatagaaaaataaatataagggtgaattagacataaccatgggaaaaaatacttatcctttttttcacccttttgaggtatatttttgctcttacattttactttttgttttttatttttctatgatatatgtaagggtaaattggacaaatcatatagattttgcatggaaatgtgacatggcatatctatgtggcgattttggtaagatcaaggactatgtcaacccacgtgacaaaattaaaggatttgtttagacagtatgaaagattaaagactaaaatgtcccaggagcgaaattttaggaaccatattagctattctcccttaaatatagcagaagaaaaaacagcacaagtttcatatgataagttgatagcgctgtagttgctgacttcgtaagcttgcatgctcctatggtttccacacttcagcaaactagatggctgctaaataaattagtaaactttttgatccgttccaggctccaggctagctagatccacgtactttgtggcagcaaagacttttttgcgtaggtcgatcgaacacttgtcgtgtatgcatgaacgccatcggttctaattctaaactaacaccaactaatcgatcacgggcttctagctatagataattaattagtactaatatggagtacatgagtaatgtaatcctaacaggaacacgcctctctggtgcctgaaacttcacgctgctcgccactaatcgagtactctatttggtcagaagagaaataaaatggtatagcaacaacacatattttgcagcatcgtctttctatgacgtctttcacagtaacttactctgaaatatgaatcaaacgacctcgagtccttgacaagtccaagagggagtaggcgaaagaatgtgacgccatttctgttcttccgcataaatgggcaaagctcgcgttatttttattgtaaaagaggaaagagatattgctgtttgtctaaagttggtgatccagagataagaaaagttctggaaggctttggatttgcagcagaaagtgcgtccaccaccattagtggggactggtaaaacactgcattgatccccttgactacttggctactgcatccagcagtgaacatttcaaaggataatcatgtggatagatgtgtcggagtacggaagcgagaaattaatctcagtttcggcgactctcttcattaaacttctgcgtgctggctgcaattttcttcacatggaatgcgaatttcttcatatagagtaggagtaggcatactgctactgtgctagcgaggaacggtctttttttcctagtccagtccatcaatgacatggggtgtgtccgtgtgtgtcggtatgccgtgaaatgcagtatgcaagcatgttcaggagacaagaggtacatgatctccatgttctcaatcaggtctgtccctgttcactatgagacattacggcgaaaccgcgaaagggcgaaagataaattaacccttgatggttcatattgtaatacacgagatctacctttcaattaccacgtgactttgtgtgtcctgaaatcgaccagacatagcttggcatagagattgcataggtcatccacatcttaaaagcttggattcaacattttcaactagaatagtagtgtggacaaatatatatgtgggcctttagttctgaaaaaaagggcctatccgggcctgccatttggcccatatcccttgttatcatctccaactgggcccatgacatagttgtgacaaggaaaaatgtgggcctttagttcagaaaaggcgggctttcgctttctgcaagaggcccgtttgaaatgttgaaatttcttactaagtcatttttttattcaatgaaattataaattccaatctttagtttgacagctctcagccgtatcttatttttacctaagttcagcattaagcaaaccttacagaagctgaaactggaaagtctaaacacattaaaagccaatattgttttgatgaaataattataataacaaactctaatgctaaatctctatctatgttcccgagaatttgcatagggtaagtccattcgaaacgttggtttttttttacatattttaatctattttatctgaaatggtttagggctggtttaaaatggaatattgaccaaaatactgtagtggattatctacgcggttatagatataaatctaatattttgataaataaacataaaaataacttaatataggcgtaacaggccctcacgaaaaagaaacctattctgatttcaccgcgtagccaagcaagcatcaggctctcttagccagtcttagggcaagtataatagtaggctataagctggctaaaagttaaggtggagaagagaagagagaagaagtgggctgtaaacttacagtcggcttggaaacaagatctaagaaactctgtgagagagacaagtggaccctatattaattgtaaagagctaactattatatgggtagactgagagaatgctacaaagaaccttatagccaacagatcggttgtattattagccttgctcttagaatagatacaatagcaggctataagctagctataaacatattttaaagagataaaagaatagagagaagagctagctgcaatacggactccaagacataatgtatgtatgatatgtagtatcaggtattactagtatatagtaaccaaatattgtataaattagctattatatgactatagataatttagagttagtaattggctatactgttaaacttctcttagcatacagcagtagcacccgagctaactgaaaaacatcagcccctcagccgtcatcctatctcaccaaaaatttcaaaacacacgccgcacaatcgtgacaacgccataacgtccactggcgccgcgggccccacactgcaaaatctccgcctccccttccccacgcatggattagtacgcgtccagctcactcactgcttgcttccgccaccccgcaccgcttccccctcccctcctaatcaccaccaccgctcaccggcggtgacctccccccctcctcccccgcctgcgccatgtcatcctcctccggcgcggctcgccgggcgcgccccgggccatggccccccgcaccgccgccacagccgcaggcgcagcccctctcctgggccaagcgcactggcttccagtcccgcgtctccggcgagtccgtcgccatcgtctccgcctccagctcggggcaggtatcgctgcctcgccccgccgaggcaccttccgatctggagtccggcccaccggccaggcccaactccgccctcccgccccctcccgccgccgccgcggccaatgcggaggcaaagccgcaaccgccgccgccgccgcctcctgcgaggacgcggaggagggattcggatggcggaaggccgaatgggcaggcggccgcagcgccgcttcctcagctgctggaggaggaggacgacggtgcgccggagcggcccaagtacgagctccgtgacagccccggagtatgtaagtgctcaaaagaggaattaaatatcccacactgtcatgtgcgagcgcgctgatttacgaggttttacgatgtgttgcagttccaatagcggtatatggatttcagcattacatctccatgctcggctcaatcatcctgatcccacttttgatggttcctgcaatgggcggttcacctgtgagtgtggcttcaatttagtagtagttctcacagcatgtttggttttgtaggtttagtacttaatatacgctgttggatgcttaggatgatatggcagcggtggtgtccacggtgttgcttgtctcagggatgaccacattgctgcacacattctgtgggacaaggctgcctcttgtgcagggaccatcctttgtatatcttgcccctgcgcttgcaataatctactcccctgaattctttgggctcaatcacaatgtatgtttatatgtataaattttatttgtgttggcgtgatgcaatgccacatgttgtcatgtagggattgcctcatcattgctttagagcgtttgttgttgaacctaacacgttgtatttcattgcagaactttaagcacatcatgaagcacctgcagggagctatcataataggaggtgcattccaagtgctgttaggatatacaggcctaatgtcactatttctaaggtgtgcagctgttgctgtttattagatacaaatacattcatctttttctcctagttgtctgctatcatgtggcttgttgacatggcagtatatttctctatttaccatggccacatgattgggtttggtagtaagtcgatcagatttttatttggaatggtgcatactgagtactaacacattcttaagaaaacaaatgatccaaaatttctactgtactacagagatacatctcgtgatgactgtgaacaactttctcttatctatgtggtgtttgttaacaatggtcacgatatgttaataaacaccgattatgatacaggtgttttactatggtctctattggtattttatagaatcaatccagtctgttcatactctctaatctaatggattgatctatttatactaccacctcaactacttgtagaatattttttttctactggtagtagatatcataaatcaatggttgatatcgcttctactggtgatgttagtagaagaccaccatagaggtattcaaataataaaggaaactttgttggatattactagttattatacatatttcctgcttctgagcatccctgttatgaattaatttctttgcataaaccgttgtttctcggacaataaacatacttttgcatgtcttataaactgatgaatccagatcaatgaaacattagtaagcctgcctctatttcttctgactgtaccatcaactgtatatttttgtgacaaatagtaatacatatgtatctccatcttcactgagcattttgtcattaactacctctgtttcaggttgataaatccagttgtcatctcaccaaccgtcgcagctgttggactttcgtttttcagttatgggttcactaaagtagggtcatgtatagagatgggcctattacaattattgattgttgttatgtttgcactagtgagtatgcagtaaaccaacttgttaaatgcattgtaatattttgtgcaaataatgtcttaagctgatgatctgtctatttctgtgacagtacctccgaaaagtaaagttatttggctaccgggtgtttttaatttatgcggtaagatttgggctaatagttatttgagctaatacctccatctatgctagtcattagtgtgattatgcaattctaattgctgaacttttggtgctgccttcttaggttcctcttgctctagggatcacatgggctatcgcttttgttctaacagcaactggagtttatagctacagaggttgtgatgcaaatattcctgcctcaaacaatgtatcagcctattgccggaagcatgtactgaggatgaaatcttgtcgcgtagacacttcacatgccttgcgatcttcaccttggttgagatttccatatccgttgcaatggggcactccaattttcagttggaaaatgggtcttgtgatgtgtgttgcatctgttattgcatcagtcgattcagtaagtttataattgctttgaacttagatgatgcttgtttttctttcttttggtttgtttacttttcataaatttggataaacaatctagtacttactgggaaatgatctacaaagcatattgttgctccccctgctaagcatcaacttaacataagctttcttctctgacaatattgttaaatgcctgaaattggatcactcagtaagtaggattctagaatcaaccattcattgctcttcactatccaatttatttttgtttcctgacaattcatttatgcattttggacttaaggttggttcctaccatgcatcttctttgtttgtggccacaagaccaccaacagctggggttgttagtaggggcattggtgttgaaggtgtctccacagtcttagctggcttgtggggtacaggagttggatctgcaacaataacagagaatgtacacacaattgcggttactaaaatgggcaatcgaagggcggttggatttggtgctatt

SEQ ID NO: 51991 - DNA, 2475 bp, Oryza sativa
tggcttatccaatcttcggtatagcgccaagggaagctccaggaacagtattgtagttgggctagctttgtttttgtccctgtcagttccatcgtactttcaacagtacagattacagcctaattcaaactcatcagttccaacctacttccagccatacattgttgcatctcatggacctatacacactggatctagtggggtatgtattcatccgttcttttctaacactatgctgtttgcatactagagtttcaatggaaatacataaacaaaagactggtgatacacatgcagagtccatattatagtgctcacattatttatgaatatagatagtttgccaactgtaactcttcatgccgcttgcctggtacaataacaaatatctggtttctttcagtaacaatattgttgtggagtgtcttatggaagtatcctgaacatttacataactatattgtacaactggagaaagcagtagaaagaaacataaagaaaggaataaacaaatcctgggaaaatagtcggaattagaaaattctcattaaatatagtcctttttactcctctgttttgatatgaaccctggaactttcatttttcatgtatatactatgcttcaactgaaattagtcaagctataaattcctagtggtaataaactttatcgagtagaagtgcttaggttgagttccataacttacatatggttccagcatagtttccttcttaacaaagaacacaattatttcactcttatataccgtgccatgatattttcaatcccattcacatgaatgatatattgctttctaatttactgcgtaggcacatttgcagtatataagaactgttctcattttatttgtgaagcctgacaaattcattcatataagtctcaaaatatggcaatatttttgctatatgtttatgttaactatttgatttgcaattcctttatttccttgctctcaggtaaactatattctcaacacgttactgtcactcaacatggtcattgcgtttttggttgccctcatacttgacaatactgtccctggtggtcgccaagagcggggtttgtatgtatggtcagaggcggaggcggcaaggagagaatcagctgtcatgaaagactatgaacttcctttcaagattggacacgcattcaggtgggtgaaatgcgttggcctatagcacagttttggtgtggtttgtagccttggccaactgcacaaaaaatattctgcagcttccaagaatgaaaaatggttactgtgcaaaatctcaggcgaaagaaatggttagtcacgaatcatgaccgactgtttcccaatgtttttcaaccaaggtatcgactatcgagtgtacatactgaattgctctctaggttagttgtcttgtcctgatgcagatgctagatgcatcaggggcttcccacatttttttggactaccttttgtcatcacttacagattttgctcttctcctggtactatttaattggtgttagggatatctatttgtacaggcggtaaatgatctgaaccaaacctgagctgtgcttaattgatctagttatcttactttcaacatttcctgtgtgtggatattttactttcaacttagctactagtgatagcgagtttcaccgtgccaggttttcctgctgaattatctcatcctcgcagtgctaaaggctggcatccatgtcaactgttaagcatgtaaagctgcctgtctgaagtacatgggcaaggaatcaaagagtctgtaatgttacggggctatttttccagttgccacctcccaactttggcataacccagcctgtacacattggatctttgctgacttgttggttatcatggctggctgacttgttggttatccccgtaaccacgtatatagcccagttctgagaccactcagcactctagagggccttgtcgtggacactagaccctcttttctgaggggtcaaagccaatggacctcgccaccggcctgtaccgatgacgaggctgacaaggaccttcacatggaacggccgtgccgggcacggcggcacgggtggcttctcagcacgctccttccaaattccaatgctgttgcttgtctacggctagctgcgtgcacggctcgaatgtcgcgtgtacagcagttagcacgtactacatgaggtacggcaatgatgccggttgtcaccggatgcagcacaatatgcaaaacattatgatgaattcactgggataaaaatgtgtagcaagcttgattccgaagtcaagcaacactccgctatcatgactgctgggcatgccacataaacaaaggacaagaactggggcatgccagtataaattgctagccgcaggccatccagtggcgcaaggctattgcttctttgtgacctgcaaggctgcaagtttgcaaatgcacttcaacatactcccttcgtcccataatataagg

SEQ ID NO: 51992 - DNA, 14378 bp, Oryza sativa
  unsure (1)..(14378): unsure at all n locations
aaatcccttatattatgggacggagggagtaccaattgtcaaaaagtggcgcacttcccatgtcttggtcaaattatctcccctagtaatcgaacgccttcttcacaaggatatgcagccatgagaaatactacttgtcaattatcagtgctgccttccgctagtaaaaaaagcaaagagaacaaattcatgcatgttacaagctacagcatccacttattagaaatagtgtaatcgcagccacgctgcatgaacaggtctgcatctgcaaggggccttcccttcctgaaatcttcagcaagtccgggaattccggagaggaaagaagctccccttattgtaaaatctgaacttggagtgctacacctaccagaagtaggcacagacagcagcccagaactgtgtggatcgtaacatggcctcgttgaaaagccatgatcatctcttatctctgacggagctaccgtgacacgatcagcagtgttgctcacgaaggcgttctgaggagcagctgcagttggtctcagattgagctctgaacctccatatttgttgcaagttgagaccatctcgtcctttggaaatgagtctgttggcaaccgaaacaagccggcaatgcagataggtatcttgatgtcatccactatctctctgtggtaatcatctaccggagccgggagagccaggatctcctgccggtgtgggcttgaactggtctgttcctctgtcagtgaaatggtagcgtcgtcattggcaggcaaattctccctgtcatggtaatcctctggtgcagggagagccagtatctcctgatcaggagattggcttgagctgcagagctcatctcttgcagaattgaactcgtcgtcgacgggggagtagccgtcgtcttctgaatgttcatggtcccctggtgcaggaagcgccagcgtcacctggctgggtggaactggcttgctcagcttctgactcagggaaatcctggcaagctgaagtgcctgaagaacacactctatgtccatgttgctcgttggctgttgatctggccctgcatcgacctggttgtcgccatggtcatggaagcgtgatgagctccaatcagagaccttgctgttcagggtggcatcactcattgacgggctcccatctgatggcgctttgatgtcacagtagcttgaacatccatccggattctcgtttccttgttcttgattcttccctgtcattgtgccggcgacattagagtttccttgagactgtgcatgacagtggccgtgaagctcctcgtgcgagtcacgttggtcggctgctgcttcttgtcctgatgtgtcttggggtgattcaggaagggaaccattcaacagaagtccagcagagcggttgttgctggcgctggggtgatttttaacgcctggttttgcctcttcgttgcaatgaaccgcttgatccgcgagcctagaatgctccttgctctgctcccaaccattttctatctggcacgccttattctctgcctcaacatgaacctggagctccaaagacaaaagtatgagtaaaatgtcaaattttgaaccaaaacaaccaggtttcactcatgatactaactaacctgtgggtagcactctgcagtgcattttgttattaaaaaaaagcattttgagagagcaaattatttatacttatcaagttggtggtacacatttttgtactgcatgtgcactaaatttggtagcatgtggaagtcaaggggaagttgactctctctgtggcgtagttcatggtacaaagttatgagattatatttttgttgtacacatgtactactgcagaagttgcttcatgtgaaacattttctctggaagtggaagaatttggtatcacaactctgagcagtgtttctgtgtaactgtgtttggttgcttaccttggctgagctccgattctcgttgaactgcttctcccactgcctctgagcttcttcctccgcctcatactggccgatcagctcggcctgcctctcgagcaccctttccatctcgccgtccttctcgtacctgatcacatactgaccaccagcaacctcgccgtccatgtccgcctggccgtcgtcggtgcaatccgatccatcttgctgccccttctgactccaggcgatctcctcgacgtcgccgcgctgctcttccggcgccgtcgacttgccattgctgatgagcagagccgtgggatgttagaattcgacaaacaatggcgtgtgcggtgtgccagcgtctatggcgggacggagctcacctgagctccttgcgcttgttcttgcggcaggactgccccatccggtacttgggcgacgggtcggaggagaggaggtagaagtagctcctccggtgcttctgcttgagctgcctcgccttgcgcgggctcacgctgcggcctttccacgacagcccgccgccgggctcggccgtcccggacagcgcgtcctccgccgcttcgcactgcgccggcggctgctcctccccgcgggagccggccgtgtcgccgtcgctcctcgcgtcgcgtgggtcgtcatcctcctcgccgtcgcggtcggagcccgagtcgagcacgtcggagaggttgccgccgaagccatgtgactccagaatacccagcacctccgtcgccgcccgctccgcctgccgcctctgcgccgtcaccgcctggacctgctcctccagctccgcaacctacaaccaagtgacccaacacacgtaatcaatggcgcgaacgacagcgagagtaggctgcccctgcgcgcggtggctggctgaccctcttggcgagctggtcggcgcgctccttggcggcgcgggagacggaccgctcggagagcagccgcgcgcggaggaagtcgacggtcatggccgtggagtccgccatgcatgccaccgcgcgcacgctcacgcgctccccgagccgagccgcgagtgacgttgtgcgtacgtatgccgctccgcgcactgtcacatgccggcggtgtggcttgaccggcgccgcgtattaaaaacggcttggtttcccgtgagccgcgcacggcgcacacgcagcgcgcgtcgtactcgcggccgcgggcgcacggcgcaccgacagcccaggacagggagtacgctacctacgcgcgacacaagcgccccgctgcagcacgagggccacgggctgacgagaccaccgcaacggtgtagttagctaggctgcgccgtccattttcaagggagaatggcgatgcctcacctacctgtatcgactgatctgcctcctgccctgtccggggtccagtggcatattgtcaatttggcatcttacaaaatcatgagagtttggatttatggtgtactgtgtacatgaactccagtagcacttgtttatgggggtaaattcgtcgaggacaagagtagtgaacgtggtacagctttgccatgttcgagcaacgcgacgaagccagcaaaactactcgtcttctcttgtgctactgcctactgctactggtgctgctccaaaaatggccgagatctcaggctgtccttgcttggaatctttctgcttggatcacgaacttctaccgcacggaaacatttgagtcttgcaacggtttcgataaggtcattcaaagcaaagtcagctcatcgtgcatagaacaatacgtcttcaaagaccatagcggcaattatagcatcgagtaacagatgtttccattaaaaaactttagaatacacatatgcagggtgttgaggccgatgatcaagcaatgaccatgcggcagattaatgcagaccgtaaccacaatctcaggtacttaaataacgtcatacccggtaggcgggtttacaaaacgttttcgtaaacgtttttagccgaaatttcgctcaagaaacattatgtctgcttagtttgacagattcaaacaagataatgacgatatctcaatcaccgctggcacagcctctgcatccacagtgaacacattctataaccttctcctctctgagatgcttggggacccggcagacgcatgtagttgcaaagttgtggtctcgtgtctgtatgcatcgaagacagcaaaggcgctcataacccggctgaaaacacacaaaaagaagcaatgatacatttgatataagaatgcctgacaaactcttgtgacaaaaaagcatcttctggatttgcatctaaaaagtgactgaaaactttgacagttgaattcgtcacgtacgtctcacaatattcttagggcaatttaggcccctcgttatcaatgttcagacaagtatataaagtagtaatatggaacacaagtattgcatccctcccaaatctgccaacttttatcagatgtccaggaaaaaaaatatcattgggtgttagaagtctatccatgatttgatttctggttacatcagctgctagtatgccaataaaaatacatagcggaaaatatataaacatcttttagtcaactgccttttctttttgctcccaaaatcttatttttcatggtgcacccatataagagaatatctagtccataaatccccacgtcactcatgctgcattatttcactatttcctacggttcattgcaagaaatccaataaggcactactcaactttgacatacagctattaatcgcaggttcatacatatagattagattctaaaacaagatttatgatgtgtcatgtcaaactagatcagtatgtgatagcttaacccaatataattgatttactgcaagaaatggtaggatgcggttagtttagtgttttatttttcatagtacaagtacaaaaagtatggttcaaggcttcaagcagttaagttacattctaagcatggggaaaaaatgtgagaaacttagcggtgtatccaggggtctatggcttcatctgaattatctttgtacacaagttaattaaagtcttaaagattatacaaggtggataaggcatcttactaaactagcacagagtataaggaatgatgggcatcttacagagcaaatcatgggtcgaatactaacctttttccactttgcaatcagattacggtctgcataaccctggtccaggcaaaactcatacaactcttttgatatctccttccttctgtaataaagatcatatatgtagcgacttctttgatgggaaatacggaaaattggccagagggcttcgcactttctcttcccatcatgtgtgtcattttcagctacatgagtagatgatattagtatccatataagagcagaagtatcaataaacatctgaaaggggagcatatgtcataccttccctcattttggcatccaactcacggatagttggttcaataagctcccatcctccaggatatttgacacggcttgtctttattttaggcatgttctgtcaatgaacgtcgagcggctaaagcttgcaaagaaaccctgaggacatagagtaggtgtaagattcacaatgcaatacatttgcacggtcaagctcttccatcgaactcaagagattataagaacataatacacactattacatagaatttagccccacattgaagccttacatcagatatgctatatattccttactataaaggaactgtgttgaacacaaatagcacaacttaaacaggtattttgcatcttcaggctaacagtcttgtcgaaccatgatttaaccctattttgcaagtacaaaatatgtgcacctcgaatcggtgaatggacggtctaatacctaaagaactaatcgacacgatgataaaaatcgtggaaaaggttccccaaaccctaggctactcggaagttttttttttgagggaatactcggaagaatttcgtcccaataaccacatacgcgagaatttcgtcccaaggaggagacgaattgaacggatccaataaacagcgaggtagaaactactaaagcatccagcgaatcatcttcagggaaaaaaaaagggaatcatggagcggaagacgaataataacctcttggcttgggcggccttgcagtcgccggatggaagctgtggcgcgcgggggagcggcgatccagagggggcgcgcgtcgtccacgccgttggcctgcgctgcgctccgctccggtcgagcaaagacggccgaagaggagacgggcgggtttggagtttggaccggagctaccagctatatgtcgtgattctttttcccctccttttttttttttgagaggagctatgccggtttgacggttttctcctctggtagcagtagtatttgctacatcatgggcctcaagaatcaaaacgggacaccaactgtgctgaaatccaattcggcaaacaaggttggtttggtttgtagccagggtatacgattccgacatgctctttcgtttcggacaccggtggaattcgaaatttttgaaatccggtggaaaaccggtaaattccgaacaaatttcataaaccaaaatttgaatacaaatccttgagtttgccggcaagttctcgaaaaccggtcggttttggcgaaattccgatcgaaatcatcaaaatttcgatcagtaatttgttttcttttttaaattctttattcttttctttcttgatgtaagtttcagtaaatatacataatacatcatttttcgaacatttatatcccaataggttctatgaatatcatactccctccgtttcacaatgtaagtcattttagcatttcccacattcatattgatgttaatgaatctagatagatattgtcgaggagcgatcctctctagtaggtggtcgtgagacccccttttgtgagttcggctgggggaaatggcgcgatgacaggagtttacttccgctcgcagtctagctgcttgatcgttgtcgggactgtatgggagatcgaggattatacaggttcgggccgctaccgagcgtaataccctactcctgtgtgtgggattatggtgagtttttacaagggatttcaagctccgacggggacctagctgttcttccttcgagcttgagttctcctcgagtcctccctttttcccggtggtaatggtcctccttttatagttcaaggggataccacatgcaccgtttgcacctaccccccacgaaaaggggtacccacatggtcctaatcatatcgctatcctttgcttcaaccggaagcaacatggtcgcctggcttcaggtggggcccaacgccgtcctccgcctgacacgggggacatccctatcattctctattaattgtatgaaggcttcggcggcccatcacgcgcgtggggcgcccctagcagcgtgccgacgggacagggcacacctgcccccactccgcctgacacagggtggaacgtgggggcactgccctccgtcccgtcgcctgtgaccggtcacaggccggtcatgctcgattgacatgggtcaatcgagcggcgccgcacgtcccccaacgccgcattgaatacggcgtgggacggttggggtaccgcgcattaaaggcgcggagcatcgtctttcgccccgcctcctctccccgccacgtggtggccaggtgagggccccggggtagcacgccccgaaagcccgaggggtgcggcgtggcaccccgaggctccctggccacctctctacccgaggggcggggggaaacgaggccgtgtggccacgcgaccagatgggaaagatatttccctttactgtgcgtacccctgggcccatttcaccgacagatatatatgtctagattcattaacatcaatatgaatgtgggaaatactagagtggcttacatcgtgaaacggagaaaatagtatttataagattttttattttttatcaattcaaatttgaatttggatgaaactcctcaaaatatctcagacggtttctactttcgagtctcgtcgaaacatcgaaattccgacgaaatccgatcggatttcgtcggaatcgtaaaccctgtttgtagctcaactttgctaagtcaatatttatgcaatgttaaactatatagaatataaaacgattggcatggttgaaagccaaatgcaattttgataacaaaacaagcaaatgcctagtcagttttgttaaaaaagaaatcaacaacaccttattcttaaccatgataaagtttgataaagtttattttaacaataaagtaaataaaatttaactatattactccctctaggtcttttaatgacattggctagtttgaactagccagcgtcatatatacgaagattatggtggtataaatttagttagttttatttcaataataaaaggaactaagcgaacactctttgtttaacttatgatattctatcaagcccattcaaacaatgatattataacgaaacacttctctatctctgctattataaaaattaaagatgttttaaccggtattttggtatatcatccatgtttgagtcattttttaacttccttcgcttttagaaatacatatatgtgtttgagttagaatttaagctcatttgcttttgaaaatacaaaagaagtcgtacaagaaatctcttttagaaaatacccgcatactaacttaagataaaaatcggactcctaattgtagctcgtgattttctaaaagaaaaatccaagcaaattcctaccgtgaattttatcctttctaaaccgtataacaataataaggttaaaatagtattcacccgttgcaacgcatgtgtatttttttatactaaaaatgctcgtgcattgcaacgggtaaaagctattttaatcttattattgttatatggtttagctaggatgaaattcactatgggaattcacttggattttttttagaaaatcatgagctacagttaggagtctggctttcatctcaagttagcatgcaagttgttttaaagaaatttcttatacgaattcttttgtatttccaaaagcaaacgaacttaaaatctgactcaaacacagatctatatttccaaaagcgaatgaatttaaaaacctacttaatctgggggacgtaccaaaataccgaccggtaaattttttttcaatttttataatagcagagattgtaaatcctatcttagtataaagttatcccccactaactccttaagcttaacatgcaaagatgccacatcatcatccactaattaacaaaatgctacatcatcatccactaacaatcatcacatttaaacatcatgcaaacatgctatatctttatagtttttataatttaagagcttttcaaatacaaatatgttaaattatcatccaatataattcacataatgtttcaatgtatatctttattatgttttatgatatcctatatacttatatagttcatccttaattagttagtgcttaaatgattaatctatggtccaaattatctttctccttttttcctctaattaagtcatatcacatcaattgtttttagcctttagatgattaatctacggtccaaactatctttctgcttttctttttccataaagtcatgccaccttactttttacgtttgaatcaacattctacatactatttaaatttaaattatcataaaccatattaatttacttaatttgatgttatctaactatcttgcacgttatttttttattgttatcatactaaatttccgcagcaatgcgcggggtttcacctagtatctcaatgttcacaccacaacacattcagagacaaacatccaccaggtgcccccatgagcggaaactctaatgggcgatcgatcgcccatcccatcgggtagcaatcgccccgcgccccctcccccctctctcccttcacctggtttccatttttttcaccgcattacttttctattttagtaaatttatgcatctaaagtttatacaccttaagtttacacatctaaagtttagagacccaaagtttataagtcaaaaatttatgtatccaattcaaatttgaatttgaattcaaatatttttttttatatatagtatttttatacatctaaagtttatagacctaaagtttatagacctaaagtttataagtcaaaagtttatatacccgtttcaaatttgaatttgaattatatccaattcaaattttaatttgaattcaaatagtttctatatatagtatttctatacatctaaagtttatacacctaaagtttatagatccaaagtttataagtcaaaagtttacatacccgattcaaatttgaatttaaattcaatttaaatttgaattcaaattttatagacctaaagtttataaactttttttatatatatagtatttctatacatctaaagtttatacacctaaagtttatacacctaaagtttataagtcaaaagtttatatacccgtttcaaatttgaatttgaattatatctgattcaattttgaatttgaattcaaatattttctatatatagtatttctatacatctaaagtttatacacctacaatttatagatccaaagtttataagtcaaaagtttacatacccgattcaaattttttatatatagtatttctatacataaatttttctaacttttgtttttttaaaaaaaattagtggtgtactgtaataggaagagaagaagggaagaaggaaggggagaagtaggaggaggtacgtattgcctataggcggaggggtggtggcggatgagtcgaacatggaaggatccgagccgtctgcccaatttaatggaagcttccaagcgcaaccgccgaatcctcctccatcttcggccagcatagctcctgcctggccacccccaggtttgctctcgcggctcttccctcaccggtgcgccgcaccgtccaccgcccgccggagtcgccgtcgtcgccgccgagaagagggacgcagctgccgtgcgcggccgagtggatgtggtgtgaggcggtgaggtggagggaacacggggagctgggcgcacggcgcttcgagaccgccgcccgggcgcgccgcaccgcctcgctcgcgctctccaaccgcaaggagttcaccaccccgcacaacggcgccatcaactccctccaggtccacccccttcttccccctcactccccttttccttctctcaccttagaggcttagatcaatttgatttgtacacccccgtagatggaatcttggcgtatttgatgtgcaatgtgtgagtcgctcccgctggtgttttgtaatttcacaatatggtcaggttgatttgacagagcggcggtacctactcgctggcgcatcggatggatcagccgctatattcgatgtgcagaatgcaaccgaatacgaagccgggttcattgccaagcacaggagcattctgcttgtggacaagcagcatgaaaatggccacaagttcgtggtatcgatggccgtatggtatcctgtggacactgggctgttcgtgacagcttcttttgatcagtatgtcaaagtgtgggatactaattcgactcaagtatgcattcatctgctttgtggattgcttatttttcttttctcttgcctcctttggtggtggcaacggtgtgatcctgatgttctgatttttgccttggctttcttttcctaggtcgtaatggattttaagatgcctggaaaagtgtatagcgcagcaatgtccccaattgcaacaacacatatgctgatcgctactggaagtgcggatgttcaggtccatttatgtgacattgcttctggagcctttacccacacgttgtccggtcatcgtggttagtttcttacttctagtgcagtgatgaaaatatgcttgctttgtttgtatggttaccaccttatccttggtatctgacatgtcagatggtatcatgtctttggagtggtctacttcaagtgagtggattttgatgagcggtggttgtgatggagcaatacgattttgggacataagacgagctggatgctttcttgttcttgatcagtcacggtctcaactaggaaggcggcctccttttcttgagggcacctcagataagatatggtcaccattatccatcacttacatttgttttcagaatatttggttgcaatgctaaagctggacttccactattattttctgcaaaagcttcaaaaatgttacagcttcaagtaaaatattatggctgtaatgctagatcaatacagtcagccttcaagtaaaagctgatttctgcggctattaatttataggtttgtctcacatattagtgtcagtatataggtgctatggtatgtttagtgctccaattcttacaatataaggtctgcatacattgtttcttgttgattgttgtgtcctagaaatgacgcgcaaactcagccttccactctagttgtgcaaatgatcaatgtattcatttttaattttgaccaggatcctttgaactctttacaaccttcatcttcttcaaagatttactctgcacagcagaggacaggcaagagtaagaaacagtcacacaaattgcacaaaagtcaaatccctggacatggacatatccaacagagattgcaccctggtttgtcttctagtcaaaattgtgcaacggcacattatggtgctgttacaggattaagaacaactacagatgggatgtaccttcttagctcaggttgattgaatttaattgctatttctatgagcattcgattgctattgcttgaaaggaattattgtctatggctatcttcttgttatgcctgtatgcagtatgcattaatgattgttatcctctctcttcaggttctgattctcgcttaagactttgggatattgattcaggctgcaatactttggtcaattttgaagctatgcgattacagactagcaaaccgctacaattagctgtcactgaggatccatcacttgtattcatcccatgcatggcaagcattaaggtgtgttgtcattttttagcttctcagtttggacgctgaattttagacttcaccttgtgttgccatattcatgtaggcgtacaatttatggtctggtatgacatttcaaacattccgggggcactatgaacctgttaattgctgctactgtagtgcacaagaacaagtaagtcttccctgtactcctatcctctgttaaccctgaatgttcccgcatcaataccactgctgagtcttttggaatccaggagctttatactggcagcaatgacatgcaaattcttgtgtggtctccatcaactccagcgtttactgaaatggtatattttctatttcttgttatcatatatctttctgtagaattttcctatatcctatcaaattcaaatttcttaggagtagtcgggcatattaggatattatcgcataagcttttttaggcatttgattgttagcacttctaagcctctgcaagaagatgatggcaagaggcaaacggattttgtagtcgatgacgataactggagcgactgagaattattcatgaggcaaacggattttgtagtcgatgaggataacttgagcgactaagaattatgcatgtatagttgtattatacactgaacattgagcgactaagaattatgcatgtatagttgtattatacactgaacattgacattagggatgttaacaggccacgtttttttttctttttttctttttttaaggggagccacgtttattactactgtacagtacttcatcctgcagtttcacccgaaatatcactttgataaagacagctaagtgaaatgtaaatatgccagattctctctccgataatgaaaatgctcctatgtgtttacccaactgttatgatatcatgttaacaaagatacatcagatctctttatctggtaaggagcaaggacagaaatgctcctatgtcgtagggtcgtgctccctacgagaacttgagcacagcagcgaagaaatgcctcaacacgttgctgttgatttgtttaaaaaagcttcgacagcctaacaactcaacaatccttaaaaagagatgaagcaacaaggctgtatgacttccaaaacttaaacagcgatgcatgaaattccacctaatatcgtgcagtttttcagctgcatcaataatatgtttaaggaaatgaataagaatagctatcaattataattacaattacaattacaattacaacagatttagcgaatctggatcgccaaaggcacttattgcacttatttcagactaatgtcgaggaagaatcgcatggagtgacagtattttctattttcaaaccaacctgcaatgaattgctggtcccaaaacgcagagaacctcgcagctcaggtannnnnnnnnnnnnnnnnnnnnnnnnnnnnnnnnnnnnnnnnnn

SEQ ID NO: 51993 - DNA, 8875 bp, Oryza sativa
  unsure (1)..(8875): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagaaaacagcatttaaaagtcacttagttgcccaaagccattttataagacgatcctagagctacacaatattattaatcaaggccgtgaaccctcacgaacctgccttaacccaaggcctacgatgattcagaccgaactggcaacccgaccctgagtcccagctcgtcccaagccaacccaggccaaccattccacattttagttgttgagcaaattttaagaattaaaacactaacttgggtacattgcttggcttgcccataacgcgagggcgtggctattcgaatagattatactctgatcagaggtgtacatctttacccacaagacacatcttcctcacgtgtaaccacgtgccacataccaccacggtatacggacggaagacgtgacatagttcccaacccatcctagccatagacaagagtaccgacccaatcccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaattccacaataaaccaacaattccaaagtgtccaggtgatatgaatatcccaaagtctagagttgtaaaaccgcctaatgttacctaattaatcagcgaagcatctacctaaaattatactagtggtactatgagtagagtgtccactagttggggttttgtttaatctagggtgaacaaggtaataataacaataacaataataataaggtcataacaaaggtaaataggcatggctaaataaaacagtgataacgcgggaatttaaataaagcgacaatgcaataatttaaatcaaaataattttataaactgggattcaatatgttcaaggatgatgtgacttgccttgctcgctttcccaaacgccggcttcaacttccacgaagagcggatcttccgagctgcagcgtctacacgaccaacggaaaagaaacggcttttactctactaaactccatataacaagcagaaacaaagcacaaaaatggtttcttgacttcttaaggaaaaattagagacttgaacggtccaattccgagttcaaatggccaagttatggccatttgaagtttatatgctctttaaatggatatttacgaatttcttcatttaaattttaatttaaaatcggatttattgcatcagccgacgggaggggcgcgcggaccgggtccacgggagtggggcccacgcggcagcctcacggtccacggtggaccgggtgcacgcggcttgcgccggccggcgccgtgggtcccacgcgtcagccgcacccgggggcgcgggcggctgacggccgggccccacctggcagccgcggggcgcgcccgaaggcggcctcgccggcacggccgacgggaggcggcgcgcccgcgcccctatggtcgccggcggcggccataggcacggcggagcggcggccgagagaggggagggaagggggaaacgaaatgggcggtccatggctcaccccggatcgatggcgacgacgggaacggcgaccggagcggagagaggcggcggcgcggctcgggtcgacggggacggcggcgttccggcggtcggcgaccgaaacggagaggtggacgaggtcggcgaggatgcggcgaagccgaaggaggcggtgccgaagcgggagatggtccggggcaacgacggcggcgaaccggagctcggcggcgacggcggagagagaggacgacggcgcgagctcgattccgacggggaaagagagcggcgagtggcggaaacggtggagagaggcacggggagtgtttatatagagccgggggcgagagagggtggccggggaagggaggaaaccggcgcgggaggtcggccgccatcaatggcgccggcgagatttgcgggggcaaatccgcccgtttgaacgcgggagagagagggagaaatggggggaaagagagagggaatcacggggaatatttccccccactttattgcgcgcgtggacggcgggaggcggcgggattcgcggcggcggcggcgctagggcacgggcgaggcggcgggagcggcgggaggacagggatgacaggtgggccccacccgtcagcgagggtggcgggcgggcccacccgtcagcggcgcgcgcgcggggaggaggccggatgggccgcggggaagaggagagagagagaaagggatgggccgagccggcccaagaggggaaaagggggggaaagactttttagggtttttctttttataaaatcattttaactttgtttatttcttaataattattatttgtgctctgagaattccactaaaatttgagggctccttttagaccaaggagaatttaacaaaaattctccgggtcacatttgaatttttcttgtacgtattttaatgtttgccaatttcttttcaaattttaattaattctattattccttttagagaatgatttttatttcgggatgaatttatcaggacgtgacacacatggagtggactaccagggcaagccggtcccagagcaggagggtgacgatgcagagcccgtcgctgcttgggaggtcactgcagtgatcctctctggctcacctgagaggacttcgctggcagtcaccgcgggtggagattccttctccgccgcttgccagaacgccgctctcctcgccatcggcactctgcaccagcgctacccggacgagttgcagcactcgccctaccgctaccaccctcgccgcggaggagcccgcgactacgccaccttccgggatgctagctcggaggatgacgctaccatcatgcacctggcgcgcatggtggaggcgtacgacgcggcccgtatcgacttccaccagatggtgcgccgcgggatggtcgataacaacatgaagatcctggagctgcgtcaggagaatctgcagctgaagaaggatctggacgtgctggaggcgcagctctgtcagctcaaggtcgcccagggagaggtctgtcgtcccaagcgccgccgcgtctgccgcagccagaagatcaccgctcgcaagagtacctccaggcccgagcttgtttgtcagtccctggcgtggacctgcttcgtggagacccctcgtgccgagcccgcgcccgtggttcctcaggagggggaagcctccggcgtagggagcacggaggatgcgctgctgctcaccttccgtcctggcccgtcgcagcggtagacgagcagttagtaggcttgcgcgtgtgttcttttcgtttgtttgttttgctagagtcgtatggggcatggttatgccggtgtgtggtataactatgtcggagcctgtctttattttatttgcctaagcaatttgaaccttaatgaaccaatttaatagcagtattaaactcaagaattatggtagtcgtgggtggttagttttaattgtcagctctctctgtttgctggttccgtgtggggttttcagatggtgacgaccaggagaagtgctaataccggtgatggccaccaacccgaaggcagcaacctcaacaaccatggcagcccacctccacctcctcctccgcctccaccaccaccaccagacaccaacgccatcctcacccaaatcctcgcccagcaagccaacatgatggctgctttcctccaccacatccaaaatccaccacagcataatgctccacctccaccaccacccccgcaacactctaagctcgccgagttccttcgcattcgcccgcctaccttctccagctccaataaccccgtggatgccttggattggttgcatgcagtggggaagaagttagacactgtgcagtgcaacgatgaggagaaagtcatctttgccacccaccagctgcaggggcccgcatctctatggtgggaccacttctaggctacgcagcccgaggggcagcctatcacctgggcccgtttcaccgccgctttccggagaacccatgtgcctgccggagtcatggcccttaagaaaagggcattccgggagttgaagcaaggcaaccgctctgtgatggagtatttgcatgagtttaacaacctggcccggtacgccccggaggacgttcgggaagatgaggaaaagcaagagaagttcttggcgggaatggaccctgagctgtccgtacgtctgatctccggggattatccggatttccaacgtctggtggacaagagcatccgcttggaagccaagcacaaagaattggagtcgcacaagcgtcgcttggcgaatttccgcaaccaacagggggctaaccaaagggtccgctacaccaatccctatccagggggatcctcctcgcagcagcaacagcagcaacctccctccgcgccccgacctcaatttgtggtgcgcgtcccacagccgcagcaaccgcagggtcagcaagggacccgtgcaccccgtccccctgcgccagctgtgcagcctggtcaaggccacagagacgttcaaggtcagcagagtctgtgcttcaactgcttcgagcctgggcactttgcggataaatgcccaaagccgaggcgccagcaaggccaagcgccgccccgctccaacaacggtggtaaggacgtcattcggggtcgtgtgaaccacgtgactgccgaggatgtgctgacaactccagacgtcatcgttggtacgttcctcatccattccacccctgctaccattttgttcgactctggagcttcccactcgtttatatctgtgccattcgtggggagaaatcagttgggggtagaaaggcttaggaaccctatgctcatcaccacccctggaggggttatgacagcgaagtactatagccctgccgttcccatagaaattcagggaattccgtttccctcggatctgattcttctagacaccaagaacttggatgtgatccttgggatgaattggttggctcaattccaaggagtagtggattgtgcaagacgcactgtcactctgcaccgagggccggaacaaccggttgttttatttgcacccccaacctctgtcagtagttcagaacttcatcagataggactgttagaaatccccatcgtcagagagttcggagacgtgtttccggaagaactacccggtatgccgcccaagcgagagattgagttccggatagatcttgctccaggaacaactcctttgtacaaacggccctaccgtatggcagcaaatgaactggccgaaattaagaaacagttggaagagttgaaagaaaaggggtatatacgtccgagcacttccccctggggtgctcccgtaatttttgtggagaagaaagacaagacaaagaggatgtgtgtcgactacagagctctcaatgaagttactatcaaaaataagtaccctcttccccgaatcgatgatctgttcgatcagcttaaaggtgccacggtattctccaagattgatcttcgttccggatatcaccagttgcgcatccgtgaagaagatatcccgaagactgcattcaccacgcgatatggactgtatgaattcacggtgatgtcgttcggtctgactaatgctcctgctttcttcatgaacttgatgaacaaagtgttcatggaatacttggataagtttgttgtggtcttcatcgacgacattctggtgtactcgcaatcagaggaagaccatcagcaacatctccgtctggtgttgggaaagttgcgggaacatcaattgtatgccaagcttagcaagtgtgagttctggttgtccgaagtcaaattcttagggcacgtgatatctgctaaaggagttgctgtggaccccgaaacagtgaccgccgtcaccgattggaagcaacccaagacagtcactcaaattcgcagtttcttaggtttggcaggatactaccggaggttcatcgagaacttctccaaaatcgctcgacccatgacacagttgttgaagaaagaagagaaatttgtgtggagcccgcaatgcgagaaggcgttcaaaacactcaaagaaaagctggtttcctcgccagtgttaatcttgccggatactcgcaaagacttcctggtgtattgtgacgcttcgcgccaaggattggggtgcgtgctcatgcaggaaggtcatgtggtggcctatgcctcacgccagctacggcctcatgaaggcaactaccctacccatgatttggagttagccgcggtggttcatgctctaaaaatctggcggcactatctcattgggaatcgctgcgaaatatataccgatcataagagtttgaaatacatcttcacccagtcggatctgaatcttcggcagaggagatggttagaactcatcaaggattatgatgtgggaatccactatcaccctggtaaggccaacgtggtcgcagacgcgctgagtcgaaaaagccgttgcaacactcttggcgtccgtggcattccactggagcttaatcaacagttggaagccctgaacctaagcatcgttagccatggattcttagctacactggaagccaagcctaccttactcgatcaaatccgcgaggctcagaagaatgatctagatatgcatgggatcctcaagaatatgaaacagggtaaagccgctggtttcacagaggatgaacacggaactctatggaatggaaaccgggtatgcgttccagacgtcagggaacttaaacagttgatacttcaggaagctcacgaaagtccttattccatccaccctggcagtacgaagatgtacctggacttgaaagagaaatactggtgggttagtatgaagcgggagattgcggagttcgtagccctttgtgatgtgtgccagcgtgtcaaggcagagcaccaacgaccggccggacttctccaacctctccaagtaccagaatggaaatgggatgaaattgggatggattttatcactggacttccaaaaacccaaggtggatatgattctatatgggtagttgtggaccgactaaccaaagtagctcggtttattcctgtgaagaccacctatggagggaacaaactagctgaactctatttcgctaggatcgtaagtctgcatggcgtccccaagaaaatcgtatctgatcggggaagtcagttcatctctcacttttggaagaagctccaagaagagttgggtacccgattaaatttcagcaccgcgtatcacccgcagacagatggtcaaaccgagcgtctaaaccagatcctcgaggatatgcttcgcgcatgtgtcctagatttcgggaaaacatgggataatagtctcccctatgccgagttctcctacaataacagctaccaagccagcatacaaatggcaccctatgaagcgttgtatggacgcaaatgtcggacaccgctattgtgggaccaagttggggaaagccaagtgttcgggaccgatatcctgagagaagccgaagctaaggtcagaaccatttgggaaaacctaaaggtggcacagtctcggcagaagagttatgcagacaaccgacgccgtgacctggaattcgcagtggatgactttgtgtatctccgggtaacgccattgcgaggggtacacaggtttcagacgaaagggaagctcgcacctcggttcgtgggtcctttccgcatcactgctcgacgcggagaagtagcgtaccaattggagttgcctgcttccttgggcaacgtgcatgatgtgttccatgtgtcgcaactcaagaaatgtcttcgagtgccgtccgagcaggctgactcagagcagattgaagttcgcgaagacttgacctacgtggagagaccagtgaaaatcctagacaccatggagcgcaggaccaggaatcgggtaatccgtttttgcaaggtccaatggagcaaccatgccgaggaagaagctacttgggagcgtgaagacgagctgaaggcagcccatcccgatctcttcgccagttcttccgaatctcggggtcgagattccgtttaaggggggaaggtttgtcgcgtcccaaatcgactctaaaatacatcctctaaattatgattagaataattaaaatccatgtgaaagccttcaaaaattaaaatgtgcaaagataaaagtcaaataaggcttggaggatttttgtatatttcctaaaagcctaaaatgcgtaaataaattttagtggaattttcagagcacaaataataattaagaagaaataaacaaagtaaaaaggcgttataaaaagaaaaaccctaaaaagttccctttccctcccctccccct

SEQ ID NO: 51994 - DNA, 39209 bp, Oryza sativa
ccctctctcccctcggcccgcggccgaagtctcccattcctccctctctttctctccctctccttctctccctcctcttgggcccccttcccctcggcccagcaccctcctccctctctctcccgggctgtctctccccccccctcccggcctgcccggcccaagccgcacccccccctccaggccgagccgccctcccgcccgtgcacagcagccaaagaaatcaagtacaagatgaagaacccgagcgtaagaaagttattgtctgttacaaactgtagtacctgttaaggaagcagacatgccaatcgccaagtggtcactggagcaaatacagtacctgataagcctagcgctagtcagaagcaaccataatactcttatatcagtgttcaaatacttttgttttatagttgttccccgtcaatcatgtaataacagagaaacatgagataatgaatgagtttgataagcttatgaaggatccatgttaagagtgcaagtgctgtgagttgtgcacattttgttgttgattagggagacctagggtctcatttccgtaaacccataatctgttaggaatcaaatagcctagcgattgatggcgaagaaaatcaagtgatcaaccaaagaggcatttgtttggactaagagtttcagatgtgtctcttcggatcaaaggcaacaatcgtcagtctagcttttgacgaactacttcaaggtttctctgaaagacagcacgcccaagcacctcattgccccagaagcatcctcaacacccggagtgaagagtacctggttgagaaaggtcgaaaggtgattaatggaagagatcggaaaagatgtttggttactgggaaaagaagtaggtcgaaaggtgattgataaaggataacgagaaccatgatttgtgtcactcaaggaagactcccgatagcaaacaaccctacaacagttgccctgtcattaaaataggtgaattcacgagtaagagagatgaccacaggtagaagtacttctatggggacaaggatggaaacttttgtgacatgaccaagaagtcaataagtaaaacctgaacagtggaatctaaagctcggttcaaccttgggctttgtatcagatgctactagaatgaaagcacttgcactagtatcgctcaacgcactttcctaccaatcgatccatcgagaaagaacacatcaaggcggaaggtgcaaaggaatatgttgaatgctaaatgatgacaacatgaagagaatagtgggaagtgaaccaaatgtaaagaaagtgaatccgagttgcttgttcgtgagagctattcccagttatgaaccaagtgatatgttcgaagataatctacagaggtcagattaaaatcgcatctaacaacgaagcctcagatttggcaggataatgattagacaacaacaaatccagcagtaaagccatttgggaagacgtcaaagtatgtcaagtgggataagttggttctcttgggaaacataattcaaaggcaaagttatcgacccttgcatcaaatagcagaagtagttatcacccggagactaggaaagctaatatgaggcagttggtggcaggttagaagtaaatgacaagcatgatatgctcatgatgacaagcatggtatcctagtaatgacgagctgatctcgacgcataacgtgaaatgggtaacttctatgaggttgacgccaaaaatatgaactatgcgaagttctggaactgaagcaccatcttcaagtgccgcaacccagtcgaagtcagctaaaggttcaaccagggacaagtcaggtgaagagaagattccatctgcaacaggagattgagccaagcagtccagagtagagaagttttgctaggcaagttgttataaaagacgcgacggaagaagtcagacaagaagagaagaccgcccaacctatcttcttgctagcctcctcgaatctcggggacgagattcttgtaaggggggtggatttgtcacgtcctgataaattcatcccgaaattaaaattcattttctaaaaggaataatagaattaattaaaattcggaaagaaattggcaaacactaaaatacgtacaagaaaaattcaaatgtggcccggagaatttttgttaaattctccttggtctaaaaggagccctcaaattttagtggaattttcagagcacaaataataattattaagaaataaacaaagttaaaaaggttttataaaaagaaaaaccctaaaagaagtcttctttcccccccttcccttcttgggccggctcggcccaattctctccctccctctctctcctctcccccgcggcccatcggctcctccccgcgcgcgcgccgctgacaggcgggcccgcccgccaccctcgctgacgggtggggcccacctgtcatcgccttcctcccgccgctcccgccgctcgcccgtgccctagcgccgccgccgccgcggattccgccgcatcccgccgtccccgcgcaccataatgaggggggaatcattccccgcgattccctctcccgattcccccactttcccctctctctctccctcggattcgtccgattttgtgcccgcgatcctcgccggcgcaatcaatggcggccgagatctccgcgccggtttccatctcctccggccgctttccctctctcccgacgctatttaattgttccccgtgcctctctcctccgtttccgccgttcgccgctcgctctcaccgtcggaatcgcgctcgcgccgctttcctctctctccgccgtcgccgacgagttccggttcgccgccgccgtcgctccggacttcctcccctctcggcgtcgcctccttcggcttcgccgcgtcgtcgtcgaccccgtccgctcctccgtttcgctcgccgaccgtcggagcgccgtcgtcctcgtcgtcccgaaccgcgccgccgccttcctccgtttcggccgccgttcccgtcgtcgccgtcgaccggggtgagccgaaggccgctccattcgcttcccccttccctcctctctctcgggtgccgctccgccgcgccggtggtcgccggcggtgaccatcggggcgcgggcgcgtccccctcctgtcggccgtgccggcgaggctgcttttcgggcgcgccctcgcggctgccaagtgggcccggccgtcagccgcccgcgcccgcgggtgcggctgacgcgtgggtacccacggcgccggccgccgccagccgcgtgctcccggtccaccgtggaccgagaggctgacgcgtgggccccactcccgtggacccggtccgcgcgccctctccctcggctgacgcaataaacccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggagtttagtagagtaaaagccttttctttttcgttagtcgtgtagacgctgcagcttcggaagatccgctcttcgtggaagttgaagccggtgtttgggaaagcgagcaaggcaagtcacatcatccttgagcatattgaaccccagtttataaaattattttgatttaaattattgcattaccgctttatttaaattcccgcgttatcactgttttatttagccatgcctatttatcgttgttaagacattattattgctattgttattattaccttgttcaccctaggaaaataaaaccccaactagtgggtactctatttatggttccactagtatgaacttaggtagatgcttcgctggttaattaggcaacattaggtgattttataactttagactttgggaattctcatatcatttggacactatggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttttaaacaaaagtacacggattggagatggatgaagtcgggggtcgatggacattctccagggcaaatgaaggctacacgagctgcggcccggtagtcgagatgtcgtggcagagggttggtgcgctgctgcttggggctcagtcctgcctgcctgtcccgggggttccggccgtaggcaggattgggtcggtactcttgtctatggctaggatgggttggaaactatgtcacgtcttccgtccgtataccgtggtggtatgtggcacgtggttacacgtgaggaacacctctgatcagagtataatctattcgaatagccgcgccctcggttatgggcaagccgagcaatgtacccaagtcagtgttctaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataaaactgtgtagctctaggatcgtctttataaaatggctttgggcaactaagtgacttttaaatgctgtttactgcaaaacttaacccctatcttattatccccttgtactcccttgcattaattatgcatctccggtgtggcttgctgagtactgtggttgtactcattcttgctctatctttctccccccttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagaagtgtctcttatatcatgtttgtgtggtgtaccccggcttttcctgggacggggattaatacactagcgttcgggaaaaggcaattttcccggtcgcgacaccgcccttcctccccgtcagaatcgagcccgcgccgtcgcactctctctccgccgtcgccgccgagctccggtccgccgccgtcgtcgccccggaccatctcccgccccggcgccgcctccttcggcttcgccgcatcctcgccgacctcgtccacccctccgcttcgctcgccgaccgccggaacgccgtcgaccccgtcgacccgagccgcgccgccgccttcctccgctccggccgccgttttcgtcgtcgccgtcgactcggggtgagccgtggaccgccgtttcgtttccccctttccctcccctctctcggccgctgctccgccgtgccggtggtcgccggcggcgaccatcggggcgagggcgctgcctcccgccggccgcgccgccgtggctgccttcgggcgcaccgagcggctgccgcgtggggcccggccgtcagccgcccgcgccctcgggtgcggctgacgcgtggggcccgcggcgccggtcggagtaagccgcgtgcacccggtccaccgtggaccgtgaggctgccgcgtgggccccactcccgtggacccggtccgcgtgcccctcccctcggctgacgcaataaatccaattttaaattaaaatttaaatgaagaaattcgcaaatattcatttaaagagcatataaacttcaaatggctataacttggccatttgaactcggaattggaccgttcaagtctctaatttttccttaagaagtcaagaacccatttttgtgctttgttaatgctttttatatggagtttgttagagtaaaagccttttcttttccgttggtcgtgtagacgctgcagcttcggaggatccgctcttcgtggaagttgaagccggcatttgggaaagcgagcaaggcaagacacatcatccttgaacatattgaatcccaatttatgaaattattttgatttaaattattgcatcatcgctttatttaaattcccgcgttatcactgttttatttagccatgcctatttacctttgttatgaccttattattattgttattgttattattaccttgttcaccctaggataaacaaaacccccaactagtggacactctactcgtggtatcactagtatgattttaggtagatgcttcgctgattaattaggtaacattaggtggttttaaaactctagattgtggtaatattcatatcacttggacacattggatttgttggattgttgtggaattggattcataccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggttcgatggacatctccagggcaaatgaaggctacacgagctgcggcccggtagtcgagatgtcatgacacagggccggtgtcctgctgctagggggctcagtcctgcctgcctgtcccgggggttccggccgtaggtgggattgggtcggtactcttgtctatggctaggatgggttgggaactatgtcacgtcttccgcctgtataccgtggtggtatgtggcacgtgattacacgtgaggaagatgtgtcttatgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcctgggacgagctgggacccagggtcgggttgccagttcggtctgaatcatcgtaggccttgggttaaggcaggttcgtgtgggttcacggccttgattaataatattaaatagttctaggatcgtgttttaaatttagctttgagcaactaagggtcttttaaatgctgtttattgcaaaacctaacccctatattataactccattgtactcctttgcaattatgctgcacttgtgggtgtgtcttgttgagtacggtggttgtactcagtcttgttcaatttttcccaaacccagaagaggagcccctggaggatgaaggctttggtgtctagctcgtgcctgccgtcaagcgcctgtggtcgtcgccttagtcttccgctgtttttcgttgtctttgagtgtgctgggccatcgctgcccatgtaataaataactatttacgcttccgcttgttacactctgaattgtatcaacttttggtgtaccttgcctcctaggacaaggaataatacacgcacgtaaggaacgcccgttgggttatttccggtcgtgacaataatgatctaattataattgttaagtgcttttcttgtttaaaatccttaaattataaattgttgtttaaaaggaattattagaaatgattttaaaagcctaaaagagaagatctaattttaatttgttaaatctcaatataaaattgggctagataaaattttgttaaatactttgcttaattctataattactagatttttctgggatttatttgagctaaggaagtgtttttaataaatggaattgcatttcatgaataatttaaattgaaaaaggttttttttttttggctttgggccgaaagccggcccaaaaccctccctctctctatctctctccctcctcggcccagtccggcccagtccgccgagccgccactcttctctctcagccgctgacaggtggggcccgtctgtcaggcctgtcttcctcctcgcgccgccgccgccgcccgaaaccctagcgcaagcgccgccgtctccttccaaatccggccgttcctttccgtttctggtgaaattgattgaggggaaacgatctccgggatctcctccaccttttcccctttggaaacatcggctaaatcggtttggaatgtgtttgattcgagttcgaatcggatcggtctctttccttcaaaccccgatctttccttctcgtcgccggcagccgtgggccttcaccgttgcctcttagcccctttataaggatccccggtgtctcctctacccgccgccaccctcgcctttgcctctcgtcgtccgtagcgccctagctccgtgtgccctagcgccgccgtcgccgccgtcgctccagccgtgcgccgccgccgttccagacgtcgccgtcgctcgggaagatcgccatcgtggtcgccgtcgcgtcgccgtcctcgtccaccgcttcaccgccgccgaagaccgtcggagcaccgtcgccgccgtcgacccgatcttctccgccaccttttcctcgacgccgccgccgtccgttggtcttccgccgacgttttggtcatcggtgagttcgccgcgccgtgatctacgtcttggtgccctccgtttgtgccgtagagccgccgttcgccggcgagcatacgcgcccgagccgcccgagtcgccgccggtgctgacgtcatcgctgacgttgtcgctgacgtcatcgggaccgtccgccgtgagccggtcgtggaccgatcgatctcggccgtccgttttggatagggttgatctcggccgttcgttcccatgaaccgttgccgtgcacccggtccaccgcgaaaccctagctgctgacgcaataatcctccttttccttttcaaaaataattcattattgcgtcataattcaattaaaatccatataagtgttttaatccgatttaatctttaaaaattcataactaattcatttgaactcagtttaatgtggttcaagttgcaaaaattatataaaataaagatctacatattaaaattgtccataaatagaattaaatttatttaattctttttaaatgggctttaattagatttaatcttgtaaaattcataataaattcttatgaagtcagaatgaggccgttcaagtctcataattcatctaaaattatgatctacatgtttgtttactttatatgtactgtttatttggtttttattagtctttttcttcgttttgcgtgttagcttgtcgtttccgtcgttgcgaaggttcgtgagtgcgccggaagtgttcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgtttgcattgattactttattccttgataccttgggttattataacttgacaagttgagctttatatattggttcagctagatattagatatgattgcttagccatgcttagaaacattagcacactattgggataacttatgactcattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttacctttcgtatagcatggttcattgcggggcaccagactgagaagtggcggagataagcccacgggggtcgctggggagtccatgccttatttataagggggtgattatgatccaggaatggtgcactgcggtggattgtgttatgcaaggggtaatgtcacagcccctttccgaggtaccgtggtggtactgaggcacatggtgacatgatgtggggctgtgtcttgtgggtacagtggtacacctctggccagagtaaaactattcgaatagccgtgcccacggttatgggcgggttgagcaatgtttttcgtgattagtcccacacttctcacaataattatggatgttatatctggtaataatttgcttagctcctggattggagattagatctgtacagccgggtatggttgtttcagaatggttgggcctgagcagcatgggcgtgttgttcagtgttgattaaaatttctgattaattactccactgttttacttctcttaaatgttttgctaaatgctgcttttgcaaatgagcctatattatgccaacctttggtatctttgcgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagatttttttttttccgctgcagttttcttcatggtgaggactaagtgcctctttagtaagtatttatcgttttagatattttgatgaatctgtatattaaattgttagtttgtgtacctcggctgattcctggacgaggattttatgcacaaataagttcggaaattactagtgaattttcgggcgtgacaacttacgccatggagtaatcttaacaaaagataatctgattaaaaggaattggagaggaaacaagtctagttctttctgccacaaagatgaaactattaatcatttgttctttgattgttattttgcccgcgcggtttggtctttaattcagtttgcttcgaatattagttttatctaatagtacaactcatatgtttgggcattggataagaagacaatcacgcaatttgagatctttggtcttattaggtgcaactaccactatttggtctatttggcttttcagaaataatgtggtttttgaaaggaaaaaacatatcttctcctttgcaggttatctttttgattacacattggctccgctcataggctatccttcagaaggtcaatttgcagggtactatcattgcggtttgtcaacaattagagttagtggccatatagtagttttctaccccagcacatgggtgacgttctaggctacggttagcgggctcctaaagttctttttgtttctgctattttggatgatgagtttatcttttgtttctttcttgttggctgtgtgtactctttggtgcagaagccgaatgtgctctcagaataattgtatcacttgatgaaatttactgagattaataaagcttccattatgtaaaaaactggttctgaataggctaaaaaaaacaccattccacaatgctttgctgaaagggaacaagttaataaggtcaaagaattctcctactaatgaccatgaaactgtgttaccagaaccataaacaattacagttgctctcatctaaatctaatactgcttaatcaaaactgtaacataacatatgatgaaatagagacaaacgaggttagctccacaatcatttgggtgttgctccttaatcaaaactgtaattctcttgaaaaaaacaagctatgtgtggcaaatggtttggtcatcactcccaataaagcaacgtacagaacatccacgatctaattactgcaaagttactgcaaagtttccataatgccaaggttaggcttgttgcgcacagtaagaaaagatggcgattgtccaacatgttctagcaatttcttgttttttcccatcggatttgattttttatcattgttcaaatgactttagaatgtgtatctgcacttcattgttcaaaagagagtagtggtggctcgctagatgatcaacagtaacaacgaacaggtaaaaaagagtttaaatatgaacaactgcagatgaaagagtaaaaaacaaaggagttgggacatcacgtcttaccttgggtgatcagatgtagaatacttgtaaatcttggtttgattcttctaatctcttgagttgatccttcaggtcgacgctgcaacgcattgctagtagttttttcagtgaagctgggatgccctcctcgggcaacgatctgatttcaggacatccgacgatgcctaatgtgcagatagaagaaaggagatgcaacccttcgggaagggactgcagacggtggcactcatagaattctagatttcggagggaggtgaggagctgaagtgcctgctcctgctcttttgtgaaatttttcatccacaaatcataagtgaacctcaacctgtagagggtggaagcgaggaggctgcaaatgggggcaacaaacaccgctgagatgctgtccacctcaagcttcttaagctgttggaatgaaccaacaggtattgccttcgtcgttgacaccgctgcgaacaaatgtgctgctacggagcagcgatgattattatcgtctatatctggcttattataaatcaccaattcactgaggctgcctgtcatgacaggatcgaacccaaccactgttaagttatcacagtctactagtcgcagacgagtgagagatgtgaggcttgagagcacagccatcgactgcacgcttgactcgctgtaaatagtgagttccttaaggggagccaggaagggcttgctagtgtgatgagttcctgcctctaccatgaaccacgaagcgaaaatcttgccgcaacgccaaaattcgagttcttggagtgaggagaaatcctggaaactccctccaacctccataggtagaaccaggttctcgtagccaaagatcttgacatagcgcaacagtctgggggacgggaaacgcagttctgcttcctcaacctcttgagcttcaccggacctgttcaactcgaactttgtaagagctgggaaacagtttaatagctttgccaaggatattccggcaagatgacacttatagagattgagctgctcaactgaatggaagataacaccttcgtctacttcactgcacaacaagcttttgcatcctatgatggtaaggcttgatagggagttcagcttctggagatcggtccatgaaatgtgtgacatcttttcaattttcatgttttctactttctgtaggttatggaaggccaaactaccaccataaccatttacactcagtatcttttcttccaaatgcaacacttcttgataatctccttccacaataatatgcgttagagtggaagtatgaggcatggggggcagtgataacttggggcaatttcggatattaagagaacataggttgggaaaacaagtgatatttatatcttgtgcatgagagatacagcgctcagaggatggtggtagtagcatagagagattgggacactcttcacactcaatgcttgcaagctttgaaaacaaatggcaatgagctcccccaacccactccacaagttctggcatggcaacaaatctaactttcttcaggtgtaagaaactcctctgtgtaacaccaccaaaatctggtccgaactgacgaatgccagcaatattgatcaaagtaagttcctctagatatatgaattgcccgaaaggtggaagagtgccccaagagatgccctctagatggagagatctcaatcctttcacacaaatatcatcacataaccaactaggaccagtggaaccaccatgatttcttattccaaatgctctaagattagaaggtggctgaagaccttcaataatctcagatccactattctgctgctctgcaccccaaactagttctagtgtctttagattccttttcaacatcaattcagcaccatttgcttcttccgttgttgctatattttcaagattatttatttgtagtgctcctccaagctctttcaaataccccaattctctaagttcaaacccagtgcgctctttcttaacatggaattcttgcagcctccgtaaatacttcatctttccaatcccacgaatattggaacaaagttcttttttggcaaggaaataatgtaaattggctagacgattaatgtcgtcaggcaaaatataattaccatggcctaggtccaaaaacttcatgtgataaaatctacatattgtggctggcaaagacatttctaagttatgaggtacttcaagctttaggtatcgaaggtgaatcagttttgaaaagttgaaagggaaagatttgatagagtttacaaacataaatagaacacgaaggcattttgttttttttgaatatatttttgaaaaatatagccatattgtcattgtatcgtccaaaaaacatcaaagtccgtaaattttctatgtctatttttctcttcaaattttccatttctctctcaaaactttggccatatttatgatgtacagtgatagatatatgtcgaatagattgtgggatgttatcagatctaaaactttgtggacttatatttagagaacttttacggtacattctactgtaagtatatacttgcagtatatagaaaggtaagtttggtatttgtgaaaaatatagaaagggctgtttagtaatttgaatttgagatttatttgcacccggagttaatctcggacgggttgtttagttggtattagttctggatctcgtagtacgttctgctagagcagcagcgcttcttcggaatacattgtgcgtggcggcgaaccgattgtcgacggacgagcacgcgtggaggcagagcgattccttccaattgaaacagtatttagtacatcgtagttcagatgccgtaagccattaacgacacacatctacctccatcttgcacgctagcctgaactctgaagaatgaccaacactcgttcaactatctcagagacacacagcaactgcagagctgatgttgctgctccagtgctctgtgctgcttccccttcctctctccccatacgtgatagcatgcgagtgtggcggcgtttgatcatggtggctgtcagcggcgagccggggcgcgacgtggtggctgtcggcggcggcagtagcgcatgggacgagtccctttctcactatccagatctgactaaagaatagaatgcgaaaatacaaaaatatcccccgcaaaaaatatagaaagacaaatatacccttcacaatctattatattattaaagaaatagaaaaatgagcctctacgttcgctctcatggcctagaaattctcacattaattggagaaaaagaaaaagcagagtccatataaaaatacaatttagaaatagctgaaattcggaattaaaaaataaagaatattagaagaggagactagagttcatatagaaatataattagaaaatagctgaaattcggaattaaaaataaggaatattagaagatgagtatagagtccatataaaaatataattaggaaataataaaaattcgtaattaaaaataaggaatattagaagtagagtatagtgtccatatagaaatacaattaagaaaaaaaaagaaattcggaattaaaaaataaggaatattagaagtagagtataaagtccatatagaaatacaattagaaaataatagaaattcggaattaaaaataaggaatattagaagtagagtagagtccatatataaatacaattaagaaaaaaaatagaaattcggaattaaaaaaataaggaatattagaagtagagtataaagtccatactaaaattcggaataaacataataaaattaaaagtagtgcttagagtccgtataaaaatataatttacaaataactaaaattcgaaattaagaaaaacatgggaagaagagtttaaagtcaatataggaatacaatttagaagtaactgaaatttaaaattaagtttagagtccacgtagaaatacaattagaaataatgaaaatttagaaattaaaacaataaatattaaaagacgagtctaaagtccatataggaagaatatatataatttacagataactaaaatttaatattaaaaataattaataactaacacgtatgtaaaatacaatatgaatattacacattagtgatttcgtaaagttattgcaaaatttaaaattatgttgtcattttaatatatttgaataatataatgagaaaacatatgtgctattatatgagagaaaatataatgatactagccgcacaatctgtacgggccaccatgctagtttatactgtaaaaagaagattggatgaatccacaccgttagattatttatactgcaagtatatattgcaagtatattgtaccgtaaaactcctctatatttatgcactcttgtgacgaaacattttgtgctagctcatgtagcaaatcatgcattacataatactgactattgcgatcagttaccttcatgaggaaaccattacctattagctcatccaaatacttcaatcctattgcttcagctctatcgttttgatatccagaatctataatgcctattgcttcccaaaaacaagtaatttctaaattattaaaccggtggtcctcagggtaaagggcgcaatacgaaaaacacttttttagatagtaaggaaggtagtcgtagctaatttttagtgctggcataatgtcaacgttactttgcagatttttccactcatccatttccagaacttctgtccaacattcatgggaaaggttgttcttcaataaacgatcaacagtttttgctgctagtggggaacctctcaatttctttgaaatttctttcgcaataccaatcaagtcgcgtttgtaacactcaggtttgtcttgaccaaatatacactcttcaaagaatgtgaagaattcactatcctcgagaccctgcagttgtattgtctcggttgttttcaacatttgtgctatagatggaaatcgagttgtgacaagaataacgctgcctttggcttccccttttgtgaatggagctactagatttttccactctgcctcactaccgcatttccacatatcatccaagacaagtaaaaacatttgtgatttcaatctttctgcaatagctttttggagctgatccaaattggaagagttatgcaccgcttcgcttcccgcgcttttatcgtgaggtatgcactttaggatctcctgagtgagcctaagcacatcgaaattagtagacacacaaacccagaccttgatagggaagtaggcatctgttcttttgtcattgtagaggtgttgggcgaaagttgtttttccaattcctccagggccaactatgggcaaaaccgatagtgttccactcggaatattgcagttagtcaagtcatgaagagtttgtctaaagattatttccctcccaaacaatttatcctgcgtaatcgttgagctagtgggaggccgctccagggatgtatcccattctcctgcagtttggttaatttggagcaatctagatatacacgtacacaagtcatgtatgccctttaccactgacttgattttattggacatgtctactcgattgaatggcaagttgccaacctggtcaatgacgtcaccatgggagttggctgtatcttgcgagtcgtcggcatcatgtcgtgctcgtgcagaagaacaaaaaaagcatgaaaaccagttaccggcagtatgacgaagagcatggcggccgtggagggcatgacctcggaggccaccatctgcctccggtatgacctcatgggtgccatcaatctgatcctggatgatgaagtagtggatctcgtccaatgcatcctcggcctcgtcggctttcttgcttagatcctgcagaaggccctgtaagccaatgttgtccctgatgtccttcctcccctgggccatgtgcaatagcccttgtgtgtacttgaggtcccttttgatctcctccacgttaaggcctagctcggtgctggcaacgtacgccgccaccaagtcactggacaattgcgtcaacaccttaccgaggagccagctcgccacgccgacggccgcctccatggaccagctcgtccgatggcccggaaagttgctggggttgattgggtttgtgtattgatgggtataatgctgcctgcaggagcccggacttcagacgaggtccggatgactccttttctactagcttgggctcattcacaatgcaacaaaagaaaattgatcagttttgtctgcctcatcaaccgcccggcgcccatagattgagatgccatcccatccctctcatgggtaaggtgtaggatggtgggtttagctggcaagaatcaggagaaaattaattaacaagtcccattagagccaaattggccattaatgacttaattatgaaatccttcgcttggatgcaaccaccgtggttgcgtctggggctggttatacgtgacagagttttttaaactgcccgcgcaattgcgcggctagcacccatataaaattatatattttttaatatgattttacttaagatttattaaaaatttatctcgatatcttgagattttgaaagaccaaatcttatcatcctcgtgtttgtaattttatagttcttaaaagtcacataagttgctaccacttacttctgtcatattattctttattagcttgcttgatctaccaccgtttctattcattcttcttagaacctttaaaaattagatcttaaaaacttatagtttttagagtttatcgtcctattagggttcttttgtataatttttagaagtcccattaaatgctgccattatactcctctacaaccgtccactgcatcttctctttattgccattgctattttaaaaatcaaacataattatcgttggtttttttatattttttagaagttccaaacctttaaaaattggaccttatagtttttagagtttattattaatttttagaagtcccgtcaaacgatgcaactatactcctctacggcccgtcaaatttcggattttttaattaatctactattgggttcttatatttactcttatcaatattgcttatatttaattccaaatttaagttaattttaaattgtatttgtcgacgtttgatgtcacgactacggtatttgcatagtatggggatcgttggtaccaggatatatgcgagacttaggtaaaagagatggggacgaggatttttatataggttcgggcccctgaattgtcaggtaataaccctactcctgttggccgaagccggtcgttgctcttattcaccaaaatcgcaccagtacaatatttggggtagcctatataactgttgtcgacttggcggtctgaagtgctgactcgtagtcgacaacagagtagccttcctcctcgaatctgcatccggcgagatcaaagacatcgttatgtctctcctgatagtatccgtagacaccgtaggggactagctatgcttatctctgaagtcgatatccggcgtcttgtcttggcgcatgttggcttgtatgttgatcttgtgtcttgatctattgttctgtgtcccctctccttctaggggaccttgtatttatacccataggtgtccctttgtctaagtagaactagggaaaccaatatagatacaatccgagtagtccttgtcgttttcatgtagaactctattcatccttccttatacggaactcctcctatatccgaaggttttttccgtataagacatggtatgtggtgggccctgccaagatttagtcaactactattaggtatgtggtatcaataaccctgacagtattcctacttgaactcttcttttcttttctttcttctaatttcggtgttttttatttttttattcggaaatttaattaatcttgtattggattcctgtatggacttttttaattctgaatttaagatatttttaaattgtattccttctcgaactcttgtttttttttctttttctaatttcaaaatttattttatttttattccgagttttaattaatcatgtattgggttgctatatggactcctctttcaataatgcatatttttaattccgaatgttagctatttttatatttgtatttctatttggattcttcttttctttttctatgattaatgtgggaatttttagcctccacagcgaacgtggtgcctcctttcaaggctgttttaataatataatagatctcagtccactgccattagctgtcggatcaacctcgcgcatgtaaggggggctaacgagccgattcggcttagctcggctcgtgaaaactagtctatctatctattatatactagaaatccattaaacttcctacaaataatcctaaaccgccatatgacactcctacaaacgctcctaacttaccacatggtactttaataaatactagaaatctattaacttaataaattaatagaaaaagaagcctccacgtttagtactctcattgtctagaaaatcctacattaatagtagaaaattgaggaaaatataaaaatcgaactatagtctatctaccctataattcaccaactcactcttacacctacattactcattcatcaaatctaacggtccaaatcatccaacgcttctagatccaacggtaccggcgcacgcggggtcacactgtgggagagagattgcgcgcacgcggggtgaccggccgaaaatcacgcatgcgagcaaatcaatcgctgcctcttcccacaccttccctctgcacattgccatggagcgcgcccgcgcccccgtcccgtccgtcgcccagatcggtgccgcccctaacctgacgctcgcgctgccgcactccgccaccgcctccccctctgattcatcgccatcctcatcttccccctcggcccaccacggcgccttatcctatgtcacgccctgaagtttccccttttccttgctttaaaaattgtttaataaattgcccgaagaaattgtttaatgaacctagagctaatccctaattaataaatgcaattaataatcagaaatggcgtggtggaatttttcttgagttccccatgccctaatgcattaacaagatttttagtggaattttcagagccttggaaataattttaaccaatttaaaatcaccaaggtgcaatataaatcccaggaaaaatcctttttcttttttttcttcctcctttttctcttgatgggccgttggcccatctctctcctgcgcccctccctcttgctgggccggcccaagccgcctcctctcctcccttggggcgccgacaggtggggcccaccagtcgggtcgtccctaacctctcgccgcccgtgcctcggcagcaaccgccgctgccgcccacgccgctcctccacgcccatcccgcgcctctcccgcgctcgtgcccacgtcgccgcccactcctccacctcccccgcacgcgcgcgcgccccacaccgactgggattcaaatttgaatcccctctctctctcccttcccatcttcccacgtcgccggcgcagtagggtggtttcccggcctcgtccgctccctctcacacctataaatcgctcccccgagccccctctctcgtttcccactctcgccaccctttcccgtgcctcctaccaccgccgcgccgcgttcgccgagctttgccgctgccgctcatctccggccacataccgtcgccgctagggccgccgccgcgccaagccgccgccgccgttagcttcgccgccgcaagagctttcccggccgccgcctcacgttgctggaatcccaccggagcgcctatctcctcgcacaccggtgagtcgcgctgtcctccccatcttcggccggggtttaaagcgccgtggtcgtcgtctcctctcctaacgcctctccatcttctcctagggtgtcgccgccgcccgtccgttcctccgcatcgccggtcgtcgccgccgccttcatccttcgcgccggtcgccgtgctcgccggtgaggaaccccctctcttcctcccacctctctctcccgcatgcgccgcctccccgcacgctcgccgccgcttcgcccgtgcgctgccgccgcttccgcgccggtcgccactgcctcctgcgccgccgctcctcccctcccgcaccggtcgctgtcgccccttcggtgaggacccccttttcctccccttcctctcctctctcgtgcgcgccgccgctccccgcatgcgtgccgtcgcaccgcgccgccgtccgcgtcgccggccgttgccgccggccggtcgccggtcgccaccgtgcgccatgcccgggctggcctcggtgccgcccgtccccaaccgcccgatcggccctcgcccgatcgtggccgtccatcccatggcccgcgtggccagccacgtggtgccacgtcgacgccacgtgatacaccaccaccccggccccgtggacctggtccacggtggaccaccccctttgagccgctgccagtgaggcccgcatgtcggcgcccccctgctgacatcatctgggaatatatattgcgcaataaaccaataaggcttttctttttatagtaaaaacacagtttatcttctgaaaatcataactaattcatccgagctctgtttaaatccattcaagtctcagtaaatttataaaaatccctagaatccattaaaaatggttttgtttcctgtttcagtagtcttatagcatgttttgcttgtgtgctttgtttgtcgcgtagactggccgtttcgtcgatccgcggtttctcgaagacgttgctgaggtctcatcagtgcgagagcaaggcaagtcatgcattacaattgatcatattgtacccaatttacaaatatcccgcatttctattaaatgttgcatccttttacaatgtcatgtgggatgggtcctattactcagccatttattgtttaccttatgccattgataacttgggtatcaaaatgactagatgttggtttaggaaaatgcttagccatgcttagttcaactagtacacaaatgggtatcacattattacatagactttgtctattagcatagctttggattggtgccaccgcaatggtgttagttaattaaaatacactgaatggcgggctgcgagtgcatggttttgctggtcgcacccatggcaattaaggaccggttcacgggaaaccctgggagacttaccgtgcttaccacaagcgggagtgggtaactgcttgatctgaagtatagctcgaccctttcctaggcaccggtggcgtgggtgggcgtgatggagttgggtcggccggggtgtccggttgtccagctgccggattcaccgcggcgcacgaggggactgcccactgcccgttaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaaaagcccgcggttatgggcgatcaaccagattcaccgtgattagtctcacccctaggttagcttaatgaactagtgtagttcaggtggctggttgggcctgttgcaacgtggtgtagcgttgaacactgattggttaatattgattaattactacaattgtctttactgttttcaactactgcttttaaatgcctgctttattgcaaatgaacccctagcttcctttggttatatcctgcatcatactcctcttccggtatgacttgctgagtacagtgggtagtactcagtcttgctctcttttcccccacaccagagctgaagatcttcctagttggagctgtcttgttgaggttggtttcgtcgctgccgtcaaggattgcctgtggagtggagtcgccccgctgctgaagtcaagcttccaagtctagctcgttttattttttccgctgcatttgtaatcttttatatttttgtaagacgtggatctgtatgtcaacaattgtcgattgtgtaccctgtctggtcctggacaggggtttaatgcacattcagcttagaaattctggttcatgaatttctaggcgagacatcctagcttcctccacgcccggaatccccgcctcatcccctctcgcaggcgatcgatcctccaccctcccgtacgcggtaggcctcccgcctccgccaatcaacgccgtcgtcctctcccgtctcgccgatgggatattgacccggcaccaacgtctttctcgctttcgtctccccgcgccgacgagagtggcgtcccgaccgtattcccactttctcagttccccacgagaaaatggacatttcgccatgttcaaaacgcggtttcgctagaatgccatcccgaagacgtgattcgataaactgccaatatgaagcgtgcgtctaccgccactttgccattttcgctattttattcattttcgaaaagattttctctcctctactaggtgttgagacaaaatttccccttatcaactcagagaacacggtgagagaggagacagagaaggggcgccgacgccgctgctgccggccggcgccgcctctccgcatcatgcgcggcaacatcgtgtgcgtccgccgcggcggcctttgcatgctctgcccggcggcggagcgggtgaccgacgaggagatgatgaggggcaccaacgccgccgccgccgccggtgccgggaacgggatcgatcatcgacgaggccctctgcctgatgaagctccgcgagaacgtcgtcgactcgatgaaggccgacctctacacccccgtcgtcgccgccacccgcgatggtgtagcagaggcgaggggcgggcgccggcatgttttcggcgacgtcctcgtccatgaggtcgtcgtcatcagggtcgaagtcgaccgcctccacatcagcgtcccggcagagctcctggcgcaccgccagcgtccgcgccgacctccactcggtcttcgccttcctatggttacagatgtgatcctcaagcgcacggatataccattgtagcatttcactcgggagtattctaaggtactgtatttgtttaatcccaagggaagatatgataagagagtactatgctaatagttatatattacttatatacatcaaggtctatgcaggggtaagttaagcttaagggtagagtgacacacaactaaggatttatctaactcctacatctcctaattatagctaagtggcagtagtttagatatgttccattcctgtacttctagtatacaacatcttagtatattataactagtatacactatgtagtataacccctttaacaatgcagcatagctaagcctaagcatagctatgccctcccgatgcatcgcaaagttaccccgggttgccgagtttcttacgataacctgtcataaccctccaaccgaagtaggatacggaggtgtatccaaccccaggaaattgtatgtaggaatataaactgcgggggagacgcccatactgagctgtcaccatcagcggcctacaaatcacccagagaatatacccccaaataatgataagcggtaacctaagctccatgcttaaattactacttattactctatagccttgcaatcggtgtagagcacctgagtccccggaccatagctctcggcctagccagagcagacttatgacccggtaatcagacactataccagaatcaatgcaaatcccagaaggtttaactacacatattatactacttattgataaactaagactggtactcatactctatgattggaataaagtactgaacttgtataaagaagaatataatattgataaatggaagtcttacagagaagaaaggaaaagctatagaacctttaccaaactccccgaagcctccgcggacttggaaactattctaacactactccactagcactaatactactttgtagagagctttgatccttgcttgagtgtgtgagggaatgaatgagaggaggggtatttataggtggagaggtgccttgggagtgtggagatgctccaagcatcctaggagcatctttgctctcctcttgacatgtggcatgatgaagcatccaaagagcatctttctccctccttgtgacaagtgtccatgacggttgcttcaggtagaaacggtcataaccgccattggatgtcgataactactggcctgtggaatttctgggccatctgggctgcttttggttcggccgaaccctggtctggtccatttggcccagaacttggcaggtgtactcctcgtttattccttagcccaatggtgtgaattatgggcttgtttactcatattaattctgtattatcagcctatctatccacaagtctacttctcgacaacgtctgattgatcgttcatctattttctgtcgattctcctccatttatatgtgcttctcctgcatacatgttactagcatagtatatagtggaagtagatattttatttggaatttatgcattgcaagcatagctagtcttcatacattgggtaatattgacggtcgaaactggtcgataacgatcgtcaacagcggtggccgttggccagcagcatccaacggctagtgctaacgccggagggccgggcgaagttaaaattgatattattatactgtaagaatttgctacataatttaaaattagtagactaagccaccgcataaacattaataaccttgtaaaaaaaattacatggttttttagtcacatgatttcatatccgtggagcattcttaagccgccatgtgacacttcaagaaattatggatatttctacgaatatttatactacttaaaaaatacgcaggagggatggtgaaccaatctagacgtactgacaccgcaccccgcgcctccccctctcacgaccccaccagcgcctcctctcacgcccgcacccgtgccctaaaaacggcccgcccctgccgccacgcccacaccgccgcccctatcatgcctgccgctgccgctccgccgcccctctcacgcctgctgccgctgctccgccgcccctctcacgccgccgcccttcgtgccgctcgggaggagttgcggcggggtcgagcccctcatcgccgactacccttctccgctcgcagccgccgtcgtagcgtgcgtcgtcgtcaccagacaccagcgatcaccattccctctgtgtcgcctcgccgtccgtccatactacacctctgccgccgagcagccgccgtcgtagcgtgcgtcgtcgtcaccagcgatcactattccttcagtgccgcctcgccgtccgtctgtactccacctctgccgccgggactcagggccgctggccaccatctcattgtcaactcccccgaacagatctccccagccgcggtcgctggttcttttgctgcaaaactaaaatggtcgggagaacaccgatgcactttattttttatgacctatacttgcctgctcttttctgctcactggggatcaataggaaatgaatttcagaccgatactagcctactgttttaagtctctgcatatgctgaatctgaaagtaccagcctgctcttttctgctcgttggggatcaataggaaatggatttcagaccgatactagcctactgttaaaagtctctgcatatgctgaatctgaaagtaccacttatagtcattatagaaccaaacaggttggagcttgcatgctcagttgtgaacagatgtatttaggtgccagtcttgcccctggctgtgatgcacaatagcagggttaatcttgctaaaaagtaattttcttgaattgtatatctgttcagattaatgagccgagcaaatttctgttgcagatttggcctggtgaaccttatgcagttttctgttgcagtgttgctgcaatctgacactaggtgagttgtatctgctattccttttcctggctatttccaagttgcagtattgcaagatgataactttgttttaccatgttttctttgccacttaacaaacctaaactggtgagtctgttaatagcaaggtattctacacaatttggtccaatatggttctgtagcccttcatatatatgaagatttctaaggatgtaattatgacctaattaatttacttgtagatatagaaatttactgtcatcagatgcatacccattttaagatgtttgaacttatctcaatgtttgcctgccgctgttttttccaataaactgttgcatacaagtatattacaacatacaccagtgaaaatacacagtaaatgacatacaagtaatagtgatgacttatgagcataaataaagcgtgattcatgtgtcacaattcacatccaccagcacagaacatggcaacatgcatgcaacaaaacaacgaagcaacaacattacatcaactccatgatttcaaagcaaccacatactttactcagtaactttctcgttaaattttggaagagataaaatgttacaaaaagcacgaacgcactcagagagttgctcctgggcttttgattatttgcctaacagtttcacctcgagtttacttaattagctaaggtgtttatcatggccttgcatatcaaagataccaaaagatagcaatgtggcgatgctccattccgtgcgtcgccgatcaatcagagctgctgatgatcagctctgcttagttatatggcggatcggcactgaaataagatggcaagggcgccattgccaaattcactgaatgaggagacggcggtgggaacttcctgtggccatgcggtgggggtgcggcagctttgccgtgaggcggtggcgatggatacttgtgcaccggaggaggtggagaatgcggcgagtaacgggacggcggcggcggcggcaggtggtgagcagccgggggcggtggcgaggcttgagcagagggcagcaggtgatgaggcggcggcgaggcatgagccggggacggcggcgaggggtgagaaaggggaggtggcggactgggccgtgttggactttggacttcgaatgactggagagggccatccgaaggaatgttggagcaccaactgcgccgtgttgcagtgagctccaaattctagatggcgtcgcttataatatgggatgaagcctccatgtcaaagaggcaagcggttgaggccctcgatatgagcatgagagatataatgggttgtccgtgttctccgtttggagggaagacgattgtgtttggaggggacttcaggcaggtgctcccggtcattaggaagggcgctaggtctcagataacagatgccactctgcgcaggtcctatctttgggattgtatggttcaattgaagcttgttcgcaatatgagggtgcagagcgacgtgtggtttgcggactacctccttcgagttgggaatggcaccgaggaggtgaaacggatatttgcatgtcgtgcaaagagaatgaaacggacctcgaaaggctcatcgatactgtgttccccaacctaaacgataatcttacgaacccaaactacatcacatgtaggaccataatgtccacccggaatgagttcgtggatcgaattaacatgaaaatgattgggcggtttagaggagaggtggtgacatatcatagctttgatcgaccagaggatgacccttataactattacccgcctgaattcttgaactctctaactctaaatgggctacctccgcatgtgcttaagctgaagattaactgccccatcatgctattgaggaacattgacccagccaacggactttgcaatgggacaaggctggtggttcgtgagttcggaagaaatgctattgacgtagagattgtggtagggcagcatgctggtaagagagttttccttcctcggatacctcaatgtccttcggatgatgagatgttcccctttcgcttcaagaggaagcaatttctggttagattgagctttgcattgaccatcaataaggcgcagggacaaacaattccaaatgcaggcgtctatttaccagagtctgtcttctctcatggtcaactatacgtcacgttgtctagagcaacctctagaacaaacataaaaatactatcgatgccggtagaagacaagaaacaaaagaaaaagtctaagcgtactggcgtgaaggacaatgagaagaaaggaaagaaattgtctaaacagacagcagcatacacaaaaaatattgtgtatagagaggtcctcacagattagaaaaggtatattatgtgactattaaccatccataatatgcttgcttaaattccattctttctgtaatttttatattccaagtctaacatttcgtgtgtttttttcttggacagcagtaaacattactttcggtgggattttggcacggactatatgcaccattacgggtattgtgatactactttttttctggatgatattgatctggagcccttgcctcgcctgtaatccatctcctagggtggtcagcaaggaagagcaaaagagggtgcagtggccaagtgtagcagctttgctgctctcccctgctgtcgaccatccatctataccaggccactattagattcacatggacaaaaaaaaataggcaaattttgctacaggacatcgcgacttcgtggttttagctgtaggacactgcacaaagtcacttttggggaaagacactctcaaaatgtggttatttgccaggggacaccgcagccaataaaatattaatttctggttcaataggagagataaacagtgtaaaaggtcaaaaatgccctcgggcccacttgtcatattcttcccccaccccaaacctccctccttgcctcctctacctccaccggcgatgacgtcctcaccccacccacggccacgagcaacgagctcggcgctgggatgggcggccaacttggcgcagggggaggcggcacgcaccaacagcgcccacggcggcggcctcgccggagctccgccacgaatcaaacttgcagggttgtgatgaagaagcggaagaggcgcggcggtgacacctccgccgccttcgaccggagcgtcttccccatcctgctcgccgtcatcaccgccggacggcgctaacccacgaccccgagcagcctctgccatctcccgtcgccatcccgctgccccaagttgcgtccgcccctggtgctgtccaacgccctcctcggcgccgtccgccgccggcgcatcacgtggcgccctcgtcggcgccgcccgtccccgcgcgccgccgcccacgcccgtcgccatcctgccccccaagctgcgtccgcccccggcactgtccaacgccctcctcagcgccgcccgccgccgccgcatcacgcgactccctcgtcggcgccgcctgtccccgcgcgccgccgcccacgcccatccccacgcgccgatgtcttccgcgtgtacccgcacgctgccgcccatcgcccacgcgccgccgcccacgcccatccccacgcgccgctgcaacgccgcgcccatcgccatgcaccgccgcccacgcccgtccccacacaccgttgcaatgcctcagtagcggcctcgctgttaaaggaggaagagagaggaagagaaagagatgagggcaatttggtcatgccatgtaaaaaagtaggccccttctcgcttagtcagcacaaaaatattaatttaatgaatgaagtgtcccctagcaaataaccacattttgagagtgtctttccccaaaagtgacttcgtgcggtgccctacagctaaaaccacaaagtcgtgatatcttgtagcaaaatttgccaaaaaaataattaatctaaacatataagttggccatagctgtatacagtatacgtaacatgtaacttgtttttgtttgtctgcaaatttaaatggcaaagtttcataattagttggagttgaaaattatattttgtatagctgatttgattaccttaggaacattacaaatggttgtccacaagcacgagcagggaaagtctcctactacagcatatctgacttaatcaattccctggaagaaacaatgcttttgatctgttcttcacacgtcttcctgaccaatttgttaaacaattcaataaaaataccttctttacctatatgcacactctttttctgctaaatattaattgctattgtatactagtagtgcactatacttactttatactccatcatgcagataacccatgagccagtactggtgttttactactctgatctaccagctatttggttccttgatgtgaatgtaaactggaaggagcaatgcaagaagcttccttttcattgccaatggcactggttgaacatgctcttgtcttcctgtagaagtgttgctggcatttgtgatttctgtacttgattttactgataaaaagtgtggatcatgcaatttattgataggggcaatgtttgccggttgaaaaaaatgagatgtgatttgttaattgtgatcgttcgggattacaatttaaacagataatatgctttcagagaggagatcgggtaggttacatcaaaaggaattattctcttgtcatgaaaattggaattaaaatgtacgtagaatcgtgtgttcagctggtagaaaatgctaccagataactgatgcaacagaaacagtagagtttcaagagctattagtctaagaataattgatattgtgcaagaaacgtgattgtccctgatgaatttcaaaaaagaatttttaaagcacctccagagcttcacactgccaagaagctctctctgtatcagatgtggcacatctagcttgattagaaactagaaaggttaactccaagcagcagatctgcaacacccgccaaggaatattttgatggaatattttgcttgcttatttgcactcttggaattaattgataaaggaaacaagctatgggcctaatcggcccatataacatctgactattacggtccaacgccagaaataggaataagttcatctgaggtcccttaactttacaccgaatccgattttcgtccctcgatcggaaaaccagacacaacggatcccttaactattaaaaccagtgcagattaggtccctcggcggttttgagagcggttttggctgacgtggcgcctacgtggctaatttgactcggtcttcgtccgacgtggcattgacgtgacgcttacgtggcaattcaacctgtgggacccacatgtcagtctcacatagaaaataataaaaaaatcatgggacccacgtgggtcccacatgtcaatccaactcacccctcttcttcctcctctctccccatctccctctcttcatctccctatctctgctctctccagccgccacggaagacaacggcgcgcggcggcaggcggccggcagcaggagaggagggagcaacgcgcaaagaccggcgaggcgggcagggagggaggacgcagggaggccggcgatggccgagcgccgtgggcgggggcttgatggcgacggacggagggagaggtgcgcagccggcggtggccagcgggagagggagcggcgaccgccctccgccgcaacccgcctccaccaccgagctcgtcagcgaccgcccaccggagcgaggaggacgacagccggcgacgggtgaagaggacgaaggcagcggtctagagcagaggtcagaggagggcccccagccgccaagatgggcgctcgatccgtcgcgtttcaccaccaccgagctcgtcagcggcagcccaccgaagcgaggagctttcgcttcccttccccccattgacgccaccgttgcagcagctgaggcgccactccccatgccgccgcttctgtggtgcacgccggatgcggacaggaacgccatggccgtggccgcggacgacgtcgacgtcgacctcggcgactcccaggacccccgtgccgccgccgctaccgaggggagcagcgcacggcggacgtcctcctcctctggctgccaccgccatgcctccccgcatgtctgcatctcctcctcctccggcggccatcgctgcacgtcgccccttctccccatcggccaccgcccttctcccggccgccactgccggatctcgattgccggcgctgctccggggggagctgccgctgccccgggtcgatctgttccgcccaccgccgtcgttgatccccttttatcgccccggcttcctcctccagctcgctgctctcgccggtgggcgccggtctcgctgccccctccagctcgccgctctcgccggaagaggagcagagaggggagagagatgaagagagggagatggggagagaggaggaagaagaggaagggtgagtttgactgacatgtggggcccacgatttttttattattttctatgtgagactgacatgtgggtcccacgggttttattatttttcagggtcgaattgccacgtaagcgccgcgtcaatgccatgtcgaacgaagactgagtcaaattagccacgtatgcgccacattagccaaaaccgcccttaaaaccgccgagggacctgatctgcatcggttgtgatagttgagggacccgttgtgtctggttttccgatcgagggacgaaaatcggatttggtgtaaagtcaagggacctcagatgaacttattccccagaaatataatatctgactgttacggtccaacgccagaaatagccaaggaaacaagctatgggcctaatcggcccatataacatctgactgttacggtccaatgccagaaacataacatctgactgttacggtccaacgccagaaacaaccaggcaacgaattttttgttcttttttcgcttttgacggcatggcaagatcacgctaatcgtgattagttacaatcatcatataagttgcgccagcagcaaccgaagctcttgttgccagccctagccaccatttccacattctttgccaccatttccacgttctttccgaactatccacccgttcttacggacgtctcttccgaacggctgattagcacacaatatggagaatgcgtagccgtgcaaccatggaggtcactcttccttcattctattgtttcttgtattgatggattgtgtaaagctatcatgttgtgtatattgtcttccccatgcagaatttgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccatattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcgtgctccaccagcttggggcgcaccccacatgggccccacctgggccgggttcccaaatgaagttacaagcccataggcccattataggtgatgcaacaccttgttcctgtgattctggccacacgagatagaattcagagaagaggctggatccgttagaaagagggctccgagagctttccatcaagtactcccgggccgaaaacggaggtcgtatgcagattcggtggccgtttgaaatcagcagtgtagtaggtggccgaatcggattccagcacttggagtacttgatctcgatatcttcttgttcatccatgatgtgagcaatggttgcatccgtggtagccatggtcacatcatcctccccttcttcacggaaaaccgtcctcggtttttccatatggtgctctttgcgtagtccatttacaacaacctgtttcttccaatcaaaactaggcaaactcgagacaatttggttagcaataacatttttctctagcttgcatattttatccacatgtacaggaggttctaaatccgagcagatgtaaactctatgcacaaaatatattccaagatcattatattcaccaaagatgtgaaatataacattggttggatatggcaaatcagacttagcaaataatttctccttgaaattatcgagctcacaaaaatcatcaaactgaacataacccaaagtatttaaagaagatctcaattcacgctcctctattttattagcaatgtgaacaacatgcttaaaatcagtgcagtatgaattaacagtaggaatagcatgttcattcacaagttgtggcatggatataagtgaagcattatcgcataactcttctttatcacaaggaacagcaaacaaatcaatttgtgacaaaggaatctcagcagttggttccactaatggttgctctgctatagcatgaaaagtggacaaattcaattcattaacaacacactcacctttattaatttcagcaccattaagtttacctttgatgccctcttcagataatggaggtgcctcgactttgagtgtgatcaatgggactggcggctctttcatgtctctctcctccttttcatgattatgcacttcctgcaaatggttagtaatagaagacaaaaacatagcatgttgcttcttcatgtcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaacgtaataaacaagcttgcatatcatgatagtatgaagtaacagctctggtatcttgttttaaacattgcagtttgttgaacaaaatgtcagcataatacatgggaacataaatatctctgaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtttccctcgaaataaggcagtgcagatttgatcttacctagaacatcatcacttaccttataatggtcatgttgatccctcctcgtgtctcgacgaagatgtcgatgttgagcacagctatccccaattatcttgcatatccctgccattgttagtagaaaacaagaaacatacacaaaaatatgcgcgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtacggctgtaatcaaatatgtggagctctgggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacaataccacaagatagcactaggaacaactcatgcacaactctgatatatgaagtttagctcaaacataatagtattttctcttttctttctttcttctttcttctttctttttttttccttttcttttctgtttttttttggtgcggctttttttttctctttttttttgcacctttctgccttttttttcacttttttcttgattttttttaacaaaaactgactcaaggaccttaatgtaagattacagggactcaaacataaatataaaatttacagggactcaaatataaaagtctaaacccaaaattaaaattatacaaaaaatggaatgctgaatttatgccggttccgtttttccaaacagatctcgaaaccgacaccaaacaaaaattcgccaaggtgtttgacacaactcggaaccgtggaattgagggagggggtcggactcggccaaaggggcgagtgggactcggcaaggaggtggagtggatggcagccgaatttggtgtatgggataaaaaggaaactgatttttaaccaatccaatctactatatctttccaaaacaaacttgactacttccaaaatcagatatggtaattcaccttcctcctctcgtgcacgacacaggcacggccaaaacaaacacacacaaggatcggcaaactctagatgcaactcaagaactccaaaactaaccgacagaaacttctgaaaactacaaaaatagaaccgtggcagcgagccgattccgttttcgtaggtcctgacaacaacagagacatggtggcagcgacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaacccgag

SEQ ID NO: 51995 - DNA, 1737 bp, Oryza sativa
  unsure (1)..(1737): unsure at all n locations
agaattcagagaagaggctggatccgttagaaagagggctccgagagctttccatcaagtactcccgggccgaaaacggaggtcgtatgcagattcggtggccgtttgaaatcagcagtgtagtaggtggccgaatcggattccagcacttggagtacttgatctcgatatcttcttgttcatccatgatgtgagcaatggttgcatccgtggtagccatggtcacatcagaattgttcggttccacgaggtacaaatggatcacatacactgaaaatggtggattgtccgtgcgagggtcatcaagaaagcgtacctggagattagctgtcttctatttatgttgctttttataatttaataaacgccatgagattgttttatgcgccaaaaaggttatactacgcttctgtaattataacatatatcttgcttttaaattaatcttagaacaactatgacttgtagtttcttttggattgccagattttgttttcccgtgatcaacaaaattcccgtagcaacgcacgagcactctactagtaataagcagaaagtaagaccaagagcgggacattctacaatactatactagtttcagtccaaaaagaaaaaaatagcaaaacgacataagcatatttactaaccagcacggcctggctgtgtatctattttggatgtagaggccggtttaatctattttctaaaaaaaaccagcacggctgattggcaaaatgtcgctattggatctgtacagatcatacaagtgcaggtggatttcgatatcacgcagctgcaacctgccaaaattcaccatgcagtttgagatggaaagaagtgtaatgacagagaacgtaagttaccaaaattgtaatgatcaatataacattgattggataatagacaaaggacatccattatgtctgaaagccaaagtggctgctctgccatccagagctctttatcttcatgtgttgtcgtgtaattcgcatttacattgtcagctatacgatgatggaagaactctgaaaggttccagatgaggcaatggtgctggatagctacatcattaacaacaaacaataaaaaacgagttttagttagttcgaaaggttagagacgaaatggggaaaaaagatgtaggagttgggagagcaccttgttttaccttgggtggtaagtttgctagtggagccgtatatgtaaatctgggtttgatgcttctaattccttgacttgaaccattaaatcgatgctgcagtctcgtattcttagacgttccaatgagaccgggaagccgtccttgggcagcgacatgatttccggacatccagcgatatttagtttatagagagaataaaggcaatgcaacccttcggggagggactgcagacgaaggcacttccggaatttcaggcattggagggaggtgaggagctgaagtgcctcttcctgttcttctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 51996 - DNA, 6131 bp, Oryza sativa
accacatgggaatactgggatgctgacaatccttctcttacagttcttcatccgattatgctcactttcgagttgtatggctttgtccacaagtttctcaaaatcttcatattcctctaggagtagttgcactgtgatctcatcttttaacccctggagatacttctcttgtttgtcttcatcattttccacatcttctggtgcatagtgagccaaacgatggaactcgtgcaggtactctgtgacggtcaaatcttcttgcttcaggtagcggaactctcgttttctcagtgtgatcattcctgcgggaacatgggatctcttgaatacagatgaaaactcgtcccaggtgatggtgtgtccttctggccgtgatgcttcgtagctatcccaccattctgaagccagtccaaccaactgatgagttgcgaagacaacccgctcctggtctgtgcactgaatcaaccccagcttcttctcgactgtgcgcaaccaatcactggcttccataggttcgacggcaatggcaaaggttggagtctcagttttgagaaattctgataacttgcactgttgctggactgtaggtacttgaacgttggttgcccctgctgggttgttccaattctgtaatagttgaaaggctgttgccaacatgttggttcggttaaccacaatttggattagctctggtgaggtttcgttgatgcttttctcattcccattggcttgggttcttcatcttgtacttgatttcttggctgctgtgctggaacatccaaaggtaaaatgccgatactggcctctgtcttgtcaactggtggctggggctgaaattgagcattgacaccttgtggtaatgcactcgctggagttggagctgttgcaacgcgggctataggactgcttcgggatgcatggatgacaattcgctgaggagcaagcttctgattgcagggagttgcgtggactgacgtgctggcagctatgtctctcggttttgggtacttgtcggcgaaatgacccattccttgacaattgaagcaacatatatcttcccggactcggcattttcttttctcattttgattcctctgtcctggcactggagttaggctgaaactgtaatcttggcgaggatttgtgttgccttgatgcttctctccgttggaactggcgggttggttggccatcttcttcgtcagcagcaaactgaattgacaatcttttggtacatgatcagttccttcacaaaagaaacaagtgatcctgctcgttggacacctgtcgggtggatggtcttcctcacaatgaacgcatgtagtggcacacgagctggcaacatgaccgatttctccacaacgagagcatgccttacgttccattttattctggttgaaaccttggggagacttctcatcttcatcatctgaggagacttgatctgaatcttcactatcagacactctacctccattagctaaaagatgctctgtcaactgtggtgcacctcggaaggtatttcttctctgacgttttgtcattcctggtggaggccattctgtgctggtaatgatcatcttacggacttcatcttcagttcgcattggtgtttttcttttctgctgaggaccctcctgtcacgtcctgataaattcatcccgaattaaaaatcattcgctaaaaggaataatagaattaattaaaattcgaaaagaaattggcaaacactaaaatacgtgcaagaaaaattcaaatgtggcccggagaatttttgttaaattctccttggtctaaaaggagccctcaaattttacttgaatttttatagcaccggaaataattattaagcaacaaaaacaattaacaaagtttattaaaaagaaaaacctaaaaataaccctccttcctcctttgggccaagtctggcccaaagtcctccctctctcccctcggcccgcggccgaagtctcccattcctccctctctttctctccctctccttctctccctcctcttgggcccccttcccctcggcccagcaccctcctccctctctctcccgggctgtctctccccccccctcccggcctgcccggcccaagccgcacccccccctccaggccgagccgccctcccgcccgtgccgcgcgcgtgcgcgcgctgacgacgccgcctgaccgcgtggggcccacgcgccaggtcgtcatcgtcttcctcccccagccggccttctctctctctctctccccggaaaccaagcgccgttcctcccttaaatccacgcgaatcaatgcccttctttccaaattgattaggggaaattaaaccccattgaatcctcttcaattccccccaatttccctcttgaatggcgcccccaatcgtcgggaacggccgcgcttttcccggccaccaaccatggccgccggccgccattcccgtcgccgttccgccctcccccgtggccggctccctcttttctcatataaaatgggatcctcatcccccgttctctcgttttagccccctcccgagcctccccgtggtccctagccatctccccgccgccctcctctctctcccacgccgccggccgcctccagccgcctgtgccgcctcgcccgcgcaccggccggccgtgccgtcgcctcctccagcgtcgcagccgcctcctcttccccggcgccacctccgatttgtggggaaatcgccggaacggtgcccccgccggcaaccagtggcattggtgccactgtactccctccagccggctcctgtacgtcgccggtgcgccgatcgacgccgccgtctcctccttcgacaccgcggcatcgcctccttccccggcatcacctcctcctcgcccgaagctcgccggagtggcctcgtcgtcggcgtccagtacctcccggtctccggtcggctcctgtacgtcgccggtacgccgatcgacgtcgccatctcctccgtcgacgtcgcagcgttgtcctcacctccagctgctcctcggtttcgccggaacaccgccgtgtcgccaccaacccctccacccgcctcgccggagtcctccggccgcccgttcctcctcgcttgtttaccggtcagccgcggcaccaccacctccggcatcgcagcggcaaggtcgccctcggcctcgcctccccttcgaccgaacccctccgcggtccatcgtcgttgtctccgttcgttctcgtcgtcgacgtcccgtcggtcgcccggctcgtcgtctcgcggtgccgcctccgtcatcgtcatcgcagcggcgtgttccacgtcgtcccgtctccgtgcagccactgctggctgtccctcatcgccccctcgccggccccggtcgtcgtcgtcctcgtcctctcgtcgttcccgatcgtcgtggcgttcgtccctccgtcgagccgttctcgtccgtcgtccgcgttcgtcaagcgagccgctgcagccccgtcctcgtcttcgtcctcggctccgcgtcgtcaagccttgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaaggatccgtcctctcgcttccccgtcctcgtcctttcggtgtcgcccgtgctcgttgtgcggttgtcggccccggtacccgtgtaccggtgtcggtagtcgttcacgcgtgcgggtggtgaccgtgtagtgtccgtgttagtgtgcccgctcggtagccgcgtgatttccacgtgtgcaggccgtgtggtgtttagtggagtccgtttgtcggccactcgcctcggttgacacacggggtctgcttccgtcgacccgaggaccgtctctgtgtacccggtctaccgcggtcctttaggttgacatgtggggtccgcatgtcaacggcgcagccttcctgtcttttccaggctagcgcttacacctgttttatagttgcaaagcttaattataataatccgcaaatctccatataacagcattaaacttcggatgatcatatcttggtcatgcgagctccgaatcgacccgttcaagtctcttaatgtttgatataacctaaagaaccctgtgctttctttttatgtattgttattgcttctttataggcttgtagctttgcttgtgtgcttcgcgtagctttcgtcgttccggaggttcccgaagcgtggttcgtggttgtcgccgaaggttcggaaggccgttctctctgagcaaggcaagtcacatcatccttgagcatattgaatcccagtttataaaattattttgatttaaattaatgcatgatcgctttatttaaattcccgcgttatcactgttttatttagccatgcctatttacctttgttaagacattattattgctactgttattattaccttgttcaccctaggataaacaaaaccccaactagtgggtactctattcatggttccactagtatgaatttaggtagatgcttcgctgattaataggacaacattaggtggttttataattttagactttgggaatattcatatcatttggacactatggaattgttggtttatggtggaattggacatacacctctcttcctctttcaaaacccctaaaacatgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcctgcctgcctgtcccggaggttccggctgtaggcgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcataggccttgggttaaggcaggttcgtgagggttcacggccttgtttaataatactgtgtagctctaggatcgtctttataaaatggctttgggcaactaagtgacttttaaatgctgtttactgcaaaacttaacccctatattattatccccttgtactcccttgcattaatcatgcatctgccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattattacactatcgttcgggaaaaggcaattttcttggtcgcgacaactcccttgcatagtgcccttgctcatcacacataaaacaaatgatacttgcttcttttgagtcaacatgtggcacgtcaccatgggtccttcgggatgctggcggcatgctgactcgtggtgtgagtgcttggactgcctccaactgcacttgaggttgtatctgactcaggttcagaattggcgtctgatgctgctgtagtatctctataagcaatcggttctggttaatcaggtgttggaccagtgtcacacaactggtgtctggtgcttcattcactcgggagct

SEQ ID NO: 51997 - DNA, 15301 bp, Oryza sativa
gaaaaagagagggaatcacggggaatatttccccccactttattgtgcgcgtggacgccggaaggcggcgggattcccggcggcggcggcgctagggcacgggcgagcggcggggagcggcgggaggacagggatgacaggtgggccccacccgtcagcgagggtggcgggcgggcccacccgtcagcggcgcgcgcgcggggaggaggccggatgggccgcggggaagaggagagagagataaagggatgggccgagccggcccaagaggggaaaagggggggaaagactttttagggtttttctttttataaaatcattttaactttgtttatttcttaataattattatttgtgctctgagaattccactaaaatttgagggctccttttagaccaaggagaatttaacaaaaattctccgggtcacatttgaatttttcttgtacgtattttaatgtttgccaatttcttttcaaattttaattaattctattattccttttagagaatgatttttatttcgggatgaatttatcaggacgtgacaaatccaccccccttacaagaatctcgtccccgagattcgaggaggctagcatgaagataggttgggcagtcttctcttcttgtctgacttcttccgctccgtcttctataaccaacttgcctaacaaaacttctccactctggaacgcttggctcgatctcctgttgcagatggaatcttctcttcacccgacttgtccctggttgaacttctaactgacccagactaggctgcggtggttgaggatggggcttcggttctagaacttcttatcattcatatctttggcgtcaacctcatacaagttacccgcttcatgtcatgcgtcgagatcagctcgtcattactaagataccatgcttgtcatcatgagaataccatgcttgtcatttacttctaactcgccaccaactgcctcatattagctttcctggtctccgggtgatagctacttctgctatttgatgcaagggtcgataactttgcctttgaattatgcttcccaagagaaccaacttatcccacttgatatgctttgacgtcttcccaaatggctttactgctggatttgttattgtctaatcattatcctgtcaaatctgaggcttcgttgttagatgtgattttaatctgacctctgtagattatcttcgaacatatcacttgattcataactgggaatagtctcacgaacaagcaactcggattcactttctttacattcagtttacttcccattatcatcttcaggttgtcctcagttagtattcaacgtattcctttacacctttaaccttgatgtgttctttcccattggatcatctcccaagaaatggcattgcctggtaaccggtgcttgcacttttcactccgtgtagcatctgataccgagttgaagatttcactctttgccttcctagaaacacttttacctaggtcatcttgcttacttaatgacaaggtgactgttgcgtggcaattacaatcaagggtcttccttgagcgatgcagagcatgtttctgtttatcaatcacctttcggcctacttctttcatgctagagaacatctttgccaatctcttttatcaatcatctttcggcttacctctaacaggtggtattctttaatgtggattgcggacgcttctggggacgatgagatcctttggcttgctgcctttcagtgaaaccttgatgtggttcgtcaaaaagctgcactgactaccttcagggaaatacattgcttgctatctgtatctatgccactagggtttaattgccgatgatcatctttagtgcttcctcgagatggggagcatccaaattgttcttctgccatatcacctttgacccttttctgatacctgatagattaattaccaaccatcgactactatgttctcaaatattgatgtctcctggatcttcttaactgcttgcaggtatatccgaacttatcaatgtagaggcatggcgggtacccttatgggtttcatccaacaatccttatcttgatctgtaaaaggcgtatccaaactcctatccccaactactgtctcattggctttttaacccaacacagtttaattggttttcttttccatcaacaggttggttattaactcgaggttagaacatagttcgtctgaaatgagaccctaggtctcctttatcagtaagcaattatacacataatcacatatccacatcttccaaaagaaccctcatagaacttgtctgtattacacatttctccctcattacatgaatactaagcactgcctaaaaggaaaggtgcttagcatcggcacattgtttctgctatgggttctgattaacacgaggcctcacgggtacggcgtttgctccagtgaccacaatacgattgggatgtctgcttcgtgtaaattggcggtaatgtggagatcgactttgccttggttgcaggcagtccctcgagtaatgccctggtcctttgcaattgtagcaaatcaacgtcttctttgctgagctatccgtctggggacgatcattctgacttggagttggaattggtggttggaaatccttgctaacattggcatcagtggtaccatagttgctatcaccattggagtctttctcagagtcacaattgctagggttgtcattttgggtgccatcattgatactatcgtcgacaccttggtgaatgatgttgacattgcacgcttgatttgagtggtcactaatggggcaagaagcatggttgttggtggtatcatcatcattagtattgctaatgttgttgtctgcattgtgtccatcttcttggggcggaaactcttgatgcgcaacagaagatccggtgatctgaagtggctccgtgcgctgtctttggttaccacatgggaatactgggatgctgacaatccttctcttacagttcttcatccgattatgctcactttcgagttgtatggctttgtccacaagtttctcaaaatcttcatattcctctaggagtagttgcactgtgatctcatcttttaacccctggagatacttctcttgtttgtcttcatcattttccacatcttctggtgcatagtgagccaaacgatggaactcgtgcaggtactctgtgacggtcaaatcttcttgcttcaggtagcggaactctcgttttctcagtgtgatcattcctgcgggaacatgggatctcttgaatacagatgaaaactcgtcccaggtgatggtgtgtcacgaccggaaataacccaacgggcattccttacgtgcgtgcattaatccttgtcccaggaggcaaggtacagcaaaagttgatacaaatcagagtttaacaagcggaagcgtaaatagttaatttattacatgggcagcgaaggcccagcacacacaaagacaaacgagaaacagcggaagactagggcgacgaccacaggcacttgacggcaggcacgagctagacaccaaagccttcatcttcaaggagctcctcttctgggcttgggaaaaattgagcaagactgagtacaaccaccgtactcaacaagacacacccacaagtgcagaataaatgcaagggagtacaagggaattataacatagaggggttagggttgaagtaaacagcatttaaagacatttagttgctcaagctattttgtaaacacgatcctagagctatacaatgttattaatcaaggccgtgaacccacacgaacctgccttaacccaaggcctacgatgattcagaccgaactggcaacccgaccctgggtcccagctcgtcccaagccaacccaggccaaccattccatattttagttgttaagcaagttttaagaattaaaacactaacttgggtacattgctcggcttgcccataaccgagggcgcggctattcgaataggttttactctgatcagaggtgtacatctttacccacaagacacatcttcctcacgtgtaaccacgtgccacataccaccacggtatacagacgaaagacgtgacatagtttccaacccatcctagccatagacaagagtaccgacccaatccccctacggccgggacacccgggacaggcaggcaggactgagcaccctagcagcagggcaccaaccctctgccatgacatctcgactaccgggccgcagctcgtgtagccttcatttgccctggagaatgtccatcgacccccgacttcatccatcttgatgcttctctccgttggaactggcgggttggttggccatcttcttcgtcagcagcaaactgaattgacaatcttttggtacatgatcagttccttcacaaaagaaacaagtgatcctgctcgttggacacctgtcgggtggatggtcttcctcacaatgaacgcatgtagtggcacacgagctggcaacatgaccgatttctccacaacgagagcatgccttaagttctattttattctggttaaaaccttggggagacttctcatcttcatcatctgaggagacttgatctgaatcttcactaccagacactctacctccattagctaaaagatgctctgtcaactgttgtgcacctcgggaggaatttcttctctgacattttgtcattcctggtggaggccattctgtgctggtaatgatcatcttacggacttcatcttcggttcgcattggtgcttttcttttctgctgaggacagttccttgcatagtgcccttgctcatcacacataaaacagatgatacttgcttcttttgggtcaacatgtggcatggcatgaggggccttctgggatgttggcggtgcgctgacttgtggtgtgagtgcttggactgcctccaactgcacttgaggttgtatctgactcgggttcaaaattggcatccgatgctgctgtagtatctctataagcaatttgttctggttaatcaggtgttggaccactgccacacaactggtgtctggtgcttcattcactcgagagcttgaggtaccaatgtcctgacttctgaccttattgcctttctcattgtcagccatctgttgcaaaggtttggatagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaagcaaggaaacacacgactaacaactctaccctagagggtggcttaggttctgtgacgggttctcaagatcttcactcctgcttcacagctggcttcagtgcttcctccacttcgctagcggatcctgcagtcttccggagcttcggcaaacaactgacgatgtcttcttcttcactgacctgaccatctagtactagttgaaatccgaagaaggaagaagggagtaaaccttttgcaaatagcattaggggaaggagaaaaaaggaactttcgcaaatagttttatttagaaaatatgtccttaggttttatccacttggcttatcctacagtcgagatggctctgataccagcttgtcgcgaccgagaaaattaccttttcccgaacgctagtgtattaatccccgtcccaggaaaagccggggtacaccgaacaaacatgatacaaaaggcacatctttattatatcgataatatttacattattacaaaggcacttaaggcctgacaatcaaaaataaacagcagcggactagcgggcctacggctacatcttcacaggcgctcaactggggtataagccaggactccacctaagacttcttctccaaagcttctcttactgaagagggaaaagattgagcaagaatgagtacatccacagtactcagcgagccacaccggcagatgcatgattaatgcaaagggggtacaaggggtaataatataggggttaagctttgtagaaaacagcatttaaaagtcacttagttgcccaaagccattttataagacgatcctagagctacacaatattattaatcaaggccgtgaaccctcacgaacctgccttaacccaagacctacgatgattcagaccgaactagcaacccgaccctgagtcccagctcgtcccaagccaacccaggccaaccattccacattttagttgttgagcaaattttaagaattaaaacactaacttgggtacattgctttgcttgcccataacagagggcgcggctattcgaatagattatactctgatcagaggtgtacatctttacccacaagacacatcttcctcacatgtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttaataaaacagttaagtaattaaacaatattaatccaacgctatacaacataccctgttgtataggcccaaccattctgaacaaccaccccggctgcacagttctatctccaaaccaggaatgtaccattccaaaccaggagctaatcaaattattaccagttatagcatcttttactatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgatcgaccatcgtgaactatcattaagccatcatgaaataatagtaaatcattagttatcccataagtgtactaatgtttctaagcagggctaagcaattatatctaatatctagttgaaccaatataaataaagctcaactagtcaaattaatataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttctttcgcgaaaacggactctccggaaacgacggaatctaagcaaaaagaagcaaaatcaccaaaacagcacataaacaagcatgaacagtacatgtggatatttttaatgtgtagatcttaattttagaaaaatttagagacttgaaccaactaaatcggagctaagatgaattagttatgaatttttaaagattaaatcggattaaaacacttaaatcgattaaaattgaattatgacgcaataatgaattatttttgaaaaggaaaaagggattattgcgtcagcgggctagggtttggtggaccgggcgcacgggcggcggttcacacgaacggacggccgagattgatccgatccaaatcggacggccgagatcgatcgggtccacggcggttcacggcggacggccttgatgacgccagcaatgacgtcaccgacggcggcggcggctcggcgaggcagacggctcgggcggcgcacgctcaccggcgaacggcggcaccacggcaccaacggagggcaccagcacgtagaggacaacacggcgaacacaccggtgaccaaaacggcggcggagaaggaacggacgacgacggcgacgagaaggaagcggcggctaccttcgggttgtcgacggcgacgaagctccggcgggttccgacggctgcgaaggggcggacggggacggcggcgacttggcgatgacgacggcggtcttcccgagcgacggcgacggctggaacgacggcggcgcacggctgaagcggcggcggcgaaggcaaagctagggcacacggcgctagggctactccggcgacgagaggcgaaggcgagggtggcggcgagtagaggagacaccgggggtccttttaaaggggctcggaggcgacggcggaggcccacggcgacggcaacggcgaaggaaactcgcggcttggagagaggaaagccgatccgattcgaactcgaatccatcgatttccaaaccgatttagccgaagtttccaaaggagaaaaggtagaggagatcccgaagatcatttcccctctatcaattcagccggaaacggaaaggagcggccggattggaaagcggctgtcgcgaccgggaaaattgccttttcccgaacgctagtgtattaatccccgtcccaggaaaagccggggtacaccacacaaacatgatataaaagacacatctttattatatcgacaatatttacattattacaaaggcacttaaggcctgacaatcaaaaataaacagcagcggactagcgggcctacggctccatcttcacaggcgctcaactggggtataagccaggactccccctaagacatcttctccaaagcttctcttactgaagaggggaaggattgagcaagaatgagtacaaccacagtactcagcaagccacaccggcagatgcatgattaatgcaagggaggtacaagggaataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgattcggaccgaactggcaacccgacctgggtcccagctcgtcccaagccaacccaggccaaccattccatattttagttgttgagcaaattttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaaccctgcctacggccggtatcccgggacaggcaggccagggttgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgcgtagccttcatttgcctcagagatatccatcgtcgcaacgacttcatccatctctatccgtgtccttttgttcaggactagcctgagcaccgagttaagccttacccattagacatgtggttagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataatcaaacaattccatagtgtccaaatgatatgagaattcccaaagtctaaagtcataaaaccacctaatgttgcctaattaatcagcgaagcatctacctaaattcatactagtggaaccaggaatagagtacccactagttggggtttttattttcctagggtgaacaaggtaataataacaataacaataataatgtattaacaaaggtaaataggcatggctaaataaaacagtgataacgcgggaatttaaataaagcaataatgcagtaatttaaatcaaaataatttgataaactgggattcaatatgttcaagtatgatgtgacttgccttgctcgctttcccaaacgccggcttcaactttcacgaagagcggatcttccgaagctgcagcgtctacacgaccaacggaaaagaaaagacttttactctaataaactccatacaacaagcaggaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaattaaaaaatcgggtttattgcgtcagccgagggagagggcgcgcggaccgggtccacgggagtggggcccacgcgtcagcctctcggtccacggtggaccgggagcacgcggctggcggcggtcggcgccgtgggtcccacgcgtcagccgcacccgcgggcgcgggcggctgacggccgggcccacttggcagccgcgagggcgcgcccgaaggcagcctcgccggcacggccgacgggaggcggacacgcccgcgccccgatggtcaccgccggcgaccaccggcgcggcggagcggcgcccgagagagcggagaggagagggaagcgaaagggcggtcttcggctcaccccgggtcgacggcgacgacgggaacggcggccgaagcggaggaaggcgtcggcgcggttcgggacggcgagggcgacggtgctccggcggtcggcgagcgaagcggaggggtggccgaggtcgacggggacgcggcgaagccgatggaggtgacgccgagtggggaggaggtccggagcgacgacggcggcgaaccggagctcggcggcgacggcggagagaaggtgcgacggtgcgggctcgattccgacggggaggagagacggcgagtggcggaaacggagggggagagcacggggaacgcttatatagcgtcgggaggggtagagcgcggccggagagggaggaaacgggcgcggagatctcggccgccattgatggcgccggcgaggtttgcgggagcgattccggacgaatccgagggagagagagagggaaaaacggggggggaaagagagagggaatcgcggggaatgattcccccctcattatggcgcgcggggacggcgggatgcggcggaatccgcggcggcggcggcgctagggcacgggcgagcggcgggagcggcgggaggaaggcgatgacaggtgggccccacccgtcagcgagggcggcgggcgggcccgcctgtcagcggcgcgcgcgctggggaggaggccgatgggccgcgggggagaggagagagagggagggagagttgggccgagccggcccaaaagaggaaggggggggaaaagaagacttttagggatttttctttttataaaaccttttcaactttgtttatttcttaataattattattcgtgctctgaaaattccactaaaatttgagggctccttttagaccaaggagaatttaacaaaaattctctgggccacatttgaatttttcttgtacgtattttagggtttgccaatttcttttcgaatttttaattaattctattattccttttagaaaatgatttttatttcgggatgaatttatcaggacgtgacaaatccaccccccttacaagaatctcgtccccgagattcgaggaggctagcatgaagataggttgggcggtcttctcttcttgtctgacttcttccgctccgctttctataacaaacttgcctaacaaagcttctccactctggactgcttggctcgatctcctgttgcaggtggaatcttcttttcacctgactcgaaccagggttgaacctttagctgacttcgactgggttgcggcacttgaagatggggcttcagttccagaacttcgcatagttcatatctttggagtcaacctcatacaagttacccgcttcatgtcatgtgtcgagatcagctcgtcattactaagataccatgcttgtcatttgcttctaactcgccaccaactgcctcatattagcttccctggtctccgggtgatagctacttctgctatttgatgcaagggtcgataactttacctttgaattatgcttcccaagagagccaacttatcctacttgatatactttgacgtcttcccaaatggctttactgctggatttgttattgtctaatcattatcctgccaaatctgaggcttcgctgttacatgtgattttaaactgacctctgtagactatcttcgaacatatcacttggttcataactgggaatagctcccacgaacaagcaactcagattcactttctttatgttcagtttactttccgctattctcttcatgttgtcatcagttagcactcaacgtattcctttacacctttaaccttgatgagttctttcccgttggatcatctcccaggacgtggcgttgcctggtaaccggtgcttgcatttttcactccgtgtagcatctgataccgagtggaagatttcactctttgccttcatagaaacacttttacctaggtcatcttgcttacttaatgacaaggtgactgttgcggggcaattacaatcaggggtcttccgtgagcgatgcagagcatgtttctgtttatcaatcacctttcggcctacttctttcatgctagagaacatctttgccaatctcttttatcaatcttctttcggcttatctctaacaggtggtattctttaatgtggattgcggacgcttctggggatgatgaggtcctttggcttgctgcctttccgtggaaccttgatgtggttcgtcaaaagctgcactgactaccttcagggaaatacattgcctgctatctgtatctataccactagggtttaattgccgatggtcatctttagtgcttcctcgagatggggagcatccaaattgttcttctgccacatcacctttgacctttttctgattccggataaactaattaccaaccaacgactattatgttctcaaatattgatgtctcctggatctccttaactgttggcaggtatatccgatcttatcaatgtagaggcatggcgggtacccttaggggtttcctccaacaatccttatcttgatctgtaaaaggcgtatccaaactcctatcctcaactactgtctcgttggctttttaacccaacacagtttaattgtttttcttttccatccacaggttggttattaactcgaggttagaatatagttcctctgacacgagaccctaggtctcctttgtcagtaaacaattatacacatgatcatatatccgcatctttcaaacgaatcctcctggaacttgtctgtattacacatttctccctcattacatgaatacgaggcactgccttaaacaaaaagggacggtgcttaacatcggtacattgtattctcaacgtgaatcatccacaagcatagcaagctcactgtttatagacatgaatatatttatgtattacatggttgctgcaaactttcgattacaccatgataagtagcgaactgaaaaccacaaacatggctgctcattttgattctggagagatatagctggcattgttctagtgactgcatccttgattggttctgtgatgatgtgacaggactacataatgctatcattcacaggagaagcttccttctgattgctggttgaagcggatgacggtcttctgcttggtatcgccctccggaggttgattgctcttggctcggcctggagtaggtcggggagagacacaacttcttccatctacgacaattctttgctgaggctgtcgatgcagagaatggttgctatgatttattgccgagtcaggtgcagcaggaggagcattggtgcattgtttctgctatgggttctgattaacacgaggccttacgggtacggcgtttgctccagtgaccacaatacgattggaatgtctgcttcgtgtaaattggcggtaatgtggaggtcgattttgccttggttggggacagtttttggagtaatgcccttcttcagtgcagttgtaacaaacaataactttcttacactcgggttcttcatcttgtacttgatttctcagctgctgtattggaacttccaaaggtacaacgcagatactggcctctgtcttgtcagctggtggctggggctgaaattgagcattgacaccttgtggtagtgcactcattggaattggagctgttgcaacgcgggctataggactgcttcgggatgcatggatgacaattcgttgaggagcaagcttctgattgcgggggtttgcgtggactgacgtgctggcagctacgtttctcggttttgggcacttgtcggcgaaatgacccattccttgacaattgaagcaacagatatcttcccggactcggcattttcttttctcattttgtttcctctgtcctggcactggagttaggctgaaactgtaatcttggcgaggatttgtgtttccttgatgcttctctccgttggaactgacgggttggttggccatcttcttcgtcagcagaaaactgaatcgacaatcttttggtacatgatcagttccttcacaaaagaaacaagtgatcctgctcgttggacacctatcgggtggatggtcttcctcacaatgaacgcatgtagaggcacacgagctggcaacatgaccgatttcttcacaacgagagcatgccttaa

SEQ ID NO: 51998 - DNA, 761 bp, Oryza sativa
ctctttccgctccggtcgccgttcccgtcgtcgccatcgatccggggtgagccatggaccgcccatttcgtttcccccttcccacccctctttcggccgccgctccgccgtgcctatggccgccgccggcgaccataggggcgcgggcgcgccgcctcccgtcggccgtgccggcgaggccgccttcgggcgcgccccgcggctgccaagtgggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctccctcggctgacgcaataaacccgattttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgttcctgcttgttgtatggagtttattagagtaaaagccttttcttttccgttggtcgtgtagacgctgcagcttcggaagatccgctcttcgtggaagttgaagccggcgtttgggaaagcgagcaaggcaagtcacatcatacttgaacatattgaatcccagtttatcaaattattttgatttaaattactgcattattgctttatttaaattcc

SEQ ID NO: 51999 - DNA, 1950 bp, Oryza sativa
gggccccacgcgtcagccgcacccgagggcgcgggcggctgacggccgggccccacgcggcagccgctcggtgcgcccgaaggcagccacggcggcgcggccggcgggaggcagcgccctcgccccgatggtcgccgccggcgaccaccggcatggcggagcagcggccgagagaggggagggaaagggggaaacgaaacggcggtccacggctcaccctgagtcgacggcgacgacgaaaacggcagccggagcggaggaaggtggcggcgcggctcgggtcgacggggtcgacggcgttccggcggtcggcgagcgaagcggaggggtggacgaggtcggcgaggatgcggcgaagccgaaggaggcggcgccggggcgggagatggtccggggcgacgacggcggcggaccggagctcggcggcgacggcggagagagagtgcgatggcgcgggctcgattccgacggggaggaagggcggcgagtggcggaaacggtggaggggagcacggggatggtttatatagggttgggagtgagggagggcggccggaggagaaggaaaccggcgcggaagatccggccgccattgatggcgccggcgaggtttgcgggagtgaatccaagcgaatccgagggagagagagagggaaaaacggggggaaagggagagagaatcgcggggaatatttccccccactttaatgcgcgcggggatggcgggaggcggcgggattcgcggcggcggcggcgctagggcacgggcgagcggcgggagtgtcgggaggaaggggatgacgggtgggccccacccgtcagcgagggtggtgggcgggcccgcccgtcagcggcgcgcgcgcggggaggagtccgagtgggccgcggggagaggagagggaggggagggagctgggccgagccggcccaagagggggaggggagggaaagggaactttttagggtttttctttttataaaacctttttaactttgtttatttcttcttaattattatttgtgctctgaaaattccactaaaatttatttacgcattttaggcttttaggaaatatacaaaaatcctccaagccttatttgacttttatctttgcacattttaatttttgaaggctttcacatggattttaattattctaatcataatttagaggatgtattttagagtcgatttgggacgcgacaattattgatcaaataattactgaactgttctttgtatcatttaggaattgagctctgaaaaaatccgagaaaatttcagagagttgacttaatcatggagaatttaataaaaattaaatccatccatgctttagatttaagaaattttatttcccacatttaacttcacttgtaaaattaaagaacacttaatataaattctattattaatttattaaataatttataaatcctgaaacgaaaatcaggatgtgacaaactaccccccttacaaagaatctcgtcccgagattcggaacggctagaaagaaaaagggaataggtaaactgcagtctatcttattccataactccgataatcattctaaagctttaaagaaaactactgctgctttgaaactggtggctgagctgtaacacttgaaaacgcaactcttgaagacgcaactggcactgcattggctcctgtgacaacaatgttgttgacctgaccttgcgactgctcactagtagactgtgataacttaacagtggttgggttcgatcctgtcatgacaggcagcctcagtgaattggtgatttataataagccagatatagacgataataatcattgctgctccgtagcagcacatttgttcgcagcggtgtcaacgtcgaaggcaatacctgttggttcattccaacagcttaagaagcttgaggtggacagcatctcagcggtgtttgttgcccccatttgca

SEQ ID NO: 52000 - DNA, 1706 bp, Oryza sativa
  unsure (1)..(1706): unsure at all n locations
tcaccaatgccataaaacatattgtgtcagtggttatgaaggaacatgctgaactttctcatggtcttaccaatctaggatcagtatttgacacaactggctcagccttatcctcatttaagagcttcatgcattctccattatttagtctgtggagagttaataacaaaactagttctgtgcttggtgtcaccgaattacttgatgaactcttagaggcaatttctgagctatttgctcagttctctagtttgatgaacaattttgatggagacaatcctagtaaaatgttgccagtgccttttgtcagtttgtcagaggacctacatcctgacaacagaagtagttttgttgatatggatcttgatatgactggctctggtgaagtagatcctgtcacagcaggtggaagtggaagtatgggtatctcaccacggcctttggagtgcaagctagaactagtctgtattatttcaacttttttctctgttgtgccgcttcatacctgggaagtcttgtacaacttagctgacaaagaggtcaatatcaaggtacgaagttgcagtagtatccactaaaatatccctcttgtcctttgcttcaattgtattcttggtttattatttccatttgcaggttggccaggctatcttgcttgaacttgcacanatatctctgcctcatcaagtagtttatcttctgtggtactgtcttgacttccattaaatcgtacttcaatctgtggttgtgctggtggtcttgtgagttttatccactcaggcatttatctgattttatccttttgcttcggtcatgcagctcaatcttgtagttgatatgtgggaaagaagtgcttgtacactacttagctctgcagattgtttagcacatgtccatgccttgctaaggaatttgacagctaattgtgatgttgggcataatactgatggaaggtcacaaggatgtaaagtggcatccaatgaggttgctatttgacatatgatacaatttagcatgtttctgttagccttcgctaaatatttctcttaactttataacttttgttctgtgacaacataccttcagttataggttttcatgagtgaacaccagttttactagttttatacagttggtgtctttttttaataactagctaaatacatgtgctttgctacggatgcatgcactcgtccctgtagattttagagattgactagataaccacaatatatagaaatactatcttgtagtaatatggaagtacataaggagtagttggtaagaaaatataaaatagagttggtggggtggcaaattcactgcctctaccaatctaccattgccttcttttagaagagtatagagtatagctatagatataattaaattactcaaaattaagtactatttgcagacctggcaatcacagtcaatcatgttattggatggactgctagttcttttgcacttaaatacatgctgaacaagaaatacagttagaagaaatatctaaggtgtaatttaaacaaaatcattttctgctgatgttcacttggtcagtatactccatatattatgatttttcatcatgtagtgatgtattaaagcgccatttcagagcatatacacctttcttgaacaacagcatatttatcaatattttttttttgtgtaactggatcctttctccaatatctagtagt

SEQ ID NO: 52001 - DNA, 708 bp, Oryza sativa
aactgttacgaaagattgatatacaaacatcattatttaatggttaaaccacgtgcctccacaaggataataagttactgacctacagaaggtttctctacactaaatttttcgtggctgttctgcttttatttttctatttgtgttgtttggctttcgttcttttcttgatgaagagtcgtcagagaagcaggttatttatagtaattcgatccatgctgttgcctgtaaatctttcagtttcatcatatttttgaatcattcatatgttttgctgtattttatttatcatatacaggtgaaagaaatgtttggctttaaatcggatgagccaaagaacttcattgaacattgctgctcatggttactttctttccttattctgaggggtgagactgccgatcttaattggctatccaaggtgaatggatatttgttttaatattggcagtcatgtagttcaatatttgttgtgtttattgttattctaaaattctggaagcttgccagttttttatttaactgtcaccgtgttaaggactaggatctccatgtggaactcctaaatatggtcctaacttgttggtttaataaacttttatacccctgatttttttaacttaactgtagaaagtggtcatactgtgtaacatgtcaaacaccaatttcccttaaaattatcaactgtgaagtattttcccttttcaa

SEQ ID NO: 52002 - DNA, 1023 bp, Oryza sativa
aattcggcttactggatccttgaaataaatgaaacaagggtttgttgaaaaatagttctaacttcggaccaatagaaacctgttacctaacttctcatatacaacttatttctccatgctttagttgcttaagagctctgcagaatggtgattccgaggagttccatgtgaagctttctaactccaagatggtatttaatttcatctgtggttcacttccctctgttggatttattgtgaatctagcttctaatacttattattttatccccttttaggatcttgtgctggctctttcaaatgctagcaaggagagcacaaaatacatccattctactgttatcaaactacaggtactggcttgttatcttacaatgatatacttgttgtgatacttggtatgaggtacattgttactctcttttgttattttatagatgttagatcatcttactatggcttgggacctacgatggaaattctgtctcaatcagacatcaaagtcttatgttggaaacaaggatttttctccagttccaactgttcctacaaggatgcaggtttgtttcacatctgttgtagtcatatataatattttggctagttctctcattattttgtttgaaataaatgcgactcaatttacattcagatttcagatgtaagtttgggaactgttgtgtgtctatatctatttatgtaacctttttaggttgccatgtgcaagcgttcgcgaaaaaggttgccatgtgcaagaaatacccccactgtttcacagcattatacatgtaacactttagcatgcattgtctgttcttatggagatagttctgacatgaacttctgttcaaaatagacaattggtttccttcacatacatgtaacactgtcaaatgtgcatcgaggttgatacagaccagtcactgtcttatattgacttttgtatcctcccactgattgtaaatcactttggatgcctaagatagtagaatagctacatgtacatgttctttttcattcccc

SEQ ID NO: 52003 - DNA, 1852 bp, Oryza sativa
aagttcctagactctcctcttctttgatctagcctcagagcctctaaccatgtaatagtgacgcagatggttacatgaggttcctaccctctgttctcatatcatacattcgtacccaacaaattaagtactagtagtactggttttaaatgatcagtccatgtagcctttccagtacacatttagttcttaatcggccttgtctttttaatatttgttgataagtcatcttttaatattagtgtcccgttggggacaaaagagctctatagttctagagaatttgccctgtttcctataaaatccatgtaaaacaaataggactaaagttgcccatagaattgttatcatagctttgaaactgggaatcgctcgaaccagcaagcccactggttcactggtttcgattggtggttcctatataataatattatagtggtttggaaaaataaaacctaaagtaagctgcctttgttgataatattacacatattggtttatatatattgcttatatgttgtgaattatctgtgatccatgaagttcatgtcctgcctttacactccagcttgaagaagctaaactgctgagagctcaagggcagcatgatatggctataaatcttgggaaatacattctaaagaaccatcctgataagaagaatgtatcagatgtctatcgattagtcggcaagtggttggctgaaacaagatcgagcaagtaaccatttatttttactttgtgctttgcacttgtttcatgtattgagaactgttctctattttctgtttgtgatatatgtatatatatattgtagttcaagaactatcattgatgactacctaaggcattccgtagattttactgaattgcacaagtgcccagacaaaaagtacaagtctaggcagtgccgaacatatttccatctagcgcattacacagatggcttattcaaaagctatgaggaaagactttcatccaacgaatggcaagcagctctgcgattaagaaaatacaaggtaaggaactaagtttgacagtggcatcatatcgatatcgaacttgaaactgtatatctcaatacattttctatttaatgcagtctaaggagctggatacactgatgaaaagacttaaaagttcatcaaaggtaagcactgcattttttcatggtgtctgaaaatgtcaaggagcatgggcactgttggctactgcatactaatccttaaaattttcagagtgaaaagactgattactcagtgaaaatccaagagttacagaaacaacttgcacttgacgaagaagaggcagggaagattcaggtgtgcatgtgtagtttaaagtatataaaatatgcctctcatgatgcattcagtcaaattttcaatacgcctatctggtcacagacctatccaacatcgaggtcctgactccaacttaaatatagcatttgctgctatcacaaattcatcacgcactatatcaatagtactaaccagatcaataaccatatatccacaaatattgtgcttctggccacagcaaccacactgttcatttttctatgtgtgcatgatgcggtgttctaaaaaaatttctaacaaaaacacctggatgatattttatgccttcacagtgcacacatgccaaatttagcgctaaaattcaaaaaagcagcaaggtaacaaacattattgccactatcatgcatcattctcctgtactactcttttcagttatccagaacctgcatcatgtgctattgtcttgtactactccctttttttttgtcatcacaagtatttaatatcgacaagttggaccttgaaattatgcatgtgcatagaattac

SEQ ID NO: 52004 - DNA, 2024 bp, Oryza sativa
gtatttggatttagatctttatagacataagaattttgagattagctattgttgaagctacacctggtcgtgtggttgatgtcgtcgtagacttgtagttctatggtacttaaggggagtcagtttgatgtatgttctggtactggcagggcaatctagatatgaccctgtgacaggctaaattctaatgttcaatgtttgataacaataccagtttctaggtttcgttaatcattgatatttgtttggagtaaattccccaggcatatactacaagtaacaagtatgtaatgactctctagacctaggcccttgatattataatctgccttcataattgaataataaaactctgtaaattatccaaacatactctgttagccatgaaccaaatatcactgcaagaaatgtatatgtggattaattttttaaaaaaaacattcaaagaatttatgcatagctgatgtattctttaccttttctgatggtgcttgatttcatccctgatttattcttggttttcctgtatatgatatttgcttggttgaattggtgagtcttaagctttactggatctaacatgatttgctttcgtgtacaccaggtgtctgtaatcatgcttttcacttccattgcatcaacaggtggctcaagactcgccaagtgtgcccgttaagtaattgcagttcctgtgtatgatttccttctggagttaagtatggtgggtgtgtgctgatcaatagcccttgttccatcttgcagataacagtgaatgggaatttcagaaatatgggcactagacaccaactgctgtctgcgcttgtttgttgccacggctgcgctacaaacacaagccgtatcatctgccgaacagctccatcgttagcttcttttgatgccttacatctatcgctggacgtttatcgtgcgtacttgtcccatacagggattgtgtttggatgatttgtagagagggtactgtatggcataagatccttcatattaatgttctgtgggtcacatatcaacttgctattattgtattcagcggttctctctctattttgccttaagctgtggtaccattttaagtccagtgcttgcttttgattgcttttctgagctttccaggacatggaatcgagcctgtgaatgtcgtcggccggtttatcctttcgactaataatttaaattgtccagtgttggttaggaatggagtatcagattctggcggtttgcatgctgtttggtcggcgacgtgccttatcctgaagatttatatatagtactttgattgatgtcaagaaggaaatttctttaagaaactttttacaaatagcgattggtagaactgattaacaacatccacggctcagaaaaggaacgcaaacatatttgattcttccctaaattaatttgccattgttatttttacttgaccatccgtcaaaatttacatgaatacacaacgcacggacgaacgatttattcatgtgaaggcatgatttacatccttaaaattctctcgcatctagatatagctagagagtggccagctgctgactatgcatggagctggcacggcagtagtgtacaatgctactgtaattttgtattgctacaagtactagacaggtacagggctgaggccagtggatggctgtaggctggcagcatactccctcgcccacagatcataatgtatgatctcctccagtgatggccttgttactagctcattccgatgagcgtcgcatgtcagctccaccaccttgaagatgtccaggtacccgatcctgcaaaaacataaccacaatcatctattcatttgcttatatatatgtaaagtttatctgacgggaaaatgtctacttgcaaagaaatagccgcggaaacattaattcaccagattaaataacttgcaatgaagttttgtcagccattcaccatttagaaaacaattcgcccttcgacaaaaacaaaccttttattatgcaccaatggataccattttggtacttacc

SEQ ID NO: 52005 - DNA, 727 bp, Oryza sativa
ataagattggtatccgcatatctggccatcccagttgagccaacacagatgaatcttgaagaaacagaacttcatgaatacttgaaaaaaaatattaagccaaacgtaaacatgaaaatacggttgccatatcaggattaagtgtgcatgcattaacagtttaaaatccactgcagttgagcataaccgctaaacattttccatagctgtgctgtaggactcacctgggtttcaatcatagagtgtatgatagattgtgggtggatcacaatttcaatgtcatcgtattcagcaccaaataaataatgtgcttcaataacttctaaaccctgtatgaatcaagtgatcattttagtgcaaatactgccaacatgacctcagtaaaattctgaaagtttactgcaaacaccttgttgaataatgtagcagaatctacagtaatcttcttccccatattccagttggggtgctttaaagcatcagcaacttttacttctttcaacttgtcaactgggccagttccttacattcatccatggatataagatggagtccaatgtccagtagaaaaacatatataacatgtatgtcagtagatttacctgaaagcaccccctgatgcagtcaaaataatgcggcgaagtgctccttcgggcaagccttgtatacactatgatagtagagggaaactgcaaatcagcatataatagaacaacagtaaactata

SEQ ID NO: 52006 - DNA, 883 bp, Oryza sativa
ccacaagataggccattgctgaaaaaaatttctccacgcaattcatttcaattgaccttagcagacagtgaccaaaaaatactgacagaactacaatggtagctggttgctatgtttacttcctgttgctaactcatcagtttggtgatagtctaaaaatgtgagataataacactgtaaagcactatgacaagagataaaagtatactgcaggcattattccaaaccatgtctcctttgtcccactaaacagaattgcttacggtaggtaacagatagtgttctacgatatggtcaaatgccagtagcccaactgttttagtcatactttgcactagctgttactagcaattgggtacacactagttgctatgcaaatacatgtactaatcatttccctgaaatacatatgtagtcttgctaatgaagacaaacatctagggcacttatgtggatcacaaattaacacacagatagacatcccatgatgcaagtttaaatgagcagattcatagtacataggctaggagaaaaagataaaataagaaagctagaactttgttggtacttgaaagctctcaaacaatacatggtaaatgcattcttgtaaaactttctcatgcttaaaatgtaggaataagaacatacagcatcttgtcgcaggtcatcatttccagattttgcgagttggcgatatttgttaccatcagagccaatacattcaataaccttcggagcattaattccattcattaccctaccacaatggaagagtcccaacagttaataaagatcaaaaggtaaatcttcagtcacaagtaatgggtaaattgcagaccaacttacataatagaatctgctagcccattaaaatgtggaaagg

SEQ ID NO: 52007 - DNA, 702 bp, Oryza sativa
atccacaaagccaaacaacctaacaacccaacttacggctaaccggcaacattttattatattacttgcaatgatttgatttacaaatttccagtacatatatgtatttcttcactcgtgaatacgcaagagattgtatctctattaaacaccgaaaacggcacacaaactattttttgaaagaaaaaacatatactcctagtttgttttaatttattctctttttacttgtaaaaactgcggatgtaacaacaagccagatcctttaaacttgctctttgtaatctcatcaatcctccttgccatctctggcgtcaggtggtttctccaatctccgaccacgccacgccggaagaccgtgttgtttgggacagtgctatcgactatggtgatcgttcccgaccgattcacctctaatccggacatgttctccaatgcgcaggcctccacgatattcctatccacccgtgcttctgctcctccgtcgtgaatggacatccgacaaactcggcaaggcgtctcaactggccgagcgtgttggcgacgagctcatcgtaggtcaagaagagcacctggttcggcttctcgacgtgccacctccagtagccgaggatatgctcccagaacggcccaaactgcgagcgccatcgcagaattgccggtgcgcctcgtcgatgtcccacggcatgaacctgttccaaa

SEQ ID NO: 52008 - DNA, 705 bp, Oryza sativa
taattgtttgggtaggctaccagagaggtgtaatggtgcgggtttaatatctgatttatcagttgctctatgttgggtgcacaggtatagagtacttcctccatttcatattataagactttctagcattgcctacattcatatatatgttaatgaatctagacatatatgtgtgcctagattcattaacatatatggagattgaaatactcttgtgcatatgcgtcccatgttcgtgtgccctcattccatagcctttcgaagtcatcgattatcggttcaaggaacacatcgatatcgttgccaggttgtctcggtccttgaatgagcatagcaagcataatatactttcttttaaagcacaactagggaggaatgttatagttaacaagcagaactggccatctactgtgacgactgctcaaatcaccaaatggattaatgccgtccgtacacattgcgaaacgcatgtttcttgggtcctttaagaattcctggtaaatcctattgattgtcctccactgtactgaatcagctaggtacctaagcatactatctactttccgttcttcagcatgccagcgcactagcttagcttgttccttattcgtaaacattctcttcatacgctccgcaattaggagataccacaccacctttgcggggcctcccctatttgacttacttccttcacctttcgctctt

SEQ ID NO: 52009 - DNA, 5864 bp, Oryza sativa
  unsure (1)..(5864): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaggcataattgttatgttgttacatttcctatgggatgttattttgttttcagtagcaggatcagacgtatatgtggggtgtagtatttttttccataaatatagtttcccaggtcttgtattttttttctgctatataaataaaaatatcatactatcttgtatgggttgtttaaaaaaatacagttgatactttttgagttttttatattaactttaaagccgctggtaatataaatacaaaagttttattcatgaattatatttggttgcttcgtttattactctgtcacagaatataaagactttttttagagttgctcctttattagttttttttttgggctcattatctgtagctcaaacagtcaaagccacacataagaacaacggtggagttagaaatctaaatatttatttactaaggggagtcagtacttgatggtactaattatgtttaaaattcaatcaagatatagttattgtcattgaaaatctaaaatcatgtgggaggccttcgctgactcgagaagttgagatgattaatcctcaaaaaatcaccaataaatctacataacgccagttcggtcaggattttgcacatcctcgggaattggcagtaatttgaaccatcccaaacaagatctagggctcctttaaggcaaaggaaaactagagaaactagccgggacccgcgcgttgccgcgggtgaaatggtgggcataagagcaaagtattgacatctcatgtagctcctcagagctctacctaattatgtcaagtattagcattaccgttacagtcaaccacaaaatcgaagagtacctcagtaatagaacagttaaatcgaagagtgtacttcagtaatagaactggcttcttttgcccaaaaagtactgcaaggtatacatgctttagctatgttattattgctgaaacatctttgcttgtcacaccaccggttactaatcagtttatatgtcacaccgctttgattgctcctttgggaaaaccagtttgccaagtgctaatttacacctaaagtttagtatctactacgtatgttctaagattaatattttacacttagattggtatctatgtgttaagtgttaacggtgtcaacactatgatatgctctagtttacaactaaagattagcgcctatgtaaattaccagaaggctatatatcaagctatatgaatctgaagcaccacataacaaagacatatgccattaattttgtcaaatgttgctggaatatatggtccagtagaaatagaacaataagttagataatggagatatgtttcactggactaacagttatccgatgcattttgagctttaaagagaatataagatggatggtattagtagtttactaacaaattgtgcttctatcatcttgtttcggcgcaaaaggaacagtacatgcagttggctacaatgagggcatgatgtgacaaacagttaatttgaggttccaaatatgaagatatcgatagttcagaaataattataagtatgtgctagaagagatcatgaacatgatatatgctattcttgccaaattcctatgcttcatctttcatagagctgcagagaccaaggcagtttgctcaaaagtaaaataaataatttaagatgcacaaggtttgtagatcaaacctttagtttttaaactgtattacaccaacagtgacaattaatccctatacacagatatgtacagttgtacactccgatatagagagatggggaagcaagttggttgactgcacatatggttgtgttcttaacaaaacctagctataagaatgcatcatttcaactgcataaaggaggaagatgcacgtatctttttaattcaatgttgttgcccagttgacatattaacctgaaaaaaaaaactgaaataggaatcccacacccatggtaccatttgtttgacccatccaaacacatggacctgcttaccatgcataagaatgctgaggacaataaaaatgtatgcattatagaatcctaacatatatagcattagctggtagcctggtacctccaacaacctagctcttttgagtcaaataagtttccttcttcatgctaaatcagtacatctcatgacatgacattttattaaccattcgatattcaatattgagatttgtaggtagtttttttaaaaaaataacataaccgagtaatttccagatatctcaatgtaacttagcacataatataagaaatattaaataagtggagataaccatcttgtacatggattgaaatacctgattataaattatagcttgttttactaacttgctgcagccatacatcaagaaatcaaatagtagtacattgcaaactctgagaaatcaccatgtgggtgctcaccggcactgagatggtcctggctcatgccacgctttatggtagaatttggttgaagatagcaaacccaatgctgggaggtactgttggcgatgccggattcaggactaatgaattaagttaggaatgatgaccaaatcaatgaagaacaggttacttaagccccatctatcagccattgctattaattccattgaacaactgtgcaaaaaaaaaaagaggccatttttggttcacgaagatccaaataaatcaactaagtatttaggtataaaaagtatacggtacaactacaacagttacaacctatgctcaacatccaagttgttatttgcttgccatagtggtactgcaagccctgaaagccacaggatggtcaactcatgccaaaaacatgctgaaagctgaaaaatttgcagaatgacaacatagaaaagaaggatatcactatacatgagaatttgtagaacaattctatggttaagagtttttcatgtaggtccaattacagcaagtattcaaaaagacaaagtcataggcaaaatttagagcaaaccttgtggtggcataactttatattttgcatgtcccattagtatttcatcactggccaagtttactctcgcaaaatttactccaaggtttagtaatatgcagcctgttactacccaatagtaacttgcaaaagacataccaactattgggcattgagcacgaaagtaagaaagaaatataggaaccccattgcaacgaattcagatcctctgcaacaggcagtcttggatgatattgcacttctgcagaagaggaacaactaaataaaaaataatgtacagagaagattgcatgtaaatttaataataataacaatttggtgatttcctattttcatggcccacacaagaactgaatagtagctcctgaaaatattttgtagaaggaaaaaaataacctgtgcacgaaaggtcatgataggcatccatgcttaactatctgttctttatttgagaagttgtcaaccatctgtcctaaaagtgtggtggttggaaatgtatggatggcagcccatagtcaatgaacgatgtttttaatatcctgcagtggttcactgcgcaatattgtcaatataactatagaagaatcaacttggatgtccctagatgaaattgtgaacatgagatccaaatcctcctaagcaaataaaagattgaaactgatagcaagaaagaaggggaagcacctaagagaattcatcaggagcagctgacgagatcatgggacctgcatgaagacctatcaatcaaatcaggaaaattggacacgaactggaacaaagaatcattaaatctataacctctcattgagaactgacgcgacgaaaagacggcggcaacggcgctggcctgtgcttccccgagaagcggcagtgccgaccagctctgcgaggaggcggcacaagccgttggctccgcctgaaggcagcggtggccggcttcggaagaggagggcggcggccggttgtggcgcttgcccgatggctccgtgagaaagcagccagcgccggctagatctgtcgcggcgctggtccttcgctcgctcgacaagaacctggcggcaccagcgagggcggcgaagccagcgccgtgatttccctcgctccgcaagaacgcagcggcgccggctagggcggcgaaccaggggaggatttggggatgagaaaaggaatcagggaggatgattcacgaattaacttgagaacctgggtaaggggacagagaggtagatcaggatagcggtggtggcgccatgcttcgtagccaccacagtcgccgaggtccggcggcgacgggccgaaggaatcaatccgcaaaaggcggcgacggcggtgacggtcgggcgtcgcgggaggaagatggcgcggcggtgacagccgggcgccgcgggaggaagacggcgccagccgagcatcgcaggaggaagacagcgctgcggcatggtggaggaagacagcgcggcggcggcgccgagaagacgaggatttggggatttttggcaaggaggcggcgaggatgtctaggcggtggctggtgtggtgattgagtggactgaggggatggagggatgagcgatgaccatgtggacggctggatggaatcaccagttggacatctgacggcgcatgcatggcgagggactgtagtactgtagcagcatttctctggcctgagatgaatcgcaacactgttgctagtgggtcacgaaaactaaagatttgatatgatatgatttgggaggattaaatttgtatggcaaaaaaaaaatcctatatggttctttggaacaaaggaatggttcttctcaattcctttaaaattcttatggaacgggccatttcgagctcttttgaaatccaaaagtccatagaagtgctggaggaagagtagcatgcatttctgtcccatgttttttttcttcccgtgacataaagttctagtatttttttcctgtgttatccaaacggcaatttttaaaatttcccaaggtttttaattcctgtaggaattgaataggcatggcactttattgctatgcttttcctcttactgcgtttccacaatcctgtgttccaaaagagccctagtcatcctttggaatggaacaatgctggaggatttctcaaaaattgaactagtttccgcggaaatcctgcaaaattcttccaaaaggagaccctaagctgtactgtttagtgatactcaaacaaattctgcagttctctatgtcatagttgtcttcttttttttttgaagaacatttttactaccatcaaaacaaacacttatagtagaaatggcaagagtcacaaggcagagtgatccaagcaaattgtccgagttgaaatgactcgtgtacgatctctcactctcctgaagtcctgattgttagaagtataatatgttagttagatataagagtcaaatacaaatatagagataagatatatcctagagataaaattctagagataagatagagtcctagagatagaatcctagagataaatctactcttacttgtattgtactccaagtctctatcctctatgtactcc

SEQ ID NO: 52010 - DNA, 21543 bp, Oryza sativa
atcattagatgtgttttccattaattatcattagattaggggaatgttaaaagtataatatgttagttagagataagagtcaaatacaaatatagagataagatatatcctagagatagagtcctagagataagatagagtactagagatagaatcctagagataaatctactcttacttgtattgtactccaaagtctctatcccctatgtactcctatatataccccatgagagagtcgatgtaatagattagaaaacaacaaaatacaacagtttagatttttccacatggtatcagagccaaagaccaacgttgcttgatccgtttctaccttccgctcgcgccgccccggggagatgagataatcgccatatcctccctggggcgccacatctacaatcctcgggagaagagaaggagcggaagccacgccagtatgaacaggagaaaaaggaagcaatgcatgaatcaatcccatctagcagatcaagaaagaacaaaaggaggaaaaggagatcggtccaagcaatcatgccgtacgatggaaaatcaatctcgccgaagcatgctctgacagattaatctgcaagacgcttcatcaacgatatcgaccgcgtcctctacgacggcaacgaccgcgacaccgacgacggcatcgatcacgtcatctacgacgacaacgactgcatcaatccagcatcaccattgtgatgaccgctacacggcgcagaaggaccaaccaaagtggtggcctcatcgccaacgacatcctctgatatatgcaagacgtccccaacggcatcatctgacatctacaagatgcaagatgctaacaattgcagtttttgtcttcacaccatggcgtaaatattttttttcgccttcggctatttgcggctacatcaactaccacgaccacggctacttcatgatcggctacatcgacgaacatctacaacaaaaatcattgatggaaactccagtcaaaagcgtccgtgtcatcgctatcatccatgacactcccgctatgactgcgggagggaatagaggagagtcaagggacgacacagaaggggacgcaggcaccaggtggaggaacgaccatcagagatgcaatcgatgatgatgactcaaagagatgaagaaatagaagatttcaaatccagtcgcaatcgttagctttgctcccgttacgactgagggggaatgttagaagtataatatgttagttagagataagagtcaaatacaaatatagagataagatatatcctagagataagatagagtcctagagatagaatcctagactccaagtctctatcccctatgtactcctatatataccccatgagagggtcgatccaatatatcagaaaacatcagaatacaacatattagattttccacactgatcgccgaaaaaagtacacaagaactcccactatcctgcttacttgcttcctgatttgagtatgaaaccgtcaatttcagaacacagcaaacacatgatatggcaacaaacacttgaaaatttatgtggctaagtttgtcacacggcaatgcttcttggaagcaccatactgcgatctatcttaatgtttcttttctcggctctcggtgcaatttccccctctagtactgactttcccttttcatctcagctgcaatcaagaattttgttcatcggtactgggtcctgcttccaatcaagctcaactgggaatgtgtacagctcaagatatataaaattgcatcctagtttgctggacatggcagtggccatgagcctatcctaagataagatatcaaccaaatctcctgagtaatttggtcacatggaatatctgttcatctctcctcaactaggccagatccctatttggaatgttaaggagtaccaagctgccattcatctttgagctctgcatttctgccataattcctgtgagatgtgacagtaatcaccttgacactgtagtagtcagagagaaattcttcattctccaatcctgcatacgcatgcttctgtaaagttgcaacaagatcagagtttacccctatatatagtgaacttggagtcttggatcatcatccatcttcttcttcccattgagtccattcatccacatttttcttctgaactcgcacacaagaggtcacgagaactgctcatgagggtacacactcgattctctggttcttctgaacttttttacatcgaatgacaaatgctaattcagcaatcgttgctgctgctggttctacttcggtttcaggctctgaactgggtgcagacaaggctccacgggacgaggaaacaagatcacactgcagtgtcatctcgacgtaagtgacgatggttttttttttctcctttcagaattcccagcgtttcagagtttcagtcacgtaattgttgctgaatctttgatctcttgcaggcgctcatacctccggtgatctccaccggaacggcgacgagctcgacgacggctgggcggcggcgatgctgtccataggcacgttagggggaccgaagggccgtcatggttctggcacgccgtggacgacggcggcggcgggcgccgacgagctcgacaggctgcaggaggagctcaggctgctggttcgagctcaggcggtggtgaccggaggcgaggacgacgacggcggcggcggcggcggcaggcaacgcaggtcactgagccgcacgtcgagctccacgaatggcagagaggtggtggccaagctgaagcagagatcgatcaggaagatcatggccgctgctctcggtggcctcctgcaccggccgagctgcagggagacgatgcctgaagcgactgtcagtgaggtagtaggagtaggactactccaatataaagagcatatttgttcattcgattttcagaaatcagaaggaaattcgtattggttcttgtgatttcatgctgatatgtttcgcagattatatggtcattgttgcacaagaacacgcatcctgaaaaaccggcgttgccacatactgtgatgaaaggtgatccaacggttccgacgccacagaaggataaacaagagggcaccaaatggatcagaacagattcagagtgtaagttcatgttcgtctgacagaaaatgagaatagtatattgtagcggttcttgcaggctaacatatatagaatctgatgttttacatccttgaattcattccccagacattgtgttggatctggagatatagacacccccggtggcagtaaagaggcaacaagaacaatttcctggatttttttttcttttcttgagagaggagactagcgtttcttttttgtacgaccgtacttcagtacatgtacatgtctgtttacaaaacgtgttgtcaacttctattacaaaaaagggtttcccttttgcttaccaaataaaatatcaaaggagattcgagtcaggtcctatatcaaactaaagggccagttctagttgtcatacatcctgccttggtgtaagcaaacaaaaatatgatatggtctctccccaaccttcaaatgtacatatgccatatgctcactcaagtgcacagtgcgcctataatctctggaatgaacagatgttcaagcaagctgtaacaaatacatgatttgcctacctgtcgaatgttatcatgcatttcaacctatgacctgcaatttgagaaagggaaggtaaggcttataatctatggaatgctgtcatgcatttcaacctatgacctgcaactgcaaatttccttacgaaagaaattggtaaggcatactcaggtgactgtaatgaccatatttagtcatttaggttcaagatccgacctggttcaccaaggggagtgcataacgttcccattctgtcgaccatttggaagatgacccagtattcaaggcaccaaccttgagggatttcaagtcatcgcattcttccggaaaccccttaaagagcatctgcatggatttgcgattgcaacaattaaaatctagacacagcactttcaacaagtatttaaaaaaaagatatgaacataaaatatggaaataaataattaaaagtgatcatcaccataagttcatcggcaagctcagaagatgttgaaaaaagaagtccattattatttatttttacaagctcatcaatgctgcacatacgaaaaaaaaattaggacatacttttaattcaaacgacatgaaggtcaaagcccaaatgtaacaaatcaaacatacgggaaacatggattaccaggagaatgaagcagcacaaactggtaatccacaaccgaacatatcaaccacctaaaagcaaaatcgtcaagttacacgcaacagataaaaaatgcctattttttcaacagagcggatgcttatgagttataccttcataggtaggtctagccctgaagaggaagtatgcaatgatacacctagatcagccgatcctgtaattattcaaagaatcagcatttatgctacaacatggaattcttttggcaatcaactagtttaccaagcaaaagagggtagtcctctgatgcaagccacatagtccggaaggcaacacgcctcagtttcaacctctttatttgctcctcatacttcatcctatcaggtcctttgccttcaaaattgatattcatggatatcataacaatactcaaaaactggttactggagctaattagcagaatgcacaaaccagtgataatgaatagcagtcttgggtagacaaattgcttcccgttcttgatatcaatccaaagctttccctcgtccattgaatcatcttctcctaaagttgcagcaacacgtctatcgtacataagtgctgcttccagaagtatgctgaaatcttcatctggtgtcctgaaatatgtggcaaaggaaaagattcttaattttactttcattttaaccacatgtgctgagtataaataatgatacaactaggatcacccagatcaagagaacagaccagcttgtgctgctgacaacaagagctggtctattaggcttcaagaaaatttcaccatcgacccagcttgtaaatacagtagtgttcctgtcttccacttctttctctgtgttgtaagagcaaacagtagaaactatatcaaagtgaaattttcttacagcaatcaaatatttagagtggctggagaacataccaacagaaatgcaatcgtcattgcccatagcactacaaatggaattccccaacctgctaaacaactatttcatctaatggtcagataggcagtacagcaaagatgaggaaataaatgaaaacagatgctcacctcatgtttctctgtcaatgaagcaggatggaaaaattcaggagattgatcgtaaagaactgttgcgctgaaatccaaccagttaagttaatataaactgtagctagcgacttcaaaaataaaagtagttgtgtgctaacacaacagccttaaacatgaaaagtgcctgaaagtttgatcttacttgattccccatttttgatcaagctcgtgtttcattgcttttgtaacacagaaggcaccatcagccatccgtccaaaatgcttctcgaacctagaatgcaaagaacacaccactatattaacacacacaatcagtatgctacatctagcagataaacaaacaggacaggaattaccagaagtagattttaacaatgatatggcttctgccatgagacaacccaagcagtgtatatccaaagttatgccagtccacaataaacttagcacctcttagccagctagccagttttacagcagccaatgttggaacagagggtggattctgttggacagaagatgatcgaataaaagaatcagttccatgctagtgtgtgagattttcgaattaacaaataaattgtaagtatcaaatagaaggatttctaggtaataaaagtctatgtcagttagtaaggccaaaagatactatacaaaatgacaaaacttcgcctaagtaaaggctgcacttatcatagctgaaattttgaattgaaaatggtgtaatgaataggtactgcataagtataagtctacagcatgacttgctaattaagctgtgcaatactttggtaagaccatggatttactagcgtgattgatagatgatgaactatagaagaattccacactattgactgatagtaattgcagaaaactataaattgtccatgtaattctgaaccatgcatgcgactaaagaagctcaatgcaattttgtgaaaactgacctgaacaatgaagacatcagggcgaggaatcttgaaacaaaggtaccaaatcaatatgataaactggatggcagctttaagtagcagtgtcagggcaccggatatctttaatattcctgttaactgcactgatttctagaaggtacaattcaaaagttaatagtacacaaaattagagaacagcgtaatgctttcaaacaatcagtaccatttcatggatgtgaattgatggattttctctcaataatagatgcgggtcacttcctgctcatttacccaaagcagaacataggtcaaatttcaacaaaagacgcaacagaaggtcgaaagttgttggaaactcagcctgtatgatgtgcactaagtggaaggtataaatgaataaaatccaaaagtacaatgaaactgcaaaaagaataatacctccatttgcaacaatgtccacttccataccagcctgtcaagaaaaataaagaatgactaattaactaaaacatagagacatatgcacatagagttggttcttcccaacacatagcatgtcccaatatcacaatttttttgccacttgaagaaaatatatatgcttagtaaatgcaaggcaattttcttctcttcatttcaaaacctgtcttatctaacaggactaatatttgcacgtgtaatcacactttcagggagaaaaaaaagacacatttttaagggagaaccaaaaatcaagggcattaatcaacccgaagctatgtccgctcacgctttcagggggtgcaaatgaccaccactgcattagttacttcatctgtgcaatcgcacaactgacacacaccacatctcctttctttactagttattaccctgctatctaaccgaggaccatatgctacactagagaagtgatgaattaagtgcaaaattcatgaaggaatattaactatcacagcacatcgaaatacacctacagctagctggagggactaagctttcccaatcaaaacaaaacagaactaatatgagatgatgggtttgggaaggggatcaatacctggttggcgagggagagggagtggtactgcatgcgcgggctgcgcccaatgtctcccagaactaccaccgccgctcgcttcctcctccctgcctctagtgccacggccattgcctactagccttccgagtttggaaatttcagattcaaccgccaccaagaagtgaggttcctgaaaaggcatttaatttagctaggtattagctccaaacatccaggaagggaggagtagataaaaaatggacaacggttctcttggttatttttctgttcaccgcatttatgctcaattagagaatacgtctgtactattttacatcaatacaacaatgttctgttgacggaacaagaatgtagggatgcaatatatgctagtgagtttatactcatgtaaattaattcgttgtttcgcatattgttgaacgcaactggagattcattagtttgtacgaatgattggcaaccaacactcggatagtatcggtactgtgtattccacagttctacaagtagcaaaggggactagtcctaatcatcagcaatcgcttaggaacatacatgaatttcattgtcctaaagtcaagtcaggttgttctgacattgatctggaatgggcaaaatcgagcggaagaggggcgagtttctagggttggggtgggtgggcatacctgctccgccgccgcacttcgggtgcgtgggggagagcggcgccgcctgcttccccacccgtgcgctggatccgatcgccgtgcgaggggagggggatacagggggggacgccggacgacgggacgattcctccggctgcctccgacgggcgacggctcgtcttcttgctcctccccgaggagtccaaccaccgcgactctcgtccttgtttggcaggccagaattccggcccattcattgtaagtgggctgggattttaactaaaggaaatcccgtcctatatatgcacgtggacgggctgggattgaggcccattcagaaatggcctttgctgtatttttacttttttagtcaacatggatggtctggcgtcctggcgatatcatcagaactttgtcgcattctttgcactgtaactccctgacgaacacaccttccatccatgggaagtacttgggatttgggaacaggcgaacgctggcagcagtctgaccttggggcaacgggttgcacagcagataactgtgcagaatctcatgtaatcgtggctatgtgacgggctgtgatcgccagagtttttatcacgcttattgtattgtttccgcaaccgctagcagtagatgcggcagccagttgtctggccggctacccaacgcttcaagccgaagacggtggcctgaacctccctcggggaccgatggcagccggaagatggcaggaaatacgacgacgagacgcatctcgtgcccgcgatcaattggatgccggaacgcgtgttcgcgaccacagctgggtctctccaagtccacgggaaccatggggggctagcttatagctctcgagtcacgagtccagactcgatcatccacaaccgagtatggaatagtaggtagcagagctgtccagaaaaacgggagcacatgaacgtcgacgcctcctgtttgggcctcacaagtcgcgtcacgttcgttgggctctcaggtttttggtaagacgggacaaacgttccgcgagacacacagctaggtacacacgtactacgtacgtagcgtcgtcacacgcagcacggctcctatttatgtacgtaccagccgcacggccgtacaatacggatcacaggatgtttgcctcgtactaatgtactccgtactgttcttcggaggtgctaccgttcataaggaaaaaaaatggagaaaaaattatgcaacttgcggtagaacccagtcagtgtctcatactttccctcgcgaagagggaaatgagaaccgtactcatttgcgaattgcgatgcggattcaactagctgacagtgacaatgaacacgtactcaacgcaccaccgcccaccggcagcatatcgagcaacacatttttcttcgccccctcctactactacccatcagctcgctcgctcgctcgcgcggtcacacgaaccttgcgttgcaacaaactccggcattagaggggacacgctttctccccccgatcctgcaggaggcaaacgcatccatgcatggtaaaacgaactagcccctcctctcacctttattccggccgcgtccgcgtccccgtccaccaccccaaattcgctcccacccgcgcaaccgcgtggagctggaggccgcctctatcggtctcggcacaccgttaaaaatccgcttactagttttatttcccatatggtaatataaaatttagaagaaaaaataataaattaaaaatgagataaacaggctaaaaaaaattcgtttgcccgtcccgtttgcatccctacgcgtgggtcggtctctcacgggaaacgcgccgcgcgagctaaaacccctcgatctgccgcgtgatcgatgagcgagatcgacggccgggtcgcgtactcgcgtcgcgcacgcgggccatgtgtgtgtggatgcgatcgcgcgcgcgcgcgcgcgcgtcgtcgtctcctcccgtgtgcggtgcggtgccgggttgttaggcagctgcacggtggcttggccgcgtcgacgtcgcggccggacgcgggtcgcggggcgagagatgcccaacaattaggcgctcgcgtgacggaaaggcagggctggcacgggaggatgccatatgcagatatgctagctgcgcgatgattattgatgagtgttgagtggtacgcccagctggtgcatatctgctttgtcgcatgggaaacaaaatctagcaccgatgggaactcgagagaggtgccggccggccggccgcgcgcacatgtaacatgttgcccatgatttcgccagttgattaagttattaattaacttcccccttgttgatggattattgattggtcccgtacgtcaagttgggcagagaaaattagcgagcaatacacactgtctagcgcatggggcacttccaggagtaaggctaactgctacaattaagtgttaacaatgcaggagtatgtatgattgtttggtattagcatctgttgccggcaatggtcactagcaataatatcaatatagcagaacaactatgaagtagttttgctcaactgattaggtttttttgggtaaaacgtatccaactataggaaactatttcaatccctcgagggatgccctctcatttgtctaaaaaccattcaaaccgttataaaaatttcttgaaaaatatgacaacacttatacaacatatatatatcactccacaaaattttaactcaaaactcaactcacacatcaatatataataaggacaaattcagcgcacgaataatattcacgtccgaatttgtcttttttgcctcaatgtgtaggtcgaattttaacttgatttttagtggagcggtaaatatcactatgctctatattatcattattttttcaaaaaaaaaatacaactatttatattgaatttgaaagcaaaatttatgcaacagaacatccactcgagttattagaatccattccccattcaattgggcttaagttatagatttggaatgaggctcacatttaatatttgctataaaattcagtagctatcaagtactgtacgttttacctatcaatgtcttggaggtctctagtgctggctcaatctcttgagatgtgcgtttgtgcgctttacggtccttcaagcaaaatttatactatactataaaagtcggtatctatcaagaacggtaaattcacctttttcttttcgcgtacactaaaagaaaaaagttagtttaaactcacctttttcagaaacatatagtatctctaacctttaaactatgtttatttacttattactactatgttgttttaaaggaaaatccacaaagctcattcgtattttctttgcggggcattcatatgactatatgagaaaccgatcatacattcatacctagcagcagaagaattatagtgctctataaatcatagaacaaatcaccaagcgtaacgcagatctatttcacacgagtgctctataaatcgtggatcaaattaccatgtgtaaagcagaatttctcaggagtgctatgtaaaggttgtgtttagttcctgaaaaaagttgaaagtttggggaaagttggaagtttgaaaaaaaaagttagaagattatgtgtgtaggaaagttttggatgtgatgtgatgcgatggaaagttggaagtttgggatagttggaggtgaactaaacacggctaaaatcacagaacaaaatcaccatgtgtaaatgcaagaatttcagaacagtcgaaggaattttatatcattaatcaattcagtccccataggaatcgaaaaaaaattcaaacgggatacaatatactacagtacttgtcagatccatacacccctctctagtcctgatctaccgactcaaggccattgcgcttcagtgaccgtgcttaattatacgccgcgataactagggtaactgctaatcacgaaatcttcatacttccatggtaatcaactcaaggtcaggctcggcgaaatcaactcaaggccgttaatgcgacgagaaccatcttccaactcgaccggccttgcagcatcggctaccgggtgaccacatggcgatcaatcgatcgagctctcaattctcaaatcgcagacgtgacgtcgtggcgatgatcatcagcgcgagtgcatgtgtccaaggcttcccagcgcgagccaatcctcgcgcctctccacggccgccttcgctttcttcgccggcggctgctcctcctccgccgccgcagcacggacgacgtacgacgaccgcgcggaggcgggggtggccttgcgcttcgccaggaaccgcttcagcgacgccttcctcgcgatcggcatgtccaccagcgcgggcggcgcctctggcgcgccgccgccgccctgcgccgccgacgcgaaccgcatcagctcggccgccatggccggcgtgcagcggtcgatcaccaccaccttcccggcgtagaagatcgtgaactgctgccccccgccgtccacctcgcatccgggttcctggaccacaggcgccgcggcggcggcggcggcggcggccatgaggccactcacaccttgagccaccggcgccgccgtcgacggctgcgaggagttggccttgacgtactggctgagcacgccgcacgcgacggcgaagcggcgggtcatgggatccgtcgacgccattgccgtcttctagcacggacaactaagcacaagcacaaagagagacgagaagtctaactttattgcgaacgatctgtactgtacgtcgctgatcacatatggttggttgcgaggttggctcaaccgctctatatagagggcatgcggggcgaaacgtgtggtcgattgattagtggaggttgcgcgcgcgcgcgagcgtgaggaaaacgtggccgggcgcgcatgacgcgacgaagacgcgcgcgcgaggccaaccgccatgcaaacccaaccccctcctgattcggtttgaaatggtctttcctccgtttcgcgtcgacgtacgggtaaccgcctcctcgttccggggagaaacacgtactacgtacgtacactctcttgcttttggttgttacatcgatcgataagatcgacggccagcccaccgttagatatctgtcaactcgcccgacaggttcggaccatatctgttaactcgatcgatctgcatgattcagatgacaacgaatatttctttttagattcacaacggattaatcaatcaatcaatcaattaattaataatctgttgaaaatcgaaatgagccacttctatatactccacatgcgcaaaagaatttttgcgcaactcgcacggtgccattctattcgaggaacccaggaggcctaaaaccaagccgaacacggcctaacctgcacaacccagcacacggcctaactagatgaggctactactagctactagtagctacgttacctgccgctcgcggcccgtccattcatccgagcctataaaagaaaaaaaaaactttgccggaagcagcaatgcacgttgttcccgtttggttcgtacgccgcgccttgccgttcgttctgtcgatcggccggggaggatgaatggacggacgagttggggaaaaaacgcctacccggcaaagcagaacacagctgcgcgatggcgacacgcaacgccgggtcgtgagggcctaaccggctaaattctctgttacgtacgtacgagaacggatgggtcgttcacgcggcaaaagcggtagaaacccaaccactcgatgcctacgatacgacgtccctcgcttaatctaatgacgttttttttttatctaggactcgcttaatcaaactgatcctcccctgcgccgctggccgatagcttaacatactaatggggacaaaccgatcgctcgtaaactatgcttagcgtgtgatcagcttgcagcgagttgtttgttgttgcaagatgctacaggccggtgcatgcgcgacgtgtacgcactcactagcttaagctcgtttaattagtttttcttctctgtgtttctttctagcagccgaaagcgagagctgggggctgcacgccaacgcgacgaaacgtcgtctcgtcctagctagcaaggaactttcttgcccggttcgattgttgccgtcatgtggtcgttgatcgataatactatgctagagaactatggtgcgcactggtgcgccatggccccacatgtaagcgactgcggcgcccgggacgatcgccatgtgggccccacatttcgtacgctgctgtctgtaaccgcgacgactctgaaaattgaacgaccggattttgtgacatgtgtgccctttggagcgtgtcgtcttcggtagtgtcgagttttcttcttcaaagtacacagttgagtgctggctaattaagcctcgggtgcagtggccgagtggcgccaccacctctgcacgtctcgtgcatggcattggccttcatgctgttttccttttcgatttctaatcgatcgtcacttgctttttcagagactttatttctttgatttaccctaatatacatcattctgagaattttctgttgttaattagttgaagtattttattaagagaacgtgcactttgcaaccttgcaagtacaaaatattcatcgagacggctggtcgtgcactcatgcatttcctagaagctttacgtcgggccagttctcgtcgaaaaataatccttcgcatgcatagactctctgagaaattataacagtttgccagttctcgtcaaaccttggaaaaaatggagtacaactatcaaataatttctttttattctaaaaacatgacgcatagcttaactgtttttcctaaggcaacgagacaactctatattatgcatgtatgacggaattggattttttttttcattttttagtgtctctgaaccatggatttgcttggttgcgtaggctgttttttttaacggctcacatcaaacagtgcaaagtttatattgatagagtagaaaaaattataagattacaatcataggaggtcataaccagaaaaaaaataaagaaaagaatcgttcattgtaaacattccatcaatgcacctaggtgccacatgcacagtaacacatgttatatataagttggtttgatgccaagaaaaaatatactacaatcgattaaaatgccatcttcaaccaatcttcacgttttagtcacagtcaatattgtttagacgaaagaaaaggagggtttcctgtagaaaaacggatagtcaaaagaaaatctttttcacccccacctaattttggatcgtgcacagcctccagcctcagactcaacgtgcacacgggcgcacttgcttgacacgtttctttacacacgatggagcatacatgagggcccaaacggtgcccaaacctaaccaccatgtgcgtgcgtgcgtgcgtacgtactgtacatgccccgctagccgtagccggccagagtaaaccaaaaattaggccatgtgtagttttaggggtgaaaaattttcacgagtcacatcggatatacatacacatatttaaaagcgtagactaataacaaaaacaaattacatattccgcttgtaaagtgctagacaaatttattaagtataattaatccgtcattaataaatatttactgtagtacaatattatcaaatcatatagcaattatgcttaaaagatttgtctcgtaatttacacgtaatctgtgtaattttttttatttaatactctatacatgtgactaaacatttaacgtgacaaggtgaaaagtttttacgtgggaactagatagggcctttaaccgataagagcaagattaataatacagccaacttactggctataaggttctttatagtattctctcagcgtacctttataatatagttagctttttatcattaatattgggtacacttgcctctctcacagagtttcttggttcttatgtccaaaccggctgttaagtttacagctcgcttctcctctctctcctctcttctctcctccaccttatcatttagcaggcttactattatatttgctctaacccaaaaccaaccagaccattttcccagcgttgtcatttgccccattcgcacgccaccaccaccggtggatttacaccgcatcgctggcgcggccgcacgacgcacgtgatcccccccacgcagccacgctgcggaggcagaggtagcgcgcgccgccgccgaaacaacccaacccaacccaacgtcccgacccgatcgaacaaccaccgcgaaaacagcgagagacgtgcggcgcgtgcccgcaatttctcgtctttttttccgcgcgggcgccgcgcttccctccgctcgcgtttcacgtgccgctttcctacccgagaaacaaagattatactaggcgtttaggcctcgtcttccttccttccacatgtacacctagtatataacaagagggagacaggctacagattcacgggaaggtttcgtcctcgtttcgtttcttgcagcaggaagccaaagtgtatttcccgagctttgatgtgagctagctgattttgctagagctacaacatggccggtagtagcgagcagcagctggtcgccaacgcggcggcgacgacggtggccgggaacgggagcaggttcgcggtgacgtgtggcttgctcaggcagtacatgaaggagcacagtggaagcaacggcggcggtggcttcttgccggcggtgacggccatgagcctcatgaccggcggcgctgatgcggaggaggaggcgccggaggtgaggaagaccatggagctcttccctcagcaggctgggacgctgaaagacacgcaagaaaggtacgagcaaacaggccggaatactggcacctagtacgcgagagttcatcgacgaaactagtagctggttcgatgctaaagctgcaagtgtttttttcttctttgttaggaaggagatcaccgagaaggcgcagctgaccatcttctacggcgggagcgtggtggtgttcgacgatttccccgccgagaaggccggcgagctgatgaaactcgccggctcccgcgacagcacggcggcggcggccgtctcagacgccggcgccgcagcggggcagccttgcctaccaggtaggactagtactccaaacacacacgtacacatgcatgcaccgggcaaagttcactgacgacccgatccacactgatcacctcaccaaccaactgacgtgtctacgtttctgcagacatgcccatcgcgaggaaggtgtcgctgcagaggttcctggagaagaggaagaacaggatcgtcgtggcggagccactgccggagtcggagaagaaggaggcggagtcgagcaagcgtgccaagaaagacgatggcggcgcgtcgtggctccaggtgaaccccactctcagcctgtgagccgaagaaactgaagatagctggatcaaacaaggaaaaattaattactactactagtagtactgtattgatttaccatttgatttccacgtgtctgtggaaagtgtggaaccgtgtattattgatcgtttttccccatttcttactattttgcaacagttgttggtttcttccgggggaattagtagctaggtagcagctatgattggttaaattaatctgtcagcttatctgtttgtttgagaattctttgattatttgaagaattctttcatgcatgctgatcttatatgtaaggatccatgcacacggattgatgcctgtcggacctatggcttgtaaatccaaataaaatggtcaacaaatggtattatcctcttctgatggttcatgttctcatgccatgttttcaatatgatcaatctcgacggctgcatttggctccgcatttatagcttaggtagctagagtgtagatgtagttgtggttttcgtctttttttttaattaaccgtgtaatttaagatttggtctcgttttccttttaaaatgagacatccttttctttatataaaacgttggcaacggtctaactgttcggaaaaaaaaagatataagcagcatgatatatattccagatgagataatgtgatattgggatgcatggtatttgaattgtgatgcgaatacgtgggaaaaataggattataatattgaaaattgatatgaatttagggtgtaatataaaaaaataactgttaatcaatcacataaatgccggggccttgatggaaagtaggttcatacgtgtaaagtttcatgtgccgaggagtaggaagtaggaacgagtaagaaagaggagacgtgcatgaatgtgtattatttgtagtcgttacacgtcgtcttccccgagacttggcgtgcgtctacatgtttaccatttcaaagctccgactaagctaattaagaaacatgcgtcgtgtttaattacgacaccgaacatcgggtcagtgtagcgtgcgtgtgcttgtagtcaagagtgagggggagtaaactaaacgggagttgatcacaatggagagccaagttcaaccagccttctctggttctccaaaaaaaaaaaaaaaacagccttctcttgccacgatattccatattgcgcgtttgcagattctgctgaatattcgaaagtttcagaggaaaatgtacactaagaatctttcctttatcgctgatgtaccagcatattacatcgttagcgtttggaatatataccactccgatatatagtttgcatttttgaaaatgcatcattaattttgcaccgtatagtgtagtataaaaggtggagaggtataaaaaattgcattataatatatattaccttgatacctctttaaatagttttttaaatgcacttgatagtatagtggcaaggggtatgtggtttcaactataagatcccgtattcaatgtccaacatacttacaatttcttctttaaaaattgtttggagcaacgcttctttctccttgcatcattttttatactctttaggcagtatcaaattcatgatgaaaaaaggattgactatagcatccccaaatatttccaactcaaagaggaattttacaaatacctctttaaatagtgtcaagttcatcaatgaaaaaggattgaccatagcatcccccaaatatttctaattcaaagaggaattttacaaagaggtaacgatcaagtatttctaactccaacaattaagtctttctagagtccccaaatggcagccaccttaatcctccaccagtcatgtatcagcttcccccctgtttcctcctctgcaaccagctgttgtcatgacttatgttcagaatatcggtttcgtaaaacatatcgttatcttgcgaatgttcaaacctatttttaaaattttaaaatgttttttaaccaacagtaaccgattggttgccagtatacgagtagtactaattgggtgtgttcggctggtatctttcaactgtggctgcagctgcagtagttaagaattgctgcagcttgcagcaaatttctgatgtagcagccgcagcagcttgtatggctgccgaatagagccattgtcgttatttagccagaagaaaattttgggaaagactaaaatataattttcatacatctaatatacatatccaatatactaagagtatggtactttttaccggcatatatatttaaccagatatatgcagtcattttaatttgaaaactttgtccctcaaataaccaaatctaaaattcacttatatagatatttgaactcaaaacattaggatcctactcgggtcactacaaccagagtatcagagtgttcttccgcacccaatatgcttagtaatggatcacgatagtttgaaaatttgacgtgtctctattttccttccgctgactccaaaaagaaaaagaaaatcattatgtggatatgcaccatttctgtctgcaaattagaaacatgggtgctgctgaatgagcgacctgtatagctcaacaaatacgaccacgggcttagaaaagaaaaacaattgagcgaaaaatttgtctgactagttcaataatgatctactccacgtctctaccactacctactgctgactggttcgtagctgcgctcctggaatcatggaggcccttgcgtggtgatgatcgatcatcactgcaattaacatgcgtggttgactccaattattcccatttacttatacttttctatcacaacaataatacgctcatccaatgtactagtagtactggtatctgcaaaattttcaacacaaaagtactacgaagtcatgtagcagacggctgcgctcgacggatcaaaccaaaataaaaaagaacaaatcaattacggccctaccacgcctccacagccgaaagaatcaatccaacatcgtgtgcgctagctggtgcgagaaagctaaacttgctcaatctgtctgcctcttttcccttttcattttccctattaatgcaacaaattgcttaattatttacgactaatgtttttaataagtttgatcatttatacagtttattaaaaacatacgtatgaatgttatttattttattgtgactcgttttatcaattaaaaatattttaaccattacttatactactaacttataacttgtagtatttgttgcacatctaccctaaacttttaaatgagaagaatcatcaaacggtatatccaaaaaccagcaacatcgtctataaaagagaataaagggagtaatttaaaaattattataataaaattccacgcacgttgctaaacacgtgactaatttaatccggcagcatgacgccgacttcacgcggcaatttaatatttttttcccttctccctttttttttttcttctctgcaagttgggctacgagtcgctgtccctgttccccgtttcgatgaaattaagccaaatgtgcgaacacatgaccccgtacaagcaagcagtataccaccgctccaaattaaattaaattagataagttaacacggcttaatttaccaatcaattaggccggatatgattattgttagtataattaattagatatattcgatcccagttcgatcgctatcaaattaatcgttcacgtacttgagttccctcgtgattcataagtcgaggccgtggagtacgtgtacagtgtacaagagggggtagcgagaataaagggattgaaacggactttgatgggatgagatttatcccgtgattcatgagcaaaagattaaagattcatgagcaaagatttaagattaagccatacacatggacaagttgggggagaaaaatgtgaagggtttgtacggttttcacttgattttcgtttgggatcttgactaaagcatatgcgctacgtccacgttaattacggagtgcgacgccactgtgtgcgcgctagctagtaggagtaattgccaagacatacataacgcatgcaatggtgtgtgcaaacataagaaaagagaaagaaataaagagaaaatagatggaccactatccgcgaccaacctcgtgataaaaattagaaaagaaaatgatgaattgaagaagaaaaaaaatcatgtactcctacatgcggttgttagggcagtcccagccca

SEQ ID NO: 52011 - DNA, 6658 bp, Oryza sativa
catcattttatttaggtggtacttatttatgatggcaccatcctagtcattgggttggacgcccttgtgctcgccgtttagtttttcttaacttttggttaatactccctttttttctctggacatttcttaaggggcgcacttatggcgcatgcgtactatagaatgacgtgtgcatgcttgtgcgtcatttatgtaattgcaaaaatcatgtgcacatatcagataatgttatttttcaccattcgcattgtatacatcacgctctgatgtatagaaaattttatgtgtactatcgacattttttcctcaaatcctagaccggccgctctatcctaattctctattgatgttgtatatttccacaaggttcacctgttggtggagatcacaattatatctctatttatctttttcagctttaattaatttatatctccataaataatacatatattggtaggttaagactgtttgccattgaggtggattgcgataatttgtacaacttcttatgatattttggcttatccacacaatattttttttatatcttagatataaccaacaatattattgcatatattttgaaacaattggaagggcatgatagatgaataaaatatttggtctaaaattaatatgatttgtaatacaaaccataattatatgtttcatctctacataaaattaaaaatataactgtcgtgcctgtgtccgacttatactcaataaaacccccctatgtgaaaaaatatagatgcatttcagtttgaataagtttttagatgttgttcataaaaatagattttcttacaatatatggagccaacatttttacaaaccgatatatatttttgattgatataattgttatatactaaatatacttataatttgattaagattaattgttgatgaaaatctataccttttccaaaatataacatacttcataatatatttctatggaggaagtacaactcaacacaagtacacaactataaattaatcctatgtgtaacctaatccgtgatcattcattcatcaaaaaatagatatttcatgtgggattgagggcatcgttttggagagctcaagtgagacatgccaatcacattttagagtcttgtaccatgtgacacggtcaacgtttcataataaacggcacaagttccttttttaccatctctcttttccattgttctctccaatattatctaaacatatgtgacgtaactttttcatggaggaagtatgcacaactcaacacaaactataaactgctcctaattatgacttaacccatgatccattcatcaaaaatagatatctcatgttggattgaggatatcgtactaaaaacccaatcaagacatgccgatcacattttacattttacagtgatatcgatgtaccgtttaacacagtcaatattccataataaatgccacgagttcctctcttaccaccccctcgtttttctactgttctcctctccaacattggcgtagtggtaaacaaaatcgttctcctcaatgcaattgcagcacagaaaaaaaaaggcggttaaaccatattcttagtcttataaaagaaattgaagaggccgtaacattttacacgaggtgcgaattaaaagagaggcaaaccagggaccgtgaagtcgtgcatgtgtgccttgcaccacagtacacatataatttgatttattttttgttcaaagaatatttttcccaaatataaaatacatcgtatttttttatggaggaattacagctcaacattatcctacacgtaacctaatccgtggtcattcgttcatcttaaaaatagataccttatgtgggatcaagttcatctttctagaaagccaaaatgagacatgccaatcgcattttacagtctcgtaccatgcgaaacggtcgacatttgtagcgcccgttccgtcgtggcgcctagcgggaaaactatctcttaaaaactctatttgtgaaatctgtttctttgcttgttgtctagtgtccgtgccatctcagatctcaaatccccgatctatcgccgagttcaatcccgaatccaaatccttcccaaatcaattcctccgcaaaagtctaatttgcctccccgggttcgatgggccgaatctctctcggcccatctccccctccctccccggcgccctctctctctctttctctccctccccctccgctccgcccgcgcgccgcgcgcgcgtgcgcgagagccgcgccgagcgctcccccctccgctctgcccgcgcgcgtgcgcgtgagccgctcgcgccgagcgccctcccttcccctcgctctccttctccccgcctccatccctggagagctccccgcccgcggaatcggccccgcgcgttgttgttcgcgcgtgcgtccacgtggtcgtcgcccgcgtcgcgcctgcgccgtatgcgccgcccggccccgctgccctgccgctcctgcagccgcgcagccgctcggccccgcaagccagcgcgcgtgcccgagctgtgccgctcaaaccgccgcgcctcccgttgcaaccgcgcgcgcgtgccgtggtggccgaccgcctggtcgccgccgccgtcagcctctgccgtgcctgcccgcgcctgccgcccgtgtcgtcgccccgctccaaaccgccccgccgtcatcgccgtcgtcatcgcccggcccccgccactccgcgcgcaagctgccaagggacggaggcagagctcctcctccctctgccgagtcgcccccgctccctcctccttttcccaaagaggcaaggggacaagcccccttttatctccctcttttcccctttttcctcccgccggcgtcatcctcctccctcctccctgtcgccgctttggccgcgaccgccgaacgctagccctctcctttgaccgccctaagtcggttcccaaactgacattgccatcctataaacccaagcttccctcttttcctttcctctcccattcgcctccacgccattgccgccgcctcccgtgctctgttcgccgtcgccgttcgtcgttgcgcgtgtcggaggagccggcacgagcaaggacgcggaaggggactccgagcgcgccctctccttcctcttccccggcccgaggccggagagattactcccgcgccgtcggcctctcgtcactgcgcccgcccgcacggtagtgcatctccccgttctccctcctcgctccatctcctccccttagactcgggtagtagcacgagtagcctccccgtagctagccggcgtcaccccgaccgttgccgccgctcgccgtgtgctcgccgtcgtcgtcgcccgagctcggaagcgccgctcgtcgccggcctcgctcggcgcagctccgcccaatccaacgctagcatcagattcccgtagccgcgtagataatctcgccgccgggaattggcccctcgtgacctcgtcgccgtttcccccttctcccgccgccggttgccgccgccgcaattcgccgccgtcgggcatcctctggcgaatccgagccgttggctcgtctcccctcgtcctatgcaaccacccggtgtgctcgctttcgcctgtatcgccatggttcgctccgccgctcgccgctgtcgtccgccgtccgttccggccggcgtcgtcgtcgacctcccgccggcccgcgtggcagccacgtaggcgccacgtcggcgccagctcggccaaaaccgggtcgagtcgaccccggttagccgctccctccccgtgcgcgcggtccaccgcgaaccgtgaggctgcgcgtgggcccaccgcatccgcgtcctccacgaaccgcgcgcgtgcaccgcgtctctcccccatcctagcgccgcgccgcgtgctctctccgcacggtgagccgagccgctgacaagcgggtcccactcgggaccacgcgaggtgagcccggtccaccggctctctctctcctcccctcccgcgcgcgcgtgccttgggccggccggcccatttagctcggccgagccgccccttttctctcgggccgcgccctagccgcccgagggaagtctaatttccctccctcttttcttttcttttctttttcaaaaaggatttaattaagtccttttcctgtagaccaaaaatccaataatcttagaaattcaatatcttcccaaccgtaaatccgtttgactccgttcaacttccaaaatccctcaaatctcgagatctatctaatggcacgcttagaggtcattaatagggctttattttcgccgtttgttgagttgtcccgttttgcgcgtagtttcggagcccgaagacccgcagtgcgaggatttcgaggatcaagctccagatctcgagcaaggcaagccacctttgaacatcttgagcttatatttgaatttaattatgttgcttgaaaaatattatgcattgataggatcgcacttaatctgtttgtcccgtctgcaaggcagattggcggacctacctagtttgttgcatttgatccttcctttgttaattgttataccatgttcccttgtaaccacccagttgcgcctcggaaatcgtgcactctgcacgagtatcgacggtcgccttcaaacttaaaatctgaaaaacttcttaggtaaaacttgggttttacaaaagacttggaaaacccgacacctgggtcggtgcttgcgaactaaatgaattttccaaaaccgcggaccggggaacgtaccgggtgtacggtttcccgctcttgcacttaaggaccgttttcttggaatttcatccaaacataagacaagtacgaccacatgggtggaatgggacacccctggctgagtaactagcttatcaggggagccttgatgccgagagacatgtggattcgccggggtggtgtcggggaggacccctgggtttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtggataaagtgtaccccctctgcagaggttaacaaactgttcgaacagccgtgcccacggtcatgggtggatgtgaggtgattcctagcgtagttttgtttgactactgcttgtgaaattgctgttgtggaaaggggttcgatgtttgaaaaatctgcagctgatgggatcagctaggcccgggtggccatttgaaagttgttggcccgggtggccgtttgaaagttgttggtcgggtgccaatcttgatcaattctaaagactgatacatttgcacatactccgaccggacaagacgcactgtctcatccatgtcgtttgagaagcactcacttagttgctttcagaaaagagttcaaataaaatcaattgcaaaaacaacagcctttccttgaagcctgcattaaacacttatttcccatggcttgctgagtactcccgtactcacccttgctctatataaataatctcccccccagttgctgaagaagatgaagcggatcccgctgacgaggagttctttcaggagcaagccggctacgatgagttttagggtttcggcctagttcccaagtcgcgcctgtgttgtttggtccaagtcctggcttccgcttcccttttgtaatgcagttgtgagctcgggatctgtccgcagcccgacttgattgtactcctactctataataaagagacctctattgctgtgatattctgtcttcctgtgataccagcactgtttcctgggactggtatcgattaataggttaatttggagcgtcacgggctagttccggtcggtactagttctgggcgtgacaacattccataatagatgacacgagttcatcttttaccatctatctttttcagtgttctccttttccggtatttatctaaacgtgcatcataactttttcatagaggaagcacacacaactcaacaaaagctataaattgctcctaagcataatttaacacacgatcaattcatccaaaaatagatctcacactggattgagaacatcgttcaaaaaaaaaactcaaccaagacacaccaatcatattttacagggttgtaccgtttgatacgatcgtcgttccataataaacggcatcagtttctctcttaccacacctcgtttgagtttatctcttaccaccccctcgttttttttcactgttctcctctccaacaatggaataacggtgaaacaaaaccgctctctgcatttctgcaaacagtacaattgcttaacccgtggtaccagccgttttttagtcttgttacaaaaattcaaaagaagccgtaacgttttacatgaggcgcgaattgaaagaggcgcaaaccaggggccgtgctgccgtgcgtgcgtgcgtgccctgccccccaacttgacaagtggatggagggaagggggacaaccccggtcgacatgcgagcggatggggaaagcgggccgcaccaccccccaccacccgatccatgggcagacgcagcaaaaaaaacatcacgaattcacgcacgcacacgcatccacagctcgaccgttctcccagtcccctcccccacc

SEQ ID NO: 52012 - DNA, 5145 bp, Oryza sativa
tcctgcagcccccttttgttttccttattcttttatcccctgtaaaataaacatttactaatatcattgcagatgatcaatgtacaatgatgaaaaatactaaaaagaatagacaatgtttttttttctggtaaatatccatactacacgaaatgttattcacagctgattggttgtgctatagcttttctaaatagaaagtaaaatttgctgtaacttgctgcaaattatttagaggaaaagattagactttgtgactaattgatttacgggattgaagttagtataattacatgtaagtacctaggtttgtcaattaagggtttgtttggatcagaagtggaggctacagctacattgtatagtaccactatataaatcaatgtattttgaataacttttaaaaagtttaattgaaaacagttagtttggaatggtggtcatcgtaatatactatgagttaatttattaggagtacacgaaagcttgacttgttagcaaagatcaaacagaaatcaaaaggaacacatccatatgtcctctctactaagttgtcattggagatttaggtgacagaataagacgtggctggacgtaagatttctttccgattgcttccgttcccagtgacttatattataacaaatagtctaatactcctatatagtgtcagagaagtaacagatatagtatatcttgttgtccatcgtgcacatcattaggatcagggcaagttgcagtaggctggtgttgatgttctttgattcggtataaatcaatcaatcaaaatgcaaaatactactggatctgggctaatttgggggctttcgtgatcgtgcaaggtaatgcaggcgatcgtgtacctgacctcgtcctcgtgttcactaatacatgtgattcagttcactgacctcgtcctggtgtcgccggacctgctcgccgcagagctaccggccggaggccaccgcctcggaggctcctcctcgtcgttgtgttgtcgcgcacggcgcaggatgtgcttgccgcagaggtaccggctggaggtcgttgcttctttatccctcggtggatcagatgtattgccggtggatgttgatggtggtgtttggtgccggtgaatgtggatggtggaacggcagaaggaatgtgagacaatgacgagaggaaagaggaatgatggagaatgaatatatatacagagaagaagaagagtcaatcaaggaagacgaagagtctggcccttccggagaaatcaggtggctttgcactttttcattatactccaacgtaagattgtcttttatatttagtccttttcgcgttttggagcgcacgcacgaaccacgctgtgccacgtggcatcgctaatcgctcgataacttgcacggatttcgatagtaagagataggaaggatggggccaattaaacttggacagactcgacggtgtaccgtaccatgttgacgacttgttcaattcaccgatcgatcgatctgcgggcggcgcgctcgcgaagacccatgcacgcaccggccaggaagatggacagctagctagctcgatcgatcgatcggcggattactgtacgagagatattagacagccgcgcgcgcgcatgcgccgccgatacggtgcatgcgcgttttcatgcaggcacagctagcgcgattccggacttcacttgtcggtgcggtgctgcatatgcatgcgccgtacgtacgtacgctcgccagatcagagctagtggtcgacggcagtatacaagcacagacaggggcggatccaacgtgataccccctaagcccccccttcaattttttcatcacattttagcatagtttaacactgagattatatgtttatatcggtgtactcagtatgttgagtcccccaactttttgtttctgatccgccacagagagatgcatggcatgcgtacgtcagggcccgcgcgcccgggtcagctgctggatgcattctgccgcgcgccaaacgtcaagttttccattttctatactaccttaatttggccaggccacgtactagctgtatttatcatgcatatgattaggggtgtcaatttcccggtgaggggcgtatatgttactgttcagttactacactaatatatatatacgtacatatactatgtgtacatacgggtaatatatattaatctatactccatctgtctcaaaatttaagcattttttttatctcgacacggtccttgagatgctacttggaccaacaatatctataaaagtaagatgtcgttttaaataaaaagagttgcatattatgatagtttgtttaataataaatccaataacatcaattttacatgattgatcttttttagttttctattaacagtcaaagtttaaaatgtttaacttgacactatgctaaaaatgcttatattttaggacggagaaagtatatactttgaatacgtacatgcatgtactggtagctgtcagagagaattgctagatttcagtcacctcaaaagaaatttttagtcatttaaaagaagggggtatttaactttttgtcatttttaagatgtggtaattaataatttgccacccgtaatctataacacgtgggccctcgtatgtctatggcatgtgggcttagtgataaatctttaattgtcacttgtaagagtggcaaatagttaattattcctctaaagatattgcacactctgcctaaatttgcagtgatgtgcaacaaacaattttcttttttactgcagtttgatgttatgtatggtttttctttattttttttctatgttggagtctttctcatttaattttgtaaatctttatgtgttataggtttacttcattttattatatatatatatatatatatatatatatatatatatatatatatatatatatgttttttaaaaaataatattgtacgattattgggcactggtaattaatactaattaagtaatatggaagtgatgagaatagtttatcatccgaagaatacgaaaagtagtgactgaaaattttaggcacctgaaatctagacagacactctcgtattaagatattaatcctggtcctatatatatcgcttatataccattcataatcagtactccttccgttttccgttttacgttataatatgttttgactttggtcaaattcaaacagctttaaatttgaccaagtttatagaaaaaataatattttcgattaagataaatttattataaaaatatatttaattattaatttaataaaactaatttggtgtaaaattactgtattaatatttgtctataaacttagtcaaactttaaacaaattgactttgactaaagttaaaacttcttataacctgaaatggagagggttattttttttagtgttgagcatgtagtatgatcatcgacctctcaccgtgtatgactaaattgactacacatgcattgatacgtatgtatcgtgcatatatgctccatactcgtctgagtcgtttgatcatgtagttattgacatggtctggtctggttacgtctactggtctgttgctttagtaaagtcccagattaagtcgatcctacatttcataccggccggtccacaagtcaagcacatggctaaccgtgcatacataccacttccatcatgtagtatgcaacaatcatggagtataatatttcatcccaaactatgcaagtgtatgttaattagtatatattaaccaccaaaagcaatcattaatttataattaattagtttcggaagacctagctatgatctctagccacaagccccacaaggcaatgaacggacactggacttaattagcacccaaattaaataatattgtcatcgtcttggtcaagccatcctaacgctgatacagcttgaccacctcaaaggctcaaaaccttgtgcgcttgcaagagcaatctagctagctgttttcagtattagtctcttgacagaaagggaacacctaattaattattttatcactgccatggaaggtcttttaagctagctattagctgctacttgcaaacttctacatattactgtctagttcgatctctttctgcagaatctaattgaatattggagcagtatgcttgatctgcttgtgtatagttaattaatacgttaaatcattggagagaaattaattaattgcaatattagagtacgtatatatggtatatatagtatacatgcatatggtcttcagacaatgaagaagaaatactaggaaaggacgggaaaatatgaacaagcatattagtcagctgaaagtacttttacttaattatctgtcttcgcgttcccttcagttatacggtcaagtagttggtctccaacaattcaaagttttctaccacattcgttaattcgtattaatattcaaatgtcccaagttgaaaaatcatgagctggctagctatctcccattctcccttgaatcttgacgagtgatgactgaagagtatatatgcacacactgagcattattttttctttgatttgttatgtctcatacgtacaagaaatgtaagcgaaatttgccacaaacttagtggcaatttctatagcattaactagtgcgtgcatccttgctcaaatactccacttaattattttgttatgtttacatagcgcgagtattatcacagccaaatactccctccgtattttaatgtatgacgccattgactttttagccaacatttaaccattcgttttattcaaaaattttgtgcaaatatgaaaatatttatatcatgcttaaagaacatttgatgatgaatcaaggcacaataaaatgaatgataattacataaattttttgaataagatgaatggtcaaacgttgtacaaaaagtcaacgacgtcatacattgaaatatggaggtagtataacggtagtgaatcgtctagctagctacctctagatcgatcatccggccgcgcatgggtatcagtgtgtatatatatatatatatgcgcttgattttatatttctatcatagcacttaattactttatttgttgttgaaaactcaaggtcaaaatgagtttcaatcaggtcgtcattgctaatttgtctagaactcctttgaataaatgc

SEQ ID NO: 52013 - DNA, 13971 bp, Oryza sativa
  unsure (1)..(13971): unsure at all n locations
ccataggcatgcaaccaaatttgcccaagcacattgcatatatgcatgggtccctttcggtttattccggtccaaagctaccgatcgatctcttgctctctctctctctcttggcttggagacgagacgacgagacgttcaataattctcctgatcgagatgatcaacagatcgaataatggagagttctccccttgaacgagacaaggtcgtcgttcccgtgtctcgaatctgtacatgccgagaggaaaaccagtaaaaatctttgacgaccaagccccgggcgatccagatcgaccgaccgaccgaatgaaataacgaaagcgatacgagtaatttttactgtgtcgatcgtatgcgtatcgtaactgttctcttgatcgatcagctatattttacttgtcggaatttgttgaaagatccagcaatcgcgggcctttttcacgcttgccagattaatcctagctaaatatgtgtcaacaagattacagatcgattgttcctcactaacactttttcttcgttataatatagagttagtaatacatgtcattttggataatggtgagatcaaactttaattttttttaaatttggttagtaaaagtaatttctaaaattttatcttaaaaatgtacagaccatatgtatatattaaaaagtacttcaccaaaaatcatatgtttgttgatatttttatttatattataataaaaagtagtggtaaaagttatttttaagaccgcacctttattcaaaacgatgataatttatcaaacctggagggagtacaaggagtctgaggctttaaaatttatcatataataaggacttttatagctgatgcactctcccaagcatggattaattagtctgaaactaaccaacaactaatgaattagaagtagcttcctattaatgagggaaattatggacttttgccttttcctatttaatttgtaagctatataattttgaatggaaggagtaacatgattattttatttttttttcatgtttttaatcaaagagcaaacatatattaccttccgatattaattcatatttcctttgtttttaatatatgatggcatcgatttttatacatgtttaacaattacctaagtattccctccgtttctaaatatttgatactgttgactttttagcacatgtttgaccgttcgtcttattaaaaaaattgtgaaatatgtaaaactatatgtatacatgaaagtatatttaacaatgaatcaaatgatatgaaaagaattaataattacttgatttttttaataagacaaatggtcaaatatatttaaaaaagtcaacagcgtcaaatatttagaaacagatagagtatcatttattttgttgtgtcttttttttatttttaaaaggactttaaacatgaattatattctttatatttgtaaaaattaaagacgaatgattaaataaatgtatgttcaaaagttattggtactatacattaaaaaagggaatagtattttcctggtattcataccataaggacaacaaaacaactcccatgatattttcttttctcaaataactaacaaagcctcatgcctaatctctttatcataagctacctggatctaggtagtttctcttttcatgttattgggaatatttgaccgattttcttgatagctacttatggacatgtgctcaaaggatgtaataaatatgatttttttttaaaaaaaaaagatgaattcacagtaactatttctagtggcgtaaaaaaaagattttacttgcatgaaaagacatggtttgaagagagagctctggccatgcagcaaggacgagccaatcagccaatggtatatgctgcaaaaagtcaaacgcatgcatgggccccagttgtcagtggcatatgcatgacctctaatttatatggtttattttttccctcgtaatatttcccaacattttctgtgtcacgtaggggaagctgcttagccagcctcagctcacatgcttaaaccctcgcctcttctccctataaatacacaccctaaccttcttctccctcccacccacacatcattcttcatcccccaccctaaaactcaactactcatcctctagctctcagctgctacgatcgatcgccattgctagctagctctagctcagagcacgtagaaacacttgccatggcggcggcgcagcagcagcagcagaaggaggggggcgcgaggcgcacgagggaggaggtgccggcggtggggagggtggcgatcatcggcggcgggatcagcgggctggcggcggcgaagcagctggcggcgcacgacccggtggtgttcgaggcgacgccgcacatcggcggggtgtggaagcactgcgcgtaccggtcgacgcggctgcagacgccgcggccggactacgagttctccgacatggcgtggcccaaccgcgacgacccctcgttccccacccacgtcgagatcgtcgactacctcgaggactacgccgacaggttcggcctctggcgctacatcgcgctccgctccaaggtcgtcggcgtcaagttcctcggcggcccctccgccggattcaccgagctctggagcggctccggcgagcccctccagggcaagcccatgtgggagctcgccgtctcctccaccgacgaccccgactccgacgacgtccaggtaaattaacatactcctcccctaccataggccggtctggccgattgtattgtgtaacaaaaacgtaactctattactctaatatattgacgtgcaataattcttttgcacgttcgcgaaaaaacgtctaggtaaacataccatgttaattctcacacacctagagcttgatttccggtcatggtgatcgatggattgggtcgatatgatgcagttgtacaagttcgagttcgtggtgatgtgcacggggaagtacggcgacgtggcgaggatgccggtgttcccgccggggaagggaccggaggtgttcaaggggaaggtgatgcattcgctggactactgcaagctcaacgagcaggagaccgtcgagctcatgagaggcaagaaggtcgtcgtcgttggctacaagaagagtgctattgatctagcccttgaatgcgccgaggccaaccaaggtaaaaaaaaatttaaaaaaataatttactcaccatcgatcgttgaatattcgtctcagtaaaaagctcgatcaatatgcatggatgttctatgtatttaccgttgtagattaggtgcaaattctcacaaagacaaaaccatttttgttcttaataaatgactatgtatgtattgagtatctaggaaattaacatgcatgtataactagctaggcgcagtcagatgagctatcatgcatgcatgaacgcggagattaacaagtaaatcatagaaaaagaagattcatgcatgccaagttcacacataactaactccaaaggaattacatatttatatcgtggaaacgtccaatcatttgatgaacttgggacggaattaatattgtacacttgcatggtatagtagtagtattaatttgcatacccaatttggtgacatgcatgtaacgccgtgacagcaacctgtcctaacgaaattcaggagacccaatcttagttagctctgacaccctgtttcagaaaaggtcactcttgtcttgatccgtcgtacactccatctagaattttatttctttttatgccacatgtagccaagcctcctcttgctctatacaggttcaaagtacgctaaacacaacacatacgcatatatgctctgacttttcaagctgaagtgttttatatgctagctacgcgttccacttgtcaatctcttttttctactctgaaactgcgcagagatgatcactccaacattttgactgtgtacttgaccatatcaaagtgctagcttagtatattaattccttttgtttggccatcaagttagtaattaattccaagttgatcatgcagcaacaaaaactatctgtcattaattctgaagaattattaatcctttaatttcaagcttgttcagttctgattgattggtttggttgcaggtgagggagggcagccgtgcacgatgctggtgaggaccctgcattgggtggtgccatcctactcaatctggggcttgcccttcttcctcttctactccactcgcttctcccagctcttctacgagaggcccaaccagggcatcttcagatcactcctctgccgcctcatgaccccattggtatgtacatactcactcgatctactcatttcacgtgaacatcttatcagaaattaagttcagaatgtgcatgctcaagactttgacaatattattttgtttgtagtagctagctagcttgtcagcatcataatttaccatgtttttttttgggagagcagaaggctggggtgtccaagttcatcgagtcgtacctgtcatggaagcttccactgagcaggtacgggttgaggccggatcacccgttcgtggaggactacgcgagctgccagatggccatcctgccggacggcttcttcgacatggccgaccgcgacctgatccgtttccggcgctccgccggcggctggtgcttctccgagaacggcgtcgtcctcgacgacggcacccacgtcgacgccgacctcgtcttcctcgccaccggcttcgagggcaaggacaagctccgctccgtcctccccgagcccttccgcggcctcgtcgtcaacaaatcctccatgatgcccctctaccggtacccacatgttaaccaaccaattacaccgcagacgcacacgcacaattagctaatggatgagtgttttttttttgtgtgtgtagggggacgatacatccgctgataccgaacatggcgttcgtggggtacgtggagagcgtgtcgaacctgcacacgtcggagctgaggtgcaggtggctggcggggctgctgggggggaggttcgcgctgccggcggtggaggagatggtgaggcacgtcgacggcgagacggaggcgatgcggcggacgacgcggttctaccgccgccactgcatctccacctacagcatccacgacagcgacgccatgtgcgccgacctcggctcccgcgtccaccgcaagtccaacttcctcgccgagctcttcgccccctacaacaaccaggactacaaggaagagtagccaatcctggccgtccatccttcccgtacaccgaatcaagataccgttaattcagtcgtataaaatgatataataagattcgttatttgtttataaaagtaattaagttaattgattattaagggctgattaattaattgttagttaataataatggaggactagcttaggtcgtgttcatgtgtcatgtgaactggggaattgatttggtgaggactcgaactacgatctggtctcggccgcgaccgggagaggaatcaaatcatatccaagaacgggaccatgtaagttaggtccgtatgtacgatctgtacgatcgatgtgtgcatgatcaaaggtggtttttccaaacctcttaatttgtaatcattcttttttgtctgatgatgaaattcaataaaattcatttattgtctgaaatcgtatccgcctgtttcgatcgcttctgtacgtgtgaatttcatggatcagccatatactgttctgttttatatttcttacattggttaaattcaaggataaatttattagtttgttcaatatttatgaatgatctgggagtatgattggtttttaatcaaatgcaaatggcaaccaacagccaagaaaacaattcatggcattttgaacttttccacgggtcaagtcaatagcttctaagatgcatatatgatacctaaaatacaaaccaaccaagtcaaaatggtcaaacagtcgatactatgtatacaaactactagagtagcacttaactaagagttgaccacaataatgctagcttcaattagtcggtacttggtagttatatgtttttttttccttctgtaaatattttatagttctctccctttcgggttgttgcaccatagtcagatgttaaggaagttatatatatatatatatatatatatatatatatatcatctattctaggcaggtttcatgaatgtatatatacaccatgtttttcttttcttttttttttcaagttgcccgttcatgttgtggcgtcaatcggtcatgattttgaccaccaataatctgcatatgtagctatcagatggtaaatttttaggcagtttaattagtcgttttggcctctgaaaaggcaagcagctaagcttctcatcgtttactgtatggagataaaccgtaaaagaaaagtaactaaaaataatttatgagtacaccttttacatatgtgtttcttagtaatttaaaagtcaatactgaaaatgaactaagatgaaaaaactttaaaatgaactctaataccatgttttaaaatttaatttttggctgtgggagatgcatgcactgaacgaccgttccataattaatttacgcacataaccgaacacatcatcttgcaaacccattacttacattattccgtttatttttgttttttattgtcacaatcttgtctctggattgtgatttttcaggagttggattcttaaaatctgattgtgaattcagattttgaaacatgcgaaatgtgcaatttatataatacttctagtgatagttttagatcaacatcatcaccccacaaaagcagcttcattgctaacttttggtttttattagaaaccatgcctcgtttctacgaatctgctttcagaatcaagctatttgcttttgcttttgattgtcaagcggtgaaacaacaatatggtacgcccccggtgttttgccacgccttaattatgacaaaagtcacaaaacccttgtcacgtcagtcaagtcggcatgatgaaacaaaattaggcatgttgttttgttattctagcctagctgttgtggccaaaagattagttttggaagttttggtatatagtttattttaaaaaataaaaatttaaaaggttcaatagataaaaaaatataattatgggcattatatgtgtatttagacactcagaacatctacttaattccaatacaatgcatatttcctcttttttttccatgattaattaatgttgcgtacgtgtaaatagttacctttaactttgtacgtcaacaatatattgtggatacaactaagaggagaaactttgaacaggagccatatcattggagcctaccaccgttgctaagtcaaattcaagcaaatatttcgtgaaactcgttgcaagtgatgtggataccaagataattagtaaatcggttagccgataatggctaaacatatgagagcccaacaactaagtactccaatggttgtatatatatacacccccgttggtgtagaagccattcccattatccaaaaaaaaaacaagtaagtactccaacttatgaatgtcaaaatatttcctatctatcttatcctagcaacaggtgttatgctagagatctgaaaaaccgttttaattcatctaattgtacgataaatcttgagctttttgtttaatttctgaaatggaaataaaacgtgagttatagaaaaactatattttgtaggctagttgtaccgtttcatcagcaatgcatgcaattgacatttatagttccagtgatgaattaaactgcaacacctttgttttctaaatagatggcttcgttaatttttagattaatatttgactattcatattatttaaaagtttagtgcaaatataaaaactttttttataaatcatgcttaaagtttctataataataaagtaattagtgccaacaaaataaataagacctatataaatttattttaataagataagtgttgaaaccctatgctaaaaaccaacgataccatctaaaaaaaagaagtatgtactactatcctgtatttgtaaaatatatatttagctagctagggaatgagccctagaaataggatagaaactgcgtcgaaattaagatgcatgaatgccatcctacatttggaagaaatgatgaaatacgtacatgcgtacgacgtagccgtataaggtagtagaagttatagttaagctaaatgttgtttatttaaggtagttctgagaaaataatgtacgtaaaggaggaagatcgatgtaccttcgtagaaattttgcaacatgaatcctctaggtaggttagttaggtcgacgctggtggtacgtgaatttcctgcatatatattttcttccgttccattaatttcaaaactggtcctaataaattattgtttctatcttcaattcgatccatgttgcactcaaattaattaataaactgcaactttttccaaagcttggaattcaagatttgctcacgtcaaggattcaacacgcgaacgaaagaattaatgtttccattttcaaaacttgcacgaacgacgacgaaaccatatgcttgtatatacagctgaaacgcagtagctagtggcgtctggactttaatttgatcaaccgaaagaccaagactagtagtactattacgcacgagagagaactaacacaacacattatattaattaatccaatcgtatatatgcaacggccggttcgtcgtcgtctccgttgggtttatttgatttcaattcgtccgagaccgatcgatcgagccgctcccacggtacgtggtccggtcggtcgtccggtccaggttgagttttcactcctggtctggtccgtacgtgcgtgcgcatgtacgcgtttggtatgtcgcttttgaacactgtactagtgctatatatatatcctgcacgtgcctgatatatacatgggtcgcgcgcattaatgaacccgacgacacgcgcgcgcatcatctgtgacgtacgtgttcgtgtgaatagctcgctgttcgtggccaaggcgccaacaaccacacgtacgtcgacgtcggtcggcttaattcccaccagcagccgatcgtgcagtgcagagacgtacagcgcagtgtgacagtcgtagctagtagagaaggagaagaaaactgaaaacggccgagcgagcgaggcgagccatcgacgtctcgctgcatggtccctcgacgcgtaccggtgtaccacccacacacgccgcagcaaccaaatcggcctgggagttgagcagcgtacgtgtcctcccgcggatgtctacaccggccggccacgtacatcgccgtcgtcgctgcgcgaccgctcgctgggccgcgcgtccatatcatcccaccgcgacgggctccgatccacttccactccatctcccggctcgacatcctcctccgatccgacccgggcctcgcctcgcgcgcgaccccgcgattccgccgcttcgcgcgggccgttcgctaagttttcttcacacggcctgtacgtctcggggacgcgcaaaaggaaaaagtacaccgaaggtccctcaacttgtcctcgagatacaaaaccagatatcccacgtcccttaactaatcaaaaccggtcacaaaagtcactcggcggttttgaccccggttttatcctacgtggctgctgagtcagcgtgggacccacgtggaccccacatgtcagcttgggccacgtcagcctcctctatctttcccctattctctcccttccgcatctgtctcactcttcccttctcttcttaggtaagcagcgttgctggcactgccggggaggagaccgccggggcgaggcgggatcagccggaatgctgagctcgtccgcatccttgccaccgtcgccgccgggatcctcctcagcgccgcctcgatgctcgcgttctgaccgccggcaacgacgtcggtgtgggggatggacaccgaatagctccggtagtccgttccctcggcaggtgccaagtgtacttggtgtacgccgacgctgggtggaggaacaccgggatgtagccggcgagcatggagtcgaacgtcgacttgcgggtataggagtcgccacgcggctggatgcagaacacgcggaattgaggagctccatgatccgccccggcgagtttccgaagtgggtgcaggacggcgacgcgtgcactgctcgatgatctgggcgcgcacggtcttggtgctcccggggcgcggcgcgccggcgaacgcccagagccaccggcggtcgcgccgccgcatgcggtcctaccaccggagcacgtcggcgtctaacaaaagtttatctctaactctacaaaaacacgcacgtatgccttcacgcaaaacccatccaaccgcagcctgcggcgtgtatgggcctccatctgcctccatctccatcgtctcttcgcaaaccagtagctatagctagcaccacattgatttggttcttcgtgacaacaggctgtgccatctatgaagtaaagcaatgccttccctgcccaacgaggcaacgatacaccgccatgcatgcaaagcccacgtgtagtacctgttaactcagcacacaaattcccaataaagcaattaattaagtaaatcactaaccaatcagcaatttggcaaaccaaataacccaactatcctaattacagtgtcaacagaccggtgcccagccggcgggtgtacatgtacgagctccctccgcggttcaacgccgagatcgtccgcgactgccggctgtactcgaggtcgatggacgtgtgcaagctcgtcatgaacgacgggttcggccccgcggcgctccccagcggtggcgcgctgccggagcgggacgtgtacgacaccgaccagtacatgctggcgctgatctaccacgcgcggatgcggcggtatgagtgcctcaccggcgagagcatggcgaggaagaagacccgcgacgcccggagcaagctcgctccaccgccgccggacttgtcggacacgacgctcgccgccatcggagcggacgtgcgccctcgccttctcccgcatcgcagccgccgctgccgcttcctcccccacctcgccccgggggcctcctccccagcagcgccgcccggcttgcctgagaagagaagggaagagtgagagagaaatgagaaagggagagaatacgggagaaagagaggaggctaacgtggcccaagctgacatgtgggacccacgtgggtcccacgctgactcagcagccacgtaggataaaaccggggtcaaaaccgtcgagggaccttttgtgaccggttttaattagttaagggacgcgagatatctggttttatggtttgaggacgattttgtatctcgatgacaagttgagggaccttgggtgtacttttccccgcgcaaaaaccaactgggataagttcacttcagatctcttattttaacagagttcgaatttcatccctaaaccataatatcagatatgaagagtcctttgacttataaaaatcggtgcaccaaagattccaagacattatactctcatgttttagctaacgtgacgagctgacttcggtcaacccgactgatttagtatgggacacacatgtcataaaaaaaatcactacccttcttttcccctgtgtctctccggatccacccaccattgacgccgcgagttcccccacgaacatcattcgcttcccccgcatcgtccccatgaacaaccgcgcatcaaagctgctcgattcaatttgtgagcaaatcaatctaaagaaaatgcaaagatgttgatttagaaggaaggaatgcaaatgtgccttgcttggtgaggaaggtatagaaatcaatgttggggtagaggtagtcatcgatggagtactcaacgagggtgtggacgtccttgccatacctgaagagggcagggagaaagaaggcgacaacgagggtggtgactggggaagtggggagcgacatgctacggcaaggaaggagcagctagaggaggaagggagtgttggtcgtggattggtagggtggttgtggcgtcgtggagtaaggcggcgaccaaccagggggagggggtaggagcgacagttgacgggaaggcgcgcggcagggagaaagacggtcaccgacttgaagagaggcggtgggtgcagcagattgtaagggcaggcagctgaacgagctcccatgcttgcgtctgcacctcacgtctccccggtgcccacagcttgccacccatctccccctgcccgccactcgctgagcatgcccgcccacatcacagaggggaagggggcaatgctgctagctcatgccatcggcgtgatgcccaagccacaacaatcgcccccttccaccaccttgcctccaccaccactgccctccacttcagcccttgtcgccgcctcctcaaccaagccaacccgctttgtagggctcatgtgggtcctatttaccacattaaccaaacccggggagcatactatcttgagatttttggtatactggttttattggttgaggaattcttcatatctgatattgtggttcaacgatgaaattcgaactcgacgactttaagaagagggacctaaagtgaacttgttccaaaccaacgtctcatcgcggttgcggcccttgtcgcgcgcgtgtcgcgggcttgcaccttgcggtttcgcgcttgggcttttgcctgccggaccggcccagcggccagcggattccagtggataaacattgtagcgttcaccgttatcgcttcctgcaaagtggatggataggataaccatggcgtttttctcactttggtaaaggaaaaacccatcttgcagccgatgacgacctgacaggttgcagccgcagagcatggctacttacaacgctgattgagaagcaaaaaattttgttatccatcgagatcgatcgaagctttcattcatccatatcaagtcacgatcggttggttttatgttcttcctccgatccagcggcctgccaccatcaaattcatcacgatgtgttcgctcctgataaaaccacgaatggattggcacgggtcacacgagtggagctagaaacactaaaatttatactccctccatttcacaatgtaaatcattcctattcattaacatcaatataaatgagaaaaatgttaaaatggcttacattgtgaaaggaggaagtatttactaataatactatttttaatttattttttataaaagctacagtgtgtaattttacagaaattgagagaggccctaaatgataacatgaggaggagtatcatttatcacctattgactgcaaacctcatgttagttaacttaataatttcatcaatatggtaagcctgatctcacaagctgactttttgtacccatacctgcatgcttctgttgcaggctggtaggtagctaacgctaactgtttataataatccaggagcatcttaatgaaagcaaaattatgcgtataatctatcacacaagtgggcacgaactcatcaagttggatatataccacggtcagagctgggctcttctctttctctcttctggcgccaattcagaatgaatacagctaatccatccatgccaagtcagcaataataatccccaattctgttccaaggaaaacggattatattacctcaactagatgcatgacggggtgtttgaatcagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 52014 - DNA, 13789 bp, Oryza sativa
aaagaattaccactgaattactccagatcaagcaacacacaccaaaaaaattaattaggcttggtatgaaagtaaagaagccacacgtgatgaaacggggcacagcatgtggcgggaggattgcgtacgcgtcaatacacgcgacactgtgtggattggaatcgggagcaagctaatcgcttcttctcctcgtccacatttaggcgtatggcccgcccaatcgcgcgtgctgaaaattcacgtggccagatagcgagtcgtctcgacgacctgctgcgcggggtcggttccgaccacgtttctttcgcctcgagatcgacggatcatctaaccgatttgaacgcaaattttttataattttggccttcttagagcaggtacaataacatactataagccagctgcaaatatattttaataagataaatgaggagagagaaaaacagcggactacagatttatagccagctgtagcacagactccaaaacacactatgtgcatgatatgtgggaccagatattaataatgtaatatgtaactagttagctatatatactattaaacttgctcttatacatacgaattgcttttactttcttgatgtgctttgccgacacgagttacgtgccatcatgtttgggattttttttatagtggggaaagatgattacatgccgaacttaatttagtactagtacagtagtacatcattgaacgttatttggatgtgaacatttttatgtttcgtttcacatgtaggagtaggttagtttgaacgttctggcaggggctaattgatgttggatgggtcatgtttggtttttttagataaggaaagtattccttgaactttataccattgaactctacttggacgtataaatatttttatggattggttgattcgactccaaaacttgccctaccgaatcattgataactacaaaggtaataactcttatgtatttggattgcaaccaaacatgtgccaaataaatatagtcgaggaatcttatcctacaaaaacgagagtaccgattcctgcctcgtgcaagaaatttgaacattccaacagggataatggcgccgcacacataaaatcttctcatgaatcaattctggttgaaacgaaccgctgctacaatagaaaaaaaagaagattatggtttactaaaggcatgcaatgatgattagtactttgtgtctgatggatcattgtcatgatttatttcgaagcaaacgaattagctctgccgccatgagtagtactactatcaggtactgttaatagtggcattgtccaatttctgcactgaaaacaacccataaaaggttagacagcgccactgatacacacttagaagtcaagattggatcttgcctgccagaaaaacacggcggttagggggcaaagaaatcagaattaacccccaaaaaaaatgtcaaactaggcagcatgcctaactagacacggtcgcctgcacggattcactttaatgatgatcaaaatctctctgcaaatcttcagagatcgatcgagacataataaaaacacaggtggtgcatgtttcgtccacaaggagcactgtatgtggaggagtaattaagtgttatttgttcttcgtgaaacacaaaccaaagtcaaacccatgcgtccttaaacaattaattaaactactcagactaataatactactactagcagccgatggagagctagccaaggccaaggcgacgactgcaaagtcaaaacgcttctgaagaatatgtgcaggctaatgcttgcagcttgcttccttccaagttcagatcagcttcctgcaagaaatatgcatgcatgtgtgccaccatttggacctggtcagtgagacacaggcacagcagcaggagatagtagaaacttaattcgagatagtcgaaacttaatttgctcgtgcttcctgcaaggaagcaaagatgttttcttccttatttgaaagatcaacaggtgagaattcaacgactgatgttagaaaaaacgatgacttcagctagacagctgctgtacggttgtttattaatctgggcgatggccctgatgaattttcgtctctgagaatagtactggtacgtgctccatcaatttcatattgtaaatcattttaacttttttttctatttattctttttaagtttaactaaatttatagaataatatagcaacattttcaacacaaaataaatatattatcaaaatatattcaatgttacatctaatgaaactaattttggtgctatatatgttatcaaattttcctataaacttaatcaaacctaaataaatttgattagatcaagaaaagattaaaataatttattatatgaaacggagttagtagtatactgctccaaatacgtgacaaaactgacactgtaatccagtagggccgagggaaaatatctagcagctgaaacacctcttgttggtttcggtaccagcctgagactgctagttgggttgcaaaattgcaatcaactttaggtggcgctagctgtgtcatgtgtgcgcgcgagagagagactcagagaccaattacaattacagcatgtgcaatagggaaagatcggtatggctcgggtctgggtgctttccctttcttccgacagataattttcagccacagttgcagttttttgccgagagatcgaagcaaccggccggccactatctctccctctccatctccctacctttcgtctggaaaaggatggatttgcacggtgactcggccgtgccgagccagacgagacgcgagtacgcgttacgccggtcgccgcgctcgcctctgcctcagcatttgcccgttgcctcgttgctgttcgcaccaaggctaagtttagttccaaaatttttcttccaatttttctatcacatcaaaacttttctacacacaaacttctaacttttccgtcacattgtttcaatttcaaccaaacttttaattttaacatgaactaaacacaccccaatactaccctttctccggtcaaaaacaagcatcgcacggtgatgacgggaaacggcggcaggtttccttggacgataggttgccggcacaccgcgatgtacttcttctgtcttaaaaaagacaatttttatacacgtattcagagaaacaagtggtaggagagtagcgtggcaaagcacagcgaaatattaaagctagcgagagctcaaaacaaacgtttctgttcgaagtcacagttgtacgcacatgttttaatttagcacggatgaggggagtccctttaacatgtcttgatcatctcggcatcttctgctacatggtggacaatagtgtcgttgtccatgggtcacaagggtcatatgtatgtgatatgtcccccataaaaggaaaattgaaggaatggtggaatttggttatattacgggtctcatggttatcgatattacctaataagtccaaacggcttattcagaataaaaactaatatataggtaaaacttttatatatttgttcgtatcgatttaaaaaagccaaaaaaatatgctaaaaatatcttaaaattaactcaaaaatttaagttaaaaaaatggtttttcctttgacttattaggccaaccgacgggactctaggcttaatagaaattatagaaattataggtttgtttgactgtacttcctatggctctgttcgtatgtcaaggttctcaactcctacttctcgtttttcgcgcgcacgtttttcaaactgttaaacggtgtattttttgtaaaaaaaattatatacaaaagttgcttaaaaatcatattgatctattttcttttaaaaaaataattaattaatcacatactaatagactgctatgttttccgtgccggagggatgggttctcagcccaggcaaacgaacagagccatgcctgcaactcaactagcccatacagtgacttgtgtcagcaacaacggctgcattggctgcggaacgacggccatcatgtagccgaacacgggttagggtacatttggttttgtgttagaatagatcttaccaaatgttttggtattagtgtgaagagagacatggtgcgaatgcttttggagctactgaattttggaatggttgttcgtttgtgtttctttgcagctggctgtgggtgcggccgtgcgggtgtgctgtattacagtgcaggcagtaaaaattatgttgggtttggtggtgttgttgcggctgcacagttgcagcaatctcttcggatcaaccccaaagtgtttaagcaatatttagtttgtttctttactaattatttttgctaggaatttctttactaaagtttgataatactgaaatattacaccgatactctctttcagacaaaggcatgatccagaattaacttctagctactgatgtaggtagacatggctcttctagctactgatattgctttggtaaaactgcacagaggaacaattatcaattattgggctatgttttctttccttttcagaagtcacagaccattcttgtatcgaaatggcagcccaaaataagactgggctagatttgtagggaaacggaaatctcttcctgttaccagtaataggttatattttaagcacaaatataaacttttaactgaaaaattttaagcaagagatagaaactcttttttttattatacggtaaacacataggagcactcaacattacacacacaacatcacactcacaccccacgaatgtgctccataacgcactctaatagatggaaactaacgacatatctctaatctcgctaaaattctcggcctcgtcttttcgtttatgcttatacttatcagccaaaatttgaattttcaatcttaaatctggagttgattttggggttttttttcataagtatttacttttagatcgctaagaacacgtatataaaagttttatccacaaattatttttgtttgcaaatatgccatttcgcacgtctgttgaaaactcatctacgtgtgtgtaatattaattgtttggtaaatggaatcatgcacctatgacttcagtaccacatcacttgtgctttcctagaaacttaatctgcaagtgctttctgcgaggaatcaaagatgttttcatccttatttgaaataccaaggcctggtttagtttcccactttttcttcaaacttccaatttttctatcacatcaaaacttttctacacacatataaacttccaacttttttcttcaaacttttaattttagtcaaaattccaattttagcgtggaactaaacacaccccaagttaacttacacgaatatgcatggatagtgaacgacctcagccaactgatgtatggtttgtttaatactatatgcgataacctgagtgcaagttttatagtagagatagcttctaccacctttaatctgatgcacgttatatataataaattaagaggtaatatgtactaccaatagctataatactcttatgtttttattgaagttttatgtagaggttgacccttatataaggagtagctttctctctcctccacttcaccattttttagtcttacgtgacattttgagacgtgtgattagctgctcatttacttgctttgatgaattttcgtctccgataatagcacactcgtaatctagtactagtactgaaggaatatctagcagctgaaacgtaggagtacattctgtaccaacctggccataagtgtcttctcaaatatactttcccaacttgtacttactagtatttctttacaaccttttgcacgtttcctaaactgaacaatatatttttaaaataaagttctataggaaagatgctttaaaaaaatcaaattaatccctttttaagttttttagctaatgcttaactaatacttcctccgtttcatattataagactttctagcattgctcacatttatatatactagaaaagatgcccgtgcgttgcaatggatgaagtctattttaatcttattattgttatagcaaatatgctcgtgcgctgcaatggaaaaaaataaaattataataattactatatgattagatatcgtttttataatatcagctctttaagaaaaatatattcttcaaatagacctagtaatcttatgtgcaattcataatttaccataataataataataataataataataataataataataataataataataataataataataataataataataataacagtcttcaacctaaaaattgaaagaaaaatcataagatggaaccaagaattgaggacaatctcataacggaaaacgaataggagtagagaattattgtttttagggtaactggagtctagtttaatttttcattatgaggacgatatacaaaaatcgtgtataacgtttaacgaaagcacttcggtttttagtagtgtgtgatctccaactgctctttgttagacgaaaccaggcatggtcaggacggttacttcaatcctgagaccagtcattaaatcaaaagagttatcaaggtcgaagaataaaaaagacgttttctcaaatattttatttagtggggtataggattagaaatattaatattaacgttaacagaaagtcgagtcaatctcctgttagttattaatttctctagcgaacaactgtgtatgatatcacagaagcatgaggtctccttgaaagccaggcattagtttgtgcgttaaaatatttcttgttaattatccgcctcacaccctcgatgattagtttttttttacggacctcgctgattagttgctctagacggaaacggattcgatttacatggcggggttgtttgatggggaaaacgctttgtagacgatatcagtacgaatcgaaaacggacgacatacgaaaacttgtggcaaaaacatcttaaacttttatatttatggtagtatgtgctaatccttcactttgatcctcgtgccggcggggagggtttctaatccctccaaatagctagtcgggtttcaatcaactttaggtggcgctagctgtgggagagagagacaaattacaggcagcatgtgcatcgacattctccgtgttctttgcttttcctttcgtccttccaagagatagctatgaaccacggttgcatttttgtcgaagcaactggccatttttgtcacacactcacacaccctttcggctggaaaatgattggtggcacgtacggctgcacggtggatcggcgaaccacaggagtgtcgctgctattctgttcgcaccacgcgttggataaattggattatggcttttattatctggtccaaacaaacaccactcgcacgcctgaagatgaccggaagaggcaggtttcttggacgataggtttcactacagtataccgccataccggcacaccagcaaacgtacggtctaggggtgaaaacggtacggaaacggacggaaacaacctttatcgttttcgttttcatattttttttcggaatcggaatcgaaatcggaaaccccggaaacgaaaacggaaacgaatattatcgaaaccgaaaacggagcaaaaacgaaccggcgcggatacggtaacgaaaatttatcggaatacataaacccctcaaactgagcctcacagcaaaatatattcttctataacttcaaataatttgcataacaaatattctaaaagaatacagcaaaacagaatggtataagcctataaggtatacacaattcaggtgctatactgctatcagcctatcactccaggaaatgggtttgagaacaacaacagaacatcagtccatcaacacttagttcatcaatcatcacagaacagcaatagttcatcaatcatcacagaacagcaacgcacatcagtccatcagtgtttcagtacttagttcaatcacaaaacacatcaccctataaatacatagttcatcacaaaacatagttcaatcacaaaacacatcagtacatggttcaaacatatctcatccacttgtgcagcaggagtacactaatttgaaatggaaacttgaaattagatgtaacttgaaaattaaattgaccaacattttcttcaaacatccattggcgcaatgccatcctcattagaacattccgcttctactgtctctgtctcttgttccgttccattagccttcaaaaaaaatgatagagcattagtaaaagtgcaaagtcaatcactatatacacctgctgctgctggttgctcagatgctgccgctgggctgctggctgctgcgaggcgaggagccgtcggcgttggtggcagtgaggaagagactgcagtggtggtgtcgtcgtcgcctcgtcggtgtggtggttgttccgtcggcggcggcggtggtggcgacggtgaaacggcgagacgcggtgggacggcgccttgagatggcggggaccgagcaggccggcggaagtgcgaaatggtggcggcggccggcggcgaaacgacgaagagcaagggcggcgcgagatggtgggggcgaggacggcgggggccagccggccaggcgaccagcagtgggcggtggggcgccggcgccacgggcggtgggcgtgagggcacgccggcgccgcgatgccgcgatctggacgccgcagccgccgctccgcctccaactcgcgagtcgcgtctgagttctgagtctgacggtctctctcctatagggttagccggttagggtagatgccgccgcgatttgggttgggctgggaagctagggataaattatggactattgaatctatgggatttttaacttcggaaattccgacaatttttccggaatgtttccgatcgtttccgggttccgacggaaactgcttttatcatattcgattccgtttccgagaaaatatttccgttttcgattccgattccgagaaattccgaaaaaattccgaccggccgattccgtttccgaaaacatgaccggaatccggaaaaattccgtactgttttcacccctagtacggtcccatcgttagcttattcgtggaataagccaaacgatatatttgtaaacgaaaaataatttatgaataaaatttttatatatgtgttcttagcaatctaaaaacaaagactgaaaaataaatttcgataaaaaaactcaaaattagcttcaaatttaatgtttatttaatgttaaaaatttaaattttagctactaaacataaacataaacgaaaagatgagacctgtagacacgtagtgcaatagcaagacctattgttgattatgtgttagcaataaaaaataatttaacgataatttttttatatatgttcttaggtatttaaaaataaatattttaagataaactatgattaaaaatcacaataatcaactagaaaatttacttttaaaatatatttattttattaaaaaataaatttaaatttagaattataagtataatcaaaacaacgagctgatactatagtagtagcatagcactagtaacatccgaagcacaacgagaaataatttaaaggggtagagataaatctggtgagagctcaaatcggcgtccccatttgacgcacagttaaaacgcacatgtttgaattcaacacttgccgagttgattcccctgcacatcacgtcatctcggcatcttctactgctacatggtgaacgaaagcgttgttgtccatgggccatggcacaggggcgtctgtgatatgggatatttcccccaggaaaaggtaccctgtacgaaatgaagacattggttttgtgacagtggtaacaagggtatgcttagtttcgtgctaaaataagtctaaccataatttaggagtggtatttaagtgtgaatggttctggagttactgaactttagaatggtcgaattgtttaagttttgtttagtttgttttagtatttactaagaagtttgatattaccgaaatttgataacgttacaagcttacaaatggcaatgaatcaaaggcgctattactatttttttatatatggcgtaggcttttgtacaattgtgcgggatactagttagctattcagtcatggcttatttttgagaaaatctaagttttggcatccacaagtgtcaacctcttctccttttttttttctattaacgagtgtaatatctacaaaagtacaaagtttgtctataaaatgccactaccgtcatatttgtcgtctttccatccatacttccatagcgttttattagcccatgtggaaagatcattttgcttttgtgcttggactcaccttgccactcggctttatggtggagctgtgcatccaacgattcgattgtgttgatcccatctagattcgcgcggtcatggtaactgagggcaacggaaaccttatggtttgtcgatatgcgaggacatataggcagctggtggcctaaggggaattgaaccagtggcaatgccttgggtaaggatgagccgattgcccaaggaggatgaggtggaggtgggagtgcgcattgaggataagccactgatgacgtcttatgcgaggttgagcttgtcgtggcggccagagaaaggacgcaacggaggtgtctggtgaaggaatcgaggacaagccggcggtgggcaaggagacgtggcaccactaaaataaaatcgtttgtataatggtatttggtaaaactcgatggtgaaatgtagaattagtagatgtttctggatagcaaaatgttacaggcttcaatgaaagagagacccaaaataagatcgggctagatttgtggtacaacgagaagtcccacaaagctgaattcatcaaggaatgggttggattttaaacagcaatattataggcttttggattgaaaatatttcttggattagcccaaacctaacaagcccaataaggctgtgggctagattttctatccaaacacatgggctagttttaagcatcgccattgctgtcctttcagttgtagaggctcgtgctccgcttgattcccccttcctctttccggccatcccactgccccttcccagcctcctcctctcgccgccggctagaagcgccgatagctgccgtcctccgtcacttcctgctccggtcgcgttcgtaccatcgtgttactcccgtgtatgcccgttccagccgttcgggacaccatgcgcaccacctgtttgcgggattgtctagccaagctgttgcgccgcgggggccagcgccagggccagagctgattctgctgccccacacagttatctttcgcgcgggggatgacgcggagccgcaacgtgaggcaacggagcaagaaaaagcgggtgcacgcgctcgaggtggccacggagcggtggaaggtgctcaccaaggtgctcgccgtcgtcgacgcgctcaagaaggaggaggagcacgtcaccccgctcaagcgcctcgagatcctgcgcccgcagcttgggctcaccaagcccaacaaggtcgcccacttcgtgagccgctcgccgcagctcttcgaggtctgccgcgacagccgcggcgtcatgtgggcgggcctctcgccgcaggccgaggcgctcatcgaggaggaggcgcgcctgctggaggatcactcgcgcacggccgctgagtacgtcaccaggctgctgatgatgtcggtggaccgtcgtctggctatcgacaagattgcacatttcaggcgcgacatggggcttcctcatgatttcaagacacgatgggttcacatgttccccgagcagttcagggtggtcaggttggaggatggcgattacctggagcttgtctcttggaacccaaactgggcagtcaccgagctcgagaaaaagacagcagcattgactggtgatgcaaatgctaacggcattggcagtccaccaggagagctctcactatcattccccatgaagttcccaccaaattttacaagttactacaaattctacggaaaagttcatcattatgtgaaaaaagggaataccgagcagtttcagaagacaacatacctatatccttattcagaggcaagaggattgactcctggctcgcctgaatttgataagagggcagttgctgtgatgcacgaggtactgaacttcacgttggaaaagaggctggtgattgatcacctcacatatttctgtcgtgagtttgttatgccgcagaagttgatgaggctgcttctgaagcattatggcatcttttatgtgtatgagagggggaagcggtttagcgtgttcttgacgaagtcttatgatgggacaaaattgatagagaagtgcccactggtgaggtggaaggaaaaagttcttcaacttaccagctatagagggaggatcaagaatcttggtaaatttgccgagttgtttgattcagaggactatttgtttggtaatgatgatagtagcagtgctactgattctatattggatgtcaaaagtgaagattcagatgatatcatggatgatggcgctcttgcagatgatactgagatggatgtaggggatctaagtgattgttgcatagagtgaataagtgacatccattaatttaaagagcagtttttgatatttgttccctaacaatcaagctccaaaagtaaattcttgtgatcctagggcaatggttatattctcttactccctcgctcatggcatatttggattctttatattaacccggggcttaaatagaaactcttgctgattggatatgtacttcttgcttattgctaaaaatataaaccatgcgtactttatgtttatgtagatcagttggttcttccttttttattcacagaagatgatatttgcaaaaaattgtgccaaagcattatatattgaagttatgaaacgtcaagcaagatttgttttaacagtaatcgctatgtctgaattcagttttctagccttccagttggtgatggattcaatattcagataagtacatcgctactatttgtcatcggctatttgaaagctttatttacacatagttaactgtgtgctgtaagaagggaatatttttgtttatggtgtcataataagacttccaaaagggttttgaagaagctgaacagccggccaacgtggaagtgtggaacttgaactctagtgctcggtaagaaattctgtttggataatttctagagactcaaaagagatcatactgtagtacggagtacataattttattgacagagattttgtagatgttgccactttttttaaaaaacttggtcaaactttaaaaagtttgactctaagataaaccaaaattgcgttataatatgaaatggagggagtagttactccagtaaattagttatttgctctaggtgctattaattttcgtatgtgctttattaagtgttctttgtggctgctgttttttttaagaaaagaacattccgtagcccattagatgtgtttcaggagtaactggattgtctatgtttgtcttgttcttttataaggtctaaggtttgtaccgaggtaaaaaaggataaagtacaagtcttcctgctgacataagtgataatacctgataatgctctgttttgtcttcctgctaacataatccattcttacattggccagcaattctactgatgactttaaaatagtgtcagaatttttaacgtactgtatgtctgtactgctcatttcttgccaaaaacttgaaaatctagcaacttgtgtatatgatgaaactaggtcccagatttaccattccttcatgtattatttggaggtggtggtgctt

SEQ ID NO: 52015 - DNA, 30534 bp, Oryza sativa
  unsure (1)..(30534): unsure at all n locations
gtaacgaaatgcagatcaatccggtctctagtgggtgatggttaagttagaactcccaactgcacatatgcaccaccataaataaatgtgcttgtagattaatccatgtcgctgttgcttcgaatatatgagctgaaggtcttgatcgtgtattcgtgttggatgcttaatcattgtgtatctggaatttttcttcttgaggacctattgacggttgtcttctttagtcagggaagtggctctcagggttgctttcacgctcaggaggttttaaccaaaagttccttcaaggtgcctatggtaattttactactacagattcctctagaactcaccagctttgaggaaattcatgtgtaaaactgtgttctatacaaggcaaaactctgaagtctgaagaaacaaagcagcagcccggtgaagaaatgaattgtgttagcaggaagtaacatcacatggcggaccgtgtattcaatcagtcaagtgctactatcggcgcagctggtggttactggttagcagttgaaccgatggatggatgatatgacgaattctggattgtacagtcgtacagatgaactgcatgtccattggcttggggagaactaaccgaaaagggcctcatgctaaaccgaacagtaagtgctggggatatttttggatcctttttcctttgcagcttgctgcagcactgatctcatcgaatggttaattaagcccttgtttagttataaattttttcttcaaacttacaatttttccatcacatcaaaactttcctacacatataaactttcagctttttcgtcacatcgttctaatttcaaccaaactttcaattttagcatgaactaaacccaccctaagactcttacagttgcaggactggcaccaagtcaccagagttttttttttttaagcagagaacagcatgaaagctgaacaggttttcgccgctacctaataaagaggccctccatgaaatctcctccgcctcttccttctaccactgcgcggtcaatcaataagggccagctagttgatcaagaatgccagatcagtgtccaagcagcagtgcaggtgcagcactctgtacatgtacatcctcctcccatcaacacagttattgattcacagctttgtagcagtaacaggattgattccacatgtgtagtacatctcaataataaacgggtttaatgtcaaaataagcatatggagttgaatctttgagctctgtttgattctattattgagtagatcatcgatttgattatagggataatcaaatgttttgagtaatagatttaacaaatgaattaaaataagtggtctaaataatacaatatttgttttcagtgaactttttttttaaatgtggagttaaagaattcattttaataattcagtgaataggctgaaaagaacagagagagtacagcatatccatgcacattttttctttatagacaatgctggtgtttgcacatgttctgtaggagtagttattactgctacaaagtcagtgatcagttaagccaaagctgtggccatgaatttgctatgctagcagtatgattccagtacttgcagttacaacatggtgcacaggctcacagcaaacagatgcatgtatatgcaagaacaccatgcattgaggcagacctttcctggcttgctctctaaatggcattaactgccatctagcgacccacccacccaccaccatctcctcccccaacccctgcactgctctccctatatctaaagtctccgagatcatctcatcacttcactgccttctcatttactgcagaaggtgaaggtgaaggaggaggcggccatggcgagggagcaggcgctgctgttgacggagatcgtgaaccgcggcgtggagccgtcggggccggacgccgggtcgccgacgttctcggtgcgggtgcggcggcggctgccggacttcctccagtcggtgaacctcaagtacgtgcggctcgggtaccactacctcatcagccacggcgtgtacctggccaccatcccggtcatcgtgctcgtctgcggcgccgaggtcggcagcctcagccgagacgagctgtggcgcaaggtctggggcgaggccacctacgacctcgccaccgtcctcgccttcctcgccgtcctcgccttcaccatctccgtatacatcatgtccaggcctaggcccgtctacctcatcgacttcgcctgctacaaaccagccgacgaactcaaggtaatactacttaattccatgcttaatcacgtatacacatattcggtagttcatcggagtagattagtattatattactagtattatgtttaaatgaaagcatattatgccaatgtgtgaagctcctaggatctatgatttgttactgcgcaagaaacttgttcgttctaacatttcagatctcacgtaaattgaatcggccaaggttttattctgaaacaataaaagcatatttctggtgcaaaaggatagatcggataaaacatatatattgacgttatacaaagtgctcaaggactaaatgaaggtctcatatggagctagcataggatcgaatttcatgattcatggaatccacatggtccttcagtgatctagccaactgtttttcaaacagcgccattctttttttttttttgagacgaatcaaacaacgcaaattaaaactgcaaatatacttttggatttaccggacgtagtagctgaaatctcaaaactgtgaaagctattcaaggtgaggtgtgaagagaaaactcttggaacgtgtaagccttgggcctcctttaatggttgagctagctcatgcttgtccacctcatataagagatagtaaaaagtctacctctcccatagattgtctcatagcacattgtataaaatgctttaggtttcacaatttctttagtagcttagctcttaaagaagagatagtgcattctctttccttatcttctctctcttccacatcatacaaaagctgatgtggagatttatgagctagctgacttacctttgttggaggagggtttagtattaactgctggatgaacttgcattgacaacaacaaaaaaaaaaaaactcatcatcagttgggcttttagttgtgaataactattggtatagtggtgtctatagctagtactactccgcatggtcctttaatacggtcataatccttgccagctactaccagctcaaatgcttttaatgtagcacacattcactatttgagcactgacaaatctgcccggcactgactgaaatacccgagccacgctcatacgattaccacctccattttacttgacagccctagatagaaccggtgtgattcgtcttttttttttccttgagatttcaccacattggcatatttgaaatcatcttgaattaaatttttagaaattatatcattagatccatcataaaaaaaatacttccatacttagtatacgcttgttattactccctccatttcaggttataaaatattttgactttggtcaaagtcaaactttcaagtttgaccaagtttatataaaaaaatagtaatattttcgaccgaagataaatttattataaaaatatatttaattattaatttaataaaactaatttgctaatttaaatattaccatatttttcatatttgtctataaacttagttaaatttgaagcagtttgactttgaccaaagtcaaaacatcttataacatgaaacggagggattatatcctaacacaacgttgtaaaatgtgcaatggtcaaagcaatatcttagaaattgcacaaaaaaaaaagaacggaggtagtgctattttgtatgaatcaaattcatttatcatatattgattctacacctaataagtttacactagatagatgcttttccttgtgcccgagtgcctctgttatcttgtactgtatgttacttttagtataaatactgccatcattctcaagtaaagtctttgaccactgcttttttccctgattactctatgttgactaaaggaatggtaataaaatattaactgaatattataaagtatttacatgatatattagatccaaaattgataagaagctcctccttagtagatactccaaaagaaactctagttatatctttgcagacttaggcctggtttagttctccaattttttttccctaaaacataacatcgaatctttgaacacatgcatggagcattaaatataaattacaaaaactaattgcacagttaggggggaaatcacgagacgaatcttttgagcctaattagtccataattagccatatgtgctacagtaatccacatgtgctaatgacagattaattaggctcaaaagatttgtctcgcggtttccaaacgagttatgaaattattttttcattcgtatccgaaaaccccttcgacatccggtgaaatatctgatatgacatataaaaaatttcttttcacgaaaccgcgttatgaaattagttttttcattcgtatctgaaaacctctttcgacatccggtaaaatatctgatgtgacatataaaaattttcttttcacgaactaaacaggcccttatatgctacacatcactaagttttggaaaacagtttgttggctaccattattttgttggagtcttgaatgcaagttaggaggcacctttggttgggccccagtccttggaagtgaatgggcagggcagggtcgaagttatgacgagctggtaggatgctttcggttatggccaggccagccggtgactcgatcagtcgatcgctctcacttgctcgtgtcatcaaatacggttgggcgattgggcacacacattcaatgagccgaaccgtattattaaaccgtaaatgttttgcgtgagcacacattttcttttcgaaaaatgttttgcgtgagcacacaaaccacaacctgcactatccttgcacgcacgatggatttgagtcaaacaaccaagtttacccggttcgcatgcatgaaatttcttcgatttcacttgttacttacagtttgtaatcagtttgatgcattatggtactagctggtgatttgtaagcaaggatgtgattttgcatggacaattgcttgcaggtgtcgaaggcggagttcatcgatctggcgaggaagtcgggcaagttcgacgaggatagcctggcgttccagtcgcggctgctggccaagtctggcatcggcgacgagtcctacatgccgcgctgcgtgttcgagccgggcaccaactgcgccaccatgaaggaaggccgcgccgaggcgtccgccgccatgttcgccgcgctggacgagctgttcgacaagtgccgcgtccgccccaaggacgtcggcgtgctcgtcgtcaactgcagcctcttcaacccgacgccgtcgctgtccgccatgatcgtcaaccactacaagatgcgcgggaacatcctcagctacaacctcggcggcatggggtgcagcgccggcgtcatcgcggtggacctcgcccgcgacatgctccaggccagcggcgcggggctcgccgtcgtcgtcagcacggaggccgtctccttcacctggtacgccgggaagcgccgctccatgctcatccccaacgccttcttccgcgccggctgcgccgccgtgctgctctccaaccgccgcagggacttccaccgcgccaagtaccagctcgagcacatcgtgcgcacccacaagggcgccgacgaccgcagcttccggtcggtgtaccaggaggaggacgagcagcggatcaagggcctgtccatcagccgcgacctcgtggaggtcggcggccacgcgctcaagaccaacatcaccaccctgggcccgctcgtgcttccgttctcggagcagatcctcttcttcgccggcgtgctcttccgccacctgttcccgtccaagacctccgccccgccgccgccgtccgccgacggcgacgcctccgccgccgctccctacatcccggacttcaagcgcgcgttcgagcacttctgcatgcacgcggcgagccgcgacgtgctggagcacctgcagggcaacctgggcctccgcgacggcgacctggaggcgtcgcgcgccgcgctccaccgcttcggcaacacgtcgagcagcagcatctggtacgagctggcgtacctggaggccaagggccgcgtccgccgcggcgaccgcgtgtggcagctcgccttcggctccgggttcaagtgcaacagcgccgtgtggcgcgccgtccgccgcgtgcgccgcccggcgcgcagcccgtggctggactgcgtcgagcagtacccggctcgcatgaacgcttaagctgcagtggtaagtatgcagaggctaatgaacggaaaattactgcaacgtcaaaagacgggatcggcatgcgatgccggttaaggttcaagcttgattaatttgtgttggtgtattagcaagtcggtttatgagccatagactaccataaaagttgtgcgagacatgtgtactgaaccagtgtacgcgagttcggtgatatgtgaacttatctacgtttgattctattatttatactgtcatatgctacttgaattaacctggtggctgtttattaagtgttgctgcaatggactgatagttgttcaagtatatgtgttttatttggtccctggactagcaagatagggagcatagcacacatttcctttttttaatagagtaatttttacaaaacttaatatatttttatcaaactatcacaaaacttcacatttaagatgttgtattattaaattatagatttaacactgaatttgtcacaaaactattgatttaagattaagtattacaaaaccacatatttaacaataaaattatcataaaactataatgtttatagttaaaattcttagcaccaatgttatgatcaagctataaacgtccaagttacaagtttatagctccttgtcccatatgcctataagaattaaaagtaagctaaaaatgttaaaatggaaacgagacgacttgccataataccatatggccctagcatatttccgttccaaccccaaaatatttttgaaactgatggactttcaagttttaataaaattttaggatgtctcgctagtttctgcttcattgaacatgggtgtatgagtacgatgttacgtatgcagtgacgtgtgtatatacgttaccacgcaataaaagaaagacaacgttgcatcaccaactttactaagttttcggctatttttacaggtaatttgccttggcacacaatccgaattttcctccaaagaaaatcgcacacacaatccactcactccgtctccattttaaaatatctgtcactgtaaatattcatatttaaactctaagcatttttttctaaaaaaagtacaaatgtttaaaggattatatattttgaaagtacatgatactgacagttgagatcggactagaaacttagactttatccgccagctcatcagacccataagcccaccaacggctttccggcccataatccctcttggacggcatagacagcttttgctctttacggcccaactacccgagttgagcccaagcggcccaccaagctgcctcgccccacaacgaggggaggcggctctcgtggcaagcagagagcgttcgtcactcgcatctcctccgcctccggtatccaacctcccgcaccaaatcccaatccggatcccccacgctaaaccctagctttaaacccccgaatccaaccaatccccgcgccgattcccgccatttcgcgcacctcgtgccaggatctgctcctgggcggcgctcttttagaaaaaaacctggcagatttcgacttctgcaatggagcccgtcgatttcggtgggggcaaaggttatggaaggaatctctgtctgagcaacgatctgatccttctggagtaaggttttgtgctgggtggatttgggattcgatgtggctggagttgagctcatctcggggagaagggattcggacggtgtttgatctttctgtcgtgattgctttgcttcgggtttgctcagcgctagaagatttgctcgcagaatcccgcgcggagttttgaagaaagcttggtatttcctggttcgttgtggtttgtaagcgatgcagttcgaggacgggggagatgttcatgttggtgccggtgagggtgaagatggtggcagggtcacagtggatgagcttaccaggtgaagaatttttctttcttttttatttttaccgtatcctacattcagcagttcagcatcgagatttcatatgtgcaatgtttgggtgaaaagctaacgtgccaagctagttataactgtagctagggcctaccctccataatatagttttttttttttgaaaccgtccctccataatatagtgacctagtaacggacgagacatttcatagtacaataaatctaacatgctcttgtctagatttattgtactatgaaatattgaaatgtctcatccagtactaagttgctatattattagacggagggagtacgagatatcacgagagaagagagctctggatgttagtactatttagtacccttttgcagttcttttcttttcccaattctagtcttctgtagttatggttaagcgagaccggattcaaatttagaagagtaacacttcctcaagtcagtattacttgtcgtttcagacagggaaatactactaagtgcaaatcaattccactacctgaaacatcatatatttccgtccggagggagtagtagctgatcatcaatgccttttctcagatcgggttatgaaagcaataaaattatcaaaggctgtctgtcggtccatgcatatggtggaatgttagtattgcacactgactacttagcaggttggtgactactatactactcagtactatcaacattcagcagcatgctggaaattgatacagatcattttctcttgaatcaaggactcaattattcatggtagtgagacgattcctaacttttatgttatagtttttcagatgtctacgttgtggcatcagtgcaaatgcgacgcctcatatgcgccgtggaccagagggacggagaactttatgcaatgcttgtggtatagcatgggcaaaggtattctaattgttctccaccacttcttgtttatactcgctccaattccaaatgtaagtcgttttggttttctacatgcagggaaaagtgcgaaaagttattgattctgatacccccatggataatgccatgtttgcacaaatggttccagaacttagcatggaattcgatgacgaagataaagcatatgagttctacaacaggtacgctggacatgtgggattcagtgttcgtaaaagttcatcggacaaatcagctgaaaacatcacaaggtcaagaacctttgtatgctcgagagaaggttttcgtaaggacaagaaaggagctaaggaagttaaaagaccacggccagaaacaagaatagggtgtcctgcacgaatgtcaattaagattacatctgatggtaaatatcgtatatctgaattcgtaccagatcataaccatcagccagcacccccatcaaccatgcatatgctgaggtctcagagagtactcactgagctgcaaacaactgaagcagactcctcagaagaatcagcgacaccatcaaggttttctagttgctctttggtgaagcaagcagaagtaattagacataccaattttctccctgcagaatacaggtgctctctttgttcaaagcgcaagaaaaatatgcaacctggtgatgcaggagtaactgtaaagtacctgcaaagcatgcagctaagcaacccttctttcttttatgctgtccagcttgatgaggatgacaaactgacaaacattttctgggccgattccaaatctagaaccgacttcagctactacagtgacgtggtttgtttggacacaacctacaagataaatgaacatagcagaccattaacactattccttggagtgaaccaccacaagcaaatctccatatttggtgctgccttgctttatgatgaatcagaagagtctttcaagtggctatttgatacattcaagattgctgcaaatggaaagcaaccaaaaacaatcttgacagattggtctatggcagcaactacggcttctgcgataacagcagcatggcctggaacagttcatcgcctttgtccatggcaagtgtaccaaaactctgtcaagcaccttaatcacatctttcaaggctccaaaacatttgcaaaggatttcggaaaatgcgtttatgactacgatgatgaagagaacttcttgcttggatggaatactatgctagagaagtatgatctacgaaacaatgagtggattaaaaaaatatttgatgatcgtgataaatggtctccagtatacaatcgccatgtattcactgcagatataaaaagttctttgcagtcggaaagtgttagaaatgccttgaagaagtccttgagtccacaatttgacctgttatctttctttaagcactatgaaagaatgcttgatgagtttcgttatgcagagttacaagctgattttcatgcaagccaaagcttccctagaattcctccatccaaaatgctgagacaggctgctaacatgtacacaccagtggtctttgaaatttttcgcagggagtttgagatgtttgtcgattccgtgatttatagctgtggagaggatggaaatgcattcgaatatagagtagcagtaacagataggcctggggaacactatgttaggtttgactctggcgacttatctgttgtatgcagttgtaaaaaatttgaagcaatgggtatccagtgttgccatgtgttgaaagttctagatttcagaaatataaaggagttaccacaaaaatatttcatgaaaagatggaagaaggatgtcaagtctgcaagtacaggcaatcaagaacttctgaatggaggagtttcacaaattcccagctcttatttgaatgttcccgtgccatttatagatccacaacatgtgcaatcaaataacgagcttaaccatgtaagttgatcaaatataactattcattaagtttattttttatccttagtaaaggttgaggttcaatatgcgtgatcaactacaggacacttctgtttctaactcccaccagcaggcccttcatggaggtgcacagggaagtcaggtaagaccccttggtagaactgaactcacttgtgcaatacttaatttctaaaagcaatattggtgcttttgctcttctcatagtattttgtatgcaccgccttctgaggcaagcaatccattaagtttgtatgcactcaaattttgttagaaaaatattctcaagatcgccacattccatggttgtatacgatttgagaccactggtgacaaaagaatacgctcacatctttttgtgcatttctggcttttagatatacagaagattagtactccctccgtttcacaatgtaagtcattctagcatttcgnacattcanannnangtaatnnaattaaaacaaananannnatnnagannnannaannncaatatgtatgtgggaaatgctagaatgacttacattgtggaacggaggaagtatctattaattggaacactcaatataagtaaattagactcatgattatatggaagatttttttaatttgcctttctgacttttggttgttttacagggttatgctcccttagcagggattcagcagcagcagtttattggaaattttcgcctgaaccatgaaacaggttttttatgaaaaacagaactggcgcttttgccctgttcttgtcttccaaaaacttttttgctctgttattccaaagacaatgacacaagacatcgaaacagtctctagtctctacctttacatctcccttgtaaattctaattcatatttcgtagcatcacaaatatacaagctcaatagttttcaggaaactacgttcagagtttaaacgctgttggaccttggaggaagtacccgctaagacaaagtctgattattggcctaaaataagggtgtattattagcatatgtgatgtagtatatacagacatacagttcgtagttctggtgattttgcagaagctttcaattgcttcgctgccaaatggccacttcaaccatgcactcttttaatctaatgctctcactgtttccaattttcagtgttggcgtggtggattatttgaatttccttattaggatcttctattactctcatagtagtaccactgctagaaaatgttttcttaaagaaaaaggtactttcagaatgctacatgttttggatagccatatttccacaacctgactgacgtctgtggttactgattacctaaccagataatcaaatccatgtgcctgcattactcaaaggaagacgatttcccactgctgatgaactatgttgtctccttgccatttggaacaagttcagtacagaagacaatcaaactattttgcagtcaggtttcagcgttgacgagcgtaccattgtctgaattactccacgtctgcaaaaacataatatgaaaaagagaagcacaaccacaaccacctgacgaaacaaaactgaaatttgaagtacaggtactagcaaatacttctacttctcctgtccaaatcatcgtattacgcactatcacacacacacacacacacacacgatctacagtacgcggtagagatcaagaaatgagacggcgtcaaaatgggaacaaaagataggaataagataagaaaatgatgtgttgttcagttcttcggtgaagctctgaaggatgttcttggattgctctcctggtctgtcatgggtgtttctgacgaatttgatgatcgctgttcctgagacaatcaaacaaattgcagccgatggaaaagatggccttaataagctgttaattcgttggcgttgacagctttggtcacatcaaaataccatttcatcccttccagactctacatgtttactgatgaatccacatcacaaaaatacacaaacgctacctccaaaccaaatacatgaagcctaacaagtttctacctccatttgtcgaaggtgtcgttctttctctgtgtatatttagtttagactaggtatgcaatgactcaaaaattgccatagatttactcctgcagagatgaactgtaaagagagtacagcacataattatcagttcagaaaaaaaagaagagtgaataatcaaatcaagtttttttttcctctgaaagcaatgtcagatttatacctcaaagacacgagcagattgtcagatttaatatataacgtcattaactttcttgacaaacatttggtcatttgtcttattcaaaatttccatgcaaatataaaagtatttaagtcacgcttaaataatatttgatgataaatcaattcaccacaaaataaataataattaaatatttttttaataaatttcagaatactacaactttagtgataaaactatcggtttgctataacattaacgatattttttagtttgctacaacaacagtgtgtgaaattatcacaaaactgaaacttttacgttatttgctacagttgtcacctatatatactgtagtagcatataatgtaaacattgtagtattgtgataagttcttacgttattattgtagcaaatcgatagttttgtaactaaaattgtagttttctgaaatttaatctattttttaaaataagacgaatgatcaaatgtataaaaaaaattagcaacgtcacatattaaaacctgaaagaagtactaggaatccatcataaaaaaatcttcacaaagtcgagaggctcagagctcgcccggacacggtcgggctggctatctcgcgcgaaacgatccaacgaaacagcgcgcagtgtcgaatccgagggccgcctcccgccggtgccgtccaaagccgcgcgcatcagaagctacacccttttttatcgaacaccacgcccaccaggtgctcgccaccgtgcgtgcatggacgacttctccttctcccactccggcccgcaaggcggcggccgccaccgccggcgaggtagcccctactctgtcccggacagctccacctccttcgccgccgggctccccccctccccgcgcggcggcccgcggcgccgggatgtggtcgtcgacgacatgtcgtggcagagctcagtgtcctggcagccggacacgtcgtgggcgcagccccacggcctcggcgccgccgtcgggccctgggcgcccgccaggatggggagcgccggccgccgtggccccgcgctgttccggcggacggcgagggagtactacgtgtcgaggcggtccgcccgcccgcgctaccgcgacgtctcctcgtcggcgcacaggcccgtcgccgccgcgccggcggcggtggcggcaggcggctggagctgcagagcgtggtgaccgacgcgagccgcgccatcgtcgtggtgccgaacacctccttcgccagcaacgacgacagcgtcgtcgtcgccgactccgccgtctactccgcgcccggccatgacgccggccgaggaggacgagccatggtgaggtacagcgacaccaacgccgccgccgccgcctcccgcgaggtctccttctcgcgcgacaaccacgaccagctctacgtctccgcggcgcggcgtgacccgcccagcttcggctacgacatcagcgtcgcgtccttcagcggccagagccggtacgaggacgccgtcggcgactacgacgacgacgacgacgagatcgacgtgagggtcgggaagcccgtcggcgtcgcggggcttttcaagtactcgacggccatggacatcgtcctcctcgtgctcgggtgcgtcggcgccatgatcaacggcggctcgctgccatggtactcctacctgttcggtaacttcgtcaacaagatcgtcaacgtcgacaagacgcagatgatgaaggacgtcaagcaggtctcgccgcgtgcatcgccatgatcatttcttcgatttctcagcttcgattcaaatccgatcttctcatcttcgtttcttgttcgatgccagattagtgtgtacatggcgttccttgctgcagttgtcgtcgtaggagcctatcttggtgagcatttttgcaaattaatcatgaaaaagttcaattcctgggaatctcttgaatcgaattatgagtttctaattatgtgcgatcagagatcacctgctggaggatcatcggcgagaggtcggcgctgcggatgcggcgagagtacctgaaggcggtgctgaggcaggagatcggattcttcgacacggaggtgagcaccggcgaggtgatgcacagcatctccggcgatgtcgcccaaatccaagaagtcatgggagagaaggtagagcgcacacacaaaatttacccccaaacacatatgttcaaaagctgacacatgactaaaatcttgtgcacattttgtaaagattccaggattcgtgcaccacgtcttcaccttcgtcttcggctacgtggtcggcttcgccaaatcgtggaggatcgctctcgccgtcttcgccgtcacgcctgccatgatggcgtgcggcatggcctacaaggccatctatggcggcctcaccgccaaggaagaggtttagcagccggccactcactctctcgctcttatactgaaaccaaatttgatgaattgaaagtttgaaaccaatttgatggaatttggtaggcatcgtaccagcgtgccggcgacgtggcgcagcaggcgatcagctcgatcaggacggtgatgtcgttcgtcatggaggagcggctcgccggcgagtacgccgagtggctggacaaggcggcgccgatcggcgtcaagatggggttcgccaagggcgccggcatgggggtgatctacctggtgacctactcccagtgggcgctggcgctctggtacggctccaggctcgtcgccaacggcgagatcaagggcggcgacgccatcgcctgcttcttcggcgtcatggtcggaggaaggcacgcacatcaacctcctcgcaccgcttcttgttgtcgtcaatggcgccggtcgccggagtttcgtggttggtgtggtggtgatctctgatctcggaatggttgtgtgtgtgtgcaggggcttggcgctgacgctgtcgtacatggcgcagttcgcgcagggcacggtggcggcggggcgggtgttcgaggtcatcgaccgggtgccggagatcgacgcgtacggcgccggcgggcgggcgctgccggcggtgaaggggcggatggagttcaaggacgtggagttcgcgtacccgtcgcggccggacgccatggtgctgtacaacctcaacctggtcatccccgccgccaagacgctggcgctcgtcggcgtcagcggcggcggcaagtccaccatgttcgcgctcatcgagcgcttctacgacccgactcgaggtgagagggaatggccattgacgcgcacgcagagcacgaccatggcgagatcgtcggtgatcgatgacgaagcttttgcgtccgtggggtgtgcagggtcgatcacgttggacggccatgacctcgcgtcgctgaacctccggtggctccggtcgcagatcgggctcgtcgggcaggagcccgtcctcttctccacctccatcatcgagaacgtcatgatggggaaggagaacgccacgcgccacgacgccatctcggcgtgcgccatggccaacgtccacaccttcgtcctcgccctccccgacggctacgacactcaggtcacactgacacacacaaactaatcaaccattaatctcacggattatctgttaattaatcatagataatataatatgtgtgttaattaggttggggaccgtggggcccagctgtcggggggacagaagcagcggatcgcgctggcgcgcgccatcatccgcgacccgcgcatcctgctgctggacgagccaaccagcgcgctggacacccagtcggaggccgtggtgcagcagtccatcgaccgcctcgccgccggccgcaccgtcgtcgtcatcgcgcaccgcctcgccaccgtccgcaacgccgacaccatcgcggtgctcgaccgcggcgccgtcgtcgagtccggccgccacgccgacctcatggcccgccgcgggccctactccgcgctggtcagcctcgcctccgacagcggcggcgccaggccagacctcgccggcgctgcagcggcgtacaccagcttcaccgacgagtcggggtacgacgtgtcggtgtccaagtcgaggtacggcttccagacgattcgagaagaggaggagaagaaggattcgcaggacgccaaggtgagggtctccgagatatggaggctgcagcggcgggaaggtccattgctgattttggggttcttgatgggcatacacgccggcgcggtgttctcggtgttcccgctgctgctgggccaggcggtggaggtgtacttcgacgccgacacggcgaggatgaagcggcaggtggagtacctggccatggcggtggtcggcctcggcgtggcctgcatcctgaccatgacggggcagcaggggctgtgcggctgggcgggcgcccggctcaccatgcgcgtccgggaccgcctcttccgcgccatcatgcggcaggagcccgcgtggttcgacgaggaggacaacgcgatgggcgtcctggtgacgcggctcgcgcgggacgccgtcgcgttccgctccatgttcggcgaccgctacgccgtgctgctcatggccgtcggctcggccggcgtggggctcggcatttgcttcgggctggactggcggctcacgctggtggccacggcgtgcacgccgctgacgctcggcgccagctacctcaacctgctcatcaacgtgggcgccaggtccgacgacggcgcgtacgcccgcgccagcggcatcgccgccggcgccgtgtcgaacgtgcgcaccgtcgcggcgctctgcgcccagggcagcgtcgtcggcacgttcaaccgcgcgctggacgggccggcggccaaggccagccggagatcgcagctcatgggcgtcatcctcgggctctcccagggcgccatgtacggcgcctacacggcgacgctctgcgccggcgcccacttcatcaacaatggcgtgtccaccttcggcgacgtgtccaagatcttcctcatcctcgtcctcagctccttctccgtcggccagctcgccggcctcgcccctgacacctccggcgccccggcggccatcgccggcatactaaccatcctcaagcgacgtccggcgatcaccggagactccaccaagcgaaggatcacgatcaaggacgggaagcccatcgacgtggagctccggaaggtgacgttcgcgtacccgtcgcggccggaggtgacggtgctgagcggcttctcgctgcgggtgaaggccggcacgacggtggcggtggtcggcgcgagcgggagcgggaagtcgacggtggtgtggctggtgcagcggttctacgacccgggcgacgggaaggtggtggtcggcggcgtggacgcgcgggagcttgacctcaagtggctccgcggcgagtgcgccatggtgggccaggagccggccctcttcagcgggtccatccgagacaacatcgggttcggcaacccaaaggcctcgtgggccgaaatcgaggaggccgccaaggaggccaacatccacaagttcatctccgccctcccccaaggctacgaaacccaggttaactactaaaaatttcaaatctaagcattcaaatatcttcataaattatagagtacattccataaaacatccaagttacgtaaaaaaataaattatccaagttatataaaaccgtaaatattttgacacgtgacacataaccctaaatactatggtactaatatttgataaaaccacaccgttaaccatttctgatacaatcctatatcaaaattttaaaatgcaggtgtaacatttatatgatggatagaatccttataaaattgatatgtgattgtagaattaaatagtgtggttttgtgaaacttaatcatgatacgtgaagttctatgccatatgccaaaatctatgaagttttgtgtaatttggaccataatacgtgtggtttgtaaaatttactctaaactaccattttgaaatgattattgggtgaatttcagttgaattgttgaactaaaatttctttgttttgcttaggttggggagagtggggtgcagttgtcaggtgggcagaagcagaggatcgcgatcgcgcgggcgatcgtgaagcaggcgaggatactgctgctggacgaggcgagcagcgcgctggacctggagtccgagcggcacgtgcaggaggccctgaggagggcctcgcggcgcgccacggcgatcaccgtggcgcaccgcctctccaccgtgcgcgacgccgaccgcatcgccgtcgtcagcgccggcagggtcgtcgagttcggcggccatgacgccctcctcgccggccacggcgacggcctctacgctgccatggtgaaggcggagacggaggcacaagcgttcaagtaaaaaaaaaaaaaaggttatctcgttgctgggggatttgcaattataacactgcaaatattaatctttgttataatgatactagacccatatttcatagatacagatgggtccatttatcatccactcgaaatgtcaaaacagtaaagccccaatgtttgcagtgtgctaagtaatttggatactatgacatatttttttggttttaattagtgacttgggatatgctgattaagtgatgattgttccactatatgtgtcaatatataaatgacggatattatgccgtatttttttggaatgatttcttaattaggttgcttgggatatgctgattaagtgatgattgttccactatatgtgtgtcaatatataatttttccggtgatgttaccaagaccacgacattaataaaaatatgcagaagtatacgaattagatggaatgtccatgttgaccatatatgaactctcgatacctgacaatgatgcggcaaaatggggagaaaatattatgagggggagagattgcagcgaagtaagatgagaaatcctctctgataagacctgcgagctgcttttttgatggcattagttaagcgaattgatttggtcatgccatcaccttgagatggatttgttgagcaacctgggttgtggatgactggatggtggagctgttccaataattgggtggtttgctcacactcacagtatttttttaaaaaaatttcacggtagtgcttagcattatgaggaaccaaaagcagattgcattagccaattcaacaaacatcttgcacaagcacgataaaaatgtctttgtcttgaacagagattatgatatttcatttgaagtggggttcatgctgctagtagtacttgttgaggtccaaaggagattattgcattaattaattgtctgatgcaatccattttaactagaaatatatggagtaccaactgtctttaatagcatatataaatctgtagattatacaatatatatgtgatattatctccaagctgactaatgctgtaacaaaacggtttaacccttaaacaagcaacctgttcgtccgctgcagaaatgagagtagggaataaagtgtcgttttctctagaggctgacatttcgtcacagcacgattgctgattcaacccctctgggcctctcaattttgtgaggtcagaggtttaggtcctcgtttatccgtgaaaataattgccccttattgcagggtgccagggtccaatttcttcagctttagcctgaatataagtacagcccataattcttggtgaagccaattgccccttattgcagggtccaatttcttcagctttaggctgaatataagcacctacagctcataattcttggtgaagccgttaatggagtgatgccgttaaacacttatcctaacctgctacggcatgatggacaaatatatagtatacagtaccatctccatttattatctaccaaatgctccctacgcctaacggcctaagtaccaacccaacaactggtagacggtagttactatttcggtagtagaacagatgtttgtatacccaattatcggcagttcggtactactcctactactactactactactactactactactactactgctactactgggttctggagtgattactttactcccttaatctcgttgcaaaattcaagcagctgtccggcacgagcttttgcactgaaaaatcttttcccgtcacgtcgatcgccatgaaaaccccccgtggcctccactaaaacaaagcgaaacgatcggtagaagaaagcgcgccgcgaacatgcgcggatgaactcgcgtcgtcgcagccacccaccaaccaacccaacccgagccgagcccgggtcaacctgtcgaccgcgcagccccgcgcgcgcttgggggggcacacgcaaacgcaatcggatatgcgcgcgcgcgtgcacgcgacctcgcggaagacggtggaagtgggcacgcgcgggcgcgaaggcgaagcggccgtggacgcatgcgagccttgacgcgcgcggcggtatggcctaataactggctgcctctgcctctgccgccggccgcggcgagggatggcattggcgtggcgcgcgcggtggcgggctgaccgcccatcggctgcgacgcggacgccgcaccggttctgcgtttggttccgagctcgccccggggatcgggacctccctcccaccccacacgttgtccccactgacatgtgggcccgagggtccgtggggtccacgtgtgagtgaccagcacaaagtcgggcccgcgcgtcagtgcgagctagcagcaacgtgcggccgccacgcggagagccgggggatctgacccgaggtgtcagagacagttatacgggcagttggtcgcctcgtgtcgtctactacctcgtcgccccctttttattcctcctcgggagagcacaaccgccgcttgccgactccgtcctcctctcgtctcctctcgacctctcctctgctccgagcatccgactccgcgcggccgaaaggtatactaatcgtctccctcctcccctccccaccccaccacctgttcgatggaatgccgcagccaaaacagctgcctccctgtttcgattttcgctgcacgaatttgatgccgggtttctcctcctgtggccgagaaagaagtgttcttgttcaattgagggattattaggctgtttcttgatggttctgttggtgcgccctggttcttgttctcggaccaaagggcggaaaaccacgcggattgggtaaatggaagttcttagagaaggctgtggatagattattttaagttctcttgcgtcttgctttcgtaatttttcttttctgggataatccttcggttaagaaattctttcctcaacaaggaggtgtaacttagtcctttgcttttttttcggtttcttgtttcgcgtactaggattgctttccttcttggtaacctcaaggtactatgtcaatcaacgccttcacttagtttggagaccaaagacctccgacaaggacaattttgctggagaatttttttctcatggaaattttcgtgcaagtgactgtatgagacattaaatatcgtttctgtgccaaataactaacagaagttggtttaagagcccctctacaaatgttgggcgttgtagatttaggagttgtattctgaccaaaatgctcatccctcccaagaattgccgtttcttggcttgttaggtctctcctttcctagtagccattaagtcaagaaatgaagaaacccatataggatggtgtcttcttccatgaattaggcagtgcatttctcacagcctctccctaaggaattgaggcatgggaaatgggaaagttggtagcttttggccttttaggtgtccacgtacctggccatgaagagcttcataagaattattagttgcgtttttagttgatgggccctacaaagctttgctggaaagctaagaaacattcataaagtcaatttcttttcttctaatgctttcgcttgttcagttaaggtctctctgtgatgtgcattggaagatatgtgattggacttctctagttggatatgctgctgttgcaggcgactgttcggaaggacatgtgtgggatttctaattgaatatggagtacatcaccaaaaagaacaaactttgcttcaggcctccttgtgatttgggttctacgtgtccttttggtgtttgtcttgttgcgttcatcttcagacatgtggcgaaatctagattgcaaatgttcttgtcttgggactctagaattctggtctagagtatatctctgtacggtgtcctttcgtggttctgatgctttgtcaaagactattttgtttcttttcctttttcctttagagtggtcaaactgtgttgttaagcagtagattacatgtttctcggcctcttttaacatatgtgatttattattcgctaacttttttcaaaataataaatatctgtatggtttcctttcgtagttctgatgctttgtgagtggtcaaactgtgttgttaagcagtattacatgttttttttcccttttttaacatatgtgatttattattcggtaccttttttcagaaaaaagaagaagaataagctggcttgaagatatggcatctcttactccaggggtactgttaaaagtactaaaaaatataaattctgatgtgaaagtatgtggagaatatcggtccattcttctccaagttattagcatagttcctgcaatcactggttcagaactttggccagaccatggtttctttataaaagtttcagactcgtcgcactcaacgtatgtttctttatcgaaggaggataatgaactcatcttatcaaacaaacttcaacttggacagttcatatatgttgaaaaggtccaatctagtatccctgtcccagttcttgttggggttcgacctgttccaggaaggaacccttgcattggaaatccaaaggatttgatgcagatgtcaactcccactgggatttcagaagcattggctcatcaacggaaggctacaaagtcagctgaactgtctgaaagtgaaaaggagaactctcagaggaaggtagtcatcaaagagcagaaggcagttgtagcttcacgttacatgcttgggatatctagcaacaatagcaaaattaccaatctaaactccagcatagatagtgacaaaagtaatggaggaagtagcatatgttctgcaaatcagaagtcagctccgacaaaattcaaacaagaatcaaaacctcaggtacgtttaagtgcgtaggtttaatttacatttgaactaagatgctactatcagccaaaacatggcctttactatatattgtctttgacaatccccgtgcatttccatagtgatgaatcattccatttactatgggtctttgagatgagcaaaattgtactaatggtatttgaatgacatctgctatattcgagttcttttattctaaaatgaacaaagataggaagcacaaaagcatctctaggatggttactgatttcatttgctgctaatattgcaggaacggccaaatactccatctcgcagtcctgctaagatagtttctgcaaaacaagaaattaacaaggacacacgcaagactagcgcttcttcacccagtcagaatggctcagctgtagtgaagaagcaaatgtcaaaggacagcaaaaaggagtctgcatctgaaaaaaactcaccaccaaagctttataagacttcaccaccaacaccaacaccaacaccaccaccgcctgcaatgacttcaccaccaaagctcaatttggcagcaaagcctaatggtacttccggtacagttacttctacgccgactgttaaacgaagagttactgaaactgtctcctgggactctcttccaacaagtctaatcaagtcagtaaaggtatattaacccattatattttttaggtcatcttcgtttaaaaaatcgagcataaatcatgacttgattatataccgtctacatgactgtattacatgggcatgcatgaagccatgaactgcaaactattatttgaaccattccatgtaaatacgaaaagaggcttcacgaagttctaatccatgctgcatacatttcttttgtgtgaataggttgttgcaaggaggaagactattgctcttgtagtagcagctgaggctcaaagggaggctactgcagcggcctcacttcttaaaggccttgggtaagtagttctatgctgaatttctgttagctcaggtgtttcttttacagctattccagctggtgtagttggtgtccccctgttccctttttgtgcaaatcctttccaaagtgtcaaacaccttttacttgaaactatatactgtactcttgctactgaacgtaagaactaatgtctgtgtctgtttttcagaatattcgctgagatcagaaagtccgctgaggaggatccacatgctgcaattaccaagttttttcagctaaaccggcttatcattcagcaaagtgttttttggaaagattactcatcagagcctgtcaaagaatctcggccagagaaggaaaagccatcaaggaaagcctctgcatctcagaacaaagctgttgcaggtagtacggcaaagaactctgacgatgcttacacaagtgaaaagattgactgggccagagaggatggtttcaaggagatctccagatcatggattattctaaagaaagaatcacagtcatggtttctcagtttcttggaagatgctcttgaagctggattcaagttcgagggccaaaacaagaacaccagagaacgagtaagagggcactccaagggcggagacgggcaaatcgcggttcggttgtcgcaactgaaggagacgagtaactggctcgaccagttgcatagtgaggttgataaatctcaagatgctttggttgaaaccattgagcagctgaagcagaaggtgtacacctgcttacttgggactgtcgagactgcggcatcagcacttgaagccaggtagatgctgtcacaggagctcagggctggttgtgtttattttttggcttggaaccagctgaagggagtactctgctgtaacagaactgcaacacacaatatgatcgatcctgatgccaaggagagtgaaggaatcgatcatctaagttatttattccacttgtacaagatgacgtagggagtgattgaggtgtaaatagccgctgtgtgtgtgtgtgtgtccattttaagttatgcattaatttattcattttgggcagtggtcatgttgctgttgcgtgttggcaaatctccgatactcttcatgtttgctcaatacgaagtacaaatctgaaagctttgcaattttcaccttgcatcaaaatggataaactgtgtgtgttggtatcaagtcatgctgggtttgcagaacatatcagcctcccttttgctgtcagcgtcacttgatccgtattatgttgtatgcaagtttgtcagaacgggtgacatatttgagaggagtatccgtgctcatggtcaataacagtataacataacgacagtttagcaagagtgcagaaacttaacagaggtaattaggtggaggctgttctttggtcctgcgtgacatccagaccttttttgtcgatgaagctttcggctggacggaccaccgcgtgagcttgcaaagcacagagatggtgggctcggatcggatggatgcagcagtgacatcctgatgtgtgtgcagctggaaagctccgggggggaagctgctttcgagctgtgaaagctaagccagtggccgctgcgcgtgtatctcgccgaggaatgcacgcacgaaagcgatcgagacccgggccgcacgacgcggcgacggcagaacaaatatgggcctccgagctggagaggccggcccatcagcatggaggccaggtacggcctggtccattttggcttagaattcagcccgaaaggcggggctcggagagacaagggcctggcccagctggccggtgtgcgtgcacgtgcagtaacaaaagcggaaaaaaaaaaaggaggatacggtcacatggccaaccgcgtgcctgaatctcctatatgcaacaatatcgtgacacactagaaaaaaacacgcggctttgccgcgtgcaatactggatgggccatgctatttgaccctaatgagacagaataatcagtttaacaacaatgcaagtattatctcaaaaaaaaaaacgcaagttatagcatgatactacagtgcacaatcatgattgctgtagtagactacaaaatttagaagatttttgtgacatatagtgtgatatagactgtataatctgaacaaaacacagtggctatttgtgacagacatttgaagagtattgacatattatcttcaacaacgggagacgacgacaggattctcgagaacccggccgacgtcctcgtaatcgttcgccggaaccaagcaacccatcgtcatcgtcatcatcctctagatgttgatctagagcttaaataatgaaagattttaataaagctccatgtcaactttgtattagagtaactggctagtagatcagtctaggttcttagtcagagctagatacaccaaaagtaatttggctagtagatgagaggataacaaaagtgtccatcttggactatagatagcaaaagtaggctgtcttgattggagaagttatcaggtagaacgcttctttttgccctttgtctgaatgaagccatagtcagtgctttcttcttcatcattttcctaaaaaagaaaaacagaatccttatcaaagtatattactaaggaaccagcaattctttctcatgcaatacttagcacaatgcaggcagtaggtttggcaagtatgagacccctagtgtcagccatatatgtgaatagtacatgtaaatagagaatagttgttgaccacagggtatacacttgcttgaatatttcattccattatctaaaaaaatacacttgattgaaatggtgccaagcttgtgcacagtacagttagtaggttaattgtatgattgaagaatgaaaaacaaatgaatttaaatatgatcagttgtttacctgatctgtactgtttggatcttcataagctctttttcctgacaaagtgcttgtttctaaattatatggttcaacttccatgctttgaatatcttggggtggttctatctgggatgatgagcagtaaataagaaagaaaagaaaggaaatagtaagagattatgtagcaccgacaaaaatgaataaaagaaagagtactactcttttacctcatgttgtattttcttggatagtataggcaccagtggaggtaaattatgtagttgttgagatgaacttgaactgatgggaagattcttagttgccttaaagccttggctggaatgttgccttccaaatctttctttaattgtcagcacctcaaatgaaggttcatcagcgttgatagttatgttcagcaaaaccttcactatgaatgtgaatttatgtcctatccatgcttttatttctggaggtgtttgattgatatcatattgccttttcatagtttcagcagtcctaccaataagttctgtacctttcttttcaaatagcacaagttcaaggctagctgtgccatcatttgcaatgaatggtattttgtacctgttcaagtgcagagttatttgaaaattatagttatatatattcacacttaatagtatgattggaaaaagaaatactcacttgtactcatactgcctacatgggcagttctctttcttgcattttaatatagaaccatcccatatcatcttgcaattgcacaatttacaggcttgataacaccaagtttttctttcctgaattccaatgatagtagcagtgcactggtatttttcatcctatgtaaatgtataaatgaaaggtttaagttgtagttcaatgaaagaatttaatagtatattaatttaggtacataagtctaaccttgtcaacaaaaggatcaatttccttcaattctgcaagtgttttgtgttcaatgctccgttgcatatcttcatcactttgcaagtatagcttttgtataggatcagcatgtggtggaaggctgcatatataagatgttagaaataggaaattccataaagtaaaagaagatatgcaggggattaaattgtacttaccatttttgaaacatcttgatttcagggatgtcattttcgttgatataccaacgacaagctgttgttccacttagaaattcatatgttcccttaaggattttcattgatgtaccaacaaatattgctattatatggttattttgaccaacttccagtattgtctctccatcaaactcaacagctctttttcctgataatgagaggtcgatggtttttccactttgaagaaacaataaagtcagtatcaagtagtttcagattagtgttagtgttcagatggggaaatatagctgatattggcataaattaccttaaatcttgtagtttgactattcttctcatcctataatctgatgaacttgtagaaatcattgctgcattagaaacagcaatgatttttccaataacatctgcaaagatagaataaagtatttgattataacattgcatatagaatattatggttacgtgtaatgaaataaaagttaatttagtacctagaaaacgatcagtcttgcttgtgaaatcatgaagtttatcaaatgacaccaaatcaaatgtatactttggaaaatccataggttgatctttggcttcaatgatacaagttcttttgtttagtttgatcatatatggattaccaactgctctataactgggcttagcattgttaactgttatcttgctgatgtagacgatatttccttcctgtaaatattggttcaataaaggtatagcatcaggtgggatctcagcatagatagcatctccctgcaatggccatgcaattttaataaaataatatatatttaatgataaatatatgttaggagaaaatataaataaaggatatagtattaccttttgatcaagtaaaaccagatctaaatgtttgatgttatcatcttcatagtcctctaaattcccatatcctggatattcggacgcatatcatgtagtcatatcgccctgggcgcagctctgcaattggagtgatattcatctgcaaattataagcaatggaaaatgttagtactgtgtttgtgtttatatagtatatagagaaaaatatagtatacattaaga

SEQ ID NO: 52016 - DNA, 703 bp, Oryza sativa
ctatcattgggttgttcgttttctaagattgtcatagtaatttcaggccacctaggattacatgtaaatgttataaataaatgtggaggtccatatacacgacatattgctatgccatcgtaatagttttgcattgtatatcgtttagaaccaacatggcttgatggtaatattattttttttcctatttggtttccttccgttaaacctttttgtactgcatcaaatattccttgtaaacattcagctcgtaatttgttttgatttttagcaataaacattagtctatcttcatcttctattgcacgggcatcaactattgcttgttttgataatctaccataacataaataaggatttggttgatttggtcgataatgcatatgatatttgtagtattcatgtactgtaattgttgatcttgtttttttactctttttatttgtattactattataatatggtatgccaagttgaaatcctctttctccataaggaaataataaagggtattgtaaagccatataggctggatggaatatagatatgcgttgtaatccattatttttattttgaacaataatatctcttttataattttctagatttaattctccaactattaaaattgctaaatcttctgtatgtggcatttcatattgtattggatcacctttatcagcccctattattcgaatactaa

SEQ ID NO: 52017 - DNA, 749 bp, Oryza sativa
ttcctgcagcccttataaattttttttaaaaaatagtcacacaaaaagtactattcattttttattattttattaccaaggaaaggtattattcttaaaaaattttcacttaaaacaaacggccaaacgttggaaataaatagtgtaaaactatacttattttgggacggacggagtatatgtcaagagcgggggatacatgccatggcctgtgtacagccaagtagcagcaggatttgattgaggagagtgagatatatcctgccatgagaaccaacccccaggaagcaagagctaatggggatccaatgaagtgacagtgatcggggccgatgtatagaggagctttgggacttggtgtttggtatgacagcagcctaattttgacatttaacagccgctgtcaattcaatcacaaaattaacggagaatgttttgagcttttggtgcaagaatgggtgtggccccagttttttgttctctttttaccaagagcctcttcttagcggttgacaacactaactgggccgtcttatctgactcacattgtggcccgtttgttggagtactagcacagtagcaccagttcggcgatgtcatgatgtcagcgattgatgcagtaaaatgattcatacgcgtgactcatattgcttgttttcctcttattcttttcattgcagccatcaggttcagtcttcatctaccaacaagaccagtagtagtctttaagccgttccagtgggaaaaga

SEQ ID NO: 52018 - DNA, 4658 bp, Oryza sativa
  unsure (1)..(4658): unsure at all n locations
nnnnnnnnnnnnnnnnnnnnnnnnnnnnnnnnnnnnnnnnnacgcttacgttgcatcagaagtcaagagacaattcaagccttgaagtccagaaaagaagattcctatagaccccagtgccaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggtggaagtgaaatacatgtacgaactcggtaaaccgcttgtcaagcctgagctgctgcagtccctacccacacaaatgtacaagttccatcagctgtacacggagatgagcgccaccggtagagagatgatcggagcgaggatcagggacacagacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgcatataagtagactatagaaaaaaatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatcctctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctagaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatttgattcatcaacgaagaaatccttgatcccaagggtgaattctactacgacggaaacacaattcaccggtccttagcttttgagctagcagcgagtactactacgtcgaaatcgtagctagcgaggacatataatggattgtaattaatacatgactacatatgtttctatatgcatatgtacacattttctataatgtaaatatattttggtcatatatatatctatatacatatgcatttgcataacatatatatgtataaatacatatatattatgcatgtatatacatataatataatataatatatatatatacatatatatatatatgtatgcatatatatatgtattgaaacatatatatgcatggtttaaccgggagtaccaatatccatgcaaaaaaaaaaaggtcagctcgatctttagtcccggttggtaacaccaaccgggactaaagatggctcagccggccactggttgatctttactcccggttatttcacccgggactaaagatagcgatctttagtcccggattggtactcccggtttagaaaccgggactaaagagggattacgaactgggactacacagggtttctccgccagtgattgtcgccaattatttgatctctcgagatcaaccaagcttcgacgtgttgtcgcggcggaggaccatggtgtcggcgtgatctaacattaatccctcgacgtgtgggacatcaactggtgcgaggtattggtcggctgagtccaagtcgaacccgacaccgatccctaccaaccaagcaagcacgacgaggagccaaaaatctactgctggattagtactaccgtgttctaactaggacaagatttctagccacgatctactggtcgacagcctgacgtcactctgcatgtccctgtaccgagccaacacccatgtgcgcacgtgcatgtatattggccgtacagagctcttatatgtgttttcatgacacatactccatgtttcccaaggtaattagtaagattaatttttaaattaatctactaattccgtaaatatatccggcatatatctacacaggtacacaatattttatatgcaatttatcgtatctattcagatcatacaacattctcagatcaataatttattatgtctacctagagcatattttttatacaatatctattatacgagtgtttccgacattagctgactacggtttaatattgggggctcgttttattttcctatgtataaatcatgcttgtttacggtctacataatacctgatatttacatctgctcgttatatcctgataatactagaagatccatgcagtttttcgaatacatactcgatattctctgctatatgtcttgccttctagaaaatattttttaggaacaattgaggactcgagtgggttgtggtcaagttacaccgcattatcgagaacgatctcgacaaatgcagagtcgtcgcgcccaacctaccaacgaagaccggcgacctatctcatagcaccggccatggctggactactcgataaaaggttgttaacggataattccttgtgaacgtcgtctgcttgatcacccgacatgattgcgaacggacacccggatatgctataagttgggtatgtgagtcatgctggccacatgagatacacatgtaataaaccaactctagcactttcattcgtgttcgagagatgattctactcgctcgctggttctcgaaccagtacgtagcaatctcctacaccacaacctccattggtgttcgagagatgattctactcgctcgctggttctcgaaccagtacgtagcaatctggttcttgaaccagtacgtagcaatctcccgcaccgcaacctccattggtgttcgagagatgattctacttgctcgctggttctcgaaccagtacgtagcaatctcccgcaccgcaacctccattggtgtttgagagatgattctactcgctcgctggtcctcgaaccagtgcgtagcaatctctcgtaccgcaacctccattggtgtccgagagataattctacacgttcgctggtcctcaaaccagtgcgtagtaatctctcgcaccgcaacctcagatggtcgaggtacgactacagcaataacgcagcggtcctcgcaccacgacttcaaatgatcgagagacacctactcactggttctcaaccagtcaatcgtagtgatctctcgtacatttacttctagtgattgagttacgactactacccggttcttgaccagaggtgtagcgattctcccattacctctacttcaacaagtgttttacccagtgatccctcaccataaaagacacctagcattgaaacctatcctaatgtccctttacgccgtcttgacaatgcctctgaggaacctaagggaacttcggctggggacgcccagagcggataaggctttgtcggatccttcagagacgaaagaccatgtaagatctggtcgtgtaagagttctcgccgtgcgtattaaccaagccgtgtaatcggaaattgattttccaacctcacggctaggggctaggatcagtgcttgttcaaccaaggcaggtcaaaggtccaagagccttatcatctgagaacgattctccgacgacaaggctgggggctagggagagtgtataactcaacaaactgactgatcgaagtcggtaaaagagtagacgctcatatacaaaacatttggtctgtaagtttaattcatcttcagttttccatacatattataacatgtcaccctttgagctttcgctcaggggctatttctatctaatattcttttctaagtattgatttcaggaaaattctattcgacattatcgaagaccgcatgtctctatggttctacaccaagatcgactaaggcgagtacgacaaatgttgacaaggctccgtcgcagattctgcgcttctcgatcactcgagaacggttggtggatctcgacaaggaatacggaatgaagaaatggtgtacccgccgagataaaatttcttgacttcaat

SEQ ID NO: 52019 - DNA, 1446 bp, Oryza sativa
ggctaccccaaatattatactagtgtgattatggtgaataagagtaataccggcttcggccaacaggatgtatggttattacctgacaactcaggggcccgaacctgtataaaaatcctcttctccgtctcttttacctcagcctcgtgtataccctagtaccaacgatccccatagtatgcaaataccggaatcgcgacatcaaacgtcgacagaatgatccacagcactccaaatgctgggtactgtagcaaacctttgaattttctcctccacaacagagaggatccgaattgaaaaacttcagcattttaaatttatattagcatcttctcatctagtaggctttaatttatgtagtaactagaaagaattccgtgcgttgtaacgggtgaagaatgttttaatcgtattattattatatatatttttttaaaaaaagtatatgggaattttattttgagatgatatccaattccaaacccttgtacttttaaaagcgaatgaatttaaaaattaactcaaatccggatgacatcccaaaaccatcgacggaaacaacttcagtttttagtaatatataaatcacctaatcctaaatagcccaacaaaatcatatgttaaaaaatgatgttaaaaagaattatatgtagatgaatccttcacaaaataaatgaacatgcatccaagctgcccatacaaaattcagtatgttttgcatttgcatgttacaaaattaatgaaataaacacaaataaatctgaaataattcagaagataggctatattttacactgaggccccctttgaattggaggaaaaatggaggaaaaacaaaggaattgaaatcctacactattcatgcctttgattcgtaggaatgagaaaaagaaaaacgtaggaaactttcctattcctacaattctagagcaaaaacgtaggaaatttaacatccactctaacctcttggaaaactttcccagagtctatctctctcatccaattcctgcatttttcctgtggtctaatcaaacggtcattcctatatttttcctgtgttttgcaatcctctgtttttacacttgcattcctaccaaaatcctgtgtttttccaattcctccgttttttcaatcctacgattcaaaggggccctgagacagcccaaaatagagagacagcttgtgatagacgttgggcccttttacacttttaggtctatatgtgtagaaaacgtattggaggtggagaaaaaaaaggaaatatcgtcaaaacgctaaacacatatatgacaagacggtttgctggaacgaagagacgacggacaaaaatacgatgagtacggaatcatttttaattttttaataggtaaagatataatctaaaaaacgaaccggaagccagtagccagaaatgaagatccagcttttccaaattcttttcaactg

SEQ ID NO: 52020 - DNA, 6630 bp, Oryza sativa
tatcctggctctgccactgagctcacctctaggaagctcggacccaccttcgtcgggtctgcagcacaggccaacgccatctcctgcgaagctagagcattctcttcctcagccaccaccaccattgtctcaccaacaaagctccccatgaccggaaggattggccatagcagggaggagctccatggagaggaaataggggtgacgttggctagcgatgacgtcgtgctcaacatcccggccatcaccgttgcccgccgtcaatgtttgtcgtcgatgtagttggacatcgccaactaccatgcccaccaacctccgccgcttgcctctcctactgacatgtcattggccacgctggactttcccgatgtcgtgccatcagccatgtctgtctctcccgcctccggtgaccgtgccaccccgttgttgttgccctggccatctccagccatgttggcctcctgcgtccgctcgaccccgggccaggcctgacatggaggcgccatatctggccgtgtggacgctacatccggtcatggtagcataggatctgcggcttccctcaccatgacgcgctaccaccttgtcggggtgcgttgtcaccttgctacgcgttgcgcctcctcctccacgttagagtcgatgtgttgtcgggattaggccccgccaccaccatcctggtcgcatggttgctcggcggcaagacggagggagggggaagggcgggctggcagtggtggctagggttttgcccctgagctgcccacgcagggacgggcaccctcctccttgttagtatttacttcgtgtccccaggtcaagcgtgcaattatgttttaaaatctctaagattgataaactaaggccttgtttagttcccaaaaacgtcacatcgaatctttggacacatgcataaaatattaaatatagataaaatgaaaaactaattgcacagtttgcatggaaatcgcgagacgaatcttttgagcctaattagtccaggattagccataagtgctacagtaacccatatgtgcttaacacggattaattaggcttaataaattcatttcgcggtttccaggtgagttatcaaattagatttttcattagtgtccgaaaacctcttccgacatccagtcaaacgtatgatgtgatacccaaaaattttcttttcgcgaactaaacaaggcctaagtctcatatgcaaatgatggaagctactgaattgggaaaggattgcggcaaaacattgtaaaaagtaaatacattaaagagactatgctccacaatgtgaaacctggacggtgtgaatgtgtgtgcaccaatattgtttcttgggacctgtagatgcacttataactatcataatgttctcatagcaactctggactcccctggcctaggaaggaaggtttcttctctttcttattctacaaacctgtttgtgtaacaaaatatggtttccattgggaaacatgaggcccctgatcataggatattttccatttcttttacacagtgcaaaaacaatctcatgggtcacgaacatattaaagatccacaggaagccaattgtcctagtggcgacataagtcatatccatgatgccatgctgttttgttacactacattaacaagatctcactattagaaaaatcatttttcccgacgtggaggtcctttttttcgcaggcggacatgatccttggaaccaaatgaccgtctacgaaaatataaattggggtgaagttcgctgaccacttaagtggcgcattttcgcaggcggactacttaagcggcgcctgcgaaaatctattttcgcagacgaaccttatatggtccgcctgcaaaaatcgtacctatcaaaaaaaaattaagtacttatcttctcctccacccctccccaccactcatttccctctcaactctctctcgctccctcaacacttctcccaccgggccatccccctccgctctcctcccctccctccctccccgccggagggggagcgaccgcggcagcacggacggcgtggacgtggtgatagcggcagcatggacggcgacgtcggcttctcccgacgcgctctcccccagatccggccggagggaggccgggggagggctccgatggtgaggcgcgtggccggcggggtgtggggtggtgacaacaacgcgcggggcggcggcggcggctcccggcacggctcccatcccctcccctcccctcccagtccggccggagggaggccaggggagggcggcgatggcgaggcgcgtggccggcgggatggcgggcggcggtggctcccgacacagctcccctcccctcccctcccagatctgaccagagggaggccgggggatggcagcggcggcgaggcgcatggctggcagggcgcgggacggaggcggcggctcccggcgcggtttccctccccttccctcctagatccggccggaggtaggccgggggaaggtggcggcggcgaggcgtgtggccagccacgacgcggggcggcgacgatgacggctcccggcgcggctcccctcccctcccagatccggccataggaggccgggggacggcggcggtggcgaggtgcgtggccggcggggcacgttttattttttgttcgtccataggattttcgcaggcgggccattgcaccgtctgcgaaagtcattggtatacaggtggtccccccctccgcctggaaaaactatttttggccgcatgcaaaaatgtttttttaagtagtgtctaacaagtctctaaatatatagtggatagctaaccacctgcactgtgcaataaacagcggtgcacttactagctgaaaagactatggatggcgcaatacgatatatgatatacgttcagtattttacaactcgccgtgctcctgaaccagcggccctgtatgagattattagcgagctaactgaacccgaagcaggcatgcaattcgtcgagcgcacctgccgcgcgtcacagaggcgacagacacgggacacccgcagagccaccgaacggagggggcgcaaccgctgaagcggcaagcaggtgaacgaggagaagcacgcggacgcgggtgggaattggaaggcaaggatacgaaccagttgaaggccttcatggaagggacgaggtttacgaggccgccgaagccacggatgaggtggtccagtcgctccggcgtcacctcctccttgaaccgcgccagcacaatgtgcttcagcacgccactcctccctgccgccggggtctccgctgccatcgccctgtggcttcttgctgcagtctcgctagcttctctgcgcgctctccctcttccctctgttctcgactcgactcgatcttctgcttgccatggtttagaacttagaagtagaagcagtgggtggctacaacctagaaagtggttgggccgttggggttggtgtgtagtagtattgtgtatccccacaaaatgggcaccttggtaagagcaagtttatggtctagtcactgatacaaaattatcatattatctatagctaatatacggctccatcatttcgcttattcgtagaacactgttacacaaaccctttgtagccccggtttacaactcctttagtccactgctgcacaaaccctttgtagccctagtttacaacccctttagtcccgggtagcaaatcggagctacgaatccgggactaaagatatatatttttttttgttatttgcatgtgcctcctccttcctccttttttttttttgctttttctcttcctggcgcgctcctctactttttttcttttattcgtttttttctctctcatctgccatttttccttctattttatagaaaaattaaaaatacatcgatgaattcaaggctacaacccatgatctcatggttcagaacaaactctcctaaccaattcacccatatgacgctatttgatttgagttcattatttgctttctctatatagctgttcaaattttgtaaacacaaactcgttatgttaatgtaggaatcatatcttggtactatgattcggtagtaacattatcgcagaagtgcagtaacacgatacgttactgcgaaatgtataggtataggtcgttgctgcgaaatttataggttgttattgcactctttacagtaacatcatgataaaattgcagtaacagagaacatatagtagtaacggtactactacagtaccaccgcttgtgcatagctaaatttttaaatctcaatcttgtgcaaaatacaagtgcaaaaaagtacttctctttgtctattcaaagatacatagcagcaagcttagtacaagtaaacttttagaattctaatctttaaacaataatatctctcacatcgcatattatttttagaaccgttttcaccataatgattagatccgtcatgattattttataacgttgttactgtggaaagtagtcgtgttactgcacattgaccgtcgtgttactacgctgttccagcaagacaagaactaaaaaaaaaagtaaatctcaatctttagagagcaatatctctcacgttatatagtatttttttaatccgtccacaccatgatgttcgtaaaaaagtacttaataaaactagatacatcatgaccatttttcgatgttgttactgtgagaaagttatcctgttactacacgatgaccgttatattactgcggaattcctgtgagacgtgaacaacaaagtggtgggtaggggagggagtcaatgggcgggtttgaccggtgttgatgttcgttagtgatcagtttcgaccgtcaatattaccaaaatagaggagaactagttatgcttgcaatgtgtatccattttagaataataatattccactagtatttggttcactaaccttttgtagagaataaccataaagtggaggagaatcgacatcgaatcagacgataaatcaatcggacgatgtcgagaatcagacttatgcatgaatgggcaaagaactcagaattgacacgatgaattgggccaaaattcacaagtctgcacaaaggagcaacagaggaggccacctaccgagtttgggccaggagggcatcggatagagggtattagctagtatgtcatataactaggatgtatgtataccatgtatatagattctctttctattttctatccacttagcttatatactttcatatgagaatgagtattcccttgcttgtgtgtcactctaccctttgatttatcttaacccctgcttggactatgattattataagtaacatataaattattagtcaggttctctctattatgatctttccatgggattaaataaatacgatacccttggaatactctcgggtgaaatgctacaatggtatatccatgcgcttgcggatgaactctgtaaccataatataccaggagtatttctgcgccattgctgggaattatatttctagtaatgtcgttaagaaataccaacaaccgacgagaggtggctttgaccagcctttgactgaggtgggaggggggatttgggccctaggaagggtggggaaggtggaattggcccatgggagggggaggagtgtagaatagatttgctatatatatatttagcaagattgagatttaaaaatttagcaatgcacaagcagtggtactgtagtagtaccgttactaccatatgttctctgttattagaatttcaccatgatgttactgcattactgcacttctgcgataatgttactaccgaaatatagtaacaaggtatgattccaacagtaacataactgattttgtttcacacaatttgagcagtcatacaaagcatacaaataatgttctctattcatataatatcatatggtgaattggttaggagagcttgcctgtcacgcccggaatttctatccaaaattccaaacgcttacatgtgtgtaaaccctcgtccaggaatcagccgaggcacacaataacaaattgataatagagtataattattactctaattaataagcgaatataatgtcattacagaggtagatagttcctctcaaacaataaagatctaagcagcggaaaataagataaacggcgcagacgactccatcccacaagcagctcgaccagggctatgcctaatcatccacaccttcggcatcactgtagaactcctcctctgatgaatgattgaaaggtgagtatatgacatactcagcaagccacgcagcaaatatgcaagtgcaagggataacaaaggatggcataacatagtctcatttgcataaatagcatttaataaatatttcagaatttaataaaacagtaaggtattaattaaacaatattaatccaacgctatacaacatacccgttgcataggcccaaccattctgaacaaccattcccggctgcacagttctatctccaaaccaggaatataccattccaaactaggagctaaacaaattattaccaattacagcatcatttattatggtgagaggtgtgaaactaatcacgaaagacattgttaggccgcccataaccgcgggcacggctattcgaatagttttactctggccagaggtggaccactgtaccc

SEQ ID NO: 52021 - DNA, 2028 bp, Oryza sativa
aaccggtccttaattgtcatgagcacgaccatcaaaaccatgtgctcacaacccaccattatcaagttttaattggcaaattaattaattaactaatcacgattaaccatcatgagctatcattaagtcatcattaaataatagtgaatcataagttatcccaattatatgagctagtgtctctaagcatggctaagcatcctattcactttagctaaaaccatataatgttctagctaatccaattattaaccaagtgacaaggaatagataatcaacatcaaagggctataacaaaggcaattggttattcccacccaatgacattcaaaaataaatgcagtagttgaatagaaacaatagctttaaacgggatcaacatgctcaaagggttgtttgggatctgtgtgacttgccttgctggccttggaactcttcaaattcttctcctgcaaaatcggactttccgggaacgtcggaatctaagtataaaagagcaaaatcaccaaaacagcacataaacaatcatgaatagtacatgtggatatttttaacatgtagatctcaattttagaaaaatttagagacttgaaccaactaaatccgagctaagatgaattagttatgaatttttaaagattaaatcggattaaatcatttatatagattttaattgaattatgacgcaatatagaattatttttgaaaaggaaaaaggaattattgcgtcagcaggctcgggctcacggtggaccgggtgcacggcgacagtctacggaacggacggccgagatcaaatcgatctaccgccggtccatagctgacgtcgacgatgacgtcggcgatgacgtcaccaccggcggcggctcggccacgcatgctcgccggcgaacgacggtgcggcggcgcaaacggagggcatctacacatagcgggcgacgcggcgaactcaccgatgacacagacgacggcggacggtcaacggacggcaacggcggcaaggtttaaccaggtttgtagtagccaccagggtccacctgctccaactactgagccgactgctatcttagccgatgcattgctcaacatctggtatagatagccgaggagaattttgcccaaggggaattgtttctttgtttctagagcttcagccagaaattgccagttggttgtggggccgcaacttgatccacagaaaagaaatttttctagacacattaatagaaaggccacgtgttctcgcggggtgaccgaaccctggcccatgtatgctgccacatagcctgaccaaccccctatgcttttggttttgaagtcatattggttctttgtgttcaaacccatagggttggccgatgaggtggcatccagaccggtgatcatactgatatctatgagggttggagtcatcggcccttaattgaacagaaaggcattagtagtgtttgaccagaagtaagaagcggctgccattaggggttcatctttggctgagtttgctatagtaaggtcaagtgcttggccgattccaatttcatcccagtgaaccctcttgctggctgatacacgtttgaaccatgtggtccagctcttttctagtggaactttctctagagatggccaagacttgaaagtattcttctagtgacctagatctgggttggttaatctaaaggggattctattggtttcaccaacaatgaactcggtggggtcaggattaccgattgggccgagaaagtagtggttttcatgcgtcagactgggaattgcgacttggtgagaaagatgctacaaattcgaagcgaccaaaagagggaaagcaatatgagataagagaagatcgatctgctgctaaagaaggggatttagccgatgagaacttacctcggcgtattcggctgatggtgcaccagatgggctggcggaagacgacattggtgcgggcggagatctcgtcggggaggaagtcgcctaggaatcacctttgcgccggaggaatcgccagagaagagagagaaaagg

SEQ ID NO: 52022 - DNA, 3721 bp, Oryza sativa
  unsure (1)..(3721): unsure at all n locations
agccctatgtaattttagaacacacacgttcaatacaatctcggcgcatcgccacccttttgctttagttttgtttcgacgaattcttgctttcgggttgagctgcatcaattttgatcttcaacaagaggtaaaattcgttatgacggattacgttcttaggattagtgcttccatcttcatgacactctaatcttgtttatataattcgtcgagttatcatatatcttacataatctctagcaatatcgccacctaatttactatcgaccaatatctgtttgcagaaagcagccgattaggttagatctcgacgttgatctagattatataagatatctaccattctatgaaacttctagcggcttgattgtctagatatcgctcttcttttcatacttaatactgcattagttgagtttgatctattaagtcgtgcttagaatatcgatctctagcctgccttctagttgccgattagaatagcattggagtttcagccgatcgtatatgatttaactatatttgttttatatgctttactgatatgttaaatctgcactttatatcaagatattgttgtatctaagtatgttaggcttttgtttgatatattatacttgctttaatatcctgatataaagtagtatcggagtattagccgatacacgctagatctatctgatcggctacgctacaaacatatatagtcttgttattgatatatatttcgatctaagtgatttataatgtctcggcatggtgaccgatctatcccaatcacttgatttaagtatatatcgatataaggagtatatatcgttaatatcttcagccgatcgagtagatttagttcttctttacttattcatgactgccgatcgatacacggatgacatcggcccaaagataaatgatatgtcatcggcatctagccgatcggctatcatttatagatttaaccacggtttctttgcttctatttcttgttgattacaagatcaaatcaactggcacgctaatacacccgaagacgagctttggacctgcactagagttaagcagatctcccaggccacgtgttttctgtcaacagaaaggtcaaaaggtgatcgataaaagagatcggcaaagatgttttctagcaggaacagaagtaggttgaatggtgattgataaaggataaccaaaaacatgctctacatcacacaaggaagactcctgacagtaatcgccctgcaacagtcaccttgtcattgagaaaaaaatgtgagtaagcaagataacctaggtaaaagtgtttctatgaaggcaaggagtgaaatcttcaactcggtatcagatgctacacggagtgaaaagtgcaggcaccggttaccaggtaatgccatgtcttgagagatgatccaatgggaaggaactcatcaaggtcgaaggtgtaaaggaatacgttgaatgctaaatgatgacaacatgaagagaatagtgggaagtaaactgaatgtaaagaaagtgaatccgagttgtctgttcgtgggagctattcccagttatgaaccaagtgatatgttcgaagatagtctacagaggtcagattaaaatcacatctaacaacgaagcttcagatttggcaggataacgatcagacaataacaagtccagcagtaaagccatttaggaagacgtcaaagcatgtcaagtgggataagttggttctgttgagaaacataattcaaaggcaaagttatcgacccttgcatcgaatagcacaagtagctagcacccagagtccaggaaagctaatatgaggcagttggtggcaagttagaagtaaatgacaagcatggtattctcatgatgacaagcatggtattctagtaatgacaagctgatatcgacgcataacgtgaagtgggtaacttgcatgagattgacacccaaggtatgaactatgagaagttctggaactgaagccccatcttcaagtgccgcaacctagtcgaagtcagctagaggtgtaaccagggacaagtcaagtgaagagaagattccatctgcaacaggagatcaagccaaacagttccgagtggggaagttttgctggacaagtttgttatacaagacgcaacagaagaagtcaggcaagaagagaagaccgcccaacctatcttcttgctagcctcctcgaatctcggggacgagattcctgtaaggggggtggatttgtcacgtcctgataaattcatcccgaaataaaaatcattctctaaaaggaataatagaattaattaaaatgcgaaaagaaattggcaaacactaaaatacgtacaagaaaaattcgaatgtggcccggagaatttttgttaaattctccttggtctaaaaagagctctcaaattttacttgaattttcagaacaccggaaataattattaagcaacaacaacaattaacaaagtttattaaaaagaaaaactaaaaataatcctccttcctcctttgggccaagtctgacccaaagtctctcctccctccctctcttttccttccgtccctccttcccggccggcccactgngnnctntcctcctcccgcctgggcctgccccggcccaagccgagcggctgcctccctccagcgcccctcacgcgcgccgcacgcgcgctgaccgcgcgcctaaccggtgggtcccacccacccggtcgtctccttcctcccgcacggcctcctctctcacccgtgaaccctagcgccgattcctcctccaagtccaccccattcaagccggctctttccaaattaattgcggggttttaatccccattggttcctctttgatttcccccgttttcccccttgatttgtgcccccaatcgccgggaacggacgtgccaaacccggccgctttccatggccgccggccgccattcccgcctccgtttcgacctcccccgtggccgactccctcccctcatctataaaatggaaccccctcggtccgttctccagttttagccccctcccgcgctctcccgtggccgccccgcctctccccgccttctccttctctctctccggtgccggccgacctccagccgcacctcccgccacgaccgtgcgccgtccggttgcgccgtcgccaccctcggcctcgcaggtgcatcctcttccccggcgtcgcctccgtttcacggggaaaccatgggagacgcgtcctcaccggtaaacagtggcgttgctaccactgcaccacctccggcagccccttccgtcgtgcccgagcaccgaccgacgtcgccgcctcctccgtcgacgtcgcagcgtcgtcctcttctctggctgctcctctgtttcgcccagaaaaccgctgcaagtcgccgccaacccctccaccctcctcgccgaagtcccttcggccgccccttcctcctcgcccgtgcaacagtcggccgcacctccaccaccttcagcatcacagcggcaaggtcgtcctcggcctcgcctcccctccatccgaaccccgccggtctttgtcgtcgtcctctcgtcgttcccggttgcgctcgtcgtcggccctcccttcgtcaagccgtgctcgttcgtcgtctgcgtccgtcaagtaagccgctgcagccccgtcgtcgtcttcgtcctcggctccgcgtcgtcaagccttgtgccggcctcgtctcgtcttcgtccaaggatcgccgccgaagta

SEQ ID NO: 52023 - DNA, 1193 bp, Oryza sativa
aagtctcctaatgtttgttataaccaaaagaaccttgtgattttctttttatgtattgttattgcttccttataggcttgtagctttgcttgtgtgcttcgtgtagcttctgttgttctggaggttcctaaagcgtggttcgcggtcgtcgccgaaggttcggaaggccgttctctcttagcaaggcaagtcgcatcatccttgagcatattgaatcccagtttataaaattattctgatttgaattattgcattactgctttatttaaattcccgcgttatcactgtttattcagcattacctattaatccttgttatagccttatcaccttgcttaccctaggcaaacaaaaccccaactagtgggtactctattcatggttccactagtatgaatttaggtagatgcttcgctgattaattaggcaacattaggtggttttataactttagactttgggaattctcatatcacttggacacgatggaatggttggcttatggtggaattggacatacacctctcttcctctttcaaaacccctaaaacctgttttccgatggggtttgggtgcatgccagttgtgggaagtagcaccccggccaatataaggattaagctcgagcctctgttgcaaagcactaccgtactaaccacatgtctaatgggtaaggcttaactcggtgctcagtctagtcctgaacaaaaggacacgtatagagatggatgaagtcattgcgacgatggatatctatgaggcaaatgaaggctacgcgagctgcggctcggtaatcgatatgtctaggcaaatgaagcctacacgggccggtgtccattagtcgagatgccatggcactggactagtacgcgggtggtctcacccctatgtgtgtggcgcacccggtctagatcctgttgctagggtctcaatcctggcctgcctgtccgggataccggccataggcagggttgggtcggtacttttgttcacggctaggatgggtaaagggttatgtcacgttttttatgatgggttccaattgcaatggaatgcagagtaaaggcgtgttttatgggtaaagatgtacaactctgattagagtataatctattcgaatagccgtgccctcggatatgggcaagcctagcaatgtacccaagttagtggtttaattcttaaaatttgcttaa

SEQ ID NO: 52024 - DNA, 10282 bp, Oryza sativa
acgcttaggaggtactatggccagtaattggattatcgccctaagaccaaaaaacatgttctatgcttttagattcacgttgttcatcaaaaaggcaggggggcatgtgtttacacccaaatttggcacctaggattaaaataggaaaagactgccaagatttggaagtctaccggtttcctccgagtgggctggtctgaccgtcgtgtgttgggcggtcaaaccgccggttgagggccagtcagaccgacggtgtgtggccggtctaaccggcagggtccgagtccgattgcgtttcgtcgggtttcgaggtttccttgcctgggaaggcatgtttcgggtttcctttggtttctatcccgagttggacgtggaggagagcctgtagaaggcaagaccaacccctatataagggacatggccggttccactgtaaaaaaaaatcaatctacaatcaatcaatcgaatcgtttttcatattgcttttagttttctcttagtttgtccatctttgtcgatttgcaccgtaaatcgtccgccgccgctgcgagagtgcaacacctcttcgtaggtttgtcctgaaaaccttccgttttgcccacgagacgggtagttatctagaaatcggcttcgctagcctgtttagttatcaaaacccatcttggtctagtttcttctagattgaggtggttggcgactctaggatcatcgcaaggcgttaggtgttgcgatcgtggttgtcaacttgtcacaaaaagttgccaacactatgttgatgacattgtcgtgaaaatttgtaaggcattcgaccatgtgtcagacttgcaagagactctcgacaacctccgcgcggccggcatgaagttaaacccagaaaagtgtgtgttcggtgttcgcgcgggtaagttattgggattccttgtgtccgaaacggggatcgaagcgaaccccgaaaaaatcgatgacattcagcaaatgaagccaccatcgaacgtacgacaagtacaaaagctcgcggggcgaattgcggcactcaatcgattcttatcaaaggcggctgaaaggggtttgccattcttcaagacccttcaaggggcaggaaagttcagctggacgcctgagtgccaatcagctttcgataagcttaagcgatatctgcaaagcccactagccttggtcagcccaacaaggggaagcgaactgtggctttatctagcagctttgcccatcgcagttggcgctgctctagtgcaagagaccgaagctggtcagaaaaaagtgtacttcgtgtccgaagctctctaaggggcgaaagtcagatacattgcgatcgaaaagcttgcttatgctctagtaatggcttcaagaaagctcaaacactacttccaagcccacaaaagcatagtaccctcgcagtaccctttgggcgaaatgcttcaaggaaaagaaatcacaaggcggctaagcaaatgggctgccgaactataacctttcgacctacactttgtcgctcgcaccgcaatcaagtcccaaatcctcgctgattgcgtggccgaatggacaccagcgtccgccccaaagcccgaaccagtcgaacaaccatgggtcacgcattccgatgggtcgtggtctcacaagggggcgggtgttgccatgatcctaacctcgccaggaggagtgccgatacattacgctgcaagattgtagtttagtacaaccaataacacagccgaatacgaagcagtattaatgggcctgagaaaggcgaaagcactaggcgttcggcgtctgataatcagaacggactcaaagcttgtcgccagccaggttgacaaatgtaacatcccggcctagggcttaataggattaatagaatactcatatcaacaagttgcaacttctttttcggaagccaatctccaaagaactccagggttaagcgtgcttggcctggagcaatttgggatgggtgaccgaccgggaaattcttcccgggtgcacacgagtgaggacaaagtgtgcagaaaagacatgtgttggtctgtgagggcagtctatgaggcgcgtgtgtcgcagttgtgcaggcatggtacgcatgtctggtgtagaccggaagtggttacacagcatggcacatgcgctggcactggacacatggacgtggccaagagaggacgttcctggctatcagatgtaagtgggcccggcctaggggaaggcgggacgttacaaaatggtatcagagccgactctcgcggtttcatgggcgcgtgtgtcgcagttgcgcaggcatggtgcgcatggctggtgtagaccggaagtggttacacagcatggcacatgcgctggcactggacacatggacgtagccaagagaggacgttcctggcctggggttgatcgacgggggcgtcgatctctcttaagggggtgagggtgtaacatcccggtctagggcttaataggattaatagaatactcatattaacaagttgcaacttcttttccggaagccaatctccaaacaactccagggttaagcgtgcttggcttggagcaatttgggatgggtgaccgaccgggaaattcttcccgggtgcacacgagtgagaacaaagtgtgcagaaaagacatgtgttggtctgtgagagcagtctatgacctatgaaagctatcagatgtaagtaggcccggcctgggggaaggcgggacgttacaacaaatccttcgaggcgaaggaagaggggataaggaaatatctagaatactcatattaacaagttgcaacttcttttccggaagccaatctccaaacaactccagggttaagcgtgcttggcttggagcaatttgggatgggtgaccgaccgggaaattcttcccgggtgcacacgagtgagaacaaagtgtgcagaaaagacatctgttggtctgtgagggcagtctatgacctatgaaagctatcagatgtaagtaagcccggcctgggggaaggcgggacgttacaacaaatccttcgaggcgaaggaagaggggataaggaaatatctagaagctgttcggtctatggagaaaagcttcgctggcataacggtcgaacacctaccccgaggccagaacaaagaagccgatgcgttggcaaagtcagccgcttgtttggggccgcattcgctaggggtcttctttgaagtcctgtatacaccaagtgtgtcaatagatagcctagagatcatggcaatcgaccaagtcaaattgggcgaagcctcgaaggaagaggggataaggaaatatctagaagctgttcggtctatggagaaaagcttcgctagcataacggtcgaacacctaccccgaggccagaacaaagaagccgatgcgttggcaaagtcagccgcttgtttggggccgcattcgctaggggtcttctttgaagtcctgtatacaccaagtgtgtcaatagatagcctagagatcatggcaatcgaccaagtcaaattgggcgaagaccaggacgactggcgaacgccattcgtcaagcatcttaatgggggatggctgccagacaacgaagcaaaggcgaaacaattacagctcagagctgcaaggtacaagttagtctccggacaattgtacctaattggggtactgcagcccatgcttcgctatgtctctttctccaaaggtaaggaaatggtaaaggaaatacaccaggggatgtgtggagcacaccaggcggcaaggaccgtcgcatcaaaagttttttgccaagacatatactggccaaccgtacttaaagtatgcgttaagcagattaagaagtgtgaaagctgtcagcggcacggccgaaaccaaacagcaccacagtatgagctacaaccaatcgcaccaatctggccattcgcaagatggggtttagacatcatcgacccattcacggtggcgcgaaatggttacaggttcgccatcgtagccatcgaatacttctctcgctggatcgaggccaaacccctcggcacaataaccgcagctgcggttcagaagttcgtacggaagaacatcatttgctggttcagggtgccaaaatagttcatcgctgacaatggcaagtagttcgattccgagaaattcagagaaatgtgcgaagggttaaacctggagatcaggttcgcatcggtggcgcacccacaatcaaacggggcggccgaacgcgcaaatggtaaaattctcgaggctcttaaaaagagacttgagggagcgacgaaggggaaatggccagacgaaatgttgtctgttctctgggcccttcggaccacccccacaaggccagccaagttcagccctttcatgcttctctatggtgacgaagcaatgacgccagccgaactaggggctaattcgccaagggtgatgttctctggaggcaaagatgggcgtgaagtgtcgctcgaactcctggaaggggtaagagtcgaagcgctagaacatatgcgcaaatatgcagcaagcactttggcgacctacaacagaaaggttttaccgacagagattttgcctagtcatcttgtgctaaggaagaaggcgaaacctgtggcggtctgaaaactagaatccaaatgggaaggaccaaatctgatcaagcatagttctcgagcgggctcctttcggctggcgaccttggagggtgaagagttcgaccactcctggaacgctgcctctcttaagcgtttctatgtgtaaaatgggtggcgcttgattcgccaattgtaaaaatgtacatattatgtaagccgttcggcacaaaaacaacaaaaaaggggggaaaatcgaaaaagaaaaaaaatactggacgtagggctattatccacctcggaggcccgaacctgtataaaaatgccagtttcctttcgccttatttattatttctgtggatgatgttctcgtggaaaaaccccaaggcaaacgcttgatcagtgaaaatgccagggggacgaaacgaatcggtcgaagcatagctcaccgaacgttgaaaccgtgacagctcgattttgacaaaaaataaccaagctccgttgaattcagcttacgcacagacttaaacgcttctagttgtgtttgccacgagccgaaaacggaagaggagagctgagaaatgaacgttcttttctgctaaaccacgcaaagaggccgacacgtttccacctaacggaagcacgaaagtgactatgcgaacattagcacaaagaaatgttaaaacatacataaacctcaatgggcgaaaacacatattctcatattaataaacacaacattcacaataaaattacatcttcgcccgcgcactcgtgtccgtctacgctacaagccagcgaacaaggttcgtcgtcactactaatattgtacacaacccttaagagggatggaggccaagcacaaacttaactataacggtgacgggcgatcgcctcttggcgactcgaccttttaaaatttcgccaaaagttagtgctatctttgcgatgtgcgacatggtagcggtcataatcttccaaggttcgacccggatgtgcacgcatccaccctgaaacctttataaccaccacgaacttctcgtttttatttcgccaattcccaaaggggggctgaacgcacgactttcggctaaaaccttgccaacaaggcataaagtatagcaaaaaaatgaagacgctaacgaaatcgattacccatcacagcgaaagcgcataattggcgaaatagtaacttttcattaataaacataaggccagaacggctacatgatggtgacggccattagccgaacatgcaaaatatttacatataaacaagctacgactctaagtccagaaagcgaaaaacgcgagggcgaaaggcctcacacctcagggtggtcttggctttcgttgcctttgccctcctgctcagccgctatctccaacggccctagctcttcagaagtattggtggcagcggcgccttcggctttctccatcttctccagttgctcacgaagccgggtcttcgcgccagacctcccaccactctccaagaagccctttaggaaggcctttggagccgccgaagcagactgggagctttcgggtcagtccttcttcacagttcgaggaaaatcctcgacatggtcacaaccatgttcatggagcaagctgagcacgaaccccacggcaactcgcgcacaacagtcgccgtacgcgccagccacttcgacgactgagccggccgcatcttgcgtccactcagtaaagtcaaaagcggacctgtcatcacccggagcgccctccgcacgtgctgcaaggtcagtgagggccagccgaagggtgtagcaagcatgtctggcggactccgtcgctggcaccaaagcttcagcagcggcttccaccgagccaagccgggcttcaagggatttgatcttttcttcggccgctgcaagctgcccttcctgttcagcatccctctgattcgccttctccaagttggcacggagagatttattttctcccaccagggatttattctccgcgttcgccttctttagggcatccgagctgtcaccatcagctgcctacctctactgtcccgcagcatatatgcccaaataatgatacttaaaaatctaatcaccacgcttacattattaaatattactgtatatcctctagaatgacatagagcaatcattcacattaacattaaacccccaacattgcacctctttggtaagctagtcacacaactatatcgagacaaatataaaataaagccggtactctaatgaagtaaagtaccgaagatatataaagaagaatattctattaattcgataagtcttacaaaagaagggaggaaagctgctagatacccgaaatatcctgaagatttgaggactaagaaaactattctattctactccactagcactagagtactaaactaaacttgagagagagatcaagtgcttctttcttgagtgtgggaaagagtggagaaggtgacccctttatatagccttgtaatgatgattatgatagttggaaaggtcgaaaacaccctccaactgtcatttggagtgaatcctggatgtccacgccaaaccacaggatgaacggccatgatgggggttcggccgaaccctggcctagcccaaacagcccaatttttggcaggcgtcctctccaatggttcctcaatccagtggtaaggtgttttgggaccttttagttcatttctttggatttataggcccattcacccataagtctacacttgacggactccgattgattcttcatttgttttccgtctactctccttctctttatgtagcaatctctgaaatcaaatagaatccaagtacaagtggaaatagattattctaaaacaaatatgcattgcaagtatagctagttcttctttattttagttacattgaccatcgaaattggtctataatgaccgtcaacaacaactagaggatatcctagtggtagtcggctgcgtgtccaaatagatagtagcaatgccgtgtagggctgcagatgccaaacatgctaagaagatgttctcggaaatcatcttcccccgctttggtaccccaagaatggtcataagtgatgggggatcacacttcatcgataaaaccttccaagacctcttgcgtgagatgggcaccaaacagaatgttgccacaccctaccatcctgaaacaagtggacaagcagaaacattgaacaaacagatcaagaacattctgtaaaacacgatccacaaaatgggaacatgatggaaggacaagttactcgacgctctatgggcataccgaacagcccataagacaccaattggaatgtccctgtattagatagtctacgggaagtcatgctgactccctatagaacttgaacaccagacatactgggcaatccagaactggaatatggattttgagggagccgaagagtggagaaagatacagatattagagttggaagaatggagggataaagcatatcacaactccaagatttacaaggaaagaacaaaacgctggcacgataagcggatcaagatcaagaaattcaagacaggagataaggtactgatgtttaattccagagttaagctattcgggcatgggaagttacgaagcaaatgggaagggccgtttgacattatcaacacctcgtcacacggagcaatcacatttcgtaacaactcaggtaacatcttcaaggtaaacggccaacgtttaaagattttccttgagccgaatgaaaatttagatgaagaagtggatgtgattaaattaattgattttgaaccataatgatctcatctaaaagttgcttaattctataaaattgtgagttttcctatttgaattagcttaagttagacatgtgaaaattttggaggccgaccgagcccaccagtggttcggccgaaccatggcggcacccgatcgcccccatatttgaaagttatatctccccgcttaattgcccgttagaaacttggtcgttcatgcgattcgggcgttagatcaatctgagctacttaaattcctctccttcctctccagctcctccacatttaatccatttcttccctcaacttaactccactcattccaaactccaatccacgaccaaaatcacccaatggctaggaaatccttgatcccctacggtgccactcgttcaaacaagtttgatcttaatggtgagccctgttcggcaaaccaattggtgccagtgaacgatatggcgctggaggaggcaaacgcaatcttcatggaccccttggagactatcccagctgactcagcaagcaagaggccgatcggtgttgccgccagttcggccgaacccagcctcgatcagcccccctattcggccgcttgtcccctctcgcctcaccgcaacgcgctgaccgaagtacagggtgtttcccctgtacagaggcctacatcaggcgaattggggccattaaagatggcgcgatggctttttcaagagtaggagaaggctgcatctcccgccgatgaatgctatgttggtaatcttgagaccaaggcaagggatgtggtattccaccagtaccaagcccccatcccactccggtgacaacgcaaaagaggttccgcgtttttggtgtgcgaacccccggtggtggctatgggaaggggctacaccggtccttaacaactcatgagaaggaagaggtggtagagtcggttgattcctcaccttacaaggttaggcgtcaattgtctccacctcccattaggagggaggccgggaaatttgaggggagtgactctccccaaccctccatatcgaaacttgcaaagaagatcaagaaactccgcaaagagaacaaggagcttcgaacccacgatgcggaatgtagggaagaaattgctaatcttgggcacgaatttgatgtgcttaggctccgttcggtagtacaagttcccaactcctcgtttttcgcgcgcacgcttttcaaactgctaaacggtgcgttttttgcaaaaaagtttctatacgaaagttgcttaaaaaaattatattaattcatttttaaaaaaaaatagctaaaacttaattaatcacgtgctaaaacgctgcttcgttttacgtgccggggccgaacagagccttagtcgtggattatgtgctaagattaagcgtgcattcaaggagatggggaaagaagaccgttattatgccaattagaggccttcccctctcattttaataagttaggtgctttagttttatttcatttcatttatttcattccaatgtaatcagcacctatatcattttgattgaataaagcggttcgttggtagttaatccaacggaagcttttttatttccatattgtgtttaataaagtctaggttcaaaataagtgtgggggagatacttcggactcctgacgtgcaaactctaaaaacacatcatatttctgaatgtctgacgatttctgaacttcactgaaaattgcagagtatttggacgtcagaggggtttggtcgaacccaaactggccccaaataccccccaattttgtctagtgagaatggtttgcacgtccacttcctcattctttcccatttttatcagtatatgagcagatgttgactgaaaaatcaactcaaagctaaaagtgaaaatgataatctctcaactaattaaatttccctgtcacattttattcttgactatgcttgtca

SEQ ID NO: 52025 - DNA, 5065 bp, Oryza sativa
aaatttatgcataaaaatattatatataaaaaatatttgaattcaaattcaaatttgaatcggatatataaacttttgacttataaactttgggcacatataaactttatgtatagaaatactatatataaaaatatttgaattcaaattctaatttgaatcagatatataaacgtttgacttataaactttgggtctataaactttaggtgtataaactttagatatataaactttagatgtgtaaacttgaggtatacaaactttaggtgtataaatttactaaaatagaaaagtaatgcggtgccataaaaaggaaacaatgtaaggaaggggcttaggaaaaagaaaaagaaaaaaagaagcgctaacttggctccatgaaagtcggtaatagtaataaaaaaagataaaaacagctttaaaaattaggagcaatttctaacagaaaaaggtaagaaaaaaaaagaggacctgatcgcgtgggtacacagacggcgatcgtccgctcgttagcaatttcggtttattctctaagaggtattttgaggagataagaagaaatgaaatatggagaatgagacacaaggacgaagctatagcttcatgtgttctaatatatggtaagatgtttatgcttggccaaactttttttaagttcgatgaaatttatagaaaaatatagcaatatattttcaacacaaaacaaatatactatccatgtattcaaatactcaattgtggatcaaactaagttgcttctaaccataaaaaaataaaactaacttggttcagatttccataaatttggtcagatttatagaagttagattcagaacaaaatcaaaacaacttacaatattgaacggagtagaagtgatcagatcagtatgacacacacttctatgttttagtattgtttactaaaatttccagatagccgcatcaaataccacacaggatgaaaccaccctggttgaatacccacctagcattggcgcattgcacatagtattattttacatgagagtccatgaacatatttgttatccttaagagtggtggctcctaagggagcctctcattattataaaaaagattttaagataagcaaggtaacttcagatggcaagtcgttgataaacttgacacatggttggcctctcttgcggcgatggaagtaggcagtcaaacgccacggagagacacctattcacgtcgtctgcttcatcatctgcaggtactggaagacgtttatccaagatttcatcaagaaaatcatcatatttagaagtagtaatagaactttggatatctccaggatgtttgcccatcagcacctcaagcaccacaacaccgaagctatatacgtcacatttctccgtgactaaggaggtgtaggacaattctacaaccaacatggaaacatatataaaagtcaggaatatatgtttgtgcaaagcaatattatattgttaacaagttttagtatatatggaatattgtactgtactgtatacacataccaggtgctatatagccataggtcccagctaatgcactccaatttgatgaatccggttttagaattcttgcaatgccaaaatccgagacatatgctctataatcaacatccagtaagatgtttccgctcgtaatgtcacgatgaattatgggaggctgacaatcatgaagataagtaattgcttgagctacatctcttatgagggttgtccttctcatccaatagaactcgatggctacttcttcattatttaagatagaagctaggtttcctctctctatgtattgacaaacgagaaacctgtaccttggatgacaacagaatccatacaacttcactatgctacgatgtcggatttttgccaacatttcaatctcaatctgaaatctctcttcatcgtgtacagtatcttcatcatctggatggagtttcttcaccgcaaacacttgcttatcttcaagttctgctttgtatacacgaccatatgctccctctccaatgcaatgcttctcatcaaaattgtcggttgcgctaattatatcatcaaatgccattttaccatcaaaactccatacagagaaaatatcattttttttcaccacattattattttcttgggagagtttttttcggcaaactgaaagaagaaaaacagttgccacaatagaaataatagctaagaatacaggagcactgacttcaactatcaactttagtctggtttttctgtggtaaggaggcaaataacaatgtgataggccagcaagttctccacaaagacctttgttgtggacaaaccattttgccgatgcattgtggagcggtctaggaataggaccttcgaggacattgtatgacacatcaaacactgatagactttgcatacttgcaattgagccagggatagcaccactaaattgattgtgtgacaagtttacatacatgagcatctcgagcatgccaagttcggatggtattggtccactaagattgttctggctaagatcaagcatgctttgtagagaaagaaaatggcccaatgtacttggtatactcccattcaagctgttgttgctcattttcaaagactgcagcttaaaacaattaccaaggtcatctggtatagctccactcagctgattgcttgagaaatcaagaatctcaaggcttttaagttggccaatttgatttgggaccttcccagaaagttgattgtttcttaaatctatcaaatttagattgactaacttgccaatttcaggtggtatctccccagtcaacctattagtggacagactgagctttacaagattttttagattcccaagctcagaaggtataccgccttttatcatattgtctgcaaaactaagtgctgtcaaattctgacatgatcacaaatttggtgaaagccggccaaccaatttgtttgacgctaaacgtaaccgccatagatgggggtacactcctaatgcatcagttatgtctccatccattttgttgtagctaatgccgagggatcgcagggaaatgcaatccctcaaagtctttggcatcgaaccattcaaattgttatgagaaagatgtaaaatctctagctttttaccccgacacaaatcaggcaacgggccaaccaagtagttcttgtctaattcgatgtcaattaaattagtgaggttgaagagtgctggaggcaattgacctgatagctggttgctgaacagtagaatttcgctcacgctctccaattttcccaaactcggagggattggaccagacaattggttttcataggatgcaaatgatatcaaacttgccagattcccaaactcttctgggattggtgcagagagattattgctatttattaatatatagttgagggaagacatgttccctatagttgatggcactggtccagttatgaaatttactgagaggtcgagctgttggagattcacaagatttccaatctcctgagggattgacccagttatgtgattaccccaaagagaaaagtagactgacgaagtaagatttccaacacttgagggaattgagccggtcaaatggttctcggacaagtccaactcaaccaaacttgacagcatcccaaacacttgagggatagtaccagtatgttggttcagatatatgtacaagatcttgagcattgtaagatttcccaaggtggatgtaattgagccgttcaagttgttttgctgcagatctagatattgaagcgtttgtatttcacctagctcgtcaggtataggtccagatagatgattaccgacgaggaacaaagaggtgagttttgtgaggtttccaaatagagaaagtatcggcccaacaagaagattgaggctcaaatctataaacgagatgtcatgaagcttcccaagctgccatgggatgttaccggacagcttattgccaaggagagaaagataagtaagctttgtaaggttacccaacgcaggagggatttccccagtcagattattgtacgacagatcaattgaggaaatcctcccaaggtcaccaatggatggaggtatatttccggtaagctgattgctggacaggttgagactggaaagcattaacagagaacttatgccaggagggatcgtacccgacagatggccattgtcgctgaggtcgaggctggccagataagggaaggacctgaagctcagggtgtccagccctcccacaagatgggcacccgggagggcgatccccgtgatggcatttcttgccgtggttcttccatgtcgtcgctggcgccatggaacgtcgccgcaggtgatgccagtccagttgcacgggtggatatcgtgcctccatgttcccagctggtgttgtgagaagcccttcaaggtggacttccagtggagaagggccgccacttgagctcgcagcgatgtgccacgccgcggcagtggcgccgccgatctggccccatggcctagcgtgagagcgaagaggagcagtagaagcattagctttaggtgcttcgacactagtatgtgcagagtgaggtttctagcgctggcctgggagttgatcaggagggatgatatgtcaccttgcccttttctgattcgtttttaggcctggtttagttggggaaagtttttgggtttggttgttacgtacttacataggatatacggacagacatttaaagtattaaacgtagtccaataacaaaaactaattatagattctgccagaaaactacgagtcaaatttattaagcctaattaatccatcattagcaaatgtttactgtagcaccacattgtcaaatcatggcgcaattagacttaaaaaattcgtctcgcaatttacacataatttgtgtaattattttttttctacatttaatacttaatgcacgtatcaaacattcgatgtgacaacgtgaaaattttagttttgggaactttgcgggacaggatcacacggaagctagctggccaagtccatgccgtgtggaaaatgggagaaggatagcaacggaaacgatgc

SEQ ID NO: 52026 - DNA, 10040 bp, Oryza sativa
aaagtaggcaatttgataggatgtcttatgttgtatgtaatagatagagtggttacacaagttaactatttcggattatccggcaaatggcctaacagataatccgataaaaaaatgttggataatccgcacccgtcggattttagaggtactacatccgcatcaaactttatccacatccgctagatttctataaacccatactatatatatcctcattttggatggattccaagcggaccggattggatatatattatccgattcgctttcaccccctaatgctttattgccaaagttttaatttggaccacccctatattactttagactaggtaatatgccattgttgtaatttgagccacaccaaaccactttgttcagcgctataacgacctcgaacacgttgactctagcacactgatgaacgctcccatgcatgcacatgtgttgatggttcttaaatcataatatcgaaccgtcaatgcctacatataatgaaatgaaatatgatatccaacttagtagtagggattattactaatcattttcactagtgttggtaaaatatgtgtatgccggtattttctgaagaaaacacacccgtcatgcgataaaatacacctctggacaatcaggacgcgattgcgcagattggatggctcacatgtcaaacaaaaccacctagaattgtgccgaaccaaggtacaacatgttgggagcccaccaggcagccccctgccaaaggagtggtcaggaggcggcccagaagttcggtcgaacaccaaggttggccgaatcgacatcggcgcctctcgccatctgcttccacgtatacgctcctgatggcaccccaatgacggttacatcgggttccacgacagttactgccattacaaccatcatatggccctataaaaggagcacaagtcactctcaacacacacacacaaatacaactatttggagtacactcttcttcctatctagacttagttacttcttcttactagaaaataggtagagagtgaggggaaactgtagaggagtgcccgaaagtttggcactctctccgactttgcagctttctaggaggaattctggagaagtacaggagctgtcggtacactctactccgggttcggagaaacttcttctataaagttaatatttgggatcctttcttatgtaatttaattatttagtccaaatgagatagatttccatctttgcgggtttattgtttagtattcgtactaagtgttctagtactaggactttagggcctgttcactttgatgccaaaaaaaaccttaccaaaatttggcattgccaaaattttggcatagacttaccaaaattttggcaggatttcttatatagttaccaaaatttggcagcaaactaaatgtagccacttttttggtaactttaccaaaatttggtaaggttgaaaatggcatcaaagtgaacaagcccttatataaacaaggaaattcctgcgcaagtattagagtagtaattagtaacttaggcatggtgtctagattagagattacctttgtttgttgtgtatcctacgaatttgtcagaggtagacaacaggtggtgatagccctgaatctcgtcctagcaatcctccacgttcggatacatcatagagctatagccggaaccacactggcagatccgcaagggtcaatgcctgaagcaacatataggaaattacctttaacttagcttagataaataaaacacataaaagtcctctctaaactagctagcctaccaatagttgttgttcttggatatagtctagattacacatccctgagttcgatatccttttggggtcacccgaaggtgaaggtcgtaagaaataccaacaacatacaatacttttgatgaaagagcagtgagacatggcttaaagaaaacagagttgggacaaatcaaatggcaacaaatgtaaagttggcaccaaattgagaaggtaagccataggatagtccaaattaaatgaagctttagcgataaaagttggcccaaacaaccattcactcaatcactaataccctggcccacctcattatctcacagagcttctatgagcccatactacagatcgatagcccgcttcttctctcttcccctccaactcaacacaaacctaatgtggcaacgcttatagcatgtttataccatcttattatacttacttgctctaatggtggcaacgtcgaactaggttgctggtgaatatggtgagaatctcaaggtagaaaaaaatacattatgcgaatcgtatggctatatggggagcaattttgattctacgtggggaacttctagtagctgcatcttaaatagttaagatacacacctagattctatgaagttgtaaatatagaagccagaaaatgaattggaagtttgaaactaggaaactcactttctggatcctcggaagttggctaccaaccaattgtttctcggaattgtagcttctccaaacttgtaaatgtatacaaagattccagatggtttattaagcttggtcagggtttttccaaagaaaaacaagctcctatcactgttggggaagtggttttcagtcccggtttgcaacccctttagtcccgagttgcaaaccgggaccccaaatccaggactaaagatgggtatctttagtcccggttaaaataaccgagactaaagatccatctttagtccctccattggtgttaccaaccaggaaagtttttttttctttttttcattgtttttagctgcttgcatattgtttttttttcatagtttttcttcaacgtgacagatcgaatgcaacaacatcaaaattatttttccaacaccacaggtcgaatagaacaacatcaaaattaacatcacaaatcaaatacaacaacaaaatcatccacaaaatctacgacaaacatctaaaaaatctacaacaaaatcatccacatttttttctttattctcttctctccttgctcttgcttctcatcctcctcgccggcggcaatgggagagaggaggagggggttcggcggctcggcgagccgtgcgccgccgcctcgggcgccagccacccaccgcccactcctgccgcccgccgtcgccatcatctctgccgacggagaggggaaggggaggaggggaagcaagcaaagcaagccgggaggaggagtggaggaagagctacgaaggaataaggaagaggaggaggcgtgcgaaggagtcaaagagataagatgaggcaggaaggcgtgcggcttggcgtgattttttttttatgttttgtcccggttggtataactaaccaggactaaagataatggagacctgacacgctacatcttatagcctgacgtcttttttaaccaggatcctatttgaaccaggattaatgtggtttctacatgacccacgaaagatcagttttccagtagtatataagcaagtgcaactttatattagaagtaactttatactaacgggatatcaaagaaatcttccttgcttaatattagttgtaccgatcacttctccacactactacacaagcgatttttgcgtgcagctaatttgatttttgcgtgcgggtgggcggcccgcacgcagcttcgggtctaggaaaatcacaattttcgcgtgcgggtgcctcacccgcatgagaaaataaaaaattgaaacaaaaaaaagaaaaagaaaaccctaactctaatccgccgccgccgctatcgatccgccacccgctaccgtcaccggtgccagatccgtagtcgctggccgaagacgccgggaagggagccgagggagagggaggggaggagaataaactcacccgacgccggccggccgccgctgatgccaccacacctccagatccgcctccgtcccaccgccgccgaatccgcaaggggaggtaggggaggggccgcgcgtcgtcgtggtcacttgccgccgccactgtcgccgcccttctccccgcccgcagccgagggagaacgagggggagggaggggccgccgccgccggatccgctgctcacatgtcgcgcgccgtcgccgctgtcgccgcctgtctccccgcccgcagccaagggagagggaggggtcgctgctgccgcacccatgccgcgcgcctccggatccacgcgccgccgtggtcgcccaccgccgccgctgtcgccgcccttctccccgcccacaaccgagggagagcgagggagagggagggaggggccgccgctggctagccgggagaggagaggagtgggaggagagtggagtgggagagagccagagagggagagagtgaggtgagagagaaggcagtgggtggaggggcgcgcgcgcgaggatatcagcggattggctattttcgtgtgcgggtctattaggtgacccgcacacgaaaatgattttcctatgcgggcgatggactgcgccggtttctctatttttctgtgcagtttcacttacggaccgcacgaaaacaaaatgagggggcgtccaggaaaatcaatgatgtagtaatgccagtacatataagggcatgatcgactgcatagaccaatgtagttggtccatgaaggccagtggaccatatatgaccatgtaacccatgtttgagacatttgccagctgccaagagcccaagactgcttgtggccacgtacgtggcttgtgtaaaactctcgatggtatctctataatgctattgttaaacctgtatttctcagatatcgccataaaatatgagtgatactaatcctataagatatatcctcgatgatacaaagtgtgaactcttaaggctgcatgtatggtacaaccataaaatttaatgaaaaccatgatattacaatatgtttggcagagctctctagatctatccatggtatatttgatgtttatatgttaaattatagtggtttaaaattttaaatttcatctaaaataaaaataattgatttattcaaatgttatatatgtaatcatagatccagatagatggatttgtggagctaggaatactcagctccattaaatcttggatatgaaggtgtgccaaagaaggcctatatctcaattatgtctactacgtgagtgtggttgaggtcgcgtaaacatgtgagacctagtaagcgattggaccggggctcatcggtgattgtttaacttgccgaagaaaaagatgaatctgatctccatcgtcacagctcgaatcaattggtggctttctccgggcttccggatccttttagggtgcgatcgtttcagcttttcatgattagattctccttattttcagttagcatgttttttaaactgctaaacggtatatttcgtgcaaaaactttctataaaaatattgttaaaaaatccaacaaatttattcattaaaaaaattatatattaatacttaattaattatatgttaattgtatttttcgttttacgtgcagctaacagtccaccggcaccgctgaaacgatcgcacccaagcggctctcttgcagtcaaactcgcgcgagagggaaatccaaggcccgcgcgcacaccccctgggctagtgggctggaaccaaggagagctctcggcccggtgtgtgatctgggccggcctgcctatgcccaccacttgccactggttaattaaccggaaaaagtacaccgaagatccctcaacttgtccaaccgagttgcaaaatcgtccttaaaccgtaaaaccggatacaatgtatccctcaacttacaaaaccagtgcaaactaggtccctcggtggttttgacttcggttttgtcctatgtgacagctgactcagtgtggaacccacgtgggctctacacatcagcctcttcttcccctcctctcttcacctctcttcctctctcctctcctctccacggtgcgacgggctcgaccggcgagggaggagctatacgtcggcggcacaaagcttgaccggcgtcgcaaagagaggggtcggagccatgctagccatgggaggactgaggaacacgatggctgccatagagactcgccgccgccccgtccatatcctcttcgttctgccacctctgcctcagcctaagtcgagttgtcgagttcccccagcttccaaacccttcgctctatcgccgctgtgtgaagggatgcagccgtcgtcactgctcttcccctccactcccctccctctctgccttgagttcgacgtggagcgccgtttccatccaagtcgccacctaggtgccacaagcccgacacggagcgtcgcatccatcagcatgttgtcatcatcgtcgtcgtcattgccgccacatccatccatctctctctcgccaccatcatccgcccgcacccatctcgctctccgaaatcacactatacatgtcgttggtgagggcagcgtcacctcaccacccgtgggcctccttcactcctgccgctcctacctctctccgctggcagtcgccgtcgccggtgagctcacaggagctcggggcgtctggcggtggtggcttgctgtggcggcgttggcatggggagggccatgaagcggcgcaactcgcggttcttccgctggctggagttgtagctggcgtggggagtccccttctcccccgtcgccaccgccagacctcctcctctgccgcctcgccccgctgacctcctccccatccggcggcctgccacgctcagcttcttcctcgccggtcgccgcccatggagaggggaggagagagaggaagagaggtggagagggagaagggaagaagaggccgacgcgtgcagggccggtcctgagttttcagggcccggtgtgaaactaaacgtaggagtttttaacattactactatataataataatcaataggacattgtttatgttacctaaaaaatttcttctaacgaagtcattgataagggtaccaatatcaatttcatccaaaaattcctcgatgacatggcctaataattgaaaaaaacaatattattatagtggcttaactcataaaaattacactataaaattacaaatctaaatttaaaatcttaccaattggttgatcgcaagcgtttaaaagcaggggctgcggcgtgttcacacttcagaaataattcacgctgcatatacattcgacgaaggagagatgaggacgattcgatatttcgatggatcaaacagaagccatcattcaatcaaacaaggcaacaagttagctaacttgataatacacagaatgagtgatgagtgactagttgactacctgcttgttagttgttctgttcgcagggctccctgcctccctggggattacgtcaagcgccgtaccacgaatctagccgacgactcgctctggcctgttaatacatcgccttacgccgtacatgcccagccactggcgccaccgcgacgccgcgacggccgacgggcgttaggcacagcaggtggcgccgcggcggcacgacgggagcagcagcagagcgggctgctggtgcggcaactggcggcctggcgcgacgggtgacggctgagggctgagggcatgtacaatggttgtcaataatggtctcttagcattactaattaggaatacttgttaacatggtagaaagagaaagagtagagacaaaacatcgttgttatgcttaacaacgactattaatcactataatatggaccccgcaaaaaaaatcactataatatggaaatatggttgcatgaggataaagaaatggaaagaatattaacaaaaggaatattttttgagttaatgattagagcctttgtcgtctcaactattggaaagacacgtctctaaataatcttttattgtttaagagatcatactcgtctctatcaatgaacattccctgagaggtgcgacactgtgacgagtgcggcggcaatcacgcattcacgcgtttctttctttctcttctgtttctgatcgcgattcacgcgtttgccgcttcgccttccgcatggatgctttgccttctgttcttgggccaggcctcacgcctgggtacaggagaggtgggaggggggctgggggccatgagattttgggggcccagagcggctgcaccgctcgcccccctctaggtctggccctggacgcgtgggtcttacgctgacacagccgccatgtcggacaaaaccgaggtaaaacccaccgaatgacctcaaatgaatggtttttgtaagttgagggatatcatatatctggttttgcggttgggagacgattttgtaacttgatgacaagttgagggaccttcgatgtacattttcctaattaacctagtccgcgtcgcatgcttgaccctttgagctggcatgtccggtagagactgacggcatggtcagatttatattattttaaaccatatcattatttgttaaaattgataatcatatgactacatttagtttgttgtcaaatattggtaaatctatgtaattttagtaacattatattgagcctattctatcacaatttgacaatgttgttaatttgctaaaattttgatattgccaaattttaaaaatatttattttggcattaatctgaagagaccctgagaccgacgtagagctttgcatattattgagggagagatttggcttctgccgctttttaattccttgcaactagtggtttcttgggagtatatctagaggaattttcgtgcaattgttgggagacgccaagaagcttggctaggcgaaggtgaacgttgttgatggctcgtacgttccgtcatgaaacgggcgaagctgcaggctggtattggaggagctgtcatttgtgctttcttcttgacgagcagtccagtgtggagcaatagcagaggccctcacatcgcgtgcatgttgggagggctcggcgccagccagcgtccgaatggactagagaaatgcctgtgtgtttattgcatcaaactgctcgatagtgcttcatttgcttgctacaacacaggaaaaccgatccaggtggtgcggtgctatagcagaaaaccaaatatcattgccaaattggaagagggtgtgataaagtttgctcgtgagttggctaattttgttagctacaaagatttaggttgtgtacagtgtgagagatttcagcctatatggtatttgacagaaaacacattataaatcatgtaaattctagaacgttggattgttttaagattcgtgcaattatacctctaaccctcacggcctcacccgtcctctctcctctcgtcattcctagcaccccgccatttgcgagtcgtgagctagcatgtgtctacgcgatgctttcaccgcccggtctcgctggctagatggaaggagtcaacggcaccggtgaggcccctcgcctgcttcttccccgtccctttttctcttccacaagccggtggcaggatcccgtcgtcttctccatcttcagtggttgcacgccagcggatctacctcctaaccacaagcttcgattcgcctccactgccaatgttggtcgaccgctctcctgcatcccagtggctctgactgttggaattaatgaatgggccttagcccactcgaagattaattctttggaaaatcacaaaaagcccacctcatgggatggcatgcatgtggagtttagtaccaccttgcttattctaggagagggggacctccttaaaagggaggatgccctcctagccacttgaaacatgtgtggtggagagaagaggggaaacacacgtgcgcgctcgctcgcctggcctggcagggcagggcagggcaggcggcgcgcgtgcacgacgtacgcgtcgaatggtccgaaaaattggctcctcacccttgcgcagatgcagcctccttttgcagttttgtttgctgcaaattcggattcgtttttgttttggaaacgttccgaaaaatccggtgcgtgcaaacggcgtggagtccgataagttacgcgcgacttatccggttcggttacgcgcagtagagggccggcagg

SEQ ID NO: 52027 - DNA, 6347 bp, Oryza sativa
atgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgttctgtagtcgaacaggctcatgagatacaaaccatggctaaggaactcgaactccttaagtgtgtcttacccgacaaatttgtggctgggtgcattattgcgaaactacctccatcttggagaagtttcggtactgcactcaaacacaagagacaggaatactccgttgaggggttgatagcgtctcttgatgttgaggagaaagctcgggaaaaagatgccgcgtctaagggcgatggtgggcagtccagcgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattcattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtaaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtctttctgggatatgctcatcatagcattgcctatagatttttaatagttaaatccgaggtactggacatgcatgttggtacaattatggagtctcgtgatgctaccttctttgagagctttttcccaatgaaggatacacatagtggttcgaaccaaccctctgaaataattcccagttcaatcacaccaccagaacaaattgaacatacacatgaacttgtctctgaggaggatgtcagtgaagctcctcgaaggagtaagagacaaaggacggctaagtcttttggtgatgattttactgtgtacctcgtggatgacactcctaagtcaatttcagaagcatatgcatctcctgatgcagactactggaaggaggctgtccgtagtgaaatggattccattatcgctaacgggacttgggaggtgacagagcaaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttggagtcaatgaggcgaataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaataggattacactcttgcagtcccattatgtggagaagatcttgaatcgctttggctacattgatagtaagccttctccaacaccttatgatcttagcttgttgcttcgcaagaacaagagaattgctatgaatcaactggaatactcccaaatcattggctcgttgatgtacctggctagtgcaactaggcctgatatctcctttgctgagaacaagttgagccgatttacctctaatccgggagatgatcactggcgtgcgcttgagcgagtaatgcgctatctgaaaggtactgtggaattggggcttcactatactgggtatcctgcggtactggaaggtatagtgattctaactggatctctgatgtggatgagatcaaagccactagtggatatgttttcacactgggtggtggtgctgtttcatggagggcttgcaaacagacaattttgacgaggtcaaccatggaagcagagctaacggcactggatactgctactgttgaggcagaatggctgcgtgatctattaatggatctgcctattgttgaaaaaccggtgccggctatccttatgaactgtgacaatcaaacggtaattgtcaaagtgaatagttctaaggataatatgaaatcgtctagacatgtgaaaagacgattgaagtctatcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacctagtctatgtgatcggagatcccgtgaattagatcctgggaagaacaaaccattaataaactataggagagtaccaatatatataccctctccaagtgaagatgcatatactctcgtgagctgcaaggcaggttggctatgccttaatgagttctgttggctttaattagcaaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagatcaattctttggaaaatcacaaaaagcccacctcatgggatggcatgcatgtggagtttagtaccaccttgcttattctaggagagggggacctccttaaaagggaggatgccctcctagccacttgaagcatgtgtggtggagagaagaggggaaacacgcgcgcgctcgctcgcctcgcctggcctggcagggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaggatatgcgaaaatcaatctagggtttacctcctactctgtactgcgccgtcgctcgtagactactccatcccgctcgccggcgtgcaccagcgatcgggagagcaggtctccggaacctctgcctttgacgtcctgcactgggagaaggcggcaataaggtttttgggaagtgcttcgtgcgactgctccctgttcgttcgcgacgactcgccttcctcttcgctcgcatgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacactgagatcgcctcccgcctatgcccacaatccaccgccaggaggctgtctcccaaaccatccctctaagtcccccctcccacccctacccctcgagccaccgccagtcgctatcgagcttgaggagaactgatcgccgaagttgaaagagaaaaagctaagtggccgaagcacgaatataatcataacgtgaatcctaaggttagaaacttacaaaagattttgatctcaatttctattaatagccatttagcggttccgtttttatgatcgagaacagttgtaatcattgccaactcaatttctcttccaggcaacattcaatgaccggatttggttcctgtgcagtccttactatgactgcaacttaggcagttataccataactgtaggatgcaaatccaaaggcccaaatttgataggacactgttcattcaaataatccaacaaaaaatattatatcaaggctattgtagcatttaatttagaccttccattgaaaaatcgaatggataaaatcttgtgcagttcctaacgtgcagttatagttgggactacacctgatcccaatcctcaatgaccactagtcaagactcaagagagcaccagcagctcaccactactcctactacaacccgtacgatcataaccagtca

SEQ ID NO: 52028 - DNA, 1484 bp, Oryza sativa
ttccctaaaccctagtattaacgaataggagtagtaaatgaacagacgcgtgtgcctcatgatttctcctcatgcgtgctatggagtacggaggacagtgcacatgcatgagcatgatagtaccctttttagggcgacctggtcctgaaggggaacacagccccacggctgttctggttcaagtacaccaagggaccatgctttgcatgcttgcagctcctccatgcccctacccagatccacaacaataaattccagtgaaactgttcgcaacaaccagagagagagagatggatgttaactccactagaattgatgtagatggaaacagaattccacatcatgtgctgctagtgaaaaatgcaacaacttcacaaggaaaattcaaggtatctgaattctgaacaggttcttgaaggaaaaacaacctgatccctacagtaacatattgtgactgcctcttatcaaccaggaaggtatatgtattctagtactaaaaatcaatgatgccacatcgcttttgctgaaagggcccatgtaaaaatttctaaggccaaatagaagtacaccacatgtacagcacaaagtaaaaccactctagcacttggccatattctattccatctaacggtgagagtactgtccatgctttcaggactccaagcttaaatatgcagttcttaatcatggccctaacatgcttccatggtaaaaaaaaattgataccaattaagtagtacaaggagagggggttttaactatttgccacttttagatttggcaaataactatttgccacccctatctcaatgacatccgtggctctgttctccaaacaaagtgctccatataatcctatcagttcttgttcattcagactatcagagagcaagctgcaagcatacacagttaaattcacccattcccatgacttataggcaagcacaatagtcataactcatgatagcaagctaacagaaaaaggctatctaacatgttaagagcggagcagaatctgagggtcctgcgaaaatgacaattttacatagcgaactgatgaagcttgagtcacctaagcttccttgccttccttgagctgtacaaccatcaaatgctctaaaaaatgaccgccttccatgatactacttttctagcctgaaccattgaggtgatccagggtttctgcgacatgcctcatagagggccttcgctctggattggcctgaacgcaagcgagagcaactttcagtgctgcgatcatctcatcttcccgttcagagtctctggcgagagaaggatcgagcacatcggcagatggtttcttttcttcaatacagaactgcacccattgcacaaggtccatctgcatagtctccaagagaacaaccggcgatctgccggtgatctttccagcaagatcacaccataggagtatacatcccatttctgagatggtttcagtgttttcagtgcttctggtgctt

SEQ ID NO: 52029 - DNA, 2126 bp, Oryza sativa
ttcctgcagcccttctaactaggcagattaagtatccatttccaagtttggaggattgtgacgttgaacagaaccacatcctattagaaaaaaatagcattatttataacaccaaattagtttagttaaatctaatattaaatatattttgataatatgtttgttttttttgtggggataatgtgtttgtttttttattgaaaactagaaaggtagcccgcgcgaatgcgtgtgcatacatcttaagttgaattagaaactatttgggaaaaatatcaattgatttattcgtgttgcgataaaaaatatgattgtcggtccactcttcgaagatgctcataggggtagggtttgcgtttgtgtgttcatagggatgagtatgcgtgctttgtgattgtctgtgttgtactatataattctaaaaaaaatgatttcctgacaacattcttcaccgatattgcttaaattttcttccaaattatttgttttctctatattatataatatttaatttatccctataagcttaatcaaatttaaaagaagaatatatgcttagcttgttttcaaaacaggtttcacaaattaagtataaattaaaatcaaggtgttttttataattgatttattaggggctttattttctaacaaatcttaaaaccattattgtttaatagacatgttttatttgtacaatcaagctattgccctctatttggttcgtgcatgcttacaacatacttaagcactaaaaaattatgcaatgtttatggtaatgggtattctagtttaagtgaaagctaagaacctattgttctctaagaatattctaagtttttctgtaattagttcacttttctcccttttgtattttttattttattttatacaatcttatttttaagttcatattttgtgagataacaaaatagtgatagagcgttacaccttatttgtcaaccatattaaaaaaacgaatatatttttaataaatatctaagactaaaataggttgatggattaggatgattcaagactgttaaatacacatacttgtagagtccaatttatattgcacagtgtaggagacaacccatatatgattattttttgcacgtatgcgaagctctacatagcttagcaagaacatgaatataactatgaaggcattattattttttcaatatgattttttatgattgtttccatgattaaattttatatgaatttataattaaatatttatatgaatttataattaaatattagaaattatgtacttgaagccaacctctctacaaatattttgtttagctagactacagtggacataaattaagtacaatgagattatataatcatacatatgatgcttataatgcctatccacttgtcacaattatcactgttttcattctacattagttagaaaccatagtttgtacatagctaatttttatcggtttaagtcattggattatttatagtttatagttaaagacccatattaactatattttgactttaaaagaaatatgttattttgaattttattgtgaattttttatatcatttaaaaatattaaaaatatgaaaaaaaatgatatagattttaccggctgaaaaattacatgtcaaatatcaactgccatattgtattatgcactaaaatatagccaacataagtcatgaatgtaaaatcacaacaaaataaacgataattacatattttcttttaatcaaaggaatgataaaacatactgtcaacgggggatacccgtagaccggatatagagagtattggggtatgctggtacgaggatctatgtagtacgacatcaagcaaacaagaaacatggttatactggttcaggccccttggtaggtaatagctctaatccagttaatatgggattatatgatggaaatcacagattacaaaaggaatagtggaactcgatgataccgacgagatcgtagtcgagttgattcaactagatcacccgacgacttggctcttgtaggctccggcttcgtaggctatggtggttgtcttggctatgagatttgatgcctttaggtcctcccggggggtcccttttataccgcaggtcagttggtctccc

SEQ ID NO: 52030 - DNA, 5146 bp, Oryza sativa
ctatctctccctctcctctctttgttatttgtaattgtttgtgtgattttttcatgtgagatgtgttcttgttgatatgagatgtgttgatgtgtgttcttgtgagatgtgttcttgtgagatgattcatttgcgccggcgacgggagcgagcggcggatccgtagccggcgaccgcgagggcgacggcggcgggcctcggctaggcggcggcggactagggttagggttagggtttcttttttccttttttttttctttttttttctccgtgcgggcgcccgcacacaaaaatcggttttcgcgtgcgagtgcgccaccgcacgcgaaaatcacgattttcccagacgactggtgtgtgcgggtggtggcccacccgcacgcaaaaattggatagcccgtctggaaaaatcggtgctttagtagtgacggtagtacgtgaaccagtgacggtacctgtgtacgtacggtacctgtgtacgtacgtggttcatgtacacgtgacggagaggagagggagagattaaattctgtttttaatctaaatcaaatctaatggtctaaattaatggaccccaccaaattaaataaaaatcaatggctagatatttctaatctattagaacgccacgtggtaatttaggagcgtttataggaatgccacatagcgttatgagagcgtttatagggtgtttcatggacttttagtatataatagaagatattagcatactccctctggttctatattaattgacgttttggataaggttgaggttaaactttataactttgaccatcaataactttaaaaatatttagtttaaagaaactagaaaaatgtatatagatttgtctttcaaaacactataataaaagtaaacatgcatttatttattgtatatattataatagaaaaataaggtcaaaggtatatcttgtagagcgtgtcattgtccaaagcgtcaattaaaatgaaaccggagggattatatttctacaaacttgatcaaactttaaaaaaactttgattaagaaaaaaatcaaataatttataatatgaaacgaatagagtagtagtgagataagcttttaaatagtatagtgaaatgttagatccttttgttgggttgttctaagataatataaggggaaaaaaagaaaacaacgtggcttgcattatcaacaatgttggtggcggcatgcttactaggcgaacatacgataattctaaatttgcaatggttccaattaacctccacccgaattaacaatgaatatggttccgatgggaaaatgttacccagcaaacgtaggggttggccagcaagcgaacgcttattggaagttggtttggaatttcggatatccttggcctggagggttggaagtaatgccaatgctatatggtaggaaaatgacatggtatcggcagattatctgcacaagatcatgaagggaaaaaagaaaggaatttgctgcttgattggcgcgcggaaggtaaagtgaggcttctactactagatgtgaattaatgcatgggaaaggtagctactacacacaagttggagtatatacgagtatcatattaaaaatgaagtccaaggttgcctgcctaatcttcagtatctagcgctggctgagttcagccccgagagtgacaggatcctacacttggacatactccaatcgcagcatctgtgagcgagcaggactagtagtactcctagacgttaggcgagatctgtcgcaggcgtggaagctacgatccacacagccaggcagatagtcgaccgtacgtgcgcgcgtcctccacaaggtcgttatatcggccgtggagccccccgcgcgcgcgcccacaaggagagacgacgcggcacggtagtagggtcacccacgccacgattggtgccaagggagcaaaggctcactagtgcacatgcggcgggcgcgcgcagaaaccatatacgactactcgcctcgtcgcttagctttcgctaacaacggctacctttccggttcggctggcgtccacctcgcgcgtggaattggcgtcgtcacgttcacgtggctgcatctgcatctgcatctgcgtgcgctccagatcaatcacactacggcccagtttagttccaaaatttttctttaaatttttaacttttcaatcacattaaaatttttctacatatacaaacttttaacttttttatcacatcgtttcaatttcaaccaaaattttaattttgatatgaaagaattaaaaggagttccggcccccggtcgctcgtcactgcgcccgtcgcgcaacaggaagagggcaaggggacggggagggtccgggccccgggccgcccgcggcagcggtcctcgtacatggagtactgtcctcctgtataaacaaagaactaggctagctactttattcctttgtctaactcactctggttactaattgtttggctgtttgctactaccttcgttctattttaagtgtagccgtctgtcttatttagacaaattatactttttttttaaaaagtcacacgtaatattttataataacgaacaaagtaataatcataattttgttaaaaataaaacaaacgatcaaatattggacaaaaacagaattattagggcatgtacaatggtttttattaacggtctctctttattgtcatgcaaacatatttggtgatatggaagagagagaaagaagaaaagagaaagatggttgctacgcatgacaatagcatagagtcgactcttagcatttattaggaaattttttattgcattgagtctaataaaggaaagatgactagtaagaaagtatttggtacattaatgatcagagaccgtattgtcttaactattgtatcgtgatagcctctaattaacatagagaccatatcggtctctacctttgtacttgcccttacaactacttagggaatgtttggttaatgggttataggatctatcttgattttcggtggtacaacacagggtctaccttttcgattccgaagtaaaaaccgctcctcaccagtttaccaaaatcagaccgaaaaccggcaaaaactatcgaatttcagtcaataccatacggaaaccggctaataccgattggtttttacaaaacgagacctagcgattttatgaaaaccgaccagttttcgtgaaattccatcggtttttctagaatgtttactcgagtttactgttttaactttaaatttcttgaaaacgatttggattttcctttgaaatctgattaggtcccgcatcctcaaacctcgatgtctcgtggttctaacgggtgcttgactgcttggagcctatacaggtaagtagagatcaggcaaaagtactactgctggtagctgatagtactactactgagtacattatttctgttccttgagcttaattgccatacaatgccgttgcaaaagtgcaaacccgcccattaatttattatttttagataatgcatgcccattaattagtatagcaccgtacgtacttgatctagccgatatgtggtgtcgatgatcatgattacagccacggctgcacgctttgcttgctaattaattttagggtattcgctcgttggtaccaactcgtccagtacttttgcgagatagagataaagtgtacgtcgatctgttgctagagtcgtcgcggccgcgcccctgcgcgcggaggcagtgtagagtgtggacacatgtagatcgatcgcccttgggccttgacatttctcactgtacgaatcagcgtgcagcagtgcaagctagctgcggagtggtcttggggttgagtcacatgccagttaggccaatctatcccaacatgtaagcagcattttttaacttctcttggctactaaaagtatgactgtcgccgtgtttagttctaaaatctttcttccaacttttaacttttccatcacatcgttctaatttcaataaaatttttaattttagtgtgaactaaacacagcctatataggtcttgtttagttcccacataaaaaatttacaccctatcacatcgaacgtttgaacacttatatgaagtattaaatataggctaaaaaataactaattatacagattgtgtgtaaattgcaagacgaatcttttaagcccaattgttctatgatttgacaatatggtgctacagtaaatatttgctaatgacggattaattaggcttaataaatttgtctcacagtttacatgcggattctgtaatttgttttgttattagattacgtttaatacttcaaatgtgtgtccgtatatccgatgtgacacggtaaaaattttcatccctggatgtaaacacaaccatacatattgttagggcccctttaaatcgcatgattgagaaaacgtaggaataggaaaaatataggattttgatatgaatgtaagtgtaaaacagaggattgcaaaacgtagaaaaaacacaggaatggatgtttgattgaactgcaggaaaaacacaggaattggatgagagaggtagacttaacggatccgttaccaagaggttgaagctcttgctaaatttcctacaaaatctctataggattgtccattccacaggaatttcaaaggattaaataggattcaatcttttgtatcaaaaggcttcataggaaatttttctataggattgaaatcctccaaaattcctatatttttcttctaaatcaaaggggcccttactacaaaacatctctacaaacattatgtttctccttttttccccccttctgcagggactataaagggctttcttaagaagatcgcacatgcaaactaactaattaagttaatcctgactaatataatggactgtttcccataaatcagaaaaaccttttcctaaattagactacaataatttgtttcatgattgctagcaggaatgaattggttttcttttaatttggtagagtttcaaagatttcattcctgaataaataaatgtttttgttaaacataaaacaatttagtaagttactaaaagggagtgtctagatttctaagcacgtgaagttttccaaaaaaaaaaccaatcacttttcttatccctttgacattaatacaatgattttcgtcactccatta

SEQ ID NO: 52031 - DNA, 1003 bp, Oryza sativa
tcggcaacccgggcctctgcgggccgccgctcaagaacccgtgctcgccggacgccatgccgtcgtccaatccgtttgtgcccaaggatgggggctccggcgcccccggtgctgggaagaacaaggggttggggaaggttgccattgtagccattgtgctcagtgatgtggtggggattctgatcattgcactggtgttcttctactgctattggagggctgtttcctccaaggagaaggggaatggtggggctgctggttctaaggggtccaggtgtggcaaggattgtgggtgttttagccgggacgaatccgccacgccgtcggagcacaccgagcagtatgacctcgtgccgttggaccagcaagtgaggttcgatctcgatgagctgctcaaggcatcagcatttgtgcttgggaagagcggcatcgggatcgtgtataaggtggttcttgaggacgggcttacgatggccgtcaggcggctaggagaagggggactgcagaggtttaaggagttccagactgaggttgaggccattggcaaggtccgccatcccagcattgttaccttgagggcttattactggtcttatgatgagaagttgttgatatatgattacatccctaatggcagcctctctgcagcaatccatggtatgcattacttatttgctgagtttcacatgactggtcaattggcataagaaaagtgccacagtagaatcacatctttgcatatattatgattttggtttgttaatttattacactaggactcaaggacactaattaggtatgcttttggccaataactcttccctctgctctagaaattagtactaggaattcaatttggatgaacttcgttattttgctaggcgttttttatgctaccagcttatgcaaattcagttcattcattctgaaatagacttttgccagttggctgattcttattttctaggattagtgccatgagcactctctctgttctaaaaaa

SEQ ID NO: 52032 - DNA, 1700 bp, Oryza sativa
tgtccttgattctttgctttaattgggagagcaaatgcattcaagattgggatgggaatggtaaagagttttgattgtttcgttttatgggttttttgtagtgtgaaatcgatttgatgagagatgtgtaacatcctgtaaatattgacacaggtagccgatatctgtaacatcatatagtggcagtggattttctgaaatccacatagattgatttgttctttggcacttctcgctccaggcaggttgcaggcagaactagtttttctttcttgtgtagcaggctatcttgtagaactaggtaggctgataattttaggaacaaagtgactaacagtttttattttgacaaaaataaaaagcagaaatcttttttttgctacaataattgcatttaatcgataatatagatagttgatgtctattaattaatgatttgggtaggtctagatcctcacttgaccatgatgacattgacgaagtgcatgtttgaggaaatggctttttgtaacatttggtttcttttacagaacagaagtgtgctccaggtgcaggtatgttttagaactgggaagcataaactgcaagcaagcaagcccactatacaatgatcagtaaccactccggcaaaactgtttagagcaaatctgaaacctgtatagagcaaagcagttgccagttactccctccgggctgataatacttgtcgttttagacaagggtgaggtcaaactttagaatctttgattgtgaatcaaatttgaaatatttatctttcaaatatagtgactacacgtatagattagtcttaaaaagtactttaataaaagcatttatttgttaacatttttatacatattataataaaaaataatggtcaaagttgttttttgaagaccgtatccttgtctaaaatgacaagtattatcaacccggaggaagaactagtcaggttgactccttgggaagcagagcagtagaaaacttttttactcttatcacttggcttggaagcatcatctccatttgcttggagttcgctaatcacgtgcaatgatggcaaagcaaagtcatcaaacatagtccatcgctgcctcggggctcctcaactccttgtcctgcgtatcgtccgacttgtttggcttggaagaacgcatgtgccagaggagatatacagagatatctgtcatcttcacggacataaaagttgcaaaacggatcgaacattacacataatgccatcctgttgtttctgtgattactatcagaacatatttcaatctgtgcaatatcacagattcacaaagttgcattagatatgttaggctgatgctgtcgaaaacaacgattgccatttttgactttgaccactaatttttactacatccgtcccaaaaacttgaccatgcaattgacaataccattgcccattaacttgaccactaattactgaggcttgagtaaatttcagataattaaattatcgctgtcggtcactcaagtaaaataaattctaggacttttgactctgccactgatcctgacagcgatcgaaatgttgctttctgcaatgttgttggagcttgaggatcgcataattaaacagcccatccatttggaaggtgtgatttgtaacatcacgggggaacaggttaggacacgttaattagctacgtggtgcgtgacagcgtgagtgagtg

SEQ ID NO: 52033 - DNA, 718 bp, Oryza sativa
agcccccacgctttttccgccactgggtgagccgtaggctaggagagggatgagtggatcttcgtcctcaactcctctttgtgaggatgacagggagctcgcgtcgacgatcttaagtggagttagttttgggagggcgttgccaccaccttgtaggtcttgcgacgatcggtcacttagcagcagctggctcagtgcccgttcctttacctgggttgtgtgaggagctgctagtaggtggtgatgttggtgtttcttttttttttctggctagggttgtaaccttttaatttttcccgctatataaatatgaaacttcacactatctcgttttgaaagaaaaaagagtgcacacttgacccgtttgaccaaatgattttttttcaatcaccttaccacagaaaagctcatctggatttatccatttttctttaaccctttttatggtagatgggagtgcatacaggtgtaagcattaacactaactagggaggaagcccgcgcagatgcatggtcaatttatttattctttactaaaagaatgttaaaaagatgttatcttaccatattttatttaaaaaccatagattatcttatctctaccctcaaattgaccatagactttgatacactaaattaaattgtaagaatgtctctcatattaaaaaaaaaattgttgtgtcctggttatatataaaatttttatcacaaatactta

SEQ ID NO: 52034 - DNA, 3241 bp, Oryza sativa
gaaacatgggatgctaacataacattactagtagcttcacgaagataatctttttccaaataattatcatatgttaactgtagtatttacacaacaatggataccatcatgtctatccctatgtactgcctttatttcatattataagtcgctttgcctttttttttctttagctttgaccaagtttatagaaaaatatagcaatatttttaacataaaacaaagaaactatcaaaatatattcaatgctagatttaataaaattattttggtgctataaatgttgctatatttttctataaacttggtcaaactttcaagaagtttactttgaaaaggtcaaagtgacttataatatgaaacggagggaataataaaaaaaccaagcagaaattcaatttctttgaaaaaatattaaattaaataaagaaattatgagaactatctataccttttctggaaaatatgagccacaaaagcaagatttagatttggtaaaccgtcgacaatgtcttttggggtcagatatcttttgcagcccatcctatctgcatgctcaagaactaatcttgctctatgaagaagatctttaactgacattggggatggtttagcactgcattcaggtgccaagacattcagtagacaagcatatgcctcactatcctgcatttttatgttacaaaaatataagatatgcattcttcatactgggatgtagatggaactaaagaacagataaaccaatatttatccatcaattgactatagtggaatttaacaaccaaaaatttgataaccggaaaaaaaaaagtattcatgatgttacatgaactatgagaatgaatgcatcatgatgtatgattaattaattattgaccatagtgttataaaataaatttaataacataaatatgtaattcgataaattaacatttttactgcactaactacattttctggcaaattagatgcattcattctatacatcagaatcctaaatgatcaaggaaaactatcgtggcatgtgaatgctaacatgtagaaaagatgtcacagctagcaacaactaaagaagactggttcatattggaaatcaagtgagcatacttttatatctgatgaaaaatttgttactgttctttggaaacctcctttcttcaattgaaagttcatccatctgagtaatattttttcaggagataagctcataagctcctccatctcctgcaaaaagcacagacatatgaatttgagttattttcccatctgacacaaaatcagtcaccagtgtattagaataaatatgaatcatgaactaccttgctgtcttcaactaattctaccaattgaggtgtgctcttcaggtttacatcagccaaaagttgtatctggtagtcattatgttagcacagtcagtgagatacatgaagaaataacagaacttcagttcttgtgcgcaacaaaataacaacaggaacacaccttaattatttgtgatatcaaacccaagataaggtgaggctgcaagcacataagagagttttcataagatccatgcacaacttatatgaatgcttgagtatataaatggagtgaaagcaggtgtaatcaatgaaatgcacacaagaacaagagcagacataaaaacaatgcaagtatagcagaagatgcaaaagtatctgtatttactagagcatgtaactagtaatatgcgaatctattcaagagaacaaaaatggcataagttacaagtattctgaacaaacaacaaaattcaaaaaagtgaaacctatcacacaacatatatttattcatgtagtagattttttctttaggggatttttcatggtattatcgaaacaatttcaagtatttgatcacaaacaaaatagaagggcagatggataaccataccaatcatatgccaccatttaagcttttacagataattgtgccatggtgttccagtgacaaccaccaagaggtacagatataaaactaattaaagcaaggagaaccaactcataatgctttacagttctggccatcacatggactttcagtctagtgtgtcccaacatcccctacttgaacacacacacgtgcgtacccgcaactaaaaagtgaacaaactgaaacattcagctttattctgaatctcatactgtcgtaaatacgttaatgtactaatgtggtgatcacacaaaagaggacaaggaattgaattaaagaaacaggcagagtccagtgcagtcctacccttccctcgcgaggtcctgcgtgccgatgttcacgacagtgcagccgatggccttggcagaattgaggcagagggtgtggttctcgttcttctcccacaggttgagcagcttcttggtgttgatgcgcgctcgtcgatcgtccccggcacggccaggttgatgagcttgctgaatcaaaaagcaggggggaaaaagagaaagaaagaaagtcagatcggagcacatgtgagtggatcggagtcgaaaaggcgatcgatgagatgagatgaggaaatggaccataggagcacgccgtccttggtgaggtggaagaggtgatcggtggccggatcgatggggagcgcggtgttgaggaagggatcctcggcgaggtaggcgttgatgtggccgacgtaggaggccttctcggactcgctaatggtgtggagcagggtggtggtggcggccgtgaggaacgccgcggccgacgaggaggaggagcgcgcgatgcccccgccgccgccgcccgccttcttcccggcggcggcgcccttgagccgcagctgcatctcggcgtagacgcggaggaagagctcgaagccgacgccctggtgcggcctctcgtcggcgcgtgcgacggccttgagcacggacgcccactcctcctccgtgagctgcgccgccgcaggcgcgctgttctccttctcggcgtcccctcctttcccggccccgacgccggcggatgatagcgccgcaggcaggtcccgcagccgcagcctcccgctcggcgccgcgtcccgcagcgccgcgtactgtaacaccaccaccacacaaacaccaaccagaaacgcgaatcacgatcaatgcggcggcggcacggcggcgggcggcggatcgagccgtggccatggacagggtcgtcgtacctgggcctggagggcgcggaggtcggcctgcgagaagcggcgctgcaggtaagggtcggagacgacgaccag

SEQ ID NO: 52035 - DNA, 1335 bp, Oryza sativa
tgggattcggggggtaacggaaagccttgccttttgcgtgcctacagagtacaaccactcacacagtcacactagtggggaggaggaattcaaattccgtgctgggctttgggatttccacgctcgctggggtagcagtagcagtagcagtagcgggcagtggctggctggcaggtggggcgcgcggggggcgtgacagctggtcccgaccgttgctgtttgggaaggtagcggggggaggagaggaggggggcgagttctcagcggctcattcgctgccttggcttcaactgatcatcatcaatggcgttggctgcaaactgatcgtcagtggcttggctgcaagtgattactgctttgactcttcgagtttgagctcaaaagatgagagggagcccagtgctcaatattagaggcaatttttttatacgtaagttgctttaaaaaataatattaatttatttttctaaaaaaataataaatacttaattaatcataagaaaatatatcgttccgttttacgtgtgcggaaggtgagtttccaaactatcctcccaaacacagccttacttcataataatttgttggtttgttcagataattgaaacttaatcactacgatattgctctaaatcttataggttttgttgtacagtgttagtgcataattattggggggccaagctccaccttgcccacaatgaagctctgttgttgtggggattgtcagataatagttgaatttgttttttttctcaccccagagaagccaccatttacacaaaagggatcactggattttatctttgagtgagtaccctttcgttggagggacgaaagaatttctcattcatttcggaggaaaatcatctgtaccattttcatgccaaccaatacaattttcacgtcaaatgtgttttggatcgttgttttcaatcaatatgggtattatatatcaaagtaaatgcatatatctagctaatttaatcctatttattaactccaggaaatagacatctgggagcatttaaacaatagccagttgtagcgtggctggagtgttgaagtctacatatgtagccaagtgcaatttttatgtcgaatgtattttgcaccgttgatgtgtatacacgtaggcaaaaaccaaagtagatgcatcaattgaaggaatttcgcaggaaatttagaggatttgaatccttggaaattatttctaatgagatcctttggaacataggaatgaaacttctgaaatcctacgaaatggtttcctatgtccctcattccatagaaaaacaaacacttcctctctctctctctctctctctacactct

SEQ ID NO: 52036 - DNA, 1515 bp, Oryza sativa
ggcggccgcattagaactagtggacccccttttgttgctcgtcgaaacctcaaaacttcatggtttttcattgaaaaaaaaaaaccttgattaaagacactacctctaacatttcgttgttttcgaatccgataggattctattggatatgacatcatattcctacatattttttgtccctgtatttttcaaaatcttgcattacaaagaagccataatcatatcctattcacttacttaagagttcatcagagtttgttgtttggtagagctccaactcctaaatttaggtcctatttagcacagctctagctccagctccacccctcctagagctggagtttagcctaacagttcagctccaccaaaactgggagtggagttgggtgtagctttctcacaaaatgtactggagttgtggagctgggtttaggcaactccacaactctactccagactcaactcctggagttatatttaggagttggagctgtatcaaacaggcccttagttccaggagttgggtttgaagtggagttgtggagcagcttaaacctagttccatctctctagctcattttgtgagagcgctgtgctcctattttaggtggagctgaaactatttggctgaacaccaactctaggagaggtggagctggaactgtgccaaacagaccctaaaacagtatgatgaaaacaataagttgcaagtactggtcgagtattgtggattggaatatcatgtcggagtgaatcacacatgaatttaaaagatgatgtatttggatggctcatagaaaaacaattcggttttttggatggattctagagaggagagacagagaggagttgcattggatttctcaaagtaaaaagaaaatgaaggttgagctcatgtgctaagggcatccacaatgtacatgaaaaccagtccataggaaataaaaaattccattcagctatcttaacacattgtgcaactagtctatagcaaagaaataacaaaagttgtccatagcactatgggtagtccatagacaattaaaaaatcatagttatgccaggtgcatgcatactgcagcctgcagcttcagctccggctgatttttttttttgcctttagtgggacccaccttaattgcacatattgtggtggtttctaaaactatgactctcaggtgtgggtcccacatctatagactagtttgccaaatacattggtgttgccctaatttcctattgaattgaggtataggaattgaatccaaaggaatttggcaacatccaaaacctatgttctaaacaacctacttagaaaaaaaaattccttagtatttcaatctgccaaaattcctacggaactctctaagatccaagtagccctgaaatcaaaagcataatgttactgtagaaatttcacaatgttgctgcagaaaagcataatttacatatactatataaacagaacgcacttaatgtttactgaagagaaatcatcacagatcttccaaatcg

SEQ ID NO: 52037 - DNA, 5249 bp, Oryza sativa
attcctgcagccccacttattgcccttgtaagtccatacgacaatatcactcatcaagtcctaataccatgagttgaagtcgatcagctgtactcccagactacccttgtccaatataatcctccttggttcatccgattcagaccattgtctagcaacagcatgaaaatttgatattagcacatgacttcctggattttctgggtcaacctccagaaggtgcagagctactttgttgcctctcaacacatccatgttagctttacatgcattcaacatagccacacagatggaaccagaaagctcacttcgggttataatgaaactacaatagagataccatgcctcatcattctggcctgcacggcctaatagatcaataaaacatgcatagtgctctggtcccggattaatcccatattgtcttttcatcaaatgcaacatagctcccccttcatccacaagaccagattgtccacaagctgaaagaacagcgagaaatgtaacttcatttggcaagaccactggtgcaactttctccatccttttaaacaaacctaatgctgcttctccatgaccatggcaactgtaagcatcaatcatactggaccaggaaaccacgttcctgcaagccatttggtcaaacacaatgcgagcagccattgtccgcccacattttgcatacatatcaatgagtgcattacataagatcgtctgtgaagtagacccatgacggacagccttgcactgcaccagcatactgtacatcaaattcgctgtcgctgagcaggcagtgagagcacatgtcagcgcaattccattaagctcaatcctccccagaatcaagaaagcgtccatgaatgatctgctgttctccacacagcctgaaaaaacagcgttgtacagaacaacatccttttggcaatccgtgcacagtgcactgtgcacatgaacaacctcatcgcttcctcaacaaggacatagctcatatagagatccacaagcgccgtcgccctgatgacatcgtcctggcatgcaagaacgcagcgcgcgtggacctgacaggctgacagccagggcggagggccatggtgcagagggtcgcggccgtgggcgcgaaccgcgcggtggccattccccggaaggcgtacgctgcggtgccggggcgcgcgttccaggcgacggcgtcccgggcgggcatttcgtcgaacaggcgggacgcggcggctgggaggcccgcgttggcgtaggcagtgaggagggctggagggcggtggccgggatagggctggagagggaggaagacttgatgagggtagcatggactacgggagagtcggacgggtgggaggagaggcggcggagcagcgcggcgagcggcggcggccgccgcattgcgcattgcatgggatatctatgacgggataaacgctgtatttagctccggttccagccggcagccgctgccttccgagtcgtggttagagcaaggataatggattaatggtgagttctttctcccaacttttccctgctcatatcctcgtgttccgcgtacgtttttcaaactgctaaacagtatctttttcatgagaaactagaaagcaaacacagcctaatagtagagctcacttcctacaattagtttattttaaagccaacatataaaatatattagctataaaattggctacaattttcttctcctctctatctcacttatacatttaatgtatttgtcctgaagcttgtgttaagctagctcttgtatgagagccaacacccttgattttttctgttacctctcttatttacgtaagcttataataggcttatagcttactattatccttgctcttatctggctttcttgaaacatgttgttgtgtactctttcttctcgattcctgccactgcgaccgccaccgcaaggtttggtggactttggagttatcccgatactggcgatatgaatgctagtatcttacgattatatcaagccgaaacaattccgatctcacatagtatcttaattttcatagtatctcaagacaacatggatagatgacacaaactcacaaaccccacgaggcaaaccaaacaagaatgtagatttaaacgcaaaccaaaccctttttttttaaaaaaaaagaaaataaatcaatagctctggtcaccctatatacttatagaaatccccactaagtgtagttaatgttattttctcttctcttaataagccacatcaccttaattatttttagccattggatgacaaatctatagttcaaaatgtctcttctttcttctctcataacaccaagtaatctcaatcatttttaggcctcaaaatttataagtatcaatttgttttagttttaatattcatatttcatcttatttgtacatattatgcaacttaatttcccacagcaacgtggcagggtattcatctagtttatagatatagtaaacacatactctctctttcatctggtcaataccagtagaaatgtagaatctcttagctaacattcaaatctttagatttggatttactccgtgaagttatgcacctgcaactttgtttagtgcaatagcgtagtattgaattttcggtaatgttaatagcaaccatctgcttctagtcaaatggtcattcatcttaaaacatacttatggattccctttaagaatctcaagattatgaggtctccttctgagagcatgagcaatgggtggctctgggtcgtagtcctagctcacaccatccggctttcattgcctttcgaacccgcgtcgtcccctaggagagagccagagatgcgcgcttgctcgcgggggaacgcgcccctcggccacttttggcggagccacagagccaggctccgcattgggcgcaccgtggctagggaagtagctcgtggacaacgctccctacccccgtatttccctattcaccctcgcccccctccctcgccgtcgccttgagttgcgtcgcactcctcctctttctctgcctcgccttctcttctcctcttccatcctcgctgagcaagaacgcaaggattagatctgagattcgatcttccactcaccctgccataaagagcaagaaatcggagcaggacgagagcagcggagagtgaagaggagatggagatggagtgggcagtttctttcacttctccctctctctctgtacacgtctcatcactttggactccgagccaacaaaatgcttaaacaagtccaaaatgtttctctctctcatttctcacctctcccttcctcttcaatgtgactgcacagagggcaaggagaccgacaaaaaaaaacaaaaggagcaaagagcaagagaagtagtactccagtgagggtgtcggtgggctcaaaagaaaaaaatgtaagagagaaaatatatagcaatggctacgtggattggttggattggtgcacactgttatgggttaggccatctataatcggtaccctcaacgcgtacccttgcaaacggtgcctcctttccaccgccgggtcattccctgggaaagaggcgcaacgcctggcagaggaatgcgtgcctcggctgcttttctggagccaccgctcgaggctacgcgttggaggagggcgtggctcgtggacacggctcctgctccacaaatttccccttccaccctcggtctcgttgctggcagtggggaggagtcggaggcgacagcgacggcgacgagcgacggccgccaccatctccttcccaatctggccaggaggggggatgcagatccgtaggcgccggatctgctgccccccgaccggcgacggcgcgaggtggaggagattagggaggcggacgacgcgagaagaagagaggggtagtatagtaaaatacctacgtgggttttttttggttagggacactcgtgggctactaggggtatcattcattgtgaggggagtttccctacaagtatcctctagtgaggacactttaggagtggctcacattgtggatgcccttagagtatctccatccagttgcttcagattttgaagagtccagctacaggtatcctccattgggatggagtggcttcagttagtgagagtaccaatggagtagctttgattgtagatgccctaagtgctgaactcaaggttcatgaatccatgaacttaacatgcagattgttacaaagaacattgtttggcacgtataaatctgaacaagtctatgacagcggcactctcaaagaagacaaccgctgactaaggtggtatttggatccagtttagttcctatcacatcagatgtttggacgctaatttggagtcatgaaccataaacgagtaactcagtgtaaagtttgcattactaaaactgtactctgatcagaatgtacaacatgatttacctgttttctatacagaaagtttgacctaggattacaacaaaaatatgtatgctttactctcagcaacggaaaatgtattttctgtctaccgtgacctccccgccttaccaacaatgaataaaaagaatttccaccttgatggttgtgaaaaagcacatgttaccagagaaaatggagctggaaaaaaatatgaagaattaacaactgggcatgtatttgttaaattttaactgggctcatcgctgccttttgctttgcctcgtaacatatctccaaaaccacccagcattatacgaccaaaccttgtgttctcttgctgagtttgtggggtaggctgagagggggtcgtggcagcagtatcatgttgttccccgctctctttcttcacaaggaggctgctctcaccaaagaagctgctcatcgatgatgcaatcccaagatgtgctcccattaccttgccaaggctctcaagtttacctcccgacctttcgcgggctataacttctagtgcttccttgtgtgcagggtctagagcatccagatcttttaacaagttctgtattgacggcaaaagcagatcacgtacgcttgtagcaggaagatctgcaacaaataagagaaaacacatgtaagaaatggcagattaaactatatggccaagccaaaacagacttatgactatgggttttactaaatatcatcaattaaagtccctagttaaaccatgactgggcagtgctctactaacaactaataaactggtgtgaatcaaaagccaaaggagttgttgattctgtcaacactggtaacatgttctacccctctaaacaa

SEQ ID NO: 52038 - DNA, 1473 bp, Oryza sativa
cagaatatgacagtaacaagctaatatgggatcaaagttggatatgcaagtgaacaaactaatgtaaatggaattcctgatataatatgtcattgctaaatacttttcaaacgcatcttgaaatataaacaaaatatactgaaaatacatgcagatgccgacttgaccaaagttacagggttgtggtataagggaaggattagctagttttggataaggctaacctgtagcatccacagcacgcagtgcttcacagaatacatttgctatctcacgacgccgctcaatatcatttccagtaggtggggcgctcgttagcttaaatatcttagttaaaagatgtatgtaatgtcaaagaaaacagaacacacaagcaatctaatgaatcatgaaaaaatggtaaagactttagaaattaaatgcggttgataggatatattcacgtagtctatctgttgtatgtggcactgccactgcaagtgcacgaataacagaaacagtagcttcatgtgatccatcttcaagaaaagcatccatttgaattcgtatcttgtcaacaacctgacagcaagtctttaaggcaatgcacgaagtacataaagtatcaaagaaaataaatgaagatgtatacataccatgtcatttttaaaatgctgagcaacagctccaaatgcttctatactagcatattttaccgtcaagttttgatcagaaccaagggttataagtgctggcaaaacatgagttgatgctactttcacactgatgtagggtacctgtgtgttaaaacaatcaaggataccatgaggaacatatggaaccaagaaggcaaaggtggtcaaccctctaagaaactaccaatgcattcttgtaatgaattaatgatacgcttacaagtgctttcagtagagctgcagcattggtttttaggttggcatcagagatcacaaccatctcccacacaatattaaatacagcaacatggtgctcctcaaacatgctacataatgataataagtgagacacattaacatagagcatatcaacaacatcgtgacactggctgcattatggattcagttagttaaagcacgaaccaaaggaaccgaactgcgtcaatgatctcagcagtgtgatgcatagaaaatgaaccatccttcgtgttctggataagtaattttctcaaatattcttctaattgttgacgttttgaaggataacccaaaataccagataacaacaatggaaggacacacacaattccaagtttttcggcaatagaagtttttggacgcaaacctgcaagatttaaacacaatacatacaaatgttgaacaaaggaaaatttaaaccaaacagccttgccatattaatacaggatacttaccacgaactctagactgggttgccagaggaaaataggtgaaatcactgctgtcaatatcccccgctgctacaagggggtgcaggaat

SEQ ID NO: 52039 - DNA, 6272 bp, Oryza sativa
ttcctgcaccccctgctgaaaataatgatcaaatatacactttggagaccgttcaatttcaaaaacgtcatacatttaagaagagagggagtagtaaagttttcacacaatattacagaggaagacaacttacgctgcatacagttttaggcaggattttgagaagtagctttctggcatagtgcctgtagaaggatcagcagcaaacgggcaagtagatatagctttctggtgaataaatggtagcaactcggtcaacatgcggaggaggacatcaatgttccaacgctcttgctctcctaaaacacggagatgagagtctattgcaccttcaacccctgaaacgggcggacagcgctgaagcataacaattgtgtcagaacacatgtggcacttcaaagaaactataaggttcccaaaatttacaaacatgtatacctgagcggatgccaggatatgtgccagtaagattctcaatatctgatccagtttatctccccatcttacaacagcaggaacaagttccttgagagcaacattcacaacagcccccgaagggtcacagaccaactggaacattagctcctcaacctaccaaacaaacaggaaattaagaggacttccaaaataagtattatgtttcattgatttgtagcgcagcaagctttcaatcaaaacatatattctccactaaaaaaaggaagttctgacgggttaaatttaactaattataagaaaccaaatttcccagttattggctctaagcatttgcaggacttaccttataatatttatccagatttggaaacagaggaagcagcaatgtgaggttatgtgttgcagcttcccttacaaccgttgcagaatcttcaacaagttgttgcacaatggataagataagggaatcacgtatctcaggacgaacatatactgctaattctccacaggactgggcaacaagcaacctacgctcctcatattggtgatttatctaaacatcaaccaatttagcattatgtaatattatatacctaaaaaggttaaaatatctgccacaaattgtcaaatacctgttcccaacattgtggaagtaactcagtttctgtcctcatctcacctacactcttagcaagctccacacaagcctgcgtgaagaggaaaacagttatgtgaataaccacaatttaacctagtactataagtttgcaagctgcatcatgagaagtgcatgtgccatgcaccaattattgcaattgtaggaacttacatccattatgatgcgtctctgttgtccatcaggacgtttgattagattgaacaacgtatgagttaaggaatcacgtacatcactatctggatgtttttctatggcacagatgatcaacggaagaagctcctacaacagtgcagcaagtaacataagttatacttatataaagattgaaacaaactacaagggttacaggtaaacctcacgatggtttataagcacataaggaacaatctttggaagagcatccgaaactattttgatagtctccaaagcctgcatggttggataaaaatagtttgcttaatgaaatttgcaaagaaataaatgtgaaaacttcatacagaccgaatatatatcaagtcactaaccatcttatctgatgatttttgtttataaggactctctactttctcggtatgaactttatcgtcagttagataaacagatatgctatctgaatccccctggctattaccagatccatgcagattgccattgacagataaatcttcaaagcaagtgtttgtgccagatttatcttctcctgaagtgccatagccactgttctcagcagttgagcaggaaacttctgcttctggacctggggaaccttcaaggctactttccatattttcatgatctttctttttaccctcagctagactcacctccgatgctagcttacttgttatggattcggatccttttagattgtcatgttcactgctcagcactactatttcttccatagaattggcaggaattaaaccatcagtatctccagaagataatcgtttacttgacctagtcccttcaatatgcatcttaagggacgtaatttcagctctacaatcattcaactccttcctctggacatccaatgattgcttcaagtcttgaacctttcttaaaatgtcagtgtagcaatgttcagaagaattgaagtataagataactgggttatttctgagagatcattaccgttttctccttctcttttatgtccttgtgtgcagcttccaaagactttcttaaagcagcaatctgactattagccacttccctgctctttatcaaagcatctttttcagcaccaagactttcattgtccttcagtagcgtctcattttcgcggagaatagaaatcttttcctgtgatatgtaataaaagtgatgacttaagaatatatggaagttatgggcttgcaaggaaaaacagagtctttaatgctcagtcatgtacttctgtggtgcctgttttcccaattacgaagaatgaccaagtgatcctaatcacgttggaccatgatacaagtcttggataagaatctaaaatgcactagaaacccccaggtttatgattgttactgcaataacatctagggctagtcaaatattgtgatacctcaaaatggtcacagaaaaatgttaaacatatcaaatgcatcgaatgctaaatcctgctacttattgattctcgaaaatcaattttaaaatactcttgcactgcactttatgaaatgaacattgactcatggcttatgcagcggttttatttcattttgtgtcactataactggattgcacattgttcatgaataagataaatgtgtcaactatatgcatactccatagaatgtaattattactaaacttgaatatgatgtaggcccttcctattagcacgttacttggattctgtcaaaggattgcatgaagcatatgatctagttaccacaaatttccagcccttttcattgaagtatgttggtaaggaaaagattcattccaatatgatttggagtaaatataatgtgtattcttagcacacattgatggaattaaaaacaaacatgtaccaggatctaatattgtcgcatgtaacactgtaatgcatcaagctgtagtcagtaaacaattagcagcttttgtaggaacattaagcaactccatggaatcacctctgcagcctctgtggtagatgaaagatactgatagtagtaacgacgaagggcatcaggcacacaagctgaactgttaatccaaacatcaaggtcctgatcaggaacctgcaatcagaatgatctagtaagctttacgaaggtcgtcaggcacacaagctgaactgttcattctactgttttgtttgattcataattgatttgccagcactttttactgttggaactttgaagcacttatgggacccacctagtgttcattccacagaatgaagcttctactaattatgcctatcaaattttcaagggataggtatgtgtgaacagatctgtagaaattacatttggcgatatgcaaacttcatttgaaaatttacaaccatgaaataaggctgggaaaggatcatccatatatgttcttttaaaagataactttctgtacatacattcccatgaattttttgtgatgctactagatacacatcctatcaaccatgaacagaatttgcatgaatttattttgttgagaaaaggacgtgactttgacgtgaagttccataattttgactttttgcatgagaaacagataaacaaaccctaataaacttaacaacaagaggaagccatgaaagaataataaattctaagagaaaatatgatacagacctcctcaatgaaagtcatggctgcaagtcgatacccagccaaaagcaagtattctttgacagcacagttcagatctttccgttcattatccttaagaggacctaatgttgaaattttggcatcccttttgtcatgatggctagatccttcatttgtcaaagcatctgaaagaggcccagcatgccaaatggataaatcatcttacaagcacaagataggtctagcatggatttgttttcatggaaactttttcagcttcttaagctcacataatcaacaaattaacataaataaatacatgcatattgtaggtcaaaaaatcatacaaggatctatgttccagtgccagtagatttacatttagcagtacatagttactagcataactcaaactgtgcactctccagctggtatgtgtgccctgatattgatcattacctcataattaaggtacagtgcaaaaaatgctaaaaagtacaatttattgtctcaaaaaccagttaaaagctatgatgcgcgctgtcagtaggacctcccctcttatatatgtatgtctatcagttagcaatgaacacgatgaatgatgactcactttgaattatctagtaaaagctagataattagatgtcaccaataaatctgcagcagagcgctcaccgcaagctagtggcccttgaagaggcaagtgttttacttaaaagtaactagaatatctcaagcttgtttgtggaaaactgatcaaagccaatgcatcagttctgttcaaccttattgaattgttgagtgtaaaagttcctacagatacccccagcataagccacattaatgcttataaccttcaaatcagacctgtcttttgtttatttcctgttaccctttatgtccatggtacttcttcttatttcctttaaaccatatagcctccagctgacaagcaaatgccatgacaacaaggacaatattgttcaatacaatcccaattcccaaagatcactgagataaacaccctctcgcgtatcacagccatatttcatcctcacatgagatggaattttcaaagttcaatatgtaagccacagaataatgagataattttcacttttggcacttatctgagtaccaaatgctttaactattgattccacttcaatcaaagaatgtaaaaacagaaaacaatagtttttgctccatgccatcacatgaaacacaatatcacgctatatttgtcatttcaaggttacataccggtagcatttgagccatcaggagaagattctttctgcttttgtaactcaagcttcaacctggaaagatcttctctggctagccggagatcataatcagtgagggccaacttttcttctgccgctattttctcttccagcaagctctgtggatcagcacctgtcaataaaaacatagagataatcacctcacagactcaatgacagatgttagaacattagattgaacacaaacaccgcatctagtgtacatggataagcttgcacaaaaaagtgagtagattgttgagttataccaagaacagacccaaacatttacctgtaatttatttgttctgatagcattgcttggcccataatccatatgctactcaattttaatgatattattaagtagttgcaaacggtgacataaacaatgaaactgccacgccttgtgtggtctaagtaaatttaattgtactgttcaaattaataatgccccttcaactgcgaagtaactaaccaaccaaatcgtctgtagaatgtaagtcgagcaccaaggcacatacacctaacataccaacaacaagatgaattcaacagcgccaattcggacgtaatgcagggatattatgaacataatggcaacacaggaagcagggagcgccactacgccgcgagatccagccagctgaggaaaagggttgggggggaagggggggtgcaaatgcgggggacgcaggggctcaccgggcggcgcggaggacgcgcgggcgacgaggtcgggcgggaacagcgcggggtcggagaagaaggagcggaggcggagcgcgtgcgcgtggcggccgtcctcctgcagctcctgcaacagctcgagcgccgtgaggtggtacctctcctccagcaggaagttcaccacgcagttgcacagcgacgcccaccgctcctcccccgcccccgcccccgtcgcctccatcacctcgggatctggtggtggtggcggtcgccggcgccccacccggtcaatcagccgccggcgacgaggcgcgctcccgccgcatgcggtggtcggtggatctcgagagaggccggtgggtcgggtcggaaactcggacgagacgagagaggcgaaggcgtgtgattttt

SEQ ID NO: 52040 - DNA, 7177 bp, Oryza sativa
aagagaggaggaagaaagaggaggagatcgacggagaggatcgaggcgcgcgctgacgtcagctcggctacagaccgctggtgtgtctgatgtggacacgttgcaaatttcaaatgggccgaaatgacgaaggcccatcaggtgccggcccatataaagcccggcccttccttccacctgctagtaatctcacgaacccttgcgccgtcggtctctctctctcgctctcgtccccgccgcggcgccgccctgctctccccctagggtttgatttgatcccatcctactctctcgtggtccgcggccggattgtgcgagctccgatcggagtgtgtcttaccggtggtttcttgtgtagtgccgctgcgatttcggagggccggtagtccggcggcaaggaaggaggcggggcgcgatgaggttggagaagtgctggttctgctcctccaccatctaccccggccacggcatccagttcgtccgcaacgacgccaaggttcgcgcggtcatcctgccttttgctctttctttctcattttcatgtacagtatgttacgttttacggtggagaagcgcgcccttctgtgctcgggttttcttgaggaagaaattatcctttctaggatgctacagaatttgaatacagcagtccctgaagggatttaggtaccacggttgtacttgcttagaccaatctgtgtgtgttttgtagtactttgcagcattttttgtttgcagtatgtgaccctcattgtgtagtcacacctcgcattgcctgcccatgtcattagcgttgaaactaacgcctaaactacacaaaccaacaaagatatattggtctggaagggttgaagaatagaagctagaaagacagaaggaatttagaatttgtaaaacgttgggatgaatgtaacagctgtgggctcaattttcagaagaacaagagttagggcagaatgcagatttatgtaacccaaaaaatatgattatcaaactacaagatttgttgttacctaaacacctcagttttcattgccatagtatttataaacaaatatatggttatccaacccatggtggccctactgcatgtgtcactggctctctctctctccatctcttttgctttgttcagagtctcagagagctagttgtcccatttccacccaatgtatagagtagtccaatggtggtatatacttcttcactttcttccacacctatgtttatccatccaatttaacaatgtactgtgtcatgttcctgtcttttttcttgtttttcatagtaccaatgaattaactggagtagtggacaaaataatcgttgttaaatttattactttgacacatatgtttctcattcagtatttttctcctgctttatggttttaatagtggtggatgctaaaagctgaggtctgttggataacaacgctgctttcgtccaaaataagctgctagaacatatgaattttttagaccatattatagtaaaagtaattacattaattatgtcagtcatcaaagagatgtgggccgctagattctcctgctggttccattatattaattattgcactcccaaatggactgaaatgctatgtcatttttctcaaatcggaatcatcacaaaatatcaactcaagagacaaaatatcaacacaagagatgattgagaggagaggaaggagcgagtgggaggccaccactgcccctcgtcgcctcgctgccgtggaggtcccgagctcggggccagatcctgagccaccgctccatcgggaagatgctgcgccactgaggatccaccgcgcagccgctgtgccggggagcagctgacccgccaagcggccagggagccgtcgacctgccatgccgccgggagccatcgacccaccggatctggcgaggagcggggcggcggcaccctgatgagaaggaaagggagcggtgagatgctggtgggggagcaactccccctgccacctcccgccccctctcccccactacctctagttgtggccgcagccgcttctcgccccaccgcaaagccggcaggtgaagaagctaaggaggaagccctctcggccgtcattggccctagcgccggcggcaaagtgactggggaggattggtcgcggtggagcacatcctcgcctctcccggccatggtggctgccgtcgttggcgagcctctcgagaggaggaggtgcgcatgaacggagagtaggaggatggacgtagcaggaagggggagggaagagccggattgaggagggggaggaagatgcgagaaagagagagaacgatggagaaaacgagaataggagagaaagaacgacaaaggggatcgatatgagggatccctcgatctgatccgatctggtgaccttatctggacttagttttttactatgaaaaaaccgaccggtctattttaaagaaaaacatgaaaaccgaataagtgaaccaactggtgaggccataaattttgcaaaagcaccactcatcttttaaattttagagcgcagtccaatttttgcaatttcttctcccccaaatatacctatataccaaattaaaaaatttaggtccttatctatatatatctctatctctactacttaaaaaattgaaaacgtttccgtcatccgcaatagcgagaaaagggcaaaaaaaacatgaaaaaaaaggaaagtccgattcaatctatctaaaattttccaccgcacgtgcgatcgatggcaaaaaatgagtctgcatcaaattcaagaacacaagaaaacactaagaaaacgctgacgccgaaaggggagggtgccgccgaaccgccaccgccattgcagggatgtcgggccgccggctgctcccctcccactggatccggtggaaggggccgctgggacgctgggccgccaccacctcccctcctggatccgtcggaggggaaagcgccgcccgccaccgtcgagccctcccgcggccccatggcgagggagaggaggtgagggtggagaggcgccgctgcctgcggaaggagagccgcctcccctcccgttagatccggcggaggtgagggagctgcccctgcctgccgtctccctcccaccggaagggagggcgcagcccctacctgccgcctccatctcccgccggaagggaagagggggagatagagcggtgccgccggtggggttgggaaaggaggagaggcggagggggagaggcgccgccgccaccgttgagagagaagggggaggggaaatgtttttagggttagggttgggctgttgaacttttatataggtcgggatcaatcaggaccgtccatcagatcgtatggctacagcttctcccgcgtcgggccaaatgccactcccaggccgccacatggaataagttcactttaggtcccttaagttgtcccgattctattcctaggccgcccacactattgggccgcctcatggaccgcgtttacgctccgtatgaaataagttcactttaggtccctttagttgaactttttttatttcattcattttgatctagagaaatgaatattgctgccttatttctcgtgtttcatagtaggggggcagaggggtagttagggcttgagccctatgccttgctccataatccccattataatcttatgaaaatgctctgtaatttgtgataatatttgagctcctgttagctgaacgcatgaagattttctggctccaccagtagcaatgaatttaagtggacatgaacaaccattgttaaatttgatgcctatgtttctcattcagtccttttctcttatattttatggttggaatagtgatggatgcctaaagctgggcctttctgaatatcaacactgttctctttcaaaataagccacaagaacatatgaattcttttacacaatatataagtaaaatcaattaaattaattatgtcagtaacaaacattttgtcggtatgctgtaacaacattttttttgtcggttataggaatgtaacattttttttcccttgcagatcttcccttgcattcctataacaagctggattttgtcggtatgctgtaacaacattttttttcccttgcagatcttccgcttttgccggtcaaaatgccataaaaattttaagatgaagaggaatcctcgtaaggttaaatggacaaaagcatacagatgcttgcatgggaaggacatgacgcaggtatttgcttgttctattttcgttcagtattaagtagagagcacattttctatgctgtgaaccactttctatgctgtgaaccacatctgaatcgtttgaaatcaggactccacctttgagtttgagaggaagaggaacagaccagagcgctatgaccggaatgtcactgcacaaactcttaaggctatccctcttattacaaagattagacatgaacgccataaaaaacatattacagagaggttggcatctgttcttttggctcagtctgttaattcttgaaattatctctttgcttaacatatgcactgaacttttaacaggcaaaaacagggtaagacaaagcaaagggagagagatgctaaggagttggaacaggatattcaaatgctcccgaagaaggataccatgctgtcaacacaaaagacaaaggtcgtggtcaaagtttctcagcagcagaccgaagaaaatcttatggaagagtaatgaaatggaatcatgttgcatgcgctctcattttgtcatctttatgcaacacttgtgtttctaattgttactttgcaagttgtatttgactgattaccagcaagttttgcacgtactgtgtgcctgtgtgctttgtgacttccatctatatttgagccttgggcctagtaatggtgtctgtgcggacttgcgctaagcccaaggtggtgtgcaccctagggctaaccctaggatatctctaatcatatttattttatttagtagccattattgtttagagttggattttgcttagattattatgccaaatataatttcgcagctaattcgatttgtagaactccaacttcaagtgcctaatcatttatttgcaattgaggtgtcatgtaccatggtgctgcaatcgctggattgtgtgtgtaagtgtttgccaaatcgatttttatccccacctaatggaagatcgggtagcccgttgtcatcaataatctaagaactcaacctttttttatcagatctagaggaattccttcacatctattctaccatcctctatgcagctggcgcaacgacaacgttttggtaaactacctatccactacattgaaaggccctgcctgctcatggctcatgcatcttcccaaatcttcgattggatcatgggcaaagctctatcaattcgtggccaattttgccaatttcaccaatttccagggcacatacaagaggcatccaaatcgaggatgaccaccatgcaacaagacagagaaacggtgaaccccttatagcaagttcaatagtatagcctggctccaaatcatctatagccaatctaatagcccattcatacaatagttacctataaaaatatacgacatcattaatatccggtcctatctctcatacactcataacgtattgcagccggctacaaatctgtagcccgctttcttctctcttttctcttttcttctcgatacgtggttatagctggcttatagcctgctattgtacctgctcttagggacttcatacaacgctttaatgagtgccatagcactattcccaaaatcaccaaagccttcatcaacacggaagagttatcatcactcaaatatggagtccaagatcgttataccatccaagagaacatggaagaaaacttcagcaatgaagttgttcaaaatcactgataactcatgcagacgaggttgactaacaaaactaaaaggaagatgtctgacgagaagttactcgccaagaaagaaaatctggaactagaaagacgctagaacaatccagaaagcggaacaaatagcacaagccaaaaggagaggtcctcgttgtacagcgagaaccacaatattttctaactccgcgagatcctggttcctgaactccatgtgttcctgtgagaaagagtggaaatatctctatgcattctttaaatgattcagcctttaaccacatggcaagacgaacttttgatcatcaatttgggggcaaaatttggaacggaatcatttcttaacactacttaataaagaatatgagaacatccaagtctctctacactggtgatgaaagaagaatacaggttcaagagaagattctacacagactgaagcatgttggcaccatgcttgcatcaattcaccccctgtcaatcctggccttgaccaacccagaagctcagccacttcacctttggtccagagcaccaaaatttttatgagattatatgatccttctacctcatcttaacaaggaagatgggcatatctctgcttaccaaagttgtgtcttctccctgatcatgtttgaaatgggctgccaacccatcagccatggcttcctacttgcagggactgcaaaattgagctcaaacatctccttgctgatgttaccaccctcacagaaaccaaccagcctggccactatatcggcgctctcatcaatgtgagcttggtcattggggtctgtccagagcctgttcacaagctggagcttccgctgcttcgcctccaggggcacctgccatttgatgaagaggcgctctcgctcttcttctgtcagccttgagcccatccttctcgcgaggaattctcgctcattcctcaatgccttgatactgcaacatgaaatcagataattggtttatatatcacgattcgatatcagttatgactaatgaaacatttgactcggaaaaacattcatgttaaggcttttctatcagataactaagctccatcttcactatcaacatataaggtttctcagtaagtgttcttttacagaggataaaactactgtgagaaaacagattacaaggttttgcttccagcaacatccattttaaaggcctaggggacatgactcttttttagaccttccaacactattttctttttctggaattaactaacatagcccgtaaaactcaaagaagtaaaggctaatatttacct

SEQ ID NO: 52041 - DNA, 1005 bp, Oryza sativa
  unsure (1)..(1005): unsure at all n locations
tttagtggtgaaacaaagtaacctttgcatgaacaaaacttatgtgtgcaagataaacgatcataacctgacagacaagcagctgcttttggtattgaagttttgcaactctctccttcagttcagtgacataagcccggatatttctaacattctcctcagcagcattttggaacatcttctgcatctttttcatgttcactgagctggatcgcctatagcgtggggtttcatcacgcgatgatacatctccagtgtcttcactcttagtaggagtagccctttctgaaccttcatgagacacagtgtcaccctctggagccctattctcaacttctggctctaaaggcctactagaagagaggggagagcatggtgctcttatcagatttggtctgtttatgttgctcacgcccagtggaagaagcatcctcttcttcttctttgctctgttggactttggtgtagtctcgttacattgtgtgccaacatttggaagtgacatcaccaatctatcaatagacctctgtacattttctagtttagcctcaagttttgcaatatcattgtcttgcatatgaagtctactaatttcttctttcaaatcagatccatttccttcatctgtgatcatgtcaacatctctgtcagatctgacagattgcatccccctgatttcagcctgtagtttagcaatagtttctgctgcatcttgattgccatgtttatggcattcgacttctttgtgcagtacttcaatagctcggttagcctcaacctcaagctgctgttgtagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 52042 - DNA, 7427 bp, Oryza sativa
  unsure (1)..(7427): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccaccgtcgcatgcccgctcggtttaggaagctgaagcggcgagtcgtgaaagagcgcgagtgggagcggcgtctcttgttgaagaagcaggcccacgcggcgcagggtgcacccataacacgcgccctattcgtgtatatgtcttcatgtctagttcaactgttttactatctgagaagacttatgcttggtagtgtcacgcccagaaatttccgaatagaatttcaagtaaaatgtgcattaaaatccccgtccaggaccggccggggtacacaaacgacaaagttgacatacagatccatgtcttacaaacattataaaagtcttacataaatgcagcggaaaataaaaagataactggagctaagccttgacttgcaccgcagcgggaacaccactccacaggcatcctcgacggcacggacgaagcctactcggagaagccaccatctgacgcatacttaaactttggggttttggggaaaatagagcaagattgagtactacccactgtactcagcaagtcataccggaataggggtatgatgcagggaattatcaagggatagctataatggttcatttgcataaagcggtcatttataaccagaagttgaaagtagtaaacagttgtaataattaatcaatattaatcatccactgtccaacgctataccacgttgcaacaggcccaaccatccacctatactattcaattccaaaagactagtctagggtgagtctaatcacggtgaatctggttgaccgcccataaccgcgggcacggctattcgaatagttttactccgatcagaggtgtacaactgtaccaacaagacacagccccacgacatgtttccatgcgccgacatgccaccacgacataccggaaagaggccgtgacaggacccttcgcataaccccctctaaccaagcacaccacacttcaggtttcacccccactcctcgcaaggcagcgggcagtcccctctcgtgcctaggcgaatccggaagccgcataggccgtcgcagggcccatccaaactccatcacgcccacccttgcctggatgcgtcggctagaggaaagctacactacaagcccagccgttgcccacgctggcttgtggtaagtacgaggaattcttccagggtttcccgcgaaccggtccttaattgccatgggcgcgaccatcaaaatcatgcacccacagcccaccatttaatatattttaattaagcaacaccagaacggtggcactaatccaatcattaacataaggacctacagtctatacattaatatgatttcccccattgtgtgctagttgaactaatcatggctaagcactccctagtccaatctctagtcatgttatatcccaagctaacaaaggaacatggtacaaaatagcatggctatgacagtaggtaaacattccacagtaatattataaaacaatgcagtatttgaagaaaaacaatagagcatttgcaatataggatcaacatgttcaagtgacaagcatgacttgccttgctctgctgctggaggaatctcgacgactatctcaaagtacaccggagcgtcgggagagccggaatctaagcgacatacaaagcaaataatacaaacaggctataagactactgaaacagagaacaaaaccatttttaatggattctacacatttttcttgatttactgagacttgaatggacttaaacggagctcggatgaattagttatgatttttagaagattctctgtgtttttactagtaaagaaaagtccttaatgaattattgcgcaataaagcatcccagggctgacgtcataggggggcaggcggcgccgacatgcgggccccacgggtcagcggctcgagagagagagggaggggcgccggcacgtgggccctactggcagtggcacaaggcgggagggggtgcggctggcaggcgggccctaccggtcgcggctccaaaaaggggggggtggcgagacgccggccgggcccgacatcaagccggccggcctgccatggcaagggcggcggagcgcgcgcgtcgccagcgacggcaaccggcggcggaagacggcggcgcgaaggcggcggcccgacccggctcggcgctaggagggagaggaaggggaaaagaggaggaggggcgcctcaccatgagttggccggcgcgggggaagacgacggcgaacggcgacggcgacgaccggggaaatgacggtgaacggcggacgggctccgagacaccctaagagagaaaaagagacaggttagagggagagagggagtccatggcgagcgggaaccgtggccgacggcggcagctatggaaaggctcaccggcgcacggcggacggcggcctccgatggcggaattcgacggaggaggggtggacgaggtggagctcggccacgcgaacccgacggcggcgacggcgtggtgcggcggcgaccctagcggcggctagaggcggctggagcaatgaaaaaaagcggcggcgggtgggagcacggtgcgggagcgatggggagcttgggagaggccgacggaaaaaaggaaaatgaggaggaggatgtggggatgaattatataggggcggagaggtcgggaacggccgggagtgggttgatttcgccggagttagtgggggaagttggaggtggggagagagagagaggcgggattcgaatttgaatcccgaccatctcgtgacgtgggcgcgagcgggagtgagggcgtggacgcggggaaggcggggcgtgtgggggtggggcgcggggaaggcggagaaggtgggcggcgcgcgcgtggcgtggctgtcgccggctcggggaggcggccggaggttggggaagggactgacaggtgggccccacctgtcagcgcccgagggagatagggggaggcggcctggacttcgggaggagaaggggaagcggaccggcccgatatgggaaggggcgcgggaggaggaggaaatgggccgacagcccatttggggaaaagaaggggaaaaaaggaaaaaggaaaagaatttccagggattaaatattgcttgtgctcaattttaattggttaaaattatttctagagctctgaaaattccactaaaaatcttgttagcgtatttcgacatgtagaactcaagaaaaattccacatgccaaatccgattattatttgcattaattcattagggttttctcttgcttttacaccgatattttctctggtggattataaattcaatttaggcttgggaaagaacttcagggtgtgacaggtagcttgtgaagttgtatttggataaagtgaagacaattaatgtgtgtatttttctatttcttggtatctccaaaaaaaattatatatggaatagtactacatgtaaaatctcatttacaactagaattgttactataagagaaactcttctttaagagaagctaatgttttttttttttccataagggactttctagaagtacagtttgttaaatgtatacaactacaatggtcgacgttccagttcgcatgcacacccagcagcccagaatgaattgaacccgtggtcggcggcggcgcatcccgccggcaagccaaaggggaaagtttcaccggagcaaacgcaagaccgattcgtcacgggctcgcggctagggcatcctctagggttcatgataccatttcaagcatcctcatggcatggcgcggcgcatctaggtggccaacggcgaattagcggcggaaccaggtgaacacgagtgtggggaaatatggcgagcaacaagacacagcggtaagctagctagctagtagcctttggaaggtgtatgagctagggaaaaaggattgggagactaccgagacgaagggcgcgtagtgaagaaatgccagcagagcggaagtaatcttccgacctcggcgcgaaccaattaaggtcggggtaagggaagacgacctcgccccagtcgccaggaacgcaccggcacctcgggcgagccacgcggtggacgagagcggagtggtggaagcgatcggcgagctctagggatggtgaaggagtggaagctaggagggagaaagagagccctggggcggctttcatagttcatagagctatcggtctggaggagaccgagccagcggtgtgtgccgagcttgttgtaaaagttagtcgatatagtggaacgacgactaaccttcccgatcgtttcagtcgttgatcgcccaagacatgccagatgacgacacaggaacacacgatatttgttaacgaggttcagccgaagcctacatccccggggctctgattatgggcgctcctccccaaccaacatagcacctagccgctacgagtccatggccacgccgccatcctctccctgcgtgtctacgctacattgtagtcgtcatggttacatcgtggtgcccccctctctatttaagagagttgccgggttacagagtccaactctaactccacccctaacacctattacaactccaagtccaactgtaaccaaataggactagtatattcgacacctattctaacaaactccaccttggaaaatatacgtcacctagaagtagtagaatcaccatgccgatccacctgtcctccagacttggattatttccttttgcagcttcaccacgagccgcccgacgagcgtacaccagactcaccgtcttcaagagactccactctccctgtaatttcttcctcttgactccacctgcaacagcgctccgccttctcatctatcatcacggtcgtcttgccaagcgaaattggattccttcctagttgtcccatcatagactccccaaagaccatgttcacctccacattccgtctttgatttgattcaatctaatccatggccagataaccaatgtcatcactaaatagacaaatcaaactcaccaggcatgaagaactgaaccctttcttccttgttgtcttatgaaccaagctaacaaatccaacatccacgcttcttgcatctgtagactgaatccatgatattttgagaaaattcaccgtcgcctcgaatcacttgaagaattaccatgatagccttcgctcttactccttcagtgacgcagatttccatatatcccatcatgccgacccgcatattctggatatatcctgtactgccaaacagtatcgttgaccccatcaacgatatttgacccgatgttgcccgggacttctcgcatagcaaaccacccgtttgccactgccgcaccggtccaaccaatctgctacacggccggtctacctccgtcctgcttctggttcggtccggccaacactctagcatactccttgttcctgagccatacctcgccaccttgctgagcaacctcgtcaccgtgagactatctctacagagttcccaaggagccttctcgccaagtcactattttgcgccgatttctgccaattttgtgccatatcgaatcttcccaagccagcttttaccattgcccaagaaagtcccagtcaaactgaattccaaacaaccgagtctgactctgatggacttatgcaatccgattgcacaacttgactctaatggccacagaaaaagatacaactcagccaccgtgtccgcctagacctctgttgcgttttcctcacgtccaacttcctctcagcaaatagcttgccacaccacgctcatacacaaattatgcacctgcttgcatctagcctcccatgcattagggcctttttctttccgcttaggatttattataatccagcttattagaagtaagctgaaagaaacaggaagattatttttacagcttattataatctagatgatgggttattgtaatctaataagctcaccaaagggagctttttctggattattagatggcaaaagacccactgcccctgattaattctaattatttacctgaattgccaccgcgtaccgcttcgtttctttttttcgttgaccgtgtgaccgcttcgtatcctgcgcgggagtcgcgagatcccctttcccctccactttctcttcttccaccgagaagatcggcaggcgagggggctgtgcgacggcatcggcctaggcgagcagagggcgtccggtgcgcggcagcagcgaactcgggggcatgctgcgtgcggcggcgaggtccatagcccattccgacggagatggatcctgcagatggtgaggactccctctcgaaagcatttcgataccgtgatgatgtggtgaataagcgatcccaatcaggaggcaaccatggcgtctctggcctacatggctccggcagcttctctgatggattttggggcgacggcgtcggcgaagatggacatataggcgatcttcatggctcacccggcgtccacggccaccatgtctcgcctgccccccatggcgccggcagttctggcggatcacccgtcttccatggagccggtgccgggcaccgcgacgccactgtgttccaagcggtggcagatgtgtctccccctggcagaggccgtggacggcgtggcgggcatggtggtggacctggacgtggtaagagatcggccacacaaccttccgcacgtggtggccgaggaaacaaggtgccatacaagccaccaaggccatccagcagtgcaactgttgtcggcgacgccgagggagcagctggtgtagacaatgacttcacagaagaaacaatggacagtgcgcctcatggaatggtacgtctacttcatttctctacttcaaaaattaaggtttaatgcatttatctactgcaaggattaggttgaatctaattgaatttaacgtgtatgtgtactacatatgaaaaattaatgtgtatgtgtctatgctaattggtcatgtatttaccatttctaatatagaaatacttgtgaatatataaacactagtggtgtaaaacaacatgtaaatctgaaccttgatgtgtttgatttatcaaatagaaggaggagcttgataaagcagattggtctagcacacacaataggatattttgtgaactatgcgtacaacaaattgaaga

SEQ ID NO: 52043 - DNA, 3188 bp, Oryza sativa
gaagaaccggtgggatgtgctgaaatccatgtacagcttttggcttggtctccttaacgacacagggcttggatgggatcatgcaaaaggaacagttgctgcacctgttgagtactggaaaaaagtcaccaaggtaataattcatgtctcatgtacatgattttcatgaaaatgttttaagtgcttgcaataattgaagatttgatgttttatttttagggacattctgaatggaagaagctacaacatggaccaccagaatgtttagaattgctggatgaaatgtttggtactattgctgttgatggttcttctgcttgtgcacctggagaaaatgctggaggggatgatgcaagtggtgatgtacaggaccttggcgacacaccagtagattgctcattgggtaaaaaaccagtgaagcgagggtcttccagcaccgccactagtccatacaagaaggttaagaaccccatggttaggataatgaggaatattcaaaccactatggataccaattgtgatattgccaacaaggtgatgcaaggtgaatttaggttcaattccattaaggaggtgatggatttggtggtggattgcggggcagcagaaggaagtgcggagcatttcatggctacaagattatttgtgaaagctgaacatcgtgatatgttcaagactcttaccaccaaggtgggaaggctctcttggttgcagagatggtgcgagaaggaagggcagcagtagaaaattgctaattatttatatgcatgaactagttatctctgtttttactttgtcagacaatatgtattagcaagattgctacttatttattcgcatgaacttatgtactgcctggccatgtaatatggcgccttaattttgattggatgaactactgtttagtgatccatcaacatggtctttctgtgactattgaggtgatatcatttgttgcattgtttgtagatgggcatgtatggaagtgatgatgacgatgaggaggaggatgaaactattattgttgctagcagacaactagatatgatgagaaaatttggaccggtgttgacatcatttggtatgttctacgctgaaaattatttgaacaagtccaagtatagaaaagctaatttagcgggtcatgcttgggttatgagaaaccttgaagttccacaagattgttatgacatgtttagaatgagtaggccactctttgagaggttacataatttgttggtctcatcttatggtctgaagtcaactagtaagatggattcagttgaagctttagaaatgtttttgtggaccattggggctccacaatcatttgttcaagttaagaaccgatttgagaggtcaaaaggaaaaattagtagaaaattcaatgaagtgttgcagagtatctatctcctttcaaaagatcttgtcaaacctagagacccaaacttcacaactattcacccaagactacttgatgatcggtttgagccccatttcaacaattgcataggtgcaatagatgggacacatataccagtagttgtgcccgcatcaaaggtggttcaacatgtgggtagaaataaatatccgacgcaaaatggcttggccatttgtgactttgacatgaggtttgcattaattgttgcggggtggcctggatcggcacatgatatgagggtgttcaatgatgctttgcgcaaatatgccgctatcttccctcatccaccacctggtaacttctcttatccgtttaatagtctcgtcgaactagcatcaattataaaataatgtctcatggtttatgtttatgctaacagggaaattttaccttgttgactcgggctatccaaatcgactaggatatctatctccatataaagggaccaaataccatttaccggaatttcgagagggtccacgtcctagtggcaagaaggaggtgttcaaccacttacattcatcgcttcgtaatgtgattgagcgctcttttggtgttttaaaaatgaaatggagaattctattggacttaccaagttatccaatgctcaagcaaacaaaaataatacatgcttgcatggcgctgcataattttattcgagatagcaaattgagtgatgaagagtttgatctgtgtgataatgatgaaaactacatgccgatgccttcatctcaagggaatgccagtcacatgggagacgaagatggggacgcaaatgccttccgtgatagtattgctgatgctttatttgctaggagataataatttggttttaagtctaatatatatgtggaagaaatattcatgaatgtataattataaatatttgtcaaatttttatttatctacatcaaatttatatctattgtataaagtcaccgaatgatgacaaaggcatccaaaaaaatagttgagggcattctagactttagccatgcaaactcaataatccaggtttccaataatctagagaaagaaacagctcacagcttattttcctctagcttataataatccagcttataataatctgactcaataagttggattataataatcctaagctgaaaaaaacagggccttaatctcagcactgtaacatgcagcttgtgcatatgcctgacgaccaccatgcactagccatcctatattttaatgcatgcagccatgatgattgtatacaaatcgtgccgcatgaaagtgtcttctccgatccatgcgatttgctcgactccgttcaagttgtacgcaaagaacagcatccgtactgttcgtctgtacctccgcacgcaccgcagtcgcagccctcgtgttcaccgtctacgaccccgtcatcatcggccatgcacgtccgccgcgccgcgccacgctcgccggcttcgcccttccatcactagcctccctgccgccgcggatccgcgatcgccgcgtgcgtcgggcgcgccgtccatggcgctacccctccgatctctccgaacgccttcggccacgcccggcctcgtcttccagtcacgctccgccatcgtcggtctgatcgcgagtgaggtcgtcgcctccgcaacgtcctcgttgtcgccatcgatctcatcgccatgactgacgatctcctgtcgatgcacgatcctcacctcgtgtttcctcctccacatgtcttctcgatccaatactgaaaccttctgctcgatgg

SEQ ID NO: 52044 - DNA, 28653 bp, Oryza sativa
gtgtgatgggtgaggaccgcccccaccttttaagtcgtgctcccccaccatcaattaccgatgtgggactaaacccaacaatctcccccgtcacacatcgggcccaataatctcccccgtcacatcaacccatgtgaccccgaagacttcttacctggcctctccaccatgtgacccatggaaattattccgggtttcaaaccttgggctctgataccacatgttataaaatttagtcgatatagcggaacgacgactaaccttcccgatcgcttcagtcgttgatcacccaagacatgccagatgacgacacaggaacacacgatatttgttaacgaggttcagccgaagcctacatccccggggctctgattatggacgctcctccccaaccaacatagcacctagccgctacgagtccatggccacgccgccatcctctcactgcgtgtctacgctacattgtagtcgtcatggttacatcgtggtgcccccctctctatttaagatagttgccgggttacagagtccgactctaactccacccctaacacctattacaactccaagtccaactataaccaaataggactagtatattcgacacctattctaacagagctggcgtggtcaaggtggggcgagcgcgtcagagcggcgacgtcatcggcgtgcctgcctccgcgtctccccgagctagaggacaaggtagaggcaaggaggaaaaaggaaaagcgcgaggcgaaaaagcgaggcctccctctgcttgactgcttctggtggcgcgactggcaaggcggactgaccggcgtcgacgccttggacactagcggcggggccatggtgagacgccggctgtgacggtaaaggcaggcatggtagcttggcgcctggcggcgagcggaggcaaggcggcggccagagcggtgactcgcacgcgagggcgggaaacggcgaggttgcatggctggccgcgctggcgagcgagcgaggttgcctactctcctgcatgtgcgcggcagcacgtgatgagcagccgtggcgagtcgggctcgggcagaccggagcttcggcacgcgagcgtaagggagagggatctgctgggctgtcctgcttagataaagaagggagaaagcggcctgattggagaaataggcatgagagggatttatttggatgaagtttgagggtgatttgatttggatttgaaattggacgttacggagatttgattcaagtttgatatttgaatgtagggactactcaaggaagggaaacacggtgggactcaaatattttggagttgtaagattacttgaaacgaggattggatttgaatagttgaaaggatttactgatagacttaaggagggaggttcaaacaagcaaatttaaactccgagtctatttcgaaacggtaattttgaggagtcaattttggttttgaaggaaaggagataaatagagcactcagaatacgagattttcacggataggtatttcatcagttttgaacgccacgtaaaaaacggggcattacactagctataatctcaaaagaattgtaatttagtaacgtttggtttggctttaaatccactattcacaggatgagaatccagagctgaagctttgtcgtaaaggacagtaatcgtgccctctggtaggcagtgcacctatttgctcgaaaacttccgtaagtttttttttttccttcaaaactattagatttttaaccattggattacctcgagatttgcgcatgaaagaattttttttctagaaataattttttacacatatcacgcgtaagaacatgatgctaactaatcaaaccatacttgaatacaagttttatataagttactatatcgtagttaccatgtaattacagtacagttacaatgtaattgtgtctcaattatatactactattgttatatgtgaaagtttttcattaaaagaattgagacatttttttagatactcccgtaccaaagttactaccactatataaggaaacatgcaatttatcaaaattgtagtaaaaactttatattagactgaaatcgtcttatatccgtgtgcatgggccataactttactcagtttaaactagtttagcggccgtccatgaaatgggcctggatttagcctatataaaataggccgtacatgggccgataattggatctgaacgatactctgaatattaaattctcgcggagatgcgtcccgcccgcccgtgacgcgtacagccgtacacccattcctccacgctgtttgctccccgcgcgccacgaagtagagtactccatctcccaacgattaatgccaagtcaacaagcaacaattctttttgtcgaacaccagcaagcaacaaatcatccagtcagcccgaacacagataatgcagccgtcgcaacgatcccgccggccaccgaggttgagccgccgcaatgccatccggcagtcggcgtacgtggcccggccggcgtcacagctctcgccgccgtcggagtcggaccaacccgccttctggtattcgacggaggaatccgttctggaggaaagggttgtggaagatgaggtcggagatcatgcagaggcaggtggagccgaggcggccgcattggtggtggaggaggcgtcgacttcgagctcgtctgcggtctctgtccacgcggctatggtgatcaggaggagcatcttgaattggagtaagctggatcttatcggggccggatcgtccggcagggtgtacaaagcggtggctgagtaagtccgcttgcgatttaccgtttgccttgctcatgaactgttcgatgcaatgcttcattgtacttcgtgtctggttgtgtgttctattctttcagcagaccggcaatttcggatgagttatctctgtatttctcaatgcttcttcgtattattgccttgtcagggatgggtttgtatttgctgtcaaagaggcttcgttgattggtcccgaaagctatacgaagcaaaccgcatgtcagctaaagcaggtagttttatctcttatcaattaattaggtgaaaaattatcttgtaagtgtttaattaagcaaattgcaatttttgtcaggggtaaaatttcagagtattgatgttctccaattctaaatgattccaagtataagctaattcagtattagtaacaacatttcaggaaatcttgcttcttagtcggttggagcacaagaacatagtgcagtattttggtgccaaaatggtatgccagttctcatatgctagttgaacaagtgtcttcattatgttgctgatcgcctctgcaaactgttgcctcccaaacaccttcattttaggttatttttcttcggtttgagcttactatccctgtttggatttgcttgcagggagaaaccgtgctatgtattttccttgaatttgtgagtgaaggttctttggtatctgtatatgagaagcaacagctggaggaatcaactatatcatctttatacaagacagatcctcaatggattggcttatctgcatcatcataatgtaatgcataggtgataacacattatctccacaaaaaaattcttgctgctggcccggtcatttgaaaatgtacttgttatagtagtgatcaagttaagtacagatgtacaactctcgatcaaatgactaaatgagtgaagtacttctttgtcatattatggtaaatctgcactgtccttcccttttcaatgcagagatattaagtgtgcaaatattttggttgataaaaatggagcagtgaaggttggagattttggactggcaaaggaggttacttcatttttggtttcagtgtccttttttcccctggtttgactgacagattatgaaatgattttgtttgatattgacgatgtgaattctcaacccttttaattgatgtaatgccagataaaagtctggaagcagaaaagatcttgtaccggaagtgtatattggatggctccagaggtaattgtttgacttagtatttatacatagagttttgctcccatccagcaggtaccatcgggactgtccggtaccaaatctcagccatttaatcagcgaaatcggacggtggaaaataagtggtacctccaggtacaaatttgcccatgaggaggtgctaaaaaatttcgagtggtggaagggtaaatttgttttttcgcgtaggagtgtccagggaggcagtggcgagttgcttcgtgcttcgtcggcggcggcgagttgcttcgtcggtgacgacttgcttcgtgggaggaggcggcgtggcggcggctgatccgtttgaggctgcggcgtctgatccgtttgaggcggaggtggcggcgacggcggtggcggcaggtggttcgttgcggcgaggttgtgttgggcgcagtggtggcgggcgcggcagtggcctggtgctgctggtggcgggcgcggcggtggcctggtggtggccacggtcacgaggtagcggcggcggctggtgtgtgggcagccttggctgcgaggtggcgacgggcgcgatggtgccggccgtggtgatgaggtggtcgtcggagccggtgttgtggcggctgcagcgacgagatggtcatggagtcgtcttagcaggcgatgtggcagtgtatacatcgatttcttttcatccgatctaaatcattaggttcggttggttgcagcagtagatactttcattttctgggctgcatatactcttcttcttcattgcttataggatttgtattgtacgatttattggatgttttgatgagctcaaccattacttgttctttgtgaatgttcaaatggccaataccctcccatatcatttactgattactgcaattcgagtaagggcgtgaatgaagccgctggtgaaggagctcgctggttccgccgccgcggatggcagatgcggggcgagcaagcgagcgcacaggcgggggcatggatgcggggtgagcatgcgcgcggctcaggtgggcttcgcacgggtggggctgcgctcggagggaggaaaaaaaaggagattagatgagaaagcagcgccacacggagggaggaaacagagaaagagcgaaaaagagaaagcgagggtgcgactcctttctctgtttcccgatcgtacccttctaacatggacggatggatttatctctgtacctgccggtaccagtacctgccggtacaagttgctggatgggagcaaccctcttagacatattagtatgaagtatctagataaacgttactctgaagaatttattgcacttttactttacgatagtcgtccaactttccggaccagcagaatctatattggttatctgaatatctgatgatgatcaggttgttcgtggcaatccgtatgggtattctgctgatatttggagccttggatgcactgtcttggagatgcttacccaaagaattccttatcctgatgataactgggtcagtaaatcctacagtactcatttagacttcttacagtctcttcaaattcgatactgattcagttctatcaggtatcagtcttctaccaaattggccgtggtcaacttcctccagttccaggctccatatcaccggtgtcacgcgatttcatccacaaatgcttgcaggtgaatcctgatgatcggccttctgcagatgaactgctgaatcatcccttcgtggctgttccagaaccagactagtatgctgcatgtttgcttaacattgctaggcgaagaacattcagtagctccttgtttccttcctgtaagttcagggtcagaaagtcagaatgcttgtggttggaaattcatagtcctatggctaatttcacgagtacttgtttgtacgacatctgttccttataaaaatatcccactatccaactttgcgactttgaccattagttgggagagcaatcaaccaatcatgtattttatggttgagacttacgacgacttgctactccgcgtctgcatgtctgagtctgaagtctgaaccgacggcgctgacgttcccggtgacgaaaccaaacagccacacactctgaatcttacaagcaaagccaattccgcaattcccacgacttggtactcggagatagcggttggtcgtaacgggagcagttagccagttaccgatgacgtcgtctcgatcgacgctcgggtcgctctcggggtacggggagggtagtcggctccacgccgttataaaaggccctcatccgcaacgcgggtctctttccggcgtcgccttgtcactcgctcgccaccacccctcggcgccacggcgagcagcgcaccgggtccaggtcaaaagcgcacgcacccacatcgcacggccgcgtcgccgtcgtcgcgcgtgagccccccgtgcctagtcaaaccccaccacgagcagaatcccccaatcttctcgcgatccgctcgctctgctgctgcgccgcgggagcgcgggggaggaggaggaggaagagggaggggcactggccatggcggcgcgccagcggccgcaggcgcagctcgcgcggatcaacgccatgaggcactcctacaccgccgcgggggacgatggctccggggacgacgtgtgtggggagctcgacgacggcgggggcgagtacgcgtcgcagaccagcttccgcatccgcggggggcgcggggccgcggaggtcaccgccatcttccgcaagctggggctctccgggcccgaggacttcaccatcccgcccgcggtctacgccgccgccatgtcccacctctccagctccgcccgccgccgcgcgtcgctcgaggtggcttccccgccggagcttctagaagcttctccagccgaagccgcggttccgatgaatcgggaagcagtcgagaagggggaggaagctggtccggcccccaaattggttcaatcagaggttacagaagtttccacacgagcttatgcaaatgcaacgcctgcagcagaatcgagcatcagagtagtagctccatcggccaccaaatttgttcaagcagaagctatagaagtttccacacgatcatatgcaaggcctgcagcgagcgtcagatcagtagcttctaaacgagctctgctgaagcaggatagtgcagacgaggacaaggagaaaggtaaattggtcagattggataaatcacgagaggaaattagaggagaggtggttgtggaggcgacaagggagaccaccggtgcctcggctctggtcgtggaggcgacaagggagtccacttcacgtgacatcgagcatttgatttcaccctctcctcacaggcggtttaggagaaccatcacgtcctggcttaagggagagcatctcgggagtggatcgttcgggtcagtgtatgaggctatcagtgagtaagtatcgatctgcctactctgtcttgacgattgcataattcgttttcattatgtttgttgttaatatgtttgcatttgctactgttttatgagaggaatacaacgaagaaagaatatcaatggttttggactatgcagagaaatcagaatatgtcatctgtctagttcacttaattgttggtatatcagaatgagtattagcttcatgtgtccaccgaactgagatttcacaaattggctgcatccatttcaacttgttgggctatttattttatgccgggttgaatgaaatacttgaacatactgatgcaacatattatctgaatcatgcggctagctaaatttcttactcagtgcttttacacttcatttggcaaatttaattatttaggtgaacccttgtgtagttcttttgtagcactgcgtggattccatctaaaccactcttggaaaatataacttctgtcaacagttactatatagccgtgcctcgttttgttaataaaaagcttcataatcgacttttaacatttattttacagtgatggttttttcttcgctgtcaaggaggtgtcattgattgatcaagggatcaatgcaaaacaacgcattgtccaacttgagcatgtgagttaccctgtttcaaacattatgtttgttattgaactatttaatatccaagcaacaattgttttgtttcaatccactgagaatactggtgaatcatttggttccaggagatctctctgttgagtcgtttggagcatgaaaacattgttcagtattttggaacagacaaggtaatcctcctttcttatagatgttaattccattaagattacagttgtgaatgtattcttttcgtttgattttaatattatgttgcttttactctgctagttatcttcatgtaaacaacagttgtctgacttgagttgctgatttcgacgtttacgtttactttgttggataaacattttacaggaagatggaaaactgtatattttccttgaactagtaactcaaggctctttggcagctctatatcaaaaataccgtttacaggactcacaagtctcagcgtacacaaggcagattttgataggtttgaactatctacaccagcggaacgtgttacacaggtgcattactataatgctctatcaatgtgatagtgtactctagcttagatgtttttattgtttaggatttgctcaactgtattcttgctggcctattgataccccgttctttcctatgttaccagagatattaaatgtgcaaatatcctagtggattcaaatggattagttaaactggcagattttgggcttgcaaaagaggtatttgctctatcaaatatctgatgtaatcaatttgtcactagactacatgttgccctcactctttctaatttggcatgtcccagatgtcaattttgagtcaggcaagatctagcaagggaactgtttactggatggcccctgaggttagtctcacagttatgctttggtcctttttgtacaacccatttaccttacgctcctattcagaagagtgtaggtgctttaccattttatgttttaagcatatttctatgcctgatctattatgttcatattgttcacctctttatacttgtaagatgttgcatggacacataattgtatctctgtggtcaaaaagtcacggtcttgcaagttcaagcaatattttgcataaagtggtatgtgtctccatattgtaccgagcgtgtaaattttctgatagcatgttctcattcaggttgctaaggctaagcctcatggacctccagcagatatatggagtcttggctgcacagttttagaaatgctgactggcaaagttccataccctgatatggaatgggtgagtatatctcttgtcttactttccagtaacagcatcccatttttaaataccaaatgcactgatatacgcgggctgcacgctatttaattaaaggagcaaaaacattgatgacaacttcttcatgttgatgacttgtttgcttacatcagtacgtatgaagtatatctttttgggaaaatcaaacattagtttcatcaggaaaatttgggtagtattggatttaaaaatgtcagtaggaaaattaaacatttctattcagaactgcaaacagcaaatccactgtatgttgctgtgttaattttcttattatccgggaatttgtattattactgtccgtgatgcagtcttttcttctgctatgtagacgcatgctttgcttaaaattggtagaggaataccaccagaaattccagctacactgtcagaagatgctcgtgatttcataattaagtgtgtaaaagtaaatccaaatgatcggccatctgctgctcagctgttggaccatccatttgtccagagatcactgcaacataaaggcgcctaatcactcttgtgttgctaacaaacttgcttgtacataagctggtcagtattccattctttctcatacaaaaatttcaagaaatagggcgctatgactatgatcctgtattgcaaacattaatggatttctctctgttgcatttcatagattttaattttacctgtggaaacaggaaagctgttgatgctgaggatgatcccaaatcccttgccatgatacagcggtagtttgtaggaagtcgagcttacagcatgtgcaagctatattcaactgaagatacctttcaggctgctggatcatgtgaacagaagataccttgtcaggtgtttactccgtgccttcacaaccatcagggtgaacagttggttgtccaaagtttttagtgctgattgtcagggattatgagttccagtgcgaaccatcgaactacgtttcatgacttggataaaaactgggaaaggttcaaaaggaggattagtggtatctcgcctagtggcctatggaagcagccaagcaggggacgtagaaagctcagtgctcacggcacagttaacttttctgaccgcgtttctgtacagcgtttttgtacctgtaaagtggcttccttgtgtatgtcattgactgttgacgagaaaatccaatttgttttatagccataccgtgaaattgtccagaaaaatcagtgtgttttgcgataattcaattcatgttggacttcactcctgtgactacacagatgagggggaatcatagtggcaggacagctaaatgtactgaactactgatatacaacagttctctaatctaacgtcggctatcttttgacttcagaatatcagtcttctgcattctccagtctccagggtctgaattcatcccccatccaagcaatcgattacatggtcataatcatgccctgccatctcatgcatgagcaacccaagcatctgagatatctcctccgcctgtggatgcgaccgatcgccggagacgaactcgtgcacgtcgccgtcgatctccacggcgctgtagcccggcctcttcctcagcccccgcgccttcatcaggctccggaccttcccggcgccgtcccacttgccgacggcggcgtagatgttcgacagcagcacgtagttggcgtcgccgccggggtccagctcgagcaggtgctgcatcagctgctcggccatgccgacgtccccgtgcatccggcagccggcgaggagggcgccgagcaccacctcgtttggccgcatcggcatggtggtcaccacccgcatcgcctcctcgagctgccccgaccggccgagcaggtcgaccacgcagccgtagtgctccatccgcgccgcgatgccgtactccgccctcatcaggtcgtagtatcttagcccctcgtcggtgaggccgccgtggctgcacgccgtgagcacgccggtgaacgtcacggcgtccggcttgaacccctccctccgcatcgcctcgaagtgctcgacggcgtccgcgcaccggccgttggcggcgaacccaacgatcatcgagttccaggagaccaccgtccgcttcctcattccgctgaacacctgccgcgcgagctccacctgcccgcaccgcgcgtacatgtcgatgagcgagttggctatcctgacgttgcgctccagcccctgccggaccacgagccggtgcacccacatcccgagccccagcgcgccgacctcggcgcacgcggagatgacggctatcagcgtgacgtagtccggctcgacaccgtccagaagcatggcgcggaagcagtcgatggcctcgtcgtggcgcccgttcttgacgcacccgtcgatgagagccgtccaggagaccttatccggcgccggcattccgtcgaacacctcgaacgcggcggcgacgaggccgttccgcatgaggccggagatcaccgtgttgtaggtgacggcggacctcacgggcatggcgtcgaacagctggagggcgaggtggggcaagcgggacgcgaagtagaagcgcacgaggcaggtggagaggaggaggtgggaggggaagagcttgagcacgcgggcgtggacggagagcgcgaggcggcgggcgagcggggaggacggggagtcggcgcaggcggagaggacggtgagaagggtgacgtcgttggggacgggcgccgcgggggaggagagcatggcggagagcgcagcggccgccgcggggaggtcgccctgcttcgccgggcgcgcgatggcggacgtccatgaggcgacgtctcgcggcggccggcggcgaggtttaggggttgggttctgaggaggttggggaagggcaagggaaggaggggctacgacggccatgaggtaaggtctatggctgagggctgaggcatttccccgcgggcacgttggcacggagcctttgctctcccctggtttcttcaggttttcttcagaattcatccccttttatcctggtttcattagcatcccaatgatatgttggcgatacaattcacaacatatatagatcctgttcatttctccaacaagagttggataaagataaagattttcatggcacggtttttaaactgataaacagtatgtgtcatgcgaaaactttctatatgaaagttgctctgaaatatcatattgatctatttttcaagtttgtaataattaaaacttaaccaatcatacgttagtatcacctcgttttacgtaaaaaaacttaaatcttcatctacacctttatcttctaactatgcctgaataaacacaacagtctggttttcagttgaagactataaggtacgacgtgcatatggagccacaaaatgaaaatatgcagaaaagagaaagcaacatactgccaatacgagggggcaagccatatgcatcaaaaccacaaaaggaggcaaatcaaagtctaaatgatatttttgaacttccttaacgaaaagaaattacatacagcacaagaagcatcttgcactagataattgcgcacagctgaacataattctgcagtccagttcttcagtaaatctagtgaaagtcagatacagaagaaagttgcttaagggaggtgtatggctggagggcagattcattggaccatcggatcagggttcccagctgcaagtatgtccagcaacgagttctggggctccagctcttcatgccacagttgtagtttgtctccagggtgaaatttcctcgaaacaccatctgcgtttatctgcaagattatcatatccataagttcaagaatcattggtctttcagaaaagtaatagcattttaagcaaagataacaagacatgcctcaacttaaaatttactttgccacatgctacacattttcagaaaaaggaagagctacaagaaaatgcaatcaaagcaaatagatgcccaacaaggacataagaaaatttgttactaatgcttccaatcatccaatgtcttgtctacaataccctaacacattttagtaaaagagtaaaacaggtctgaatgaagtataagggatatatcacactgaaatattatccatttttggcaagaaaaccagtccatggaagttaaaaaaggccaactttttcattttaagtttcatctgatactatattctatggccatcacagcaaacagcatgacaaatatagcatagaaatttacatgtttgtatgaagtcaactaaagcaatcagttccggtatctgatgtttcaaaatatctacaacaagggaacagacaatgacaataaggacgaaaaaagggagcacttacagtgacggtacgaacaacccctccactagcaccatcacgggctatagcaagggaaactaccttaaccacaaacttctgtaaagatgaagaggaaaattaagtaataagagatgtgatgcagccagcaatattatacagggaacactgaagtgatggaaaatgatctttgcactctatgaatctggacatataaataatttgtgatattttcattaaatcatggcaaaaatgctgacaaactatctcttattactcatggattacgactgtttgatatttagatgatgtacctcagcttcttcctgggacatgccctccttccattcgtggtcaagcaatccatagaggtaactagagcctgaacctgcaaaactcagaaatagcatctggtgtcaggcaaacagcaaacaggggcttgggaaaattttatagtcaatgattataacagggcagggttgcacaggacagtgttggtaaacaaaaaagaatgaggcaagctaattcaagacatcaacaaataaagaaagaaatgaatcttgctaactgcaaaagattgcttctgctttgcttgaaaaaattaaactgctcaggtaagtttgaaaaaaaatatctcataactaattggcttatactattgaactgacaaattattcttgtacgatatgtagatatgttatatatagacacaaatgttggtgggaaatatgtttcccattagattactctgagcccaatgaagagacatttgccataatatatatacctccgattgcaaatggttgcctcagaattgttccaccaagggggactgagaaaatttggcctccctcatatttatcccatccaccaacaatcatgccagcttgcaacatgttctgaaaaataaaaaaaatggtaaaaaaaaaaccattgcgacaataaaacaacaacttaaaatcgtgtatcagagaaaccattgcgacaataaaacaataacttaaaaaatcgtgtatcagagaaagaatttcatctcatgtagtcatggagttattggatcgcagaatgctatagaaaatataccttgttctgataagccaacaacctaattaagttggctgcaactttcacggtagctggctgcccaagctgaattctgaaaatggagggaaaatttagcatgaactgtcttgcacatcaaatgtttccagtaactagtagaacaatatatatgaagagttcattcaacttcttcctattcgcttcaaggggacaacttacgtgtgttggtggagaaaatagcgtacataatcggaaattacttgtgtatcagcagcctgtgagacagagagaaacaaatatttacatgtgaatactactggactcttggaaatgccttagctgataataattagaagccgactactaacaactacagaataaatgaatcaaagtaaaatattgacaatgagagtgtaacttatgagagggcaatgaatgactgggaaaaccgatcaagatgacatgacacagtataacaaaagaacatatataacttgatgaataggaagctcgtgatttcccaatatcttatggccacagtacaatgagacaacatgaaaaaggagtaaagtccctaatatagatacttacagatccagagcggcagatgtacacattgtcagttagctgagtaatcttgtccgacgcacggtttgccacatacattcctaagaattaataccagacaacaaagggtatattaaaggaaagtaacaaaaaccaacatagtacgtcaacataacatcgatttcagttggttcagaacatgcacatctaagataacaagtcagaacatcaaaatcatctaagaaagcttgttaatcatgtagacacgagacccaatgttctaaatttccaaaacagcaacatcacgctaaacaccaatcgtgtacacttttctgctcttcactcttcagggccaaacgagaactatatggacagaaaaatacaactggaacaattggtgttgtttctagtttcctctaatgctacagtcacgattttttcacatatctgccatacaagttttagcacgcattctactcgtcacatacagatttaagcaggataaattagtggtaagaagcaattttccatcaacactacattacgtgatccactgtggacgctatatatatattacaactaataatctcataagtcacaaacctaaaacagtaaaacttgaatcaggatcgcagaggctaacaatcactactcctattccccccatcccccgcgattttgcatcaaaattgggcccgcgacgccaccggctccacgttaaaccccaaccacatcaatggaagagatctcccgcatcgggaggtgtcgaggcataccggtgctggttctggaatcggcggcgaggacgacgccgccgtcgtagcagacgccgacgatggtggtccccatccggtgctccccggaggtgggattgtctcccgctgcggcggagggggcgcccatgagagaggcgtccatggctggccgggggcgggggcgagatcggcggtggcggaaaaccctagcttagctgcgcggcggcgagatgcgagtcgaggcgctcctttcagtcgcgcgagcgagaagagaccagacggcgagagagctgtgtatgttacggttttgggctctggtctggcctcccccgcaagaaagaacacgaaacggagacgagacgaggacgtgactgggtcggagttgtcgcgtgctggtgcggttcgacccgatggcaccacgagccggtgcaaccacataccgacttcccgagcccgaccgaggtcgggtcggagatgacgtcagcttgacgtagtccgcatcgacgatatcccacagcataactcagattcaacactacttacttccaaaaaaaataatttacatagtatatgatgtaacatatactacgaatcttaacaacttgtattccctccattctaaaatataagaacttatttgatatgtagggaaaaacaacaattttagaggattttaatcatataagaatatttcatatggatgcctttgaaataaaggattgaattcctatcattttaaaattcctatgaaatggacaatcctatatagattttgaaggaaacttgaaaagagctctaatctattgaagattttcccttgagcctatccctctcatctgactcatatgttttcatgcattttgcaatcctttattttgtagttgaattcatttttgttttttccatgcctgcgatccaaagagtccctaaaggattttgatcgaatgggacacatctaacactataaatttggttagaacatcctagttctactaattttgatagaacatcttagcactacgaaattggacaaagctattcataataatatgatgtgtcccatctaactaaaatcacttatattttgggatatagaaagtatattacatctcatattatgttaacttattttgggatgaagggagcagagaaaaaaaaagttgcaatgtactctacaaaaacagcattggaggaaactgcaagcactaaacagatatcacaaccaccttactgtaaacaactgaggaggaaagcaatacacagaaatcaaatgcattgattaaaatcgatatacatatttcaccggttgatccatacagcaaaactggaaaaaataactcttcaatttagtatttacaaaccaagactctgtacatcacctgctgaatgttttacagccatttacatgtacatacatcagacgacccatactgtacattggcaagaaaatacgaaattaataaatcgaacatgttggcattacaatttacaactttacatagaccgatcaactatgcctgaataagtacaccaatctggttgtcagttgaagtcttgaagccgcagagaaaactcaaatatgcagaaaagaataactaacatacccccaatatgaaggacaagccccatatgcatcagagccacaaaaaagaggcaattaaagtataaacgatattctttttgaacttccttgatgaaaagaaattacatatcggaaatgaagcatcttgcacttgataatggtgcgcaaatgaacacaaccaaaaacctgcttggctgcttcatctgacgtttcaacaatcaagttctgctcatgccaacaacctacaaagctgagcaacctaagaaaaacacagcccttcttacaacagtcaaatctgatccatatctgacaacaacgttggaagtgttattgtccaacctgaaaacatatcaaggcttttctgtcgtgctggtagacagatccaatctctcaaacctcagtattaattctaatgaatttggacttcatatattctaccacaagctcattccagtctgacagggaagcaaatggcagcaaaccagccaagcatgggagaataaccgacaggacagtataaaatgtgtatcggcaaacccgatatggtaaatcagacgccttcgttctgtcagtcactgaaataggaccataaagcatgcggtataaaagagatggcctgctgttcccaaataaatggatgaagcagagaatctcccagaaaaagagccagacatttccatccccgcctagtgtgtcaacgcagaaccttccgacagaaccacagagaactcccaataacataacattgaacgttattggcatgtttggtccagtcattgcagaacgctggaatatcaaccaagcaatcaagagaatcattaacatgccaaatgacatccttgttgctgctattaaatgacacctgaaaaacagcaaacccgaattgaaagctgatactgaatttggcatccaccaagatttaggttcctgccaaaaaaaaagtgggttaaagagattagttcatagcacaaatatttactagcagttagtagcgaaaaatgatgggacatacccttgaagccgctgcacaagctgcagtaacagcagttatccgcttgtacgaataaatataggttccataaccaaaacagacagacataaataccactgcggtaaggagcaaatctataagcctcctgaggagttcagcatgtcttgtgtcctccatttgcgtcctaaatttttcctctctgaaagaagctttctgaaatcccatagaaattttgatcttctctagcatgtgtgagtatgagctgagagctatctgagattgcttcaattgcaatttcctcatgtttagtcctatttcaagttccttgagctcatttgaacgagtctgctcattcagagatctctcaaatacattaagaatgtgcctatcaaattctggactagctttattatgaggtagtttaaccaactgctgatcggtgcccgcatgaagaatgatttgattatccattgaacttaacgatgtactctcctggatatcatgtaccggcctttttgaatcagcaccactcaatttgatttcagcagcagaagtaccatcttcgtgagaaaaccgagagttatcttgctcatagacaggtgtctcattaattaaatgaagtgtcctcaatgtacttccaaatgatttctcaaagtttttcgtgaagttgtcgaatctatcaccatatatctgcagaataacgtaagtcagatatgtaaaaaaacctgtctaagtgtaatcacagacaaggaaatgaaccattcatacatttgtcaaggactctttcactgctgacgtgcacatctgcatcaagattcagagttagcatacctgaagttctgttatagtccatggccatcatttgtagaaaggctaattacatgaactgtgtacctttgaaaggaaatcaggttgtaatcttccttcagagcaactgcttctattaaggacctgaaacaggataaggtcagttcttgttaattacgagtaagaaaaggttaaaccatacaagctgaatccatgcttcagaaccacagttctctactggagagcccaagaaattcatttgattcatttttgtaaataaacaacttcattttaatttggcttggatgtatttcatcatcctaatggcgagacgatcatccagagaacagaaggattacatatctgagcctacgcttcaaaacacacgcttctgttcattagtgccgtcccatgtaaatttgcttaattcaatttggttatataaacgactttagttgaatttagatgcaatgtgaaaagacgcccaaaatgagttccggagcaaaagaatatctctacttctccatcctaaattcataatccaatgaccgtcccagcaaggcaagaattgggtgaaccacatgaggagggtaaaaaccgaacctttccgccgcgactaaacaagaaaccagtcaagaatcgaagcgaacgcgcacctgggcaagaaccgccgcgaaggacatcccgagaggcagcgcgaggtcctgcgcgccgtcggcggcgcccctcccatcccctccagtcgcaagcagcggtctccggagcctctgccgccgccgccgcaggcgcacccccttctgcagccgggacgcggagccgtacgacgacgccgacgaggacgccccgccggactccggcgagccaccgccgtcgcagcaggccccgtccataataagggagcgtggcggcgaggcagaggcggtagggtttagttgccgcgccgcaatttcttcgcctcgaccggtgcgcgacccgctctccggtgggcttctcataacgggggagagagagagtctaggaaaggcaagtcaaaatgggaacgcgacgcggaacggcttcggggtcgcgtcgcgtcacggtgcggtttacgttagccgttaagcaaactcggaaattctgagcaaactttgtgccgttttgtgcgtgtatattaggcttttggcctggtttccattaaggaaaaatgttgtaaggaaggaaagcagtgttaaattattataggaatattatttaaactactggtgttgtagtatccacgaagtttaccgtgtcatttgaaatttctaagaaggtttcacaaactttttccgaaatatttgcccgtcaaaaaacatgcactgaaagatcaaaaaactttcttcaagttttcgagagaagttggtcagtagctttgggccctgcactgccactcggtctttgcaggccggtgcacatcaagattgggctggatactccgctatcaacgggttccgcacccacaaggcccgttacgctgctgattttgcttgcgcgcgaaccggattcgatggcacgaaatctcgttcaatcctcccttgattaacctgacgattaccttaacatatctgccacttatttataaccacctcatcccataatcccatcctcatccaagagaagatagatatccatcaatcaaataaccatggatgatgcggcgggtagaccaccgcgcccggcggcgaggtgcccacaggctggccggcggccgacctgccgccgatcaccaaccgcgacggcctcattgtatcccgatccagctgaagcggcggcggacgtggctgatgattgctcggtctcccgccgcacatcatggccgacgaggaggccatcgaggatgtcgatcatgaagacgttcgccgggctggtccgcatcatatcgaccggtggctcgacctgacggatgggaagacgacgcacgcggctcgtctgcgaggtggacgtacgtcgtcgccgaaccatgcgaggtgccgcgcgtcctcgcgctccacctcgtgcccaagtggctcgtcaccgtcgtgctgcggagacgcgacgacgacgcctccgatgacggctgtgacggcgagtcggctaaggccttgttcggcacgcatgtttccaatccaggccaggaattgatcaaggccaggtttcagtggatccgggtggattcactggaaccacctgtggattgaatccattccttttttcaatccacctcttcaaaaatctgtgttcggtttgacctggaatggaatgaagccattcaagctgccgtggattgtcgatcgatcagatccagtgattcagaactcaaaacattcagttaatgtcatcactcattagaattcagaatcatgcacatttctaatttctaacagtaatagtatattgcaggagttaattaaccaaaattcccaaatagaaagacagggaacaccctgaatagcatcaggacaattcttcaccatattcagttgctgtcatcattcatcagaattcagaacatcatgcatatttctatctagttaagcatgaacagtaatatatttcaggattaagcacattcttttcaggactatatcactaatcaatctggcttcgccttcctccggtccctctggtagcaatccatcggcatttgggaatatcaattgattatccgctgcagccatagcaaagaaatcttgcggttaagacttagacagtgtgatatagaagcagtacaactcttgcaagtaaaaacagagcaagtaaaaatacaatagagctgttgaacttcacacttattatccattttacaagtttgtttgcatgcattcaaacaaacttgggggatctgcatttgtgttatcatcataaaagggctatcctatgtggacacaacatttgatatcttcagattcgaaaaaaccaaacttgtcggcttatataataagtagatatgtgaagtctaatacaacataatatcaagtaaattcaaaagaaaatttggtaatgaacagagaatttccatttattcacatgtttgagttttttaattagcctaaactacccagagcttagaaagaaaatggtcctattccaggacttagatgtaattgaaaaatatgagcctatttgttgttgtcatttattacagactacataagaggcaatttagctgaaaaaaatgttaagatactgcactgtagttgccagaatgaggcagccaaaaaagaggcaacaaaatcatcttcctactgcagttcaatttatatttcagcatcgatgcgcaaagctttcttctccaaataaagcagaaaaatatgcttgttaatgatgtttgctgataacaggggctggtttgttaatggatcactagcaggattgcagtttccaccaccctcaacaatagttgtcagtaatgccaggccttcatgtctgttgaaaacgcctgaagcttcctgcaaattctggttatgaggtgcaaattgtcatgcatgatgatcctcagagaaagaggatggccccatcggaacaaggacaatctacaatgatatatgcagagaaagggagaagggaccaaagcatctgatggaaaatggctaagatttaatgaatcataaacagaaagatggaaatagaaaaggtttataattagcatagtagtttgttgaggcagccagtgctggctaaaattaagtatccaagctaaaaagcagctaatccatgaggacatgtggttatcaaaatctgaataatgaacagaaatgccatcaagaactgacaaaaactggttatcaaaggatcttttcttatgcaacactgaatttaataacaatcttgacttagcctggcttgggtgagtacaaaaacagagatggagcaccagtccagttacagtgacatgtttttttttcagcataatttcctggttcattcgagaagaagacaaactgaaagggaagctggttgacagatccatggctatgcaacacatcgatccttcagccaagatctagggcaagaaacagaaccaagaacctagggctcttccaccaagaatcccccgcaacactgcaagaacctaaaccacagaccaaatctccaagaacccatcacgattcccccatccccaccccctacgcggatcggaatccccaacaaacaccagcccttggaaagccctcatttgggcggaagaagagcagcagcagcacaagaaccctagcaagcaaaaaccaaggaggcggcggtggcgtgctacagcggcaggggaggaggcggtggccaagaaccctagcaagcaacaaccctagcgccggggagagaaaggaacaaggaagacgacggtgatgcgttactggcgagaaggcggcggagagcgtggacgtcggatgggaagcgggtcgtcgtcgccgtcgcctctcgcgtcgccagccgcatgccgtcgcctcttcgcttctcctctcgcgtcgcctcgcgtccggattggaaccggagggtcagaggtggggaatggatccgggccaggaacagggggaggcaggccaaaccgggcccgtttccaatccgggccggccgaaacgaacgacgcttccgggccagaccagatttggaaacgggccgcttcgttccggccggaactgaggccgttccgggccgttcctggcgctgccgaacgaggcctaagatggagatgctgccgtggttggatcgtctggccgtccaatgcagccacgattttttttatggcggtgagaataaaaccatccgttgttcttggtgattatggaaattaaccggaacaggttctgataactctccgcgaggagagcgccgcggcgtcggtagcgggcggcacggcgagttcccgtggcgatcgacgaaatgggccggaacggtaatgcggcctacgtgcggaaatattggtcggaactggattcccacgtcgcgaatgttgggctgatatcgcgctatggacagaccacaaactaccagcccagtaacgacgatctgggcctgagccagattcccgtgaactgtgccgatatgttgggccggcctcagcaattgtgggctgaccaatttgtgggttccagctccacatgtcctggagctgaaccaaccaaacatttgtagctctagctaaaacaagagcggagctcgcgaagctcggtggagcatttttataaaatgaactagagaggcaaagttaggtttagactactcaacaattacactccagattcaactcctggatccattgtaactggcttttttttcaaaatcaaaaatcagaccaagcgaaaaattaagagacctaaagtgaacttattccacccagatggtgctctggaatgggataccgacgccgcgtcgccttcagttgtccacggtctagctattttttttttcaaaatcgaaaatcagaccaagcgaaaaattaagagacctaaagtgaacttattccacctagatggtggtctggaatgggataccgacgccgcgtcgccttcggttgtccacggtctagctactacaaaatcaaggccaaaatgcagtcttctgcttctttttttagaagggtattttttacccggcctctatatccaaccgaatatatgcatccattgaaatagggaatttagttctgcaaacaataaattcgctccatagaaaatttgaactcagaaccttggggtactactcaggtcactgtagccactaggctatatgcaatcttctgcttaattattattgtcaaaatcaagggtcattttccgcttagataatccgcacgacttcaatgttcgatcgtatcagcatggaatttgtttcaccattcaccaaatatgaaatcagccctaggcctatatatctagggcactattacttcactttatagagccttgatgcttgtcgcttcagccacagcggacagcgtccgtccgtgcgtgcgtgcgtgcacggtctccgtgacgccgaaacaactggccaacaacaacgatctgtgggtgcagtttactgtagtgccaaacttctctctcttcgtgtcctaggatttgtttggatgagcttaagttttgagaagttgtccttggtagttaacttatgagattcttgagaagctgaatttctcggtttctgacttttatttattttattttggaatctgaataaaaagctaaactatttataaaagttttaattcttggagctcgatcatacatcccctccgtcccaaaaaaaaactcaacctaatataatgaatatagacatactagattatgtcacatttcaatcctagattgttttttttcagatttattgtactagattatattagtattatattatagttctatgttaagtttctttggaatagagggagtatgtcacagctgtcacctatcccagagcccgaaatgtttgacatattccctcgtctggtgctttctggtaggctatcacatgatcatctctaccagtcagttcttgccgctcgacctgattggtcacctaagccattaggtccacgacgatctctcaccttgcacacgccatggctactgtggtaacagtgttataaatggagtgcacgcaataggtgaaactaccctatgggtagctgctgctagtagctttgagagcgtgcaacttgtcacgtccagctagagcgagtcactgactcgtgggcccggacaccgtgcgtttattagatggcgaattgtttaattagaggctaatttggcctcgacctgggacggggttgataggctaaacaagggtcaaaccgacccctatcccgactcgtacttggcccaaattaaacctgtgtgcatcgatcggaccgagccggtttaccccagcacgaatcgtgatgtatcgctgatcacttggtgactcggaaaccgagagccctaggtagctactaatccatttgcacaaatttaaatactacctccgtctcaaaataagtgcagccatggatatccgtgcccaacgtttgaccgtccgtcttatttgaaaaatttgcgaaaaatttaaaaaaatttagtcacacataaagtagtatttatgttttatcatctaatagcaataaaaatactaataataaaaaaatttcaaataaaacgaacattcaacctcaaacgttaaacgtgaatagtacaaaactgcacttgggacggggggtataacgtaccgaattgaacccgatccaaatctgcactcaaacccatggcataactaaccacaacgtcgtcataaatggatcacaagggagcaaaaaccacttgtgaataaatttttactaatcccagaaaggtaaactctaatgatctgcaacatggccaatcagatcgtttcaaatatcatggccaatcaggggccgtacacgttcatgcgaaggatcgatgcagcttgcagagtagctagcagtagaacttctggtagatttgcacgtgattggtcgttccgatccattttgctttgggctacgacgactatgagcagagttcaagttgaaccttgttttgtttacatgcaacggttgccgtgctaattaagcagtttattaccaagggagttagttactactggtcttgtactattggagtacaatattttgttgaaggcatgtgggaagagaattaattttattcgggaagtgaatattaaactcttaagaacatatcctcatgttgtctatataccatctaaatatttatgaaaaaaattaaaaagataaattaatatgtgatatattactccgtaaatatacaagctataattcaactctcacaagttacaacaaaaataactaatcaaactaatgtatattcacaattaaatttgtattttttaacttataaaagttgaatctatcattgcacatgtttgtggagtaatctatcacatattaatccatcttattgatcttctaaaaatatttcataactatttaaatgaaattctaacaacgagatgacgtccctcgagatagtttagaattatcttttatctattcgcgatcgaactcactgataatagggagcaaattctcttacgtgtaagatcgaatcacaagaactaagccaaccagagggggggtgaatggttgatataccccaaaacccaaacttttagcgcaaataaaagttaccctcaaattcgatgtaaaccggtctgaccgaggttgatccgccggtctgaccgagctcgtgccaccggtctgaccggtgttgatccgccggtccaaccgcctgaagattgcctgccgcgtgtgaagtcgccgccggtctgaccgccgcctgccaccggtctgaccgccggtatgtcgttggttagaccgccgaaacccgatgaaacacaaatcgaagaactctcaaaatagatgacaactttattacttctctctgtgtttacaaagtgcaccaacatcactccttacaaaaatcttgactaaactcgaaaccctaactaaactagcaactcaatagctctcaaaagcgataccgggaagcctcacgctccccctctatttatacatgatgtaggcagcctaaagccacgaaccaaactcatactaagagtcctaaacaccttaggaaaccctctagtacaagacacaaactttacataaccaactgtaccaaatttggactccttccaaattcgacttcgcatcccatacgcacactatacctccatcgtatgccatatggaatcttcaccaaccacgtgcatcaactctagccttagtatcccgcatgatatctgaccaccacggacatcgtcttaccatcaagccgactcccagtccatcaccgcaaatactcttccgaggcatcgagtcacctacacacgaaataaacaaagaaaccatattccgataccaagctatccccaacttgactcattgttagcaaacaacagtattacatacgtatagtatccatctagaagccataaccatgaaacaatcacggatatccaaagaaacaacccaaaaccgaaaccgacacaacatcggccggtcagaccgcgggccggccggtctgaccgctcgatcaccaccggtctgaccggcatacaccacccggtcggaccggtaagataaaataacagtgaatctgatcatcacctgaaaattgattatctccaaaaccacttcgacgataatctccaaatatcaaaaccaataatcacagatacctattgttcatcacagaataagaatcaaaacacactttgatcttacaatctcccccttgatgaacacattggcaaacctcataaaaaaatgtt

SEQ ID NO: 52045 - DNA, 22439 bp, Oryza sativa
tgaacccatctataacagaacaagcatgctttaaagtataaccatgaaccaaagattttacaattaagcttgaatcaacaatcaaaattcatgatttcatatgatttataatgcaacatttttacaagcacataggttgaagaataaacactaaacacatatacctattgcatttatcactctttctcaaataacctttagcacaaaacaaccaagagaatttttaactttttctttttcttgagcatttttgctcatatttttctctttttattccgggtacgtccctgtcatcaagactgtttctagggattcggcacccattattttgctcacatcgaatacgtccttgtcgtcaagactgtttccaaggattcggtatttatttttttctcatatttttattctgtttttcacaatgagcaattaaagctatttgaggaataacaagtcaataaagcatatatataaagcatttataaatcaaaccatatgctagcatcaacattgcatatttgcttaattcaagtatagaatttaagtgtcatgcattatctcccttgaaagcaaaatctaaatcacatgaaaagactagaatacatacaagctttgctagagacaaataaaccttcaaagtattgctagcatgcacaagaaaataccatatgtataaaacaaagttctcttttctcaattttttcattgtcatattattgcttgataaaaccatgaggtacaaactccccctcaaaacatgccaaaaggattcacgaataagcactaactccccctcaaaataacctccaattctccccaaacaaaaatcaagaagaaatcaaagattttgaaaaagacatccaattgccaatgatatcaccaagattatcatgaattgacatgtatacacttgtattaacaaaaactactacctcaaacacaagcatatgaaaagctaataattaagaaagtagaacaaaaaatatgtcaatccaaaattaaattgatgttaccttgtgaagcaatcgtcatctcaaaattgaacactcatagggagtatgctgccaaaatacctacgaacgagaagatgtcgaggccttcgtgttggggttagaaataagaaattttggaatccaacactgagttacacgacctgtagaaccagtaggtacaaatgcactgacaaaatcagaatcagacttacctgaaaaattacctttttccttcacaaaagtctgagttaaatttcgtacaaaattgccccgaggtcggtctgaccaccgctgtgcctacggtctgaccgggcctgacagccggtctgaccgccggttcaactgcggtctgaccgctggacggtctgactgactggtcagtgtcggtctaaccgtggtcctcgaattaaaacccgatttttgccaacgtcgttttgcaaaagcaatttctctttccttttttctgtttatgggcaagtttaaaacaaaaaccaaccaaatgtccatcttttccacaaaaagaacaagtgtacttctcacgacaagtttgtgaagtggatggttttgaaattgatggttttgcaacaacagaaggttttgcattcacaacatttgatttcgaagaagatgcattcaaagaagacatgatgccagcagatttatacacagtgttcttaggctcagtttcaatcaaaatttcacctctcccagcaacacccaaaaccgtaggaggatgtctagtatgatgagcataagaatcaaaacctaaaccacgattgtgtgtgctaactttagattgatcaagaatcatgttgaggttctttttaccatcagaaaatctttgcaaagaacttttcaaataagaaacctcctgagtaagaatagcacaatttttgcaagcatccaaaagacctttttgttttctacaagttgagcaagaaaacacctcatcttgtttaacaatttcttccatgtgtttaacacgctctaaagcatctttcaacttcaactcattcaaaacacactttgaacaatcttgagaaatcaaaacaccattgttttgttttgccttatttgcacatgaagcattgaccaaagaacttgcacaaaaagcaactttgtatttttttcaaaacgttctttgtcaaaatcaactcatcaacaacacgagcatgtaaagcaaatccaagagcaaaagaagactccaactttttagatttttcaatctcaaattccatttttttgcaattaacagaattgacatatcgcaaagcattaatttcagaaaataaaacttcacaagattgacaattatcatctttaggaatcaaagattttaatctagcaatttcagcattaagaatctcaatcgtacgatccttctcatcaagcacaatagaacatgtttgaagtttcttagcaaatttgtaagcatcatattctaattgatcataactaagcttttcttcattatcatcatcagattcatcaacatcagaacttgcattacgagcaataaaagctagatcaacaacttgcttacctttgccctcatcttcatcttcagatccatcaaaaatttttatgagttcttgaattaaccactgcatgcaatgtttcttcttctccttctccttcatgttcttcttcttgttcacgtcatcctctttgactctaccatcatcttccttcttgactctcccaagcttagggcaatgcgagcgaagatgatcaagtgcaccacactcaaaacaacgattcggttatcctcttttcctgttcctaacatttttcatagctcgagaaaatttgttaaatagcaaaaccaagtcctcctcctcgaactgttcgagttgatcatcagacatggcattaaataaagtaagaacataagacttcgatgaagaagcaccaacatccaaagaagttgaagacgaaaccaaagcactagaattagaatcacctttacgagaaagaatattcatctcatgagttttcagttttgtgtaaagcgaatccaaagtcaaagtagacatgttcacagactcctgaatagatgtaattttcatctcccaaatagacatgtcaagaccattcaaaaagtgacgagaaatctcaaattgtagataattagcatcataagaagaatcaacagatctaagatcacccaaaattttattaaacctaaaaaagatagtcatccaaagcttctccaggtttcatctcaaatttaatgtactcctttttgaaaagatcacaacgaagttctttaatgttattagtaccttaatgaaaattattcaaagcaacccaaatctcatgagcagtttgaagatgagcaacacaatcataatccgaacgagaaatcccactcaaaaaaatattgcgagctttgcaattcagttcaaaagcagttttttcagcagcagtattaataacttcaggaatcacataaggaagagaaacttttctccaaatatcataattctcagccataatgtaagattgcatcctactacaccaatgagaaaaatccattccatcgaaaacatgaggcttagttgaaaacttattagaagcagccatggcaaaaactttggatcggttaaaatccaaagaagcaaacaaagctctgatactacttgtaggatcgaatcacaagaactaagccaaccagagggggggtgaatggttgatataccccaaaacccaaacttttagcggaaataaaagttaccctcaaattcgatgtagatcggtctgaccgaggttgatccgccggtctgaccgagctcgtgccgctggtctgaccagtgttgatccgccggtccaactgcctgaagattgcctgtcgcgtgtgaagtcgccgccggtctgaccgccggtatgtcgccggttagaccgccgaaacccgatgaaacacaaatcgaagaactctcaaagtagatgataactttattacttctctctatgtttacaaagtgcaccaacaacactccttacaaaaatctcgactaaactcgaaaccctaactaaactagcaactcaattactctcaaaagtgatactgggaagactcacgctccccctctatttattcatgaggtaggcagcctaaagccacgaaccaaactcatactaagagtcctaaacaccttaggaaaccctctagtacaagacacaaactttacataaccaattgtaccaaatttggactccttccaaattcgactccgcatcccatacgcacacaatacctccatcgtatgccatatggaatcttcaccaaccacgtgcatcaactctagccttagtatcccgcatgatatctgaccaccacggacatcgtcttaccatcaagccgactctcagtccatcaccgcaaatactcttccgaggcatcgagtcacctacacacgaaataaacaaagaaaccatattccgataccaagctatccccaacttgactcattgttagcaaacaacagtattacatacgtatattatctatctagaagtcataaccatgaaacaatcatggatatccaaagaaacaacccgaaaccgaaaccgacatagcgtcggccggtcagaccgcgggctggccggtctgaccgctcgatcaccaccggtctgaccggcatacaccacctagtcggaccggtcacataaaataatagtgaatccgatcatcacctgaaaattgattatctccaaaaccacttcgacgataatctccaaatatcaaaaccaataatcacagatgtcaattgttcatcacagaataagaatcaaaacacactttaatcttacattacgttattatacgttcaccgtgaataacatttagacccatcactctcgagttcatatatcagccaccacatcggaggaaagttatgtgagagaatttcaatcggtgataatataggcacgtacgtgtcgcctctcgacgacatgtaagacctgatgactgaaaaaccttagcgcagtactactctgggccccggcgttagtggctacaaagcagtacaccagttggtgtgaactaatttgacagcttaattactttgcagtcgtgttatgttagagtaccgaaacgtgtgcatgactagtgtaggtgacaattacatttgggatcgagttaatggtgacaataacattggcatcgagttaaacacgccgtacattgaaacttactctacggatatattctccttgtctcgaatgaaaaagaaagaaagaaaataattaatgatgaggtcaagaaaatatcacatcgttgatctagctggagaaaaccaacaagctaagactgctagctactgaagaatatcaaccatggtcgctataatggaacgatcaaattagaccactcgacaagatgttgaaagattccatacctttgactatgctagagcattttcaccggtacgttaattaccgcgtgttaattcgacgtacgtcaaaactaaacacctggtagtacgtgttcgaactctcctgttgcatgcacacgtaagtgacacgcataagaatccagaccgatcacacgtaatacacatggaaatcaaatcgcacagagactaatgctgcaattaaaattccatctggaatttaacacgatcagtacgtctgaacatgcctacatctacctgaaacggacccgtggaaaaccggaaaacgccatggccgacacacatctacactactctcaggctagtccaatgagcactccggtcgtcgccggccgtgcaaccgccgaaataaacgacgacgacggtgacgactgatgagacgttacaagctaggcaagaccataaaattaaattaaaaacaagcacacacgcactagaattccaagaaaactacgtcttgttacgactctttgcttgtagcagtacatgtgtcttgttgtgaaatgttgattaattctagcccttgtaagtgttatccatatcgatgcaatgcctgatcccgaagccacgtcttgggatttcgtacggggctcctcctctcacgaggagctgagttttctaaccaaaaaaaactgttacttattgtgcatagtcagatcgatagataggttgtttcaaaaaagaaaacgatataagatagatgttgcatgcatatacattacattagcagtgagattaattaatagtaagaacattaattatccataatatgtaattaacattcataatatatatatgtctgttgcattgctggtggtaatgagaatcttgagatctattccaagtccaacgtccaattaaaggagaacagcttatatattagccagtttttggttccaacaaccagttgacctcaatcatcatgacgatcgaagagctagagaaaaaaattatcaggatcaaaggtgtattataatacagaagagaggatagttggcgtaaaataataactatacattgttactgaaattctgtgtggcccaaacaagttgactcgagattttatacggagacgcaactgctagtccggccttagttttccattatactgtataaatcttcggtcatcggtgagctatagaaggagatcagattaaggcactgaaatggctatcaccttacaggatgcagacgatggcatgccatgagtcaacattgcagaggtccgacttaagacatcgaagcatatatatacactaagtgttgtgaatcacaattaatgcatgcgtttagaaaacaaaatggtaacaccttaggtttttttttctaactaatttttgggttttgctaggtttgcatacaagctagctagcaacctcaatcaagggcactccttaattacataagaattatataaaggtcatgaacgaattatattgtctaacacatatatatcatcaaaaaaaaatttgcatgttgttttactcaattcctaaggtgctgtagacagctatattctccatgaaatgaagtgcttgcgagccacttgatactaaattatagtcacatacacaagtcaacagttcaatttatagcgcgagcgagttctataaaagtactaaacatggcattgaaagttgacattgtgcaactagaatgctagatttatacatatgaaaagaaaatattaatgtatatatagctcacattttaatctgtcattttggtaatggggaaactaaggtgcgtgatgatagcggccctgaagaaattccaagagttgacctgggctccatacaatactaatccccttagcgttagaagcgctctctcccatcatgcacatgaccaagcccccacttgacttcggtatcccttgtcatttggatcacaccaccgtgcacttcacaattcacactactccttcagattaatccatctcgttgatatttcatctcgagtcgtaaaaaccctcatattgtattcatcactgacatgtgtgcccccaaaaaatatcaataggtgtagaaggtcgtgtatatatacgcattcatgtgtgtcaaggcaatatattttgttgaatatgagatgacatgggataataggattaaggaggagtcttccctcctcattgcccttttaatacgtcttagacacccagacattgacttagatgcctcgggagaagtagcattaggatttaagaccgttccccattttagctgtaccaagagagacaaaggtacacaagattaccagaaagaggccaggagcatgtcatccaagaagaagagagctgccatagatctctccctggaggcagagagaagacggccagaagaacgcggcggcggcagcgatcgcgaagccagcgatggcgccgctgctgcagctgaggaagatggtgatgtcaagcaacgagagggccctaaagaggaaaccggcggcgaggaggagaaggtagttgaagtggttgtggaccaaggagaagacggctccaatgaggagatcaaatataggactcaacaagcagagatgatcgaggaggacaagcaaccagctgcagcagcaaacgtcgacgacgatggcggcgacagcgacggagtcggagctagcgcggaagagaagcacatggtaacagaggccaccggcggcgaaggcgacgacggaggcgatagccgtacccccatggcgcaagatgaggtactatacacagtactacaattaaacttaccgacgattataaaaactcctaattatactattagctggtgatgtgatgcaagtagatagaattaatatcgatggagatttctcttgtcctttgctcccatttggagttgacatatatatgtgtgcttcttcagctcagcgagatgcaggaggagatggagaggatgaaggaggagaaccggatgctccggcgagtcgtcgacaagacggtgcgcgactactacgagctgcagatgaagctagccgcctaccagcagcaaccggcagcagcagatgagcctaaggtgatttaatttcttaattagctgagctagcttaaccaagctgatttagctagctattatagctaggctaaatatccaattgagcctacccatgttgaaactaagcttagctctagctcgcgcgctcatctcgtgcatgactttaattattcttccacgtgacacaccataattaccatattactcaattaagtcacgccttgttgtttgcgaactcgtgattgattcgatcgatttccgtgtaggagaccgaggtgttcctctccctcggcgcaacggccgccgcctccgccggctgcggcggcggcttcccggaggcgaagagcaaggagcaggccgcgtggcggcggcgctctgtcggaagcgacgacagcgactgcggcaaggaggatctagggctgtcccttagcctgggagcgtcgtcgtcgtacgacgacgaccagaaggcggtggaagcaaggccgcacgacgtcgacggcgcggcggctgcggccatgatcggcggcgacggcagcaggccggcgccgagggggtacgcgctgctggagagcagcaaggtgcagggtggcgcggcgccggccgccggcgagctcgccgcggccggcggcatcacgagccagagcgtcaacccggccaaccgcaaaactagggtttcagttcgagtccggtgccaaggccccaccgtaagacacaatgcatgcaacatctgtgcgtgcatgcgtgcagtacatgatacgagtactaattactaatattgatcttgtgatgttgtcgcaccggtgcagatgaacgatgggtgccaatggcggaaatacgggcagaaggtcgccaagggcaacccgtgcccgcgagcttactaccggtgcaccgtcgcgccgggctgcccggtgcggaagcaggtgacgatcgaaactgacaagaattcagattgattagcattggttgcatgcatgatcatgtgtgttcgtgcatggattgatcgatctcgtttgattgtgtgcaggtgcagagatgcctcgaggacatgtcgatcctggtgacgacgtacgagggcacgcacaaccacccgctccccgtcggcgccaccgccatggcgtccaccacctccgccgcggccaccttcatgcttctctccagcaccacctcctcctcctccgtctccgacgcctccgccgcgccgtcgtcgtcctacctcagcccgtacctgctcaactccgcctcgccgttgctaatgccgggcgccaccggcggcggcggcggcatgcagcatctcaacctgttcgggaattcgccgtcgtcgtcgtctctgctagctccgcaagcgccaggctccagcaagtacccgtggtctccgaaccaccctccgctcgccggcgccggaggtaataagagaccgttctggagcgccggcggcgacggggacaagccggcgccggcggcattggccgagaacgtcggcgcggtgatgtcggacccgaacaagttctcggcggcgatcgccgcggcgatcaacaacttcatggggaaagacggcgagagtagcagcggcaagagtagtagtaagtggggcgtggttgaatcacttccaccccatgagtagtagtgagaattatattactagttactagctaatcaaatgtgacaagattgattcaatgattgggaaatcagttaggattattgcgtgtaaacaaatcaaactaggggaaatcacacattggaaacatttttttcggggagatttcgttgtaatttttcagtttttttttgtttggaacagatcgaattgttgttaaccgtaaattacagtatctgttcatcgtctttattaattaacaaggttgtacgatcatattcagatcatacaaagtagtatcctatattagtagggccgtgggggttcagttctgtgtgctataacagttttttatttactacatttataagcatttttatggttattttaccatacttaaggagttatcgggagttaccatattttctatattgaaaatattttctagtataaaatttgatgcatatggtggtattagttatcaaaatttttagtgtaaaatgtaggtacctgctctattaagaaccataaaatttctcattttcttatgggcagtcgatttcacacttgcccttggtttattcaagaatgtttgccggcattttaaattttggagaaaaaaaactaaccggtggatatatcagtgcatttaatagtggtttcaatttggtccctatgtctaaattgatcggttgttttgctctctccttttatttatttttatttttttaacacgcaaaacaattgcacatcaatgtattagaataaaaaaatgttacacaacgtaagtggctagacatgtaattaatgaaaaagagttttcattatttggtctattaattatacacatgatctggttgtaactatatatattgtgacaattattttttctgtttgagaaaacaaatgtccacagaggttcgcttaaatagtaagggttacatcatgacaggatcgcatcatttatgaaacactgtatgggctactgtgccagggtcacacctgtagctgatcaagcattatcagttggcttccagaacaacaatactgaattaggcctaataacaaaaccacactttgaaatcttgtggctagtactatatatatatatatatatatatatatatatatatatatatatatataaatatatagcttgatgactacttcatccgtttcataatgtaagactttctagtattacccacatttatttagatgttaatagatgtagacatatgtatgcgtttaaatttattaacatatatatatatatatatatatatatatatatatatatatgtggataatgctaaaaagtcttacattctgaaatgaagggagtattaattaagacagatcatacgaattcagcaagtattgttttgtgctgtactgctagcagtgcaagagttgttccgcgaataactcatttttccttttgatttttcggtttgagaacgtcgtctagcaccattcaaattaaggaagcctgcagtgcactgtgcactctgcatggtctcctgactaattagcaatctggcgccgtcagctcagctttctcttgtaaaacatactccctccgtaaaaaaaaaaagacaaaccctgggttttcgtattcaatgtttaaccgtctatcttatttgaaaaaattatgaaaaaaattaaaaagacaagtcacgcataaagtattaatcatgttttatcatctaacaacaatgaaaataataattataaaaaaatttcatataagacggacggtcaaacgtttgacataaaaatctagtgtttgtctttttttttttaaggcagagggagtacgtagagattggcgcggccggggatgcaatatgcaagtcaaggccgttgcagcgaaccagcttgttggtagcggccatcaggatgcaggccggatcgatgcctgcaaactattgttgcgcatgaagcgactgttgtagcacattagaagccagtatggtggacaggatcttccggcaggcctctgtaaggccccagaggaatttcacagagagaacgctaagccgctaactcttcagttcagtaagatatcttatatatggggtatatagggcaaagttgtctcggtacccaaaaagaaaggggaaatgttatcactaaacaaggaagaacagagatcgcatattacattcgtatagaggaaaacaatcactgtacgctccggacaagcttctccagactctagagtggtgtactacgttccaacttccaaccccttgtttccattgatcattctaacacctctggtcacatggttctgaccatttctggaacatgcctatgctctcttgcagtagtgtccttcgcgtaactaagcctattttccgttaagctcagtcattgcttgtacttacacgagtgttaaatcccctcctggcatgtactttcatcagcactaaagtctgaaatttcttgtagtattagggtgtgtttgagaagaaggggattggggagattgggaagatacgcaaaacgatgtgggccattagcatatgattaattgagtattaactattttaaattgcaaaaatggattaatatgattttttagagcaactttcctatagaaattttttgcaaaaaacgcaccgtttagtagtttgggaagcgtgcgcacgaaaaacgatgagctttctcacccaatgtcactagaacgaacacagccttagtacaaaaccccaaaatccacactgaacttctctgaacttttatcacagggccattagcctgaagcctcgagcaggaggtaggagagagagagaggctggggaccaatacgccagcaaaagccacagtcccacggatcatgtgatcagccaccgcccacgccccaccaccaccaccaaagccaccaaactcttctctgaagaaatttcagtactcagtgttgaagcctgaaccacccatccagaatcgcaggagcagcgagcgatctcggtttgatctcgtgcgagccgcgcttctcggtccatccgaaaaacgccaagcccaatccaattatccaaccctatcccagatcagaatatatcggatatggttgatttaatcccaactcattactgctatttcttcgcttgtttctcatgcgtgtttacaagaatcttccaacctaatccccccgtcttccaccacaatcacgcagtgacagcgaggaaattatagttgcctggtcaagtaaaactctgcttagtgagacattcctacttttccaagttataaaacaaacattctgaattttatccatggggttaatttcagctgttccaattgtaatctcactagctttattaatgaattttagctgttccaattatgaactcactaactttacatagaggttgatgaccaccggcgggaaggaatctgttcccgtttaatacgggttaacacgccgaaatttactcgaccctacgataaaagtacaaacgataagaggaatattcctttttatattttattttctctctctctctctcaacgtgctacagttcaacggtgtacggcaaatcgcaacacgtcccgtagaaggcaccccccgtctccgccggtttcgtcaccccagcttttgcgtggacgcggtccatggactgcaccgcgaccccggcttccgtcccggctcccgcccgcccgaggagggagccggtgcatggaccgggtccacgcaggggtgaacaggcggcgaaactgtaattgcaacgcgaactcgcaccaaaaaacgtggggcccacccgcccaaaatctttgcgtctcctcccctttctaatccactttttattttttgcgccattttttctttttctttttcgttttgttttttttttcgttaatttggcttaactaggggtgtccttgtctttcgccattttctctctcgctcggtttgctgctctcctcctcctcgtcgtcgtctccaactccgtcgcggcctcgcgctcaccgccgccggaatccggctgacctcctccgctcccgcatcgggcgctcgccccccgggtctaggtacttgcccttgcccccctgcccatgcccttcgtcccgattcgaacatgtcagatttggttggttgggtatcttggtggtgggttggttcgccaggcgccgaggcccaagttctttgtcctggaatggtggctagggagctttgtttcggggttctatctctgtgatttgggtgcggatgggaggaattcttcttggtttgggggaatttggggggttccggtgctgatttgagtgttttctggctggttcttggcgctccttcgggagaattttgtggagctctctgatgggagtggtctaggtcgggatctcagactggatggcctaatttgatcttatcaaggtgaattatgccttctcagtgaggatttaggtgactgtggttacaattgctggggtatttgacctaaaaacgaagatgggcgagcaaaaggggcctcctattgtcaaaattttagtcattgaaccagtagcacgagagcggtgttctcggtgtattctttgcgtgtagattggaggattggccgcaatggcgtagcaaaataccctttaatgtatcttttgagcttctgttgatgcttttaagctttttgattgttgtagtagtgattaacaattttgtaggaaatgatctactgcgagaaggtactgtagtaaggaaatttaattggcagtaaagcttcattttctgaactgtccttgtgcccattgataatgccattaacgtagaaaaaatagcatttcggatagcattttagttaaatcgtgagcacttatctagtcttgggccgtggccctttcatttctttgcttaaagttaacgaagaaagatgcttctcgggtaatatttaataatgcactattcagtggataaggtgcactttttagatggagaagaaagtgtttttgtcactgatttgagttgaaaatggtgaattttgaaccaatttgtggcataagaaaacccttttgccaacctccatccatgtgttagcaatcatggtaggaggatcaagattgaagtaaaacttaaagaagccctttgcttcaaatacctttcttgtgctggttacttagcatgttcttaaaggatggaatccttggcccaattgcagtatcaattgattctctctaattaaaaagttatgtgttgttccttgtttctctttaattctggtagatctgggaggggtcctgacatgctccatgtgggccactggttttccctttatctcttatctggctcttaggtgtgacttttttaatgggtattgtagatcacatctaatgtgcttcattgatttgattatttaaaagcctttggttgttgctattcgtttgtttatgttcctacccttctgtggttggatcccataaagtctacctgtgacttctgctgccttggttgcttgttagtcattgttgtggatcttaagtttgctgacttggtttaaggaggaaggctgctgcaagagtaaagctgcaattggttggtaatgttgctcatgagtttttcttgtataattgcaacaaccaaggaggatctttttgtttgttttccattttgacattgtacaatgccagtttgctacttcttgcttcttttttataagtttgcagccttagtttagtaagtttgcttggtttcatatgcttgatttgactcacaaaaatgataactgtgtggatgcctcttttccttgtttgattatgtgattatatcagggtctacattcactgcctctgtggcggggttcatccctatcatcatgttaaatattaaactttcctccttatgccaattcaatggagcagcaaatggtgattccaatgccaacagaaattgctgcctttggaagttggacagttgtgatttgtgttttttgtttcatgattttagttgcgcccttcaactatccatccataaagctgtgttcatttttacgttgccttgtgtgttctgtttgacaaatgatgaaaatgaccagataaggaatcaggaaatgttttgacttggccaaggaagatccatctgtgcagctcctactgacccccacccccaccccccaaaaaaaagtcctcaacacattcttgacaaagttgattaatctttttcccttttgttttgctaaattgtaatataaagaattaaccttgtacatattttctctctttaatgaaattacactactaggcaaagcccttgtagttttcccagtcaaaaaaaaattgtaatctaaagaaggttaatttctgtgtttatcttgtattttaatatccttgcagatccctggcctgtttttgtttataagaaaacaactgtatcaacaattcatgcaaatcacgttatggtttctttctggacaggtttccgaagaaatggcaagaagtgcaagggcaaggaggcatgtggctcgtcagcttagatccgcaccgtatcccatcccttcgtaccgctggaaagcaatgaaagaatcaaaccgaaagaaaactctgccagctgcacagaagatggactgggaagatgccaactgctctgtgtgcatggaatacccgcataatgctgttctcctcctttgttcttcgcatgataaaggttgtcgcccttacatgtgtggaactagccaccgccactcaaattgccttgatcaattcaagaaggcttacaccaagggtgcattgctagaggaacttcctgccaacactgttggcacgaacttggactcgacgccattgattgcaggtgaaaaaaatgagtctgttgatcttgcatgtccactgtgtcgtggcaaggtgaagggatggactatagtagaaccagctcgaagttatctcaatgggaaaaggaggacatgcatgcaggatggttgctcatttgtaggaacctacaaggaactccgcaagcatgtgaagtcagagcaccctcttgcaaagccaagggaagtcgatcccatccttgaacagaagtggagattgctagagattgaaagagagaggcaagatgcactcagtacgataacagcaactatggggagggcgattgttttcggtgattatgtgctagacttggaagatgaagatgatttagatgatgtagaaagtgatgaggatgacaatgccaacggacacgggacagataacactagacgaatgttaatgtttctaatgcgccaagttgctcggcatcatcaaaaccaaaggcttcagaatgcaattggtacaactggcggtgccgaggacaattatgcggtgagcagtggtgcaaatgcaaccacgccttaccattaccccttggaaggcgacgatgaggatgatttggttatggccggaggcggaagcaccggtatggttagaccagagaggcggcgtcggcgccgccgtagaaaccgcgagaggttgttcttaggtgctaattgagacaacaggggctttaccactggaggagtacattgcacaattggttctctggtgcatagcattcatcaatttcaacctcaatttacttgttcatgatcatgtaccaaagtagttgtcttaaccttttagctcattgtttcacttcaatgtatgccatctcacattcattgttgaaaaggaaaataccgcacccatcttgtgcggtttgtgtagcctttatttccagtttttcagaagctctgctaaatattaatccagtggggatcgattttagatctcaccagcttcagatattcagttgtgcttagtgctgactaaacatagatttgaacatttgctaaaccggaggtgttgactgacgatattacaacataagaagcagtaagatcttacaatgacctgagctcatgtttcaaccaaacatagaaactgtagaatacattatcattgagttcgacacttcatcgttgaagtgccctacactttatgacatcaacatacatgctctaaatgatttcccgtaacataacattacaattttgttcataactacattctacagagcatatattaatataatcatttacttgtatatacttgcaagaagaaagatttgtatctcttcacgacggtcgatgagcatttccacagcagatcttctagtaaaccgtcgatcgaaggcatctgccaattcacaccatcttgcctgatctacattcccagatggcgaatgaatatcacaaacatcacaagcacatgcgagctcgtgcaatgcggtgccaagaatgctcacttctgtcaaacgccatacaccatcatgtcatcgattgctcaatgcccagaaccaggaggcgcattggacacccaaaatctcccacttgagcacagggcagttactttttcctaatgatggtaggcacaccgtagcaaacgggagatccaccgatcataagaggaagcctgcaagcacgcctagcttcacttaaatatgaagctactcgcctgttgccacaagtgcaacgcttactacagttattcattcgttcggacttcttccctcgtgtgcctcttcgcctcggcctgccattaccctccacagcaatggtcatggattcaaattctcgtgttagctggcaacacttcgagcaatttttggccgctacaaaattctcttgcaaccatgaaccgagcaatgctttgctgaatcgatcaatatccttatctgacacatcccagagatttgcgataacagctggagaaccagcagataaatatgataaaggggctccttgaggagcataacaccctttgcaacgcaatgttccactactgcaacccataagaagagcagctgcgcaattatctaatttctcaatttcctttccagagacatactgagttcctgcaacatttcaagaccagttagaaaataactgtttagttctaataaatgaaaatggctgttctctgtattagtcaaaggctaccagaacagtgcccagtaagaacaaagatactcatgatcactaggttagttcttattcctaacagtccaatcaataggtaataaatacaattgaaaacttgaaagcatccattggcactgggccccctagaagcagttgttcttgttccaattgacacataacccactctgctatcacatgtggccggtttgtgtagttgactcaagggcaccatctaatgaattagcggttcaagctttagttatttttatataaaagctgggtttgagtattcatctaaagaaatttcacccaggtggccataatagaccaatcaacaatttaggtcatgttatcacccgttgaaaatagcaatcctaatgtatcgctgttgcagcaatcagtaaaaagaaaacaggttcagcaaataacttaactatggtactccctccatcccaaaatataacttctagtgttcaaaattttatcccgaaatgcaaaaacttctccacctactttcttatctcaatcaatcacaaccatctttcatttaatttctctacatattttctcatcttaatcgatgacaaccatccctcatttaatttcacctcttcttaattcccgtgaaaaactctagaagtgcttatattttgaaatggatggagtattaccctactagacttaattctgaggaccgaaggcatcagggtttaacatgaatgggagaaaacgttaatatgtagatccagcaaaatgatgactacaatctttatatctatagggcttaccacttccatgaccaaaataaaggaaaagatcatgattcctcaaggccaacaccagctcttcagctgttggagcatacccagcctttccctgcatacaatcgttgcaacattcacaaatcacaaccgtttgttggtgcactatataggcatccaaattcatgctttaacatgcaacataaatgctccagcaagcctgcaaaagccctaagggttcatgtcctgttatctctatgacatatgttagacgctgtagttgattgatgcaatttattaaatttagttgcaaccaacagtagcaataagcagacaagctgagctagaggtatctagtgctagcctacaggtagacaagattttgcagccatttatatttctaaagtgaaaggagcagtaaatataaccacttttggtatggcaagcacatgtttacaagcacattgagatgccagaatataaccatttctcatctcccaacaagagcatttccacagttggtggaagcaattatttttcacaaatttagcactgagaaatggttgttagaacaaggactgttgttttatcatttctaaattgttgtcaaatcaatgttaccttccattcgtagttcttaaacatctgatcaaattcttcttgtgtactgctcaggtctccactaggattcaacagataaaatgcgttgaaagggtcaatgacaggaaaaggaggagctataacacgggcatctttccaataattattacttctagtcaaagctagaaagacacttccaattgatggcatgcgataaatttcttgattccttagtgcaggcaagttttcccaaggaagcatctgcatttaatcattttaaacaaaagaggttaatgaagatatcataaatgataggaacatacatcacagcctcacagagtcacagggactgctgattgaaattgaaaaaaaaagcagaggcaattatttttttagagtaaatttcagagaatgccatgttttatagttaaagctgcagaaaaccacacgtattatgactcacataaccacagttttttgtctaaaggtttcataaatccccaacttcattcaaatctctattaattttagcatatctgaaaaaatattattcaaattagtgaagagttaaaccaatcaccttaatcaagaagtcaataattaaaaaaaagcatagacactccatattttttaaaaaataagtaaatatatgctctgcatgtataggggtgggattttgtgaaactttaggaccataatatccagggctatggagctatgctagtaatagttcctaaggttttgtacaactccaaccataaagcatggcgttttctgaaatttattctttttttaatcaacaaaggatgcagtaaattcaacaactgtaagtgccaagctgttgcgacagttttaagatatttgtggttatgtttaatattcatattcatattaaatacaaccacagacctggaccaacacaggcttgagacaaatgatatcgaatccacagtatctattcctaccattagaccgaacagtcaaggaaaacatccataacactatctcaaggactcgaagaaatatctacgcacatgtactaacccacacagtaaacatagttcacaatctggccatcttattgctcacctgcacattagtgtccagaacaaaaatgactggatctctatcaactggttcaatcagctcattcactgtactttttattaagcattcgactgtctccagagcttcagactcaatacagcaagaagataaggctctaagtctgtctttcccacaacaccctcctcggccaaaatatcctttatacgatataagttgggaaacacagtcctgcacttcatccactgacatagcaccaccaaggatgaccttgatgagcactggatttacttcaaatttgaattctgattccagaccagcaatcaggtttgtcagagcttcctcaatgtgttggtcagttaaatcataccccaagagaaggcatttccatggccccagccatgattcctccatgtctctgttcaaaaaagaacataacataccagaaccaaaaagttattaaaaatatgatccatctcaacaacagaaaattcaaacatttttttaggaatacatcttgtggaatcaattttcaagttttgccataacataagaaatcttacttcagcatcttatcaaggtggttgttgagcttcattctatgtgaccaccactttacatggtttgcttgtccatcattcagagtgagggttgcactagagagggaaataaagttctcctcaagtatctttctaaaagtaggagccacgtagtctattatagtgtagccccaagggcactgccaattcttatctgtggctctcattagattgtccagttctttggtacaggaatcttcatgttgggtttctgccaagcaacagccatgtgagaaaaaaaaaacacaaaagaaatactaagagtaagctatgcaattttaatatggaatcaacaaacctttagaaatagcatccactggcaaaagcattgtaataggtttgtttgttgaatcaaacctcgaaagcatcatccaagcaggaaaataagaagggagaagaagaatttccccaagaacattcacaaaatcaccttcaagcatgctaatgcacacaattggtacatcaggaagcttatgaaagaattctt

SEQ ID NO: 52046 - DNA, 4287 bp, Oryza sativa
aaaactttgagagactctcatctgacgcatttgaaaaatcttcaagagcggcctgaaatgcagggtaaaaattaaagataaatagtacatgaaaaggaatgtgttgatttagcagtgaattacgtacaaaccttcgagtcatttttctgagtaatgattttaagccagcaaagtactggcaatcgagataggttccaacagaattctgatgaaagtatgcagcccaatgattcaaagagagagatccactggagtataaaggtaattgagccgtggaatcaatcgttgcaagtaagaatatacatgcaagtagcctgcaaacctgaaccaagagagttggatttcaacacaagaaccatcaacagtaaaacatatacttgaagacggaaggaaactatagcctgaactcagcaggcactcagagatgataaaattaagaatatgcaatgagcatttaaaacattatactgcatggaaacatgactaaaggaaatcacagacctcctgaaaaagtgagggattctctctggacagcacaaaagctttcagcaaccaaggaacaacatcagacatttgtacactgcagaagcggcagcatatgtccctgaagacagatgaaatgaaaacaacttacacaagtttcacgaagcgctacaattgcaatgtggatatgtgactgatactatagcaagacaatgaaataaccttgactgttctgaaaggaagcccttgagcaaaaacaaactcatactatataatatttctgccctctctgaaataagaaaatcaccagtgctctgatccatgattagtccaaataaattatgctcataagttctataacaatcctgaggaagggatctaaagtacaacaatgatatgcactgccaatagatattatgaattttatgagctccatgcaatcctccatgagcacccaaggcttttgctgtaaaatacaacactcagaagtgagaaaaaaaaactatatgaatatattatataggaatttagtaatgaataaaattcaatcagacttcttaaacaaaaggactatatctgtcaccatcacatgattcaatgcatttcacagtagcaaaagatcatttgatgttcacccgtaacaatctcttcgaatgtataaataaacttaactttatatgaatatcatttggagctaaaagaggatttcccatctcatatgtgtaaaccaacagcatttcacagaaataactgcactcctgctgttcaacagagaactgctcaaaagccaggtatacaaaattgaaaaactggactggtccatgggtcttccataataaaggtatcctcttgaatgttatagcatgttactaaaaaataatagtaaataaatgattaaacatgaaatatatcgaaaataaactagcaaaaacctgaaaacatacacgtaatttatgcgcaaattgtgaagcccttagttgcgcacatgttattacgtcaagtgtgcaatttatttgtttaacacacataataaggagcataaatagagaaaagtacctatttttaacaggatagacacatggttgtgatgccaaacacaatcccatctgaattgcaaaatattctggatggacccagagttgagtgtattcacaaaaaggcaattccaacatccaaatatactgcatgtgtaatctatgctctggtcaacgccatcaaggatacagtttgcttttccacggaccaaagtatctgtggacagattatcgctgcaagatagccattcttacagtgtagctcattgaagccttttcacctttcatatgagcagttcgcttactagagcgcgtcctagtttttacatgagcttccacattctgttctttagctaaacgtgatgaatttctggttgtccttttaactttaacatccaatggtggacaacattcagaatccttatgtttcagaaattttaatgccgtaaactcattcgagtgatcaccggaagcctgactaaaatttgcacatacagtacatgaaggtaacactccatcatttgcagctaatggttctttcccatatttgctgcagataatgcaagtagttttaagcttatcatatgagtcaacaggagattccaatttggtgccgttcagtttatccagggcagactgatacatgcctagagcattagacaaattgcctgctgactgtttctgaaagtctttctcatatagactccaaaatagatctccagcttgcacatcaagtgatatatccagagttaacttgcagagcttgcacgaaatgaatgtagcattttgtgcaagaagatccctggcatatttaagctcgccctctgcggtgtcccattgctgtctcttgcggtatatttgacctaaaaaatcaggcaacatgaggcagaaggacaaatgacgcaaaaaccaccaaaagcaatatgtacaactgttgtatacttcctccgtttcatattataagactttctagcattgcccacattcatatataatgaatctagacatatatatgtgtcaagattcattattcattaacatttatatgaatgtgggcaatgttagaaagtcttataacctgaaacggaggtagtactatctttggagaagtcccaagaggtccttttcataacttatgaagtgccaaaactaaattacaagtaatagtgcctctttgatcttcgtaacactgatgtaaaagtatatatatacgcacagacctaaaattgataaggaagtatataaacacacatacctaaagctgatgcgaaaaggacaccaaaaaccggcaatccttgaaattgtgatatatcctttcctgttcgtaacaaaacttctgcttcggcaccattaccaatcaattcatgcagcaaagcaacctgaatagttaatgcattacagtgtgagcatcatgcacaaagtttctttttattttaggaagcatcattcccgaagttaagaatgctggccaaatgccaacaatttgtgtgttgcactgtaaaaattatgtctacagccatttgcataccacagtaggcacccatcagcaggttggatgtcacattgacatgacagataggcccacatttatttgactacagtggtgtaccagttccattttttcaatcattaaagagtattgcaatggcctttacgccatgtcattattgtacctgcaaaatgctatcaagatagcactggagtacagtccaaggagtaaggaaagaatctcttgttccagttgatctggtagaatctggccaaatttcagttattgttgatccccatgcttcaagtgaaacagagttttgccctccagaacattgagcttccccacttgtaaacttgccaaaattgaatttgaatttctttcttaggagcttcttgcgtaaatgcaaggcctcttttccgtatgaaaaggcctacaaaaacagaactactaaatgtttatatcacaagaaatctaaaatatcaaccaagacaacaatttagcaatgattcctacaaataaagatcttgcaccaagacatgatatttcaaactggagcaccggtgcaactacctggaaaagttctcctcttgatagaagtctttctgataaatcaaagtacagatagccagctagaaaggttgattgatcatttacagtagcctgtagattcacagtacacaatggttaatagaaaactaaaacagccataattacaatgcaattgtgctgcaaataacaaaacttacatcagaaaccaaagatgatgcgacactatcaacctcatgaacactaccaccgaaaccaaattcccttcgaaaggaaggttcacatgtcgtagaaataaaggaatcaataggccacaatctctggagaaacatacaaagagaaggatggtctcctttaaaacagtttctccaaaattctgtactatggcaatcaacatcaagatgatgctctgcaattgaaataaattgttggtccattgggagatgacaacacgcatgatggaggcgcccattggtaaatagcatggaaaataacttttcagggggtaagttttcttgcttccatataattatcataagcttgcacagatcaaattgaagctcaaagcagccctgatatgtcacagtaaaagaacataactatgttgctaaaaggatagcaattgcatctcatccaaactaggtcgaaaaatctataatgaccttgcttaccttcattgccaacaaatcaaccaaagaacaaagaagtggtacaagattttctgatggctgc

SEQ ID NO: 52047 - DNA, 2544 bp, Oryza sativa
ttttattcaacagaatgtttgtgatcctcttttgcatttctacacaaaacatagtgcctcgagattcaactaatgcataagccaataattcctgtgaaaatcaatgcacgtgcaaaaaccatttagcttcaaatacagaacatgacagattctcagatacagcattatttattgttaaccaataaaatataacatggtacctgctctaaaattaagcctaccaactttgtaggcaaaggaggtgtacaacccataagagagtggtacagaaggggagcactatcaacactttcatcatccttagcatctttgtgtgttatctgtagtgtgaataaccaattaaatgaaatcaatagtggtcttggtagcaacataattcttttcagatcagtaccttaacccacaacttgatgaggactaatgaactgttcaaaaattcggatgtgctatcattagccagcaattcagacaagctcttcacaataatatcaggtattatttttactccacatctatggagaatgtcaaccatcttggtaatcttagcaaacgcatccatactgatgtccttcaatgtatctttcggtatatcctcaataattctctgttcgtcctggcttgcagatagtctatggtaagaaagcctggcatacacccatactgtttgacaacatagctctaaagcctttggtgcctaaaatagagaaaatggttttgaatttgtggttaaaactcaaaagcatgttcaagtaaatggatcaacatctcagaatggtacctcatccaaatgtccaatattgtaaagcgtcacaccgatgttaccaagtgaggacatgagaaatttgatctcatcaagttttatccatgtacttgaaatggcacatttgatgaaggacacgctcttctggactatgaaagcaagatacattaataggtgataaggatgcaattctaattagtaaacagcaggctatgtaaaggcaatactccactaatgtcctttggataggagaacaacaaacagatttacttgtaagtcaactgtttctatatgtaataaaatgatatcaatattaaaaaccaacaggctgaaacaaggcatactgtagttgcaaaagacatagtgtcagtgataaatggtgtccgttcaaattaatcagattcaatctatgtgtaaatacttcacatggtcccaaccatcacccattgctcaaatcagtcctccaacttaagaaacaagtcatactagcacatgacctttattagttggcccattctcgtccatattctgggtcagcagccaaggttacccaacaagaactatgagaaacgaatgaaataccctctaattatttcactgcatggttttatgcatcatgcacaaacacaacagacgctctgttgggtctatgagcaatggaaattaaaaaaatgttaatggagagcaaatttggtcatttcatgtactctaggttggctggagatcctaggtgctgactcagcatagagatgtgtgatgccacatacacacaaggactaaaagagctaattaatgaaattcgaggattgatttgactagttgaaggaccaacgtgaaccacaaacagtaattaagtgaccaaacgaacaattaactccaagatagatacaggaaaagcgaatggggtacctggataccttcattggtaataaaagaaactttcattgctgaaactagggctctcagcaaggttccatgttgttcatgctgtttatccttgtctccttcaggcatttctgtacagctgtcacaagaaaattcaacacgcagaatcagggatcccttttgtttcatctatatcaacataactattttgcaaatttgctcatataaacataggtgggaaccctattgactaagaacatatcaataattgaaaataacttgcaacatagtgtagagctgacaaatgctgcctgtgtatttctgatgaacctacctataagctgcaatgctggaattgataaactgatgcagtgctgttaacacataggtcatgtttatagaataattgggtgttattccttcagagaagttcttccaaactgcattcacgtactgtgataatatcttgcaaagaaactctagcgaatccaggtatgccacaaaagatatatggtcatcagagtgagacaaactgttcttcttattagaatgcccaggctgcattgatgaactagaagctttacccatagtatcaagtggaatggatctaccattggcaaaacaaaaaagatgtgccagtgtggcaagggcactctttaaagtttgtagatgcttttcatcattaagaaaatctgtggatttatgaggccgctctctattttcaatttgctgagcactacagtataatccaatggcataaagaataagtactgaggcagttgcaggggttgaggaaacctacacacagcaagtaattgaattaatcaaaagcactgcttgcattgggatggtatgcattcacattaaatgatgctaacgaaatagtacagcatgtacct

SEQ ID NO: 52048 - DNA, 5268 bp, Oryza sativa
ccccttggcagaaaaacaggttgttggctatttatggaatgaaagaatagacagatgaaggtgtcattgcacattacaaataaacaaatcaggccagagtgcgccacaaatctgctctccatgacctagttgtttctagtcattatcacttagcccatcagatggcacatgactacattactcaaaagagggggaaaatgatacagtgaaacagcaccgatcagtcctcgatgatatttaacataaaggaataacaagcactggaaatggtcctatataaggggcattcatggttaccagtttaagcaaattaaaatgtaagagaaactacaaactagaaagaggtttccagctgcataaaaacaaaggaagcatgaaaatacctttagacatgcagcagacccaacaacggtctttaagacatcaagcaaaagctgagtgcccccaccccaactcacatctacagatgaacaaatcttgcgagcaacctgatccataaaaatatagtaacatcattgactagccacgttttttagcaaattcgagagggtaatcaattgtgtaatgatacatactgccggcaagcgttcaatagtttgcgccttcatacactcccccaaggttgcacgacagaattcacacacaaggttggtattgaacactgaatattcagcaaccaagagaatggcacagcgacttaatgcattcacaagcagtgtcagatacttcctgctgacatcctcagccagaatcctgcgcacacagaagtacactttaaaccactcatttcctattttattaatcaaactgaatgcaaagcttagctgagcacacaatctcaccgaagccatggctggagttggtcaacaaggctgacaacccgttcgtatggggcagcttccttcaccttgcacttgctggcacaattagcaaagcacacggtgagctcaatcgcgaggatggtgacttcagggtccgcaccagcctcccctgagatgccaggatcaggaaggagggaagcaaaactcgcagtcgcagcacggcgagactttgaggccgtcggcactgacagcacagaccgaagcgaatccagagtggcagcagcgtccgcctcggcgcgtgcgtagtgtccgcgcgactcgaggcagcacacgaatcggccgcgctggagcagcacggagtagggcttcccggcgaggcacgccgatatgaccgcgaggcagtcaaggaggagggcgtaaacgtcgagcagctcgtcggtgcacccggcgtcgcctgagctagggttggggcggagtagcagcgggagtacctggagcgcgcggcacaggaaggggaggaaccgcttagcgagcgggcggaccgtggccgcgtcgggtggcggcggcggcggctgctgcttgcgctgcttcgccgtcctcttcgccggcggtttggcgctagggtttagcgtgggtaggtagggggagaagggctcgaggtaggcggcgaagcgggaggtcaggccggattgggaggacggggaggagagcgcggcgaggaggtcggcggcggcggcctccattgccgtggtgcggattgcgcttgcggcgccgcgtgtggggaaatttttgtgcgcgtatttggggatttcggggacggggatgggcgggaaaggaggaggatttcggagctctgcgcgctggacagaggagataggacggtggggaccggcgaggaggaggcgtacgctggaagatttgattaatgggctggtaaattatcttgtgggctgccagtgggcctattctgatgacctctatatgggcctcacttcaattcaacaatttggttagtgatgcaagaagaaaacattagccatttccaaacatttgaaaaatatcaggcagaggagtgagttttgccgacagtcaacacaatgtaataacagattgttacagtcgtagtaatatctcggttttatttgctctagtatgaccaatgaaatatacatcttgattctcaaatgaaccatgtgcacaaccatccatcaatctacactctacactttttccatggccatcgaatgcgaccgccgcgcgctactccgatgtaccggaactcgagagagctccaaactttgaattaaaatttatgcaactatgctacgtatatgtacagtttttgcagtgtcgtacactacacacgtcacgtttcagaagacgaggcaggacttgtcgaggtcatagcccatcttctccaggcccggccgcaccgtgcactcgaccatcgccggcggcccgcacacgagcgcgagcgtctcgccgtcgcccggcggcaggtgctccctgagcgtccgctcgtccaccctccccacgccgtactcccacccgtcctccggccgcgccaccttgctcaccacgtaccacaccttgagccgcgccgggtgcgccgccgcccaccggtcgatctcctcccggaggagcatgtcgtcctccgtccggttcgcgtacaccacgtgcatctccgttccgtcgtcgggctggtcccagagcacggcctggatcacctggtacaccggcgtgatccccgtcccgccggccaccatggcgagccgccgcgcgaaccggcgctcgccgttcaccgtgaaggcgccgcggccggcgtactcgatgtgcccgatcgggcccttgatgtcgatggtggcgccgagcggcaggtagtccaggtactgcgacatgagcccgccgtcggggaacttggggtcctcgcccttgaagtatatcttgatcaggagctcgatgtagccgacctcgtcgacggagctcgtcggcgtgtacgcgcgcatgcagagcttgccgccgatcgacgcgcacacgtacacgtgcttgccgaccggtagcccgagcttctggtccggcgacggcagcgcgaaccggaacaggcgcacgttgtaggacaggctcttcttgtccatgagccggcatttcaccttctcccgcgggttggacagcgcgacggtcgacaccggcacggcgggcgccgccgctgccgtagggctctcaacgatggacgtgaggtcagcactgctgctctgcggcgagtagtcgctgccggtgacgatgagctcgccgatgcggtacatctcgaggaggccacgggccttgtcggagtggatggcgtcgaattcctcggtgcagtcggtgccggcgttgatcatgatgctgtcggcgccgccggggtggtccttgaggaaccccgtgcagtcgtagacatggccgtgcacgatgatccaggcggactccggcgtcgtgtggcggcgcacctcggacatggtgtactgcgtggtggccgtgttgaggaacggcgtggacgtgctgcgcttcagcgtgctcaccgcgctctccgacgtctcgaggtgcttctgcctcgccatccacccgccggcctggttgcccggctgcgtcgggtgctcgaacaccagcccgatctcccccttgtgcggcctgcacgtcttcgtcttcaccctgaaccagcagttgttcatcatgccctgcacacacgcacacgaaccaaaacgtaagcacatcgtcgtcgttgaaacggatggcgttgccgttgctggtgcttagtgcttaccatgagattccaaatgagcttctccggctgggtgttgagggactcgtcccaggcgcggacggcgatctccttggcggcgagcagctcgagcacctcgacatcgacggaccagaagcaccagcaccagtactttccgtacttggtcggcctctccgggtggtcaaggttgcacacctgccacgtctcgccgccgtccagggtcacctctacccttgtaactttccggccaccgcctggcaacagaaaatcatcaccgttaatcacccattcaccatcagtacaaagatactgatattataacggcccagtaaaagcataaagtgatcatggtgggcttttagaacgagcaggccgaagcccaaaaacaaacaacatgatagatgagatgggcttggggcttaccggagtaggcgtatcccttcatcgtatacggccgctgcgtcgtcagcgcattgatggggagcacctcatcgtgtcccggcgtggtgatcaccgagtttatgttcagctcgtttatcatgtactccggcttgtaccaccaagctgcacataatccaaaaaaaaaacacacaagttaagatcacaaagatgcaacaatgtgtgtctcgtgcagtgcgttcgaggaagatatggttggttaattaccttcggcattggcgagctcggcgtcgacgtgagacgggaggacgcggttgtcgcggtaatggtagtagctctccgactcgctggacgcgacgatgatgcgcttgagccatttcaccatgcggccgccgatgaagcccgggacgatgacccggacggggaagccgtggtcgggcgtgagcggctcgccgttctgcatgtaggcgaggatgacgtcgtgggcggggtccatggccacctcgcggcgcaggctggtgccgtacttgcacccgccgccgcctgggaggtcctcggcgccctcgaagcacacgttggccgcgccggcggaggcgcccatgacaccgcaccaccgcagcacgtcgcgcagccgcacgccgcgccacacggaggtggagatggcgccggggccccagttgaagcccacggtctggcgcaccatgttctgctccttgcgccggttgcccgcgcacaccagcgtgacggggagctccacggcctcgaacccggtcacgagctgctccatgttgagcctcgcggggcgcttgacgagcccggtcacctccacggcccacgtcgaccagtccgccttgggcacggcgccgtggttgcgcacgtagtggagcggcgccggcgtgatgaagccgtgcgacatgaggcgcggcagcggcggctcggagttgaacgggtgcttgccggtgagccggacgagcgccgggtggcgacgcacccacgcgtcggaggtggcctcgtcgcgggggtccttgacggccggctccgccacctccagccgcgggtggtacagcgacctccagtccggtggtatgctgtcctcgtcgtcggagtcggtctcggagcccgaacggcgcttgccgccgccggacgggaacaagtcgaggttgctcgacggagcattgctcgcccacgggtgcggagccagcttgtactccaccgaggccgccattgttgccgatggaaggacacaatgttacaattttgggctgcaggaat

SEQ ID NO: 52049 - DNA, 7431 bp, Oryza sativa
ttcatataatagcatatatgttttctcattatattatttaaatatattaaaatgacaacataattttaaattttgcaataactttataaaaccactaatgtgtaatattcatattgtattttatatacgtgttagttattaattatttttaatatcaaattttagttatttgtaaattatatatattcctatatggactctacactcgtcttttaatatttctttttttaattctgaattttcagtgctcttctttcaatattatttatttttatttctgaatttttattatttataattgtatttctatgtggactttaaacttatctttcaatattatttaatttttaatttcgaattttagttacttctaaattgtattcctatattgactttaaactcttcttcctatgtttttcttaaattcgaattttagttatttgtaaattgtatttttatacggactctaaactctacttttaattttattatgtttattccaaattttagttagttttaaattcatatatgaactctatactctacttctaatattccttattttttaattcataatttctatttttttcttaattgtatttctatatggactctatactctacttctaatattccttatttttaattccaactttctattacttcctaattgtatttctatatggactctatactctacttctaatattccttatttaaattatatatattcctgtatagactctagactcgtcttttaatatttctttttttaattccgaattttctataaattgtatttctatatagacgctatgctcttcttccaatattatttatttttatttctgaatttttattatttctaattatatttctatgtggactctaaacttatcttttaatattctttaattttcaatttcgaatttcagttacttctaaattgtattcctatattgactttaagctcttctgctcatatttttcttaatttcgaattttagttatttgtaaattgtatttttatacggactctaaactctacttttaattttattatgtttattccaaattttagttagttttaaattcctatatggactctatactctacttctaatattccttattttttaattcataatttctatttttttcttaattgtatttctatatggactctatactctacttctaatattccttatttttaattccaaatttctattattttctaatcgtatttctatacggactctatactctacttctaatattccttatttttaattccgaatttcagttatttcctaatcgtatttctatatggactttatactctacttctaatattccttatttttaattctgaatttcagttatttcctaactgtatttctatatggactctagtctcctcttctaatattccttattttttaattctgaatttcaactatttctaaattgtatttatatatggtctctagtctcctcttctaatatttcttattttttaattccgaatttcagctatttctaaattctatttctacatgaactctgctttttctttttctccgattaatgtgagaatttataggccatgagagcgaacgtggaggctcctttttctattcctttaataatataatagattataaaaaataaaaaaaataaaaagatgtattaacatatgatatatcgctccataaacatacaagtttaaattcaacttatacatctcgaaaaaaaacagacttgatcatgaatatgatgtactttaatttgtttttttcgttgcaggatatagaagttgaatttgaacttgcgtggagtgatatgtcacatgttaatacatcttctcaaaatttttcaatttttttataactatttaagtgacatgcaaattatgagaggagatcaaaatagttttctcaaactgttgcactattttcacatctgcattgttaactctggtgagaatgagcagctcggactgttcaacctctcgtaaatcagacacgtgcatacgtgcctggtaaatgccgtggccgtgttatgctaaacacaggctgatggattagttgatcgaggttcaaaaaagaagtttttttcctgacctcctaataaccccagctttaggtgcaagaaaaggagacggcatttggtggctgccggatccagccacccccgaatgcagcttgcctgagaaatgacctcgcccaggtgaatcctggggagctcatggacacggacaccgggcatgcacacacgcacgagccccactcggagatcctgcctgtacactctcgtcgcttctttcctgcttcctttacgcttctctgaatgatcaacgccaatatactaatcaggggcacggacccgcgttccatggtggatggatacgtgcatcggcaaattcgaccagccgacctccattagatcggctgtgatgcagcattggagcgatcataatttagtagctttctttgttgattccccccgtgttccaggacatgcgtcaggggcaaatatttttagcaggtgaaagcctgcaagatcatgcatgagcttgcagcaaacgtcctatgggagttgttcagaactggttgattaacagcggcttggttagtttgagaagccgagtattgtagttatggaaatggcctctaggatctacagagcaggcaccctgtggttttaattactgtaaaggcaagttctacttgcatcattttctcacataattaagtcaaaagtcagagcacaaagtcataagcacacagcaaattcccagctctctcgagtcgacacactaaaataaaccaaagccttgatgcatgaccagcaccccgattccctgtaaattaatataaaccagacagaacaatactaatccaagcatgatgcagagagtatcttatcacaggacataacatagaaagatactttcccattcaaaaggaaatgaaaaaccaaatgattgacttaacccaaagtataagcagcaacagcaggtcgggtggtaattaacaatggcttggcgcatggcattttccaatggccaagtaaccggtgggaagctcggaggatacttcatcacatcacttgctggctggtttctttcagcagcagctgagctgcctactgtagctgcatcttctcaatatcccaaagccggccggctccaaagcaggagttgcctcccgccatcgccaagggccaactggaccaagccctggtccagaggcaggcaggagagtagtagtagtagtagctagtagtagcagcggtggcttgttagctagcttctggagtccagccttccccagttggcgactctgccgctgcgtgccattttgatttcttgagagatctctctttttcatggatttggtgttttgcgagatgcatggaggcaacaacctcctgttactgacgttaaagtgttcgactcgccatcagaaacgtggtctgccagtatggtttgtcgacattgtgactttgtgaggctgacacttcattcacttggctttaggtctagtagtatcctaatgtaaggtggttaaatatctatcatttcctgtatagaattttttgtttgcacattacaaaacagtcattgcttcgcttattctgattataagccacaacagcttattagcaatcaaaaaaatatataaataaaaattatatatatgtgttcttaattagcaatttaaaagcaaatggtgaaaaataagctacaatgaaaagacccccaaaatcaactttaaatttaagtttttaaatccaaaattttgctgcagcttacgagctgagggtaaacaatgggagttttaagagagtaagtgttttctaattggtgcagccctgagaccctatttgagagaactattagaccgtagcccctgtggagaagagtgttgtcacgccccgaactaatcccgaccggaactagcccgtgacgctctaaattaacctgttaatcgatatcagtcccaggaaacagtgctggtatcacagggagacagaatatcacagcaacagaggtctttttattatagagtagaggtacagtcatgttgggctgcggacagatcccgagctcacaactgcaatacaaaagggaaacggaagccaggacttggaccaaacaacacaggcgcgacttgggaactaggccgaaaccctaaaactcatcgtagccggcttgctcctggaagaactcctcatcggcaggttccgcttcatcttcttcagcaactgggggggattatttatatagagcaagggtgagtacgggagtactcagcaagccatgggaaataagtgtttaatgcaggcttcaaggaaaggctgttgtttttgcaattgatttttatttgaactcttttctgaaaacaactaagtgagtgcttctcaaacgacacggatgggacagtgcgtctcgtccggtcggagtatgtgcaatgtatcagtctttagaattgaaacaaggttggcacccggccaacagcttttcaaacggccacccgggccaaccactttcaaacggccacccgggcctagctgatcccatcagctgcagattttttttttaaacatcgaacccctttccacaacagtaatttcgcaagcagtagtcaaacaaaactacgctaggaatcacctcacatccgcccatgaccgtgggcacggctgttcgaacagtttgttaatctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgacaggaagcccaggggtcctccccgacaccaccccggcgaatccacatgtctctcggcatcaagactcccctgataagctagttactcagccaggggtgtcccattccacccatgtggtcgtacttgtgttatgtttggatgaaattccaaggaaacggtccttaagtgcaagagcggaaaaccgtacacccggtacgttccccggtccgcggttttggaaattcatttagttcacaagcaccgacccaggtgtcgggttttccaagtcttttgtaaaacccaagttttacccaagttgttattcagattttaagtttgaaggcgtccgtcgatactcgcacagggtgcacgaatatcgagacgcaactagatggatacaaggagacatgatataacaattaacaaaggaaggatcaaatgcaacaaattaggtaggtccgccaatctgccttgcagacgggacaacagattaagtgcgatcctatcaatgcataatattttacaagcaacataattaaatttcaaatataggctcaagatgttcaaaggtggcttgccttgctcgagatctggagcttgatcctcgaaatcctcgcactgcgggtcttcgggctccgaaactatacgcaaaacgggacaactcaacaaacggcgaaaaataaagccctattaatgacctctaagtgtgccattagttagatctcgagatttgaggaattttggaagttgaacggagtcaaacggatttacggttgggaagatattgaatttctaagattattggatttttggtctaaaggaaaaaggatttaattaaatcctttttggaaaagaaaagaaaagaaaagagggagggaaattagactttcctcgggcggctagggcgcggcccgagagaaatggagcggttcggccgagctaaatgggccggccggcccaaggcggcccaaggcacgcgcgcgcgggaggggaggagagagagagccggtggaccgggctcaccacgcgtggtcccgagtgggacccgcttgtcggtgacacggttcaccgtgcggagcgagcacgcggcacacgcgcgcgggcgggggagggacgcggtgcacgcgcgcggttcgcggtggatgcggatgcggcgggcccacgcgcagcctcacggctcgcggtggaacgcttggccgagctggcgccgacgtggcgcctacgtggctgccacgcgggccggcgggaggtagacgacgacgccggccggaatggacggcggacgacagcggcgagcggcggagcgaaccacggcgatacaggcgaaagcgagcacaccgggtggttgcacaggacgaggggagacgagccaacggctcggattcgccggagggagcttgacggcggcgaattgcggcggcggcaaccggcggcgggagaaggggaaaacggcgacgaggtcacgaggggccgattcccggtggcgagagcatctacgcggctacgggaatccaatgctagcgttggattaggaggaaacgcatcgagggaggccggcgacgagaggcgcttccgagctcgggcggcgacggcggcgggcacatggcgagcggcggcaacggtcggggcggcgccggctagctatggggaggctactcgtgctactacccgagtctaagggaaggagatggaacgaggaggaagaacggagggaggctctaccgagatgaggtggggcgctgtgacgagaggccgacggcgcaggagtgatctatccggcctcgggcaggggaagaggaaggagacgagcgcccggagtccccttccgcgtcctcgctcgtgccggctcctccgacgcgcgcgacgacgaacggcgacggcgaaacagaggggtggcaataatggagtggaggcgatgggaggagaagagagggagggcgcccggggctttaagggcggcaatgtcggtttggaaaccgactttgggcggtcaaggcgcgagctggcgctcggcgctcgtggccaaatcggcgacaggacggagggaggatgatgccggcgggaggaaaaggggaaaaggagggagagaaaggggcttgcctccttgccgctttggaaaaaggaggaggggagcgggggcgtcgcggcagagggaggaggggctctgcctccgtcccttggcggcttgcacgcggagtggcggggccgaggcgatgacaacggcgatgacggcggggcggtgtggagcggagcggcgacacgggcgacaggcgtgggcaggcgctgacgacggcgacgaccaggcggtcggccaccacggcacgcgcgcgcggcttgcacgggagacgcggcggattgagtgccacggctcgggcacgcgcgctggctgcggggccgagcgcggcgcggctgcaggcggcagggcagcgggaccgggtgacgcggacggcgcagacagcgcggcacgggcggcaaccacgcgggcgcgcgcgcgcgaacgacgcgcggggagcggcagcgagggagcggagagg

SEQ ID NO: 52050 - DNA, 3290 bp, Oryza sativa
ggctcgccggccaccccgggggagatgggccgagagggattcggcccatcgaccccggggaggcaaaatagacttttgcggaggaaattgatttggaaggatttggattcggaaatgaactcgacgatagatcggggattgagatcttgagatggcacggacactagacgacaaacaaagaaacaatatcgcaattagggtttttaagagataattttcccgcaaggcgccacgacggaacgggcgctacaagtgcatattttctctttgaaaataaaaaagaagtgaacacaaactgagttttaatgtgttatttatccctagctcaatcgtactaagctgctacaccgggaaagtatttttaacactcgcatgcacctcatgtttcctccagggtacttttcagaattcagattaactgtttctgaaacgacaaattgtgatatttcctcttttttgacacaatcatgctgattcttgtggattcagtatcccccacagagaaaaagaacgacccagaagtccttttctaagaaaagagcatactactgtcagtgagggaaatgctcacctctattaattctgtttagttcgaagcagatcattagaacagtttacagagtggtggcctgtctgttcagatattatttttccttctgcattttgaacagtatattcattctgtagaattagaacatctctctgcattttttagtgtaccatctcttgcttgttacggttcaagctgttttcatgctcaacatcgatcgattccagacaaggagatgaccatttcacagactcacagtgcgtgcaccacgcagagcaaacacactaaggacattgatcgcaagataattcaatcaaccactgcactcgatgatattcttgttttgtgcaggatacatcactgcttgtatacatgaatgtctaatacgaactaggttactccacttgaaccagaataagagaaagatccccatcagaataccagctagctccgagaaagcaagagctgcttaagaaaaatgtcttccaataagaatccattcaatgattcaatcaagatcaaagctgcaaccgtatgcatagcatgatagcatctataccggattcatctcataaagaaagaaaactttagtacatgccaaaaacttgcgcaagttgccgatcttttactccgagaaagagctagaatattctgcgctttttcacaattcagaatagaaaatatatgatgaataaggaattaaggatacgatcacatccaaaacgaatcgcgagatggaactgtagtgcagcgaaagcgccgtatcgaattcagtcggctctttggaagagctaatggctacactctaatgcaacccacaaagagaacataaaaagtgataaaagtgcagctttaataatggggattcaaacaacatgatatattttggggacctttttcgtgacatcacctggcttgtttagatctttcttcagtggatctttcatgtgttgatatatccttgtgtcaaagtaagaaaatgagatgcacgaataaggtcagagcacaagtgcaattctgggtagttaaatttgggaattgtaaaccagccaacccatggctggaaatggaacacgaccggccaaatcgagtagatgacaatctactcttgtccagagatattcttgtgctgccccccttgttcggcggattcaccgctgattcctgtggcagggcgccgtgaaagccacagcgcagcacatgctcttcagtccctctccacctagacactagagacactagactacgacgttaccgtcgcttgagtcggccgaatgcgcctaaatctgctagagtataacatgaagctgaacagctatgggtagattttgacgttggtaactttggtatccactcagttcttcttcgagcaggatcaaagagagccgtgaacctgaacggcatggggctagccattagccaatgttggaaggagaggcgccggcgggggcacgtgcagcggcgcggtgtcgctgaaaccagcggcccacggcgacgcagcgcaggcggcgcggggcggtggtctggctggacgctggtgggtgggtggggtggggtggtggtggcttggcttgcagctccgttggttcgggcgcgcaagcgcaaaccccttgcgcgttcgaaaggccacccgcctcttgcagttttgctccttttttctctcccgcgactcggcagccgatacaaaagctgcgatgcggcagccggcctagccaagccgcggcgtctgtgggtgcttcgcagagagcgattcagatgatcagatctgtgggtggaagcagagagcgagaactaggctactccctccatcccataatatattaacattttacactgtttaaccactcgtcttattaaaaaaaatttgtacaaatataaaaaacaaaaagttatgcttaaagtattttagataataaagtaaatcaataaataaataaataataactctaaattttttttgaacaaaacgaatgatcaaacagtaaaaataaaatgtaacaaaatattaatcccttatattatgggacatagggagtatgttttatgcactgtgacaaagatagtggcttggccggtagtaatagatattttcatgcactgtgaacgtggtaacagggtttacaggcagcgaccaacattttcactgcgagagttcaaaaaactgttcttttcagtaaaagagaaaaaaagaaatgaaggtattgggtttgaaatttaagcgatgaaacggcaattgcgtatcctggaaaattttaaatcagtaaaaacaataagaaggcttgggggtgtaatatactgtacttttagccctgcgtaagatcaatgagatatataagttaactatttctgttaggtagcagatgtgtgacaaactggcttgtgttgctgaaatcagcccagtacagcttgtcttcccagttcccaaaatccaatccaatatatgcaaccaaacaagcttatttgatgttcatttctcaattctcacgttacatatgtataatcaattacttgactgctttaaacctatacatgagaattctggactatgcacatttcgagccctcgaaaccctatgtcagctgattaccttcaaaactttgcgccctatgttggagatcagtaatacctccactcccatttggggtataatggcacgaaaaggaaacaactgtatacatcaaatatacaagctatctagggatctcatgaaaaccactgatttcatcaaggagcaagtaca

SEQ ID NO: 52051 - DNA, 1889 bp, Oryza sativa
tcctgcagcccgactaatagatgagctaaaaaagaaacaaaggtgaaaacaaatgcttatccaagaatttcggacctaaccaaaggtttttcaaggaccagaattcttcgaaaaaaaagcgaagcttctcaaatagttttttcccaggaaataaagaaacactatagctccaatttttatcgatatgaaatagagtatatcctaaaacatcactttttactaataagtcatagctgcttaaaaggcaaaaacataatttcataattgcagtgcaagaaaaatctcaatgacacatacagggcaattttctttgacatcccataaccgtaatgtgctatcagttgatgcagacgcaagctcattggtggacaggaacttcacataagaaacagctttcttgtgcccaccaaaaacatggacaggcgcacttggatttcgcaaatcaaaataatgaatatggtgatcagcagaacccacctgcaataatgtaacatctggtaaggaaaaaaaaacttatatttgatatgagccaagaaaatcaaaggaacatactgcaacatagtggctcgacccaggattatatttgacagagcaaatattggccttcatatcaatattgatggcacttgcttcttgctttgtgcaccacactttgacctagcacaaacagcagtaggttccataaggtatactgcaatacagatacttccatctatgcattcaatgaggttgggatagcctaggtagaaaaatgcaccattatagaaaaagggacatgaaaaactgataaataaaataaaatcctagtatgttgcataacatgcgatatatccaagttatgttttactgtattttgagaactacgcaaagttttcttgctttcgggaataacaaaagtagttgtaccattgaaatttgcaaataccttgcaatcatcactcccagatactagcatcgagggttctgttcgagaaaaatcaacactccatgctctcttttcatgttcttcatactccatcacactctaaagaagattgaatacataaatatcatgaatccaagttcagaaaataacacaagtgtgcaaaatgaactgtggaacagagcaagaaatacctggcgggtttggacatcccaaacagttactataccctcatagtcgctgcctgctataacattttttgagtacttgttccagctaaggcagctgagtttagatctagtagccatttcaacaactggacaatgcacatctgatggttcattaacaacctacgacataagataggccaaatttgagtattttcaaatactatacaggcatatagctatggccaacataagattcctgaaaaaaaacttactgtagaaaactcgaagactttgatgcgctttgagactccagcagtagcaaatagctcatcatcacggtcaaattcgatactgcatttaagaaatatcaatgtgattccctattctcatgtaaggtaggcgactgaaaaacatatgagattacagatagacatggaaatgaaaattatgcaccaaaaaaacaggcacaaacttatagtcatattttgttccttataatacatgataaacatcagcattcaagattagtggatttgtttgctaattgaacatagttgaagtttgactcataggagcaatagaccatcccccctccaaccaaaacctctcctcagctcactgctggcttgaggattcagctatgacaacatccacattgccaatagcatgttgatgcacatgaaataaggcacatattttgtaaaagcactaaccttgatacgatatttgcagagtgaaacagatctccatgtcttagctccgcaattacacgcaagcgactgaagcataaatgacag

SEQ ID NO: 52052 - DNA, 2277 bp, Oryza sativa
caagcgcgcaatgggagaaacaaacctgagcttgaactcgcctcttccgagcaataacgttgcctgattgaataggggcactaggaggatccgagcaagtgagaacatctctcctttgaaatccttgatgactaatttgacctttcaagtcaagcttcttattctgtaaaccccctggatttgatgtactaagtggtccccgagagttgggaggaaagagaccactaggtttatccataggtgagggccacatctttgatgcagcaggttcatccaaaagcatgcggagcttcattgagtacctttcttttgttcgatataattctaacctatgtctctccacagcacttatatcttctttgatgtactgtaggtcagtttgaatctgtgtaaaaaagaggttaacatgattaacaacaatagacatcagtaaaagattatttattgttgtaggtagcaagaaaaaaaacctgcatactgaaaaatacatatagacaaacctcattcagctcttccaacttttgctttctgaggcaatgcaagaagaccagcaatatttgcatatttgtttctgactcttgctgttccatatgccgcttcttctccgcgatcaaagtcataagactatctagttctttaaccgccatatcgtttccctagaaaaagaaagaagaattaaactaaaacatatgatagtgtttggtcatcattcatctattacttatttagagaacgtcagttttatgtttgaattttgaaacagatataaagtcagcaaggtagtgcaaatctatcttctgtggtatacttggtttatcatatggacaatccttgtaacagttaagaggacgatagagatcatgtggctgtaagagcgaaggaacaaaagatactttgatatcggtcacagtagcttagattctacaattgatgcaagagataagcatgttcagtgtagaacttaattactactctgtactacttagttctgaactgaagatcacaagcacagctaaggtacggaagcaaaattttcacagtacataaaaccatttaggaacataccactatgtttaaggagctattgaaagtagacattttcaaaagtaaaacatgtgaagtgactgacctgttgcagtgcatatcgaaattggtctatcggtgatgctgtcttcgcaatttggcgagctgacattttcttcaagacctatgcagacataaatgtgataaacatgcttagagatacatttatacaatcccagtatcaagtaaccagtaattacagcttgttttaagttttaacagaactagagaagaactctagtgatgaacaaattatataataggtactgataaccagagcagacatagaactaatactgtccactgctggtgattctaaacaaaacttacattaacaacaaactgtaatgtaccgtgcaagtcaaataaaactgagctatccaatcagaacacctgctactacttcagaagctaccacaaacagtagtacaataaatcgcagctcaagcgctgaatactgttgaatagttgctacaaacgaatcgaaaggcatactgttgaatagttgctacatttgttaaaattggttataccggatacctatcccaagccacatccaaaggtacattcagtgacatttcaattttttttttttgcggggcagtgacatttcaattacaaagccctgcgtttgaaattaggataggcatccaaaattcccaatcgatcggcggaatatggaagccacggccaatccattatccatctcggctgtgtaagcagaacgagcaagcaaaccttgtcgaggaggaagttggggtagagctgcgccttggtgaggtagttgccgcagcaggggcagtcgctcttgtggctgagatgcgtgacgatgcacatgtagcagaagctgtggccgcaggcggtgaggaaggcgtccttgatgaccgccatgcagatcgggcagaggaggtccctgtcggccgcggcctccccgttgccccccgcggaggcgcgcgcccccgcatcctcctccccctcccccgccaccgccaacgccgccgtggacgcgtcccccgacggcgcctgctcctgcttcggcaccgatggcaccagcgcgccggccaccgtcgagtcacccatgcggcaggaggaggccgccctgcggtggtgagtcgagcaggcggcggcggtggaggcggcgactgggcgtgaataattgcatacgaggggtgggtggtggtggtggtggtgtgg

SEQ ID NO: 52053 - DNA, 7187 bp, Oryza sativa
  unsure (1)..(7187): unsure at all n locations
aacgcgtgctttcgatttgcgcatttaatccgagtagtttggtttgcttaatccgtgcgaggaatttggcaggtcgggacggacgcgtcgcgaagcgaccgggggagtggttagagtcccaattgtcctcataaatgaaaaccaaaaattaaaatttcaaacttgagaattttaggtcgctaaaacatctctgtaaattactactaccttcatattttaatatatgacgctgttgactttttatctaacgtttgatcattcgtcttattcacaaagtttatgtaattatcgtttattttattgtgacttgatccatcatcaaatgttttttaagcatgacataaatattttcacattatcacaaaaaatttgaataaaacgaatagtcaaatattgataaaaaaagtcaacggcaccatacattaaaatacaatacggagggagtactttaatttaggtaaccgatgagtaaccttagtttcagacgtgctgggtccggttgttatgtgggttacaaaacagcgctgcattgaacaagtgggtgtggtgaaatggatgttctgttagaaaattcttgtaagagaagatcatgcgtgtttctgggatcattctccgtgtaaaaaatgcatcatctccatggccaaattggccactggatgctatcactgacccggtgcgtgagcccgtggccaccacacgaattctgtacggctgtaccgtattacaggcaagggtttatatttccaatcgaggtcccgctcctgaccctgtcagtataacggttttcacgaaaaccgtcaaatttcaaacaaaattaagaagccaaattctcaagttccatttgcccgtcaatgaaaaatgatcaaaatcaccgaattccaaccggaactaccaggatttcagttgattcgaacaggaaaccaccgttccagtgttttggaaaccaaacaaaagcatctaaaactcattggatttgctgaaaagccaaagagtagcgtgggaattaattgtgttttctgaatatttggataataggggaaaatgtttgaaatatgagaaaattcatggagatgataggaacattgcaaactaaaaggatatcaaaatggggaaaccgtggaaacgtgggaaaatgtaagaaattaataaagaaattcagcatgacctttcctacaatttgacaacctcacattgagaataagcgcaatgtatattcatgaacacaaatacaagataatttgaagtccatatcattgacaattaaatatgcataaccaaatatatgttacgccattaacatcaacacgcataatataaagtacatcaacacaatacaaagtacacccacaatcaatacatactgtaaagtgcataaacaacatagtataacaacaatacaaagtccataatataaagtgcatacacaatcaacacatattgtaaacccttctagatgtcttttttcaatttaccaattcagttgttgtccaaagagcattttcattctacgcctatattttttgacatttcatatgcatgtatttactacaaatgtaggactatttacaagttatttttaaaatattcttcataaattttcaattcaaatttgaaaaattctgaaacgattcaaaaattccaacagaatttgctttcgcgctgcgttgaaacgtcagagttgtgaagtgtgaaccctaatctatctgatcaaagccttctttttttttggattgatttcatccaggagagatgtcagctagacagagacgatcactgatcacgcgacaagttgccatatcagagacctcaggctagggcaacacactgccagcactaacccatacttaacgaggactggggttcagtttataaaggagtcaagagttcaggactgattcgatgaccgatttcagtcttgctacattctatcactgtctggaatgataagacaaaccaaaaacgaaatttcaatgttttatactacatcctatcgatctatctgaactgagaagagacgctgactgaattgcctagacaagaacatagaacatccaactccatcactaagaagcaaaattttgcaggtaatgcctgttcacgatatagtttgcaggtaatgaccaggtacactttcttatgccatggtaaggaacgccgagctactactgttcacttcagttcagctcacctagtcactcgaccagctcagcgagcaccttggtcacctccttggtcaggtcgccacggcgcagcaccaccgaaatctcggcaatcctctgcttcttgatcttcatgtccagcgcatgcgccttgtcgtcatcgagcttcccgaagtccctcttgaacaagccagggtgtgccgcctccagcaacttgacctcctcagcgaggtgcgggtacagctcgcacatctcgccgaactccctcggcgcggtggtggtgccgttcaccgccgccgctgccgcctcgctgccccagacgctcttggagaggtcatagagccggcggtcatggcccttgcttgggagatcgcccttcttcttagcggtggattcgtaacggcgcttgagagtgctgaccttcccctggagctccttgcggccgtagccagtgttgtcgaggctgccggcgagggtggcgatgagcgcgtcggtctgtggcagcgacccgtgctcccggcggtgcgccgcgagcgcctcgaggatgcgcacctcgtcctcggtcgaccagatgcggtggaaggcctgcctcttgggcgacgagaccttcgggccattcccctccgccccctgcttcggagccggattcggcggcggcggcggcggcgcctccgccttctcggattcggacgactcgtcctcttcctcatcggacgaatcatcctcctcgcgattctcctgcggtggatccctgctcttggtagcggaggagcgcaccaagtcctcctcctcctcctcctccgattcctcctccccggaagaatcggactccgcgcccttgttagagaccacgggtgcgggctgagcaaggggactctcctcctcctcctcctccgactcgtccgagtccgagccggaggcggtttcctctgaggaggcaaccggaggcggcggcggcggcggagtggggcgcttcggggccatcgccggagctagggtttggagggcggaggcagaggtgggtggcggtcctggcggcgccggtctcgggacttctccgtgcggcgtgatattggattagcttgtagggcttgttggggtcttgggggttacatcgaccgttggatttcggtgcgtagcccgcatccaccgttcattttccgatcgtccattttttgatcgtgatcggatggcttattgggctaaagattttatgggccggcattttagttcaaaatcgaggcctacacatgtacgtgggccgggattaaagcccatctaaacatggtctgagctgggagtgtgtggaccagggtttacaattccgacagacgcttccgtttcgggcaccggtggaattcggaatttcgcgaaatccggtggaaaactggtaaattccgaacaaatttcataaaccaaaatttgaatacaaattccctgagtttgccgacaagttcttgaaaaccgatcggttttggtgaaattccgatcgaaatcatcaaaatttcgataagtaatccggcccatctaagtgttttccttttttaattctttattcttttctttcctgatgtaagtttcagtaaatacacacaatatatcattttttttcaaaaaaattatatcccaataggttctatgaatatcatattatttataagattttatttgattttttccttttttatcaattcaaatttaaatttggatgaaactcttcgaaatctcagacggtttctacttttgagcctcatcgaaacgtcacaatttcgcgaaatccgacaggatttcatcggaatcgtaaaccctggcgtggacgatcgcgggatccgacgggagaacgcgcgaaccagacaggtggccgttgggcctattctctgttcaggctttgatccaaataatctgcaaatttgaatctgaattgtttgtcgccctatcgacttgaactccatgaagatcttatcttgaagtctgaggatgcagtccaatgatgcccttcacttcatgtttttattccttcttgttaagatttccccaggattcatctggactcgatggataatttttccttttttctcctcctaaatttgatgctccttttggctagggctcagaagtcaggacacaggagactggggtagcgagtattcagtgcaatccatcctgttaacaggtaatttttgcaccaaaagaagatcttttgttgttgcacataagcacattcctgtcagatttcaaaacgagtacaagatcctaaatttcagcatctaggaagtaatatgttagcgatgcagtaatttcacgtatccagcttccaaattttgtcagaatctgcgagactgcgactactgtatctctgcagtacaaaaaaaaaagaggaaggccttgtattttgatggatacttttatgaggataatgatggttctaacattattctctgatgaattgtttcaatagcaacattacaatatgttgctaggtagacagcatggttacagatcgggaccggatatgaaaaaacattcggttcggttaacactgtgaggccgtcaggtgcatcaagctggatgtgtcaaacagctccatgaatctctgatcagtacttctcgccttcgccgctgcaaaatgctggtactcgtcgaaaactgaagttaggcaccatttctgcaactttctcaggcacccaacgacgcagccagtccggtgctgaaacatgtggaatatcaggaaaccgtcgaattcccatgtagcaaaaggtttcaagaaaatgggatatcagggatgtgcaatgctaaatagatatagctaccttgcctctcttgcagtggatgagcaccggttgattccttacgtctgaattgatcaaaacgataagagttagatacagatagtgtgatgaaattttgagacattggatatatctttgtagaggcagataccaagaataactttgagtgcttctcggattttttcttcagggatgtttacaagcagctcctgtaacagcaaggttcagattattgtcaggctatgcatcaactttaagagtcaacaggattgaagagaatggtcagttggatgcatactgaattactgatgatatggtatagcaatagaaggatgttttaatttgtttcacagtttcaggctaatgcggtaactgataaggttcacctttatcgaaagttcagatgcaaagatatcgtcatgccactcaagtatgtactacattattggttctagttaacaaagaaacaagcttagaccctgtttagatgggactaaaactttttagtccatatcacatcgtatgtttggacactaattataaatattaaacatagactattaataaaacctattatatgaccccggactaattcgcgagacgaatctattaaacctaattaattcataattagcctatgtgatgctacagtaaacatgcgctaattatggattaattaggcttaaaaattttgtcacgcgaattagctctcatttatgtaattagttttataagtagtctatgtttaatactctaaattcatccgatatgacaggagctaaagtttagtccttgatccaaacaccaccgtacaatccatctagcagtgaccatcctagaatccatctagcagtgacacaattattaccggtgaccctcgtaattcagtggtttcagacacctagcttgagtccggcgaaaaagaagcatcatctccagacaatgtcaaagtgagcactaatttccattcacacacttgtagtaaggtcagccacctgatcagtgtcttttcactcagcgatatatttcttttttgctgggaatgctaaagttggtcagcacatctgtgttgtttatcatcgacagcaacaatcgccaatgaacgatgaaagtttttttttgtttgaaggtcccaacttaactcactcgattttcacatgcacatttttttaattactgaacggtgttttttttaacaaaaatctatatgaaatctatatgaaagttaatttaaattttatattcatattaattttatttttttaaaaaaactaaaacttaattaatcatacgttaatgagttatgtcattttgcatgaactagggatgaatacctaacccaagcaacgacctcagccttaagtcgccgacgctgaccaactttgaccatttgccgtggcagttcatgccttcatgaacccagaactgacagtggaatatgttctcattgttgcagacttgcggtggatgctaccacgcgatgacacgagtactaaagttgcgagatggagtaatataccgacatactccaaggctactatgcgtctatgcctaaatgaacttttaatatggacagcttgacaaaaccgtactaatggctttcagtgaaggactagtaaaatgagaataaatatggcatggcacacagagaaatggtaatcttgggtggctggttaataacggaattaaagtcatggccaacaaatttatgaaagaattacgctggtcagacgtcactcgacagttaaaagacaggtgcgattatactataagtcaacttgatcctctttttttttcacataagttctcttaaaaaaaataatgggcataagtcaacttgatctttgtttaggcacccaattcacagaggagactccacaagcccatcatttctcagctactccctccgtctttctagattcaaatttaggattagttttttttttgatagagggagtagaacttgtgctgtactgcatcactgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 52054 - DNA, 2518 bp, Oryza sativa
aaaaaatggtatctcatggtaccaaatgctaccatccaaaagctaacataacccccacataaaagtcatgtgattctcccagcaaaaaagaaaaaaaaaccataaaatctcactcgatggatccatgatccgtctcgcgattaattactgcatcctcctgctgctgctggtgtgcctgtgcctgcctcacctcacctgcagtgcaacaacccaatccgggcctgcactggcagcaatcagggggaggatggaatttttcgcgcttctcgaggggcaaagcgaactgaattttgcagctgcctgtgatgcccattccatccaaattccccctgatccacgcgatgttactgttactgtatcccctctaatttcttaattagtacacggaattgcatgcagtgtgtccatcagaattacatgttaatctatgcaattctgcagctgttactacaggctgatctccacttgtaacccttctcctactacctgatctctgaatgcagattactgcagtatattttcaagtgaattcatgcaatgttatgtcggagtgattagctagctaggaggtagtagcatggtggatagtagagttatatgggaaactattctaatccctcgaagggatgttccctcgtttacctaaaaaccatctaaacggttatgaaaaattctggaaaaatttaacaacattcatacaacacatatatacaactccacaaaatcttaattccaaactcaactcacacgtcgagatataaaaaagacaaattcaacatatgaatagtagcgtactgtttatatctaaatttgtcttttttgtttctcgatgtgtagatcgaatttgaacttgaattttggtggattagtaggtatcattatactctacattgtcaattttttttcagatttttttataactatttgtatcgaatttgaaaaaaaaagatatatgaggggatattatccccctcgaatcccctcgagggattagaatccattcccagttatatggatcacatgactctcaatgatggagaggccggcctgggctggctggctggccctgcctgacccacgctgggctgtgcagatccagacccttcctgccctccgaggggaccaaccagatctcccacagatattcgcctcgctgtattctcctacctacacacatcaacctgacctagctagctcgctactgctacctccgtcccaaaataccacacagttatatttagataaaatcaattattttttcagtttcatatcataagtcgtttgattttttttcttagttattttttaaaaagtttgactaagtttgtagcaaaataaagtaacattttcaatacaaaacaaacattgtattaaaatatattcaacattaagtttaatggaactaattttgtgtcgtaaataatttttttataaacttggtcaacctaaaaattttcgaccgaaaaaagtcaaaagactcataatatgaaacagtgggagtacttcatcattctcgccctcacctagcaaaaagtaaaggcgaggagagggagaaactacgtactggttcatgcgtgcaacccaaaaggtaaaatgatcatgttatcctactataagtcgtagtgctagaaaggtacgcacttgaaaagttgagagcccaggtagatcagatttggttgctgctgtgttggttgtggtaatattgacagtccaaataatgtagtacttgcattgctgctcggttcctagtagctatttatatgtgtcacatgcatgcatgcgggctactagcaaaggcatctgattctaaaaggaagcaagacacaaggaggctacgacattaatgtatgtgctactgctagctatatatgaagttgtcatggttgagtgagtggtcatgagctagctagatagatggctagctcgtcgatcagctgcatggtagctaggaggaggggagcttggcgatgaacgcgtcgaccttgatgttggtggtccgggagaggaatttcatgcagatgggaggcttgacaccggcgagggcgagcaccgactgcggcagcgtccagatgccgtcgccgcagatgaggcccgacgcgacggggggagcgaacgccttggccctggcgccgtcgaggcggtcccagacgaagcggatgaggctgccgatgcacatgtcgatgccgaagtaggggccgaggtagaaggggatcgccatggccatcggcagcgggaggaacctcgccaccttgggcgccgcgaggtccctggcgaggttgacggcgatggcggcgacgaagaagccgatgcagaggtcgaggcagtgcttgggcagcgagccgaggccctgcaccccgaggatggccatgttccggtacaccagcgcgttcggcgacgggtactccgaccccggcatcccgatgtcgtggaacgccttgtagaagagccagaacaccgacggcgcgatcacgcaccccatggcggtgccgatcacctggctcacgaacatggaccgcgg

SEQ ID NO: 52055 - DNA, 3486 bp, Oryza sativa
cagcccgtcgccgaggatgagtgaaatggagatgaacacctgcatcgatcgaatcacaattactccattgatcatgcaacagatgatcatttgcaagaagctcgttctacccggtagccgacgatgccgcggaggctgctgggtttgaggtcagcaggataccagtcacccttcttgtgctcgatgagaggccacatgattccccacgacatgacgcctccgaggagcacggagatgttgacgaggtaagggcagatcatcccgacgccgacgtacgtcgcagagaaatcgaagaagaacctgcagcaagaaaccaactgaagaattcagttaactgttgttgactgtccagtgtggcgagcatctgtatgtttcaagctagcatgacatttgtctatttcttttattcaaaatacttgtattattattgtttattttattattacttgttttatcatcaaagaaatgtaactttaacttatatttttaaataatgtattatacgaaatattaacgacgtcgtgtataaaaaaacaaagacaatacttgtttctgtaggcctcgagacccagcgtcgggaacgacatgaacccgcaaccgtcgccgccggtgtagaaccactggaagaagccccaggagaagctcatcacgaagaatttgcccagcattttgacctgcatcctgcaggaaaatgattcagaattcagacaagagtcttatttgttctctgtattcaccacatgtacatatctttagcaaactttcttatctgaaaaaaaaaccgtacttggcaagctttgcaccctggggagtgtggaagctgttgatgagatgtgcggttgcagtgccactcgggtatatgagcttgtaatcgatgatcattatctgacagagaaaaattaacatcatggttcaattaatttaactatgtccttcaaagaaatcatatatctctgaattttaggagaaactgtaacagctgagctgatgaaatgtactaagtaccttcctgagtggcacaactgagaagaggcccaggaagctgacaatgaagaggaatccaatcatccagcccaagctggggttcttgatgttgtgctcgtccctggcctcgcctgactggtcgctgatcctgtcgctcatcgcgaatatgtagctgccaaaaccccctgtaccaccagtgcatagatcagcatctgaaaccatcaccaccctgacaccaagcagagaacgtagtgcacagtgctctctgtggatgtactactgataacagggagagcagtgataaaagtctaggacgtgaagaacggaacatgtatgcttatagtaacaaggtgcttaaagaaagataagtttttttttgttagtaaggatgcaaattaccaagtgctaggggaaacaacacgaggaatgagtctccaatcaaatcatttctttgtaggtgctttcccatgggccatggctagttggctacattatcctctgtatttaaatgcagcaatcatttttttttgctaagcaccgtatttgtcctacgtggcaattagaagtacacctatgttgtgtactcccttcgtcccaccaaaaaacaacctaatattagataagacatttcgtaatataatgaatctggacattagtctttttttagacggaggaagtatgctcaataggccagtttccaatggtgtgctaaaaacatcattttggttggaaattcaaacacctgaactttaagaaaggcaagcacagaacaagaaaaagaatccagaaaaaacctaagatcaaaattcatgctacacaccgaaatggaattgtggcctgtgggccttgatatacatccaaaaaggaggccatcgaggcctaatttacggcccaaacaagtgatccgtcgccattcgattcgacgcaaaatttgcatcgcgcaatcactgaatcgtgcagcgagcgagcgatccgatccgcggcgagtgcgaagaatggcagcggggaaaccgtaccgctgaaggcgatgccggagcaggcgacgacgcaggtctggacgacggtgttctcctggcgggtgaaggggcggacgctggcgacgccggccttgtcgaggagcttggtccacgacgtgaggaggaagaagccgaggagccccgcggagacgttgagcgaggggatgatccccgtcgtcaggttcagcttcatcacgatcacgctgaacatggcgcccagcagcgcgctcaccgccagcgcccgcagcgtcacctgctccttccaccccggcaccaccctcccctcgaacacccgctccaccgacaccaccgccgcctcctcctcctgatctctacgctccctcccgctcctcgccatggcccgcgaattgagctctcgctctcgctctctctctcgatcgatcgcggttgcgaggtgtggaggcgaaggcgaaggcgcgcgtgtttccggggagttaagagttgtcgtctgggccccacatgtcagtagtactggttgtccgctacgaggggatgacatgtggggtcactgatgagtttcacttgggttcagtttgctagtgccacgtggcagggataggggcttttccgtcgggatccgcttctatcggcgagtgtcaccccgtctcttgatcgtcttcccgtcaacgtagcactagctcgcggttaaatttggcaaatcaaccgcttgatgatagatacgagcccggaatttgacgaccaaatgcccaaaatttcacgaaacatcgtcacacggacacgtacgtagtgcaaaatcacatggcaaccaaaaaattaccctggcaaaaatgggtgaaaatttttagcgtgtcacatcagatatactgacacatatttaaagtattaaacgtagtctaataacaaataaattacataatccacatgtaaactgcgagatgaatttattaagcctaattaatatatcattagcaaatatttactgtaacaccacattgttaaatcatggaacaatttggtttaaaagattcgtctcgcaatttatacacaaactgtgtaattagtttttttcgtctaatatttaatacttcgtacatgccttaaaaaaaatttatcggtggatctaaacacccccccccccccttcccccaatcaaacaggccatggctggtggtgctgatatatcgacagaaacatgccatgccatgacaatgcggaatgcatcagcctctgcctgcaccagacatttctgctctgtgactctgtccgagtgaagaagacgacgacgacgctaaaaagcaagtgccacatctgctggctagatgccgctacattttactgttgcgtttggtgttggtgcccgtggtgggccccatctccttggcgatattccggagcacgtacttctggatcttcccggtggacgtcttcggtaactcgtcgcggaagatcaccgtctttgggaccatgtaccgcggcatgcgctcccggctccacgcgaccacgt

SEQ ID NO: 52056 - DNA, 1109 bp, Oryza sativa
tgcatctcgtacatcgccggcacgttcggcagcagcacggacacctgactcaatccagcttaccttagcaacacgagtaaggtgtttgacgaaatgaccgtggaaggaaaaaggatcgatggatgctcacaacgtcagccgcggcagatgccgagggagtagacgagcgcggaggcgaggcggaggcaccggcggtgggtctgcgaccacgtgaagacggtgtcgtggtagacgacggacgggcagtccccgaacacggtggcggcgcgctccaggaagcccaccggcgtgagcgcgcacgagttggccgggttggcgccgagcttgtccatggccgccgcgtcgatcgccggagcacgagctgtcgcctgtgtgaacgccggtgactccagctatcgcggggtggttggagtggaggcgaggaaagagcgagtgaggaggctgcggtgatataaaaccagtttgctattgaccagatgacttattctccgaatctcagtcaccttgattcctgcccgttggatcgagatcaacggctaaggatagggcaacagcgagtgaaatttacgctggtcaactatgtcaaataaggaggaatggatttagtagtaatatatggagtacagtatatagtactaatttccaattgcatttataaagaaatcagtggtcttccatttaaataaaaagaaatttatccatataaattggcagcagcttcgtttgatggggacggccacgatcagttgcaggcgcaatctggatacacggaatgtatccttccttagtcccagaagtagatagaaaaaacaaacgtatcgattataacacattaataatgtgaatctaaacttactactacctccgtctcaaaataagtgcagccgtagaaatccgtatccaacgtttaaccgtccgttttatttgaaaaatttatgattttttttaaaaaatttagccacacttaaaagtactatttatgttttatcatctaataacaataaaaatagtaattataaaaaaattttaaataaaatgaacggttaaacgttggagatgaatagtataaaactgcacttattttaatatggagggagtactgtgttaaa

SEQ ID NO: 52057 - DNA, 4197 bp, Oryza sativa
aaggatctgctcagagatttgcttacctcgaagcagattcttcaaaagagaccctgcattgcatgtggcctctcagccctgatgtcgttggaatgtacagtgctaattccagattatgaaaagagatctgaagaaaataaaaatctgagagagagagatgcattcagattggttagcaactgttaggtcaggtacaggaactgttctgatttcttgcgattttctggaacgtcaaagttggagagcctggattggacgtgttggttcgttggaatagtttttggtttgcttgcgaggaaaagtccacgaaaacactgtgcgatatgccatgccatgtttttttgcttgatcgcttcagctgtgtgtgtgagcacgtctgactttgaccttgatttgtttactggttaaaaacgatgtactcaaacatttttatttcttttgtccatctccgtttgattgctacgcatggacgtttcacttgtgtagataaatcaaacattttttttccctggacgacaggtcgtctctcgtctgctcctcgttgcatctctacactcaaaatctaacctgcacgtactccaaatcctgattgatagtgaaatcgcttttctttgggtctaaattcgtgttgaattagtactagcttaaacggcacgaatggaatcagcttgatgagaaactttccttttctcttgacgacattgcattgattgcattgcacggttaagacggtcactaaactcttccggccgggcaccattaatttcaccagtcaccactgctccaactgaacgtcacatgaccaatcggctacagtagcagtatcttaaatgcgttaatggaaaaatgtataagggcaagtataagcctctgcatgttgcccctaaatttaccacataaggcactgtttagattctctaaaatagtaaaagttttgtcattttatagcactttttgccattttggatctaaacactagtagcaaaagttggcaatttggtatttggcatttgctagtacatagtagcaaattgtgccaaaaagtgctttgggaccactccctctctctttctctctctcactttagtgctagaatgacaaaactttaacatgcatctaaacaccaactagtacttttgtaatgccaaaacttttgccaccaagacttttgccatttgccatttgccattccaaatggatctaaacatgccctaagattaggtgatgagttggaggagagaagttaggagagagagaaaatgagccacctctcatgtaaggggcaacctccacacaatctccaagaaaaatataagatgatgtgagagtaaattaatgttggggtttgtgaactataggtggcatgttgtacttgttacctcttaattaatgagaatatgacatggtttaaattagatatggcactcacctccattataaaaatttccctaagggcacccacaatggttatctataagctctctacaagagatacatgtcagcatattttcctacttggaagagattaaatgaagagagagagtaaaactatctactaatctggggatagtctatagagaaaaacgaggcaatggattagagagctatagatacccatgtagacatactattgaggtggtttactattaatctaatctattgctgagatgtacatattttatagagagcaccttattttaccattgcgggtggtctaatactacctccgccccaatataaatgtagttgtcgtttttgtgtccaatgtttaattgttcgtcttatttaagaaatttatgaaaagattagaaaaaataagtcatgcataaagtattatttatattttatcatctaataacaataaaaataccaatcataaaaaatttttaaacaagataaacggtaaaacgttgaatacggaaactcctaactacaattaaaataaaacggagatagtagttcgtcatatctcgtcctagatcagtttttctctagacggagatcgagcgtactggcgattccgattctctacgggaaaaacccaaccaaacgcatcgatcgcgcgtacggggagagttgatggccgaggccgtatgcagatacgagacagcgacgggcgcacgcaacacggcccgggtgggtcgtgtagcgtgcgtgcgagagtgcgtcgcggcgcgtgtggggacccgacgggatcgtatcccgtgtgtggtacgtggtgtacggggggaggtgggggcgttgtacttaaactaagctagtaaaccctgtgtgctttggttcagttgctacttgccagttgccactgccacggccgctgcttctcgtgggatcctctttttaacaactggtccatcccctaagctaggagtacttaattatggtgtacgtgaagcggttcctctgacgtgaactaaccgataacgtggtcattgataggtcggcccataagcggtgggcctaacctgtcagtgaccacgttcctctgatttcatgtcatacgatcccaatcagatgtacgtttaggtctatacattgccacctgaagctacctctctaactatgtgtattgatgtgtatattatatagtactagtagatattgtttcggagagtgaattttaaactctcgagaaacgttcactcgttttttcatgtcactcaagtagttataaaataaattaagaagatgtatagcatataatcactctgcaaatatgcaagttgaaattcaaattttacatgttaaaaaaaattaaactacaactagttaatgtatattcgcaattaaatttatttttcctcgaaaaaaatgttttttcattgtaacatgtagaagttaattttacatttcatgtttgtggaatgatctgtcacatgttaatctatcttgttgattttctaaaaaaaatataaccatttgagtgatatgcaaacaacgaggaaatatctcctcgagagtttaaaatagtttcccaattattttgtcattactttttctaactactttagcagggtgtgtttgattaccagtcatactttgcagctaaaagtatggcgtggcaaaatgtagctaggaaccaaacacctccacggtattttccatgtgcagtggtgaatccagaaaacaaactagataaagctacaatcatctctctcatctatgtatggtaaaaaaaatagcggtgagggcttcaccagggctcttagagtcttcacgctaatagtggagactcgagaccccgctaccatatactggatccgctcctgctcgcgtgaagttctaatatttgtatatttaagtttttgaggtttaacggcacgtattttacaacgtcatttatttgtaaacggaagcactcctgtacgaaaaacaggtgcagcacatggtcacattgcatttaccagatgggagtacattagtagatgaaaatgaatgacgacctcgcattcgcgtagaatggacgacacaagcagagctgtcaggttgtgtacagtgtatgcaaattgagaaccccagatgtcgtacatgaagtttaccctgtcgtccacagtaggccatagacgtgtccggtgcaactaggcacgtgctacggttgaggcctccatgactgaacatcgttgcatggccagaccatgggcgttggcgttggcgttggcatggctgtcatcccatggagaagcatccaaatctcggggattacgggaaagggatcacgacgagcgaggcaaaccgcgcatacaatcgagagggcagaggcgacaagcgagaagaaccgagacctggggctacctgccgtcaggtggaaccaaatactccaatcccagccccaggtcatgcaaaacggcaggcagccatccacattccaccaggctacggtggtgttcttttctcttaaaaataaaaataaagatcaatctacttatgtaaaataagttggtattaacgtataattaattaagttttaattattataaacttaaaaagtatattcatatgatattttagaataactttcatataaaaagttttcgcacgaaacacactatttatcagtttaaaaaacgtgtcatgaaaatttttatcttcatccaaaactctatagaaatgaactggacagctctctcgtatttggcatatccacgagggaaacgtgggcgtggaaaccatgagcgctcgcggatcgctcgcgcgggt

SEQ ID NO: 52058 - DNA, 1261 bp, Oryza sativa
ccatgtcgttttctactgcccccggtttgagctgatgagacaacgtgcatggttgtgtgtcaagtttcagcaaagcatctggactctggatggactaacacgttgcgatgcctgatgcgtacgtacgctgcgattctggagttgtaacgcttacgctgcggttctggagtattacatgtcactctctggctgcacacacggcgactgacgtgccggttttctgcaagctctagaagcatggagtatctgtctaattatttgcaggcaaccacctgctgtacaaaaaatactacagccacggtaggtatcgtgcgagacgtgtaccctttcacctgctcatcacgggctttaaatactcactctgtacgtaggtgcggcactcatcgaattaaaagaggggacatgtctctagcacgggaatttcttaggatctaagggttggtgacaggcctacgagcaaaatctaagaggacaaagggatcccagatgaggaaggacgatctggctttatggtatttaaaaaacttgaaaggccaggacggttgttaagcaattcttcagatctaacaaagcgaccaaaatggcgcccaagcgctacgcaaagtagctgcacatacgacaaccgaaacaatttagatgtttcggtgcggcattagataccatataagaactgcgtaattacattagcattttgatcggccatatataatttaaggtcgtacaaaattttggccgaattcgatggtccttgcaacaagtaccttcaaagctgaggtggttgtcaggcagacagaccacatgatgtcttcatatggtctagagttgccaatcaatggcagatagtcccagcctctccaagatctgattcgttttagaaaagtgcctgtttaagataagcacagcacaacgatcatcaataaaactttatcctactgcaggttgattcagcgataatcacaagggcaaatgtagcattagaatgatttggattggccccataaacagtatgtgagatgccaatatcccattcacgttctatatgttgtgcctgagttaatgcgtcatttggctgtagccattaactctagtgagtgtaaaggcaaaagtaatatcaagttggcacaatcaagacagggcaagacggcaatgagcatgagggtttatagcagtatagcaccactcagcatggaccgacagtaccattgtatagtggtgcaggtgagttaaagttgattttaggataaatcattataacccaccc

SEQ ID NO: 52059 - DNA, 3424 bp, Oryza sativa
ctcagccaaatgcagtggtttggtgctttttctaccagctgttactactatctgtgtgtcaaggttgccacatatgagaacacagtgcaattcgcacccttttgcagatgtggaatccagtaaaaacttgggaaaaccgtggcaactgttcacctacctatgtaattttgcggcttcatacatactgtatgtataccatgaggaactttgtgaagaaaatctctcttaccgacttcaccagttgaaacagacacattaatgaaacaatcagcttattatggctcagattttttttttttggcgagcgaaatgaaacaaaacattaatgcacgaataattaagtattatctttgttgtaaaatataataacatttgattatctaggtagacaaacccttgtatagagccggatgtgttaatgtattactccttccgtcccataatataagagattttaaggtttagcttgcactgtttgacttctcgtcttatttaaaaaaatttagaattattttttgtcacttactttattatctaaagtattttaagcacaactttttgttttttatatttgcacaaattttttgaataagacaagtggtcaaaagatgtaaaaaaaactcaaaatctcttatattataggatggagggagtacaaacttgaaattttagattcatttatttttctaaaaaaaacttttatataaaaagtattttgtataaatcgcatcatttaatactttagaagatgtggttacgatgaatgggggaatcatagctagggagtagcttagccgagccgtacaaacaaccagcgtgagagaacgagcaacctggcaccaacggcgatcgaaccgcggccgcacgtacggcgaaaatgtcagcggcgcggcccgcatgggccaccacggcgtgggcgcgagccgcgaggttggcttgccgagaggcgcaaggaggcgctggccttggcgacgacgatgacgacgaggacgccgtggcgcactcaaccgcgcaggcgatcgaggtcaagcaccacccgcccacgcccacgcgcgcgcacgcacagtacagtagtcgcgcacacatcgcccatgtgtgcggtggtcggagccgtcacgcaagcgatctcgcgggcacgcacatgcggcgcggggcacacaggtttgccgtcgcggcaagcggaagaaggtcgcgccggggcagggtcaggtgaaggtcaggtcggccgctgctgtcgcggtagcccgcccggccccgacagagcacggcgcttgccgatacacttccgctactcccgatggggacgccatgctttgtccttggtgtcaccacactgtccctccttggtgcgagatagggtaggagtactacaatacgggagtcgcgtgcttgctcggattctcgaacgtactagggctacagtatctttttacacgcatccggtgccagcgaggagggctcggtgcatctcacaccgttggatccgatacgatcgtactgcctgccaggctgccactggccagtgcatcgtctacatacaacggctgtgtacgggctccatctcaaaatacaacaatataagattagatgagacatttcctagtcctatagctcgtccatatttatggtactaagaattatctcatctgattttatattcttatattttaggatggagggagtagtagttcttcagaatgtgtttgttttagctttctccagaagccgggtaatcaatatttagcctgttataaaaaagaaaactagttcttgttcgctttgctctgcgttctgcactgggccgttggctagtagggccgcaacttccactacaacaattaggcccaggatacgcccatcagctcagagcctgagaagtgagaaccaagttagcagttggcagttgattggcacgtcggtcaaacgaggcaaccaatcgccgagtcatactagacatgcaagaatgcaagattgcagctacgccaatgcggcccacgtagtcgcaatctccactattccctccctggctgaagactccaaaaccgccgccgcctcctcctcctgggacctgggctcctggcttgccgctcgaccatccgcgctctttacctgctattaattcgctctccgccctctgcattgcaccatctcgcgatcggtaatgacgacgacgaaccacctcgtctcccccgcgctgctgctgcttctcgccctcctcggcgcatcggtccggcgtgccggcgccaccaccttcgaggtcggtggggaacacggctgggccgtgccgccggccaaagacgccggcgtgtacaacgactgggcgtgcaagaaccgcttcctcgtcggcgacagcgtccgtaagatcactcgatcgatcgatcaatctccatttcgaataattctgtcggcaatgaacagggaaagtgatttcatctctagaggggatattcatcgtttcgtgcatgccacctaaatagtcatcgaaaattaaaaaattttgacaaaatatattaatatgaaatatattacatcataaacatttaagtttaaattcaacttctaccggttgtaataaaaataacaagtacgcgacattgatttgcatttgatgcagatttcaagtacgcgaaggactcggtgatggtagtgacggaagacgactacaacaagtgcaaggcggagcacccgatcttcttctccaacaacggcgacacggaggtggggctggaccggcagggcctcttctacttcatcagcggcgtcgccggccactgcgagcgtgggcagaggatggtcatcaaggtcatcggccacgacgcgcctccgccggccagcccgccgccgccgccgtcgaacgctccccctacaccgcctcaccccagcggcgccgcctccgcgctaggcgccggcggactcgccgtcgcggccatgctgctgccggtcttcgtgtacggtgtctgatggtcaccgtagctgcatgcacctgcgtgcatgcccgatcgaattgatatcgtcttgtagattgtcaggtctttgcgagtgttatgcttagtgatttttgacgtgctcgttcattgcaatctcgtgtaattcttacttagattttttttttgtatttggaattgactttggataatttatttgtgactttgctgaatgttgcatcccaaaccttcagtttgcactcgcatttttctcccgtggaaaaccgcgcctctcgttgattaaactataaactataaaccatctttagcggaccatcctttgtattgaactctttgcgatattataaaaataataatttggaaaattacaattattcgattgaactatcactttgctataacttcgacgtggtattttacaaaaccaaaacaacaaatggtttttatcaaagaaatataactctatctactatgtgaat

SEQ ID NO: 52060 - DNA, 2020 bp, Oryza sativa
tacagatgaggatgttcagcgtatgctatccaaatgcaatcttctggagtttttggagatttcatattgcgaaatggttactagcatacgaatgcttcatccattggaccggcttaagcatttggtagtggatatctgccctaatctgcaagagatagaactgaattgtagtccaacaacacttaagtacagtggcaccatggttcctttgatatttgcttcaacatccaggctgacaaatattagtattgtattcatcaattaccaatctgctatttcctatatcattactggattccccagtactttgccaaggctcgagactctgaccttacattgtggagaacgtgaggttcgtgatatgtcgtcctttgtggccatattttgtgcatatatcactataagatcaaattcaccaattttttttttcatttctgttgcagagaactatcgtaccagaagggcctttcaaatttacttatcttcggaatttgaggttggaattagctctctgtggccatggaaatatcagaaagactgatgcccttgattatgcttatatcctgaagattgctcctttcatggaaacactggagttgtctgtagtttatttcattgtggcttcgcaaacagatttcgtaagttgtggaaaaaaaaaaatgccaatgacaataaaattacaagaatagtgatctatttatgttatctgttggggcagttggtaatgctaaaaagcgcatagtgacatgcagtagtttatttcttaacttttttattgaatagaatatttgattctgtcttttgcgcatatgagcatacctaaaactttggttcagattgaagttaagtcatgattgtagtgtattcacaaaggggggaacttctaaacaaccaaagttctttttttttaggctagtgaacacctatattgcacggatacgcgatactggtacggggatacggatacggcgatacggaaattttcaaaaacactaatacgtcgatacagcgagtgtatatatatatatatatatatatatatatatatatatatatatatatattgtaaaaatagattatacttttaaagaccaaacatttctatacttttcaaatatgcctaagtagtatctgaatatgaaagcattgactatttaatcatgaattatactgtggttgaacaatgaagtacgtttacttggtaacctggcttcatttcataataaaatcaccataagttccacaagaagaataactgagtccgtgttgaaggctgcaagctagcgtcatgaccttgctgatcagaccagattagatatagctcagaataacagatcagatgcaaaatataatcatgcatcatatttcaatcgaatattcacaggtagattaaaactaaaaaggtggacagtaacaccagtcagcatggagaaattaaaagatgagagaatttagggttaaatagttatgggcctataatgggcttcctatatacatattcaaattcgacatatacacaatagaaacacaaattacaaatataaatcaaattaagatatattattttttctacctttataaatcaaatttaaatttatatatttatagatcgaaatatcacaagttaatatatatttccatttttaaagattttttatgactttatagttgacatgcataaaacgagtctacgttcaattcggtaaaaaggaaaaaaatgtttatctagtctatttgaaaaaaaatcttaaaattgtcggactgattaaaaatatcaaatgtgtcattccttcttctatagaaagctaatacccaccaaacacttaaaactcaagatacaagcatagtatttattatcactcctaaaaacctacatattgcacaagtatgtcacatcaacccattagtatacaaaacacaacatacaagcatataatagttatatctactatttatttcattttaaaactagaacatacacacgctaaatcatcattctcaaatcattttcataatattt

SEQ ID NO: 52061 - DNA, 5910 bp, Oryza sativa
ggtcctacgcatattttttatttctactgccacgtaggtgccacgtcaacgccacgtgtaacaaagactcggtcaatattgccacgtaggcgccacgtggcgccacatcagcaaaaccgctcagggagtcaaattgcaccggttttagaagtttaggggtcgagatatctggttttgtagtttagggtcatggtttagatttcgatcacatttgagggtcatggagtgaacttattccttatactgggcgccgtatcgagggaagtatcgaccatgtattgatgccgtatcgctcatttttttttatttttttggctaacaaatcagcgatacttctccgataccgtatcgctcgcgtatcccacgtatcgccgtatcggatacgtatcccatacgggaacggcggcaaactgccgtatcggtgcatcacaggtgaacactcaaaggcaaccctttgggtcacatgaatttcagaaacaatattattgccttgatccatgtactaactccacgttttaatgcatgcaatatttctttttccccattagatgtggatgctgaactgccggcatcaaccgtatcgcgaagaggatggtgagctaaggattgttggtcctccacaccagcacgctcatctcaaacgcgttcgcatcagtggtttctttggccacaaagaccaggtggagctagcacttcacatccttcgcagctccatgaccctcgagcagatggtgatcaccccaaagctagagattggcaacgatctggcgttttcagacccttgtgctgatgagtacgagaagaagcattacgtggatggccatcgagtcgccactgaatttgtttgcaagacagaccatcgcaatgttgtcactgtggaacgggtggtgccagagcctgccgacggcgaggtggagcgaaaacggagaagggcaaattagacttttgtctagaatgttaaatttgttagatgtgctcatttttagtttttactggtagtatcaaacaaatgcaactggtaaaaagatgaagattagttctacctccgttctaaatataaaatactataaggagttctcgttatgtgttatgtcactacagaaattgtgatttgtagtgagtgtgtggcctttttatggcactgttcttcttttttggaataatgactcaataggttgataattatttgaaggcaccaacaaatgagttagtaaatactataaagttaaaaataaatttaaagtgatattataaaaataataaaatatctttcttcgtcctgcattagttgccgttttatgttatttaaaaaactaaggtttagtaaaaatgactacaatgtcttctattaaatgatataagattgagaatgagaggataattagacttggaatgtgtatggtgtcttgattaatgtgatttaaattatacttggtcttgatatataaacatatatgatgatcaatttgataaggagggagtacttgaaggtgataagctttttaagataagttttgaattaaaacgatgactattttagaacgaagggagtataaaggtcccattcatttctccaataagagtttgatgcagataaagatttttgtgacacgcttttaaaattgctaaacggtgtgtttcgtgcgaaatctttctatatgaaagttactctaaaatatcatattaatctactccctccgttttagcatttcccgtattcatattgatgttaatgaatctaaacatatataatatctagattcattaacatgaatataaatatgaaaaatgctagaatgcattacattgtgaaacggaggaagtatttttcaagtttacaataattaaaactcaatcaatcatgcgttagtactactttattttttattttttaaaaaaacttaatcttcatcttcgaaagaaaaagaacaccaccaaagtttgtttaaaggttcgaaactcaggaaacatatgcctctttcgtaatccatggccgtttgatgcagatctcgcttggcaaagcaaatctccaaattacttcaccttcactattatgcctttgcaaactgcaacctccgctaatcattcatgacggccggcgcatggccggccgccgccgccgccgccacctccgcgccactgtccgccgcggtgcgcggggccatgcgcacgctcggccacctccttccccgcccccaaccctccgccgccgccgccgccgccttctcctcctctccccacaccctccacgactacaaccgcctcctggatgccttcgcccgcgacggcgacggcgacgcggcgctgcgggtgctccgccgcatgcgccactcctccccggcgtgcgcgcccacggccgcctcctacacctccgccatgtcggcgctcgccaaggccggccgccccgccgacgccgcggccctcttcgacgacatgctcgccaatggcgtcgcccccgaccggtgcgccttctccttcctcctccaggtctactcctcccacctccacctcccgtcggccgcgcactccgtcctcgtctggatgtcccgcttcggccttcccccgactcccatcgactacgcggacctcgtcttctccttctgccgcgcgggccgcctcccggacgcgctccagctgctcgacgaaatgcgcgccctcaattacccgctcaccctgcacagctacacaccgatcctccaggtgtactgtgccaatgctgatatgcagtcggctgatgcgctcatcagctccatgcgctccactggatgccaccccgatgtcgtattttacaacatctacgtaaatgggttatgtaaggttggggattttgatgctgtccagaggaccattgatgagagtggccggaatgggtgggtgccagatgcagttacatacagcacctacattgctgggctttgccggttcgggtatgtcgaagaggcactccggcagctggaaatcatggtaacgatggggttacagccgacagtagttggtctgaacatactgctcgactatgttgcccaggaccttgatatgtgggcaggcaaggaggtgctggaacgatgccaggagcttggctttgtggtagatgtcgtgacatacaatacggtcatggatcatttctgcaagaagaggaaatggctgcgtgttctaaaactgttcacagatcttctcaagaagcccataacacccaatgtgcaaacgtgcaacatttttatttcatgcttgtgccgagctggaaagtttcagtttgccaagtttgtgttcagcagcaaggggttcatggcagacactgtgacttgtacattctaattcatgcattctatgaggccgggaaggaggatgagcttggttttctgttcgctgatgtgaatgcgggtaaaattgccccagatacgatcacatacaatacgctggttgattgcctctttaggtcagggaggagagccgaggctgtcaatttgatcagacatattgatgatggctatcctgttgagcctgttgcacgcttggcgtattggttggttaggagtggaaatgttcgtgaggcattgaggttgtttgatgatatgctagaaaaaggattgttattagatagtaggatttttgctaatgtcatcaaggcattctgcagaaagggtccaggggaatgcacagaaatgctgcagctgtgttctgtattagataggatgcttggaattgggtgatccttctgtttaatgtgtttataacttggaagtgcttgattggagttaaggaaaaaaaagggacaacttgagagtgctcataggtctgccaagtctttttcactactttacatggtagtggcattgtttttggacatgtactatcagtgaatagccaatgaaggtaaaattcctgttgcttttgtcatgcaaattttcattaatatactctgctgatataatctgtcagccaacacttgtaaagtacttgctgtaaaagccccggtgttataatttttttgataaagcatatctggaataaatacccacttgcatggcattctttttcttccttcataaatgtgggatcatgtgcttgtgatcctgtccaatgcttgtcttatggtgttactttgacagtcttcagagttgtgggagcagataaatagcttgctcctagaacttcatatagggtaatccaggaggtcagtacctccagtaaaaagcattggctcttgtagtcttgttggtgctccaatgaatatgttctgaccatgcaatccttgtgatccaacacaaaaatgataattgtgtttattttttaggaacagctggtttcactaattatcagaggaagtgttagtcatgaaacgtgcttctagtcctggtttgttgcattctcattatcttccccccatcttgtctagcacttgcattatacatgctcctttaagaaaccactcgcttgacctgattttgcaaactgcaagcgctgaagactaattcatttgcagttagatgcaatcccggataatcatggatgttccacctgatgatccttataggcaaggtctgatttggtagagctagtcctaacaaaaaagcaagagatctccgtgtttatgaattaaatcaggtagtgttctactaatacttacttttatctgttttttcccatcatggaggaaatactgacttggctgttacttaattcatggcataattatatagctcaattctttctgttgtcctgctactgcagagtaggcgatacttcctccttggtataaatgctacatcaactttaagtcacaaggaaagctttttcttgatcaaggattgacactaaaactctagtactattttgcttcaaaggtattaatgattgatttttcaggtatattataagaatatacaattatctttttaaaagtgaatatacaatgaaacttaactctgctaataacgatgaataactactccattagtatggccgaaataaaacatgatgccttttagatagaactaatgaattaaataaggctgctaggctatgggtttcgaattgaattttatccagtgttctggtcttctgggatatcatctgtcaagagttatatatgctctccttgttgactttatatggtttgggtgtcagttgtacagatcttacgtgttatgtgtgctgttgtgaataactgaacagttgggctggttcgctgtaaggaagatctccaggccagcgtggagctacttcaacagacaccagtgtgtcactgaaggccgatagcgtctttgtatggatgacagagggatagtcatagagagttgtcagtgttgatggacctctgaagttctgattatctgtcatcatgtagaaagatagtgttttggttttaaacatcatctgttctatctttttgttggttatcttgtgttttgcgttttggttatcaaatttagcagcagatctaccagctttagtttcaggttctggatcgaggtaataacaaaccatcagggcttggattctcagccatgttgttcctacttgtattccgtgaagctgtgggcagaatgtacttccagttaatggacttcaccaatgtgagcctgattcatgggatgaatctactgaagattagataaagacaagtacgggtcgttgggggattgtaattcagaaaataactgaacttgcaagaaacctcaatggataatttgcattgtggttgtatcaaaactagctgggaattccgtgtactcacattgtttgtatcttcagtaccttgccatctcaagtgtcttttttttttcaggatctgttttttggagagatttgatgttgttcttgaaaaaattagatacagtaaaaatctactgatagcagcgagccgcgagcgacgtgtctcccgccctctccagccaatggcctgcggcg

SEQ ID NO: 52062 - DNA, 2566 bp, Oryza sativa
agaggctgtacgtggcctacaattccacgtatgtgcttggaatgctacttgcgatgcagatccggttcgttgggttccaacacgtccagtctggggagcacatggccgctatgggagtattcttccttttgcaggtatttcttacacatattgttatgaaatgatgtaacaattcatccgtagcgatgaaagtgccttctaagattagtagctagttacagctctggtttattagatggctagtttagtaaattagcaacagttgacataaaaaggtatgattcagatgaaaagtcccgccactttaggaaatttgcaccacccgtcttaattgtcctggaaatgagttaggattatttgtaactgagaaagggcgaaacacttaattgaaggcaacccgatcttggtttgtaggcaaactatggagtaaattggacaggtaattttgtagaacagttaagatcaaatgacctgttagtacttattgttagtttcatataacccagatgattagatggaacattggcatttgtgtcagattgctgctactctcattttgcctcttcagatagatcatgtttactgggtagacatgttatggaactgtgaattcttgtatgtttgcagtgtgattggtggcccatttatgcctggctgtaaaatgtgagatgctatactctttactcttgaatatgtcccacagccaacataactcaatgtcgttattgtgtttgttgtgtgtatatatcaaacatagcgtacctttgttatttgttaatatgaatgctttgacaaatatctattctattatgaggtactttgtgtactttgtatagatagagcagtatagcacatgtataagagagctatcataaaccatttcctctttttgcaggttttctttttcttggactgggtgaagtacctgctgaatgatgccaaactattcaagtcattcctgagaatcaccctgacatgtgtgataactgttggcaccctagctcttggaattggtaccgcgtcaggttacatctccccttggacagggcggttttactccctgcttgatccaacctatgcaaaggaccatataccaatcattgcatcagtatctgagcatcaaccaacagcgtggtcttcgttcatgtttgatttccacatccttcttttcctgttcccagcaggcctctacttctgtttcaagcgcttgtcagatgccacaatatttatagttatgtatggcctcacgagtatgtactttgctggtgtgatggttcggttaattcttgttgcagcgccagctgtttgccttattagtgccattgcagcatcagctacaataaaaaatctgactaccttgttcggacaaaaagcaaaagtccacaaactgtctctggaaaatcatctggctcaaaggcagctgcaaaggtattcccttttttttttttgtctatgcttgcttgcatgctttatattttgtatatggatagttgaaataaataaatttgatggagcttgaaatctgaaacatacttagataaaatcaagtggtacaattgaaatcctttgtttccgccaatcaataccctccagagtattgtgccatttgaaatgctggattgcaattttccagtttaccatgtgcatggctgataagaatataaaggatttgcgccttttctctgacaattctaattccagtaggttcaattgcacataattttgtggttttcagtttgcttgtatcaattatttaagtttctggttttcacatcactcagaagctgacttggtttcttgtgtaaacagggtgcagttgatcaatccttgcctttccagcagaatgtggccattgctttacttctgggtgctttctacttgcttagtagatatgctgtacactgcacttgggtgacatctgaagcttactcttctccttccattgttctggccgcaaggggtcataatggaggcagggtcatatttgatgattatcgtgaagcgtattattggcttcgtcagaacactccttctgatgcaaagattatgtcatggtgggattatggataccaaatcacagctatggggaacagaactgttattgttgataacaacacatggaataatacacatatagctacagttgggcgtgcaatgtcatcctatgaagatgaagcgtatgagataatgcagtcactggatgtgaattatgtgcttgtcgtatttggtggtgttactggttattcttcagatgacattaacaagtaagtttatccactgaatctagagcaaattttaataaatcgatgttattggttttattcgaattagtattgaacattttttcaaaaactgaactacaaaatggattcttacttagctgcttatttccaggttcttatggatggtgcgcattggtggtggagtttttcctgtaatcaaagagcctgattaccttgttaatggggagtatcgtgtcgacaagggggcagcaccaaaaatgttgaattgcttaatgtaagtatgaactccctaatgagacttatttgtcaacacatgtactatt

SEQ ID NO: 52063 - DNA, 762 bp, Oryza sativa
aacttgcatcatctcattagttagtactcagtactcgctgcctcataaaaaacagcagttcttgcaccctacaagagaactgatttctcgtccaaaccacataagctgaatgctatacgtctcgtacatttcattttgctctactttatatctcattttttcaccactaataaattccttaattgcagtaacctttatatacatgcatctatactactatgtatacttcatctatcctatgtatctttatgtcatcgtgaataaatcatgtattcgcttcatttcctgaagttcacttcgctcctcgcgagaaactgaatgaatccggcaatcgccgcgccgatgatgaaccatgtcacggaggctaggacgatcttgagctcgaagctgttcacgagacccagagcggcggcgccaccgacgtgctcctggatgccgccgccgccgactccggccacctcctccctgttgtaacccacgaacccggccgagatgatcgccatcagcagcggcgccgtcaggtcgatgctgcccaatgtcaccccgccatcgccggtgggggttgctcgccgcgtctggctgcggggaggagaagcgctctgcctccggtgaggtcgctccggcggcgatgctagggacggcaggttcagctgcggagtccagtagtcgtcgcggcgggcgtacgaagccaccgtcctcgccgccgtcgcgcctcccgctttgcgtcgagctccgcttcttgagcctgtccgtcaccgggtc

SEQ ID NO: 52064 - DNA, 1709 bp, Oryza sativa
agaattataagatatgtccataccggacaccactattatctctaacaaactctaagatatcataagtctttgcggcagacttttgccctaagcatatctctaaggaaattacgtaaaacatcctaattaatagatacaattgccttctcaggactctatccatgtgcggcaatcatcttgaagcatatatgttgtacaccaagtcgtattgccggaatcggctgtatcacctaacccagtctgattcagatttagtcgattttagtcgtagccgatctggactccagccgattcttactctgttcccgcaacaatccttatttccgactccgcttcgatcccatcttcacctccgacgctgatactaccaaattcggttgctaacaatcccgcacatgtagggaaaattaattgtctagaaacaaacacgacttcttagtcatcgaacatatctctgattcttatgatatggttgggtgctttaataaatcgttaaaatcctacttcaatcactctgcattacacagtgcgacgcacggggatttacataaggcttccgggttttttcgtcaatctttttttcaccctttttctcatccgctttttattcatcgccttttttcgtccgtcttatttttttgccttttcctttttttttccatccatcgtttttttgcctttatccttcctctcgatgcagagagtcgacgtgatccatgcgggaggggaagaggtcgtcgaatccactcctcacgtcgcacaccgatagcgaatccgtgcgatagggaggcggagagatgacgggatcagtgtgggatgagaagagttcgccgaatctgcccctcccgtaaccgctgacggcggatccgcgtgagatagaggcagagaggcgataggattcaggcgctggtggtggatcagtgtgcgcatcaacaatggcttggagtcagtgctcaatttgtttggcgacaactacggctctgttctgatgctagatacaatgagtgattttttttgtttattattttttattgttgacatcaaaatcaccggaagtttcactttaatatttatttgagataaaaaatatcaattgtaaaaaaatgtgtgctatcattcacatgtcacataccggtctcaacgcgggtccatatatgatagtgaaacaagacgcatgcttacaacgtgagagttgacataagcgagaaagcaggcgtaacctctacaaggctattagtaaatatccaaaagtattttttatccatcttgattattattggtattatgaaaattttctattttaaatacatttttttgttaatcacaatttttttgtccattgcctcttgcatgaaaatgaccatggcattcacactattaactcatcaggtacatcgttcatattatacacatacacgtggaataattgtcaaaaaaaactctgcgattattattgacatactatattgcttaaaaaatcgttcagttaaacttcaattgccgcgacattatccagtgcaacgcacggacattttactagtaaagttaaaacaacgagctaaacttgcaacgaactaatagcttcaacaaataggtttctgagatttttctttttttaaaaaaactccaccaaccatggcaggcctatcaagaaattccaagtcgacgtacggtgacgtgctagtattatacatatagaatggatttgg

SEQ ID NO: 52065 - DNA, 1230 bp, Oryza sativa
tttcgtgtcccatttgttaaggctctgattccattggtttgtagcgcgcctcaactctcaagctcagtgttgctggtcttgtacgcctcaagttcatctgtgtggtttggcgtgcatctgtttactgttttgtatgtattggttgatgaattcatcgtttcgaaaaccacatgatatatagttcagcgtttatgtatccttttcaaggattttacaggagttgagcacgtagcagtgtctagttatatcaggaggattcaccagaatagagatttctgtagtcctcaaacatttctttcgaatcccgtatgttattttaaatctacctgagactgctaatgtttgattttctttatggtgttctatacggagtttcatttcagaaatagatatcaaacacccctgatactcttagcgcagtaaaatattcttccatacgaatgatgatgtactctaccagcatatgggcggttgttcctgttaggctctctcagagctcttccaggattccatcatgattttgttcttgactattttattcactaatgcatgcaccatttcaattttccttgtaaacccattagcttcccgaaaatattgttattttctttgtacctcccttaaatatgaacaggaaatcatcattttggtgagctatacagcttgaatccccttaatgcgaaaggtatgaaatatctaatggagaacattgatgaaaactcactcattcttcttctgattattatttatactattcaatgttatcttcttcctttttttttgttcatggacaaattatacacttaaccacagcttttaagcttacacatactctcttagattttattcataattgaataaactgcttaataattcccagagggtgatatctcaaaaaagggatgatatgatgtttcaccagttcccgaatgaatcagaaacttgcatattatcatatcctgccagttacatttgagtttcacccgaaggactgcattctgtatatattgtagactgatttcctgttcaaggtttattttataatgattggagcaaacccatcaaccaagacggatagggtcaagtttctgttactttactttttttttttgaacgactcgcacgagacagtgcgaagttctattgatagagcaggaaaaaattacaagattacaaccctagagggtcgtaaacaggaaaaaggaaaaaataccaccacccacacaccga

SEQ ID NO: 52066 - DNA, 1403 bp, Oryza sativa
tgaccaattcatttgcataataggtcccagaatgacggttgttgcagtcaaccaaagactttatggattgatggttctgtttcaccgtaacgtttgtcagttgaaactgagcctgagtgaagcggatatttgtatcaggattcagggagatcctaccatcttatttcttttgaagatgctaactgcatatcacaatttcaacaatgaggtaatttagttagctaaatattctatggaggattttttttttttttggaaaagttgttgaacatattacatatctacctctttcttttcgtctgtgtattccagagttctagatgaactcgtttgaaagctaacaactaatgggaaaatgacagggcttgatggcttgagtagaaatttcagtggatggcaatgctccacacttctacatgtcaaaaatcaaaacatttccttctgttattggatgtaattaactaccttgctgacatgttcatcatttcatccctttgggttcctaacaaacagatgccatgcaaggtaagcatacgtttcatgcattaacctcacaaatgcttaaattgtcgatatcattaatcacaactttcctctcaatcagtactgatatgctaagagaaataactcaatctgtggtttatgtaccctttttcaatatcttttgaaatccatttacattttacggtctgcgtacattcttcttctgaagttagtgacaaagagtgaaagaggtgcccattggagaggtactacctctgttatcaaaaggatgacatcctagagaacacattcaaatctcgatatgataatcattaaaaattaaaaaaaaaggttaagatgtgaaaatgacattgatagatttgtcatgaaaaacacattcacatggttatatttttaataagttttatacatatataactagaaaaagtaatgatgagagtatgagacatatacattggagattgtgtcaatgtccaaaacgacaagtaaaaaagaacataggtagtaatattttagcatgtgtttgattgtgctttattaaatagactcctttcttgtgttgtgtacttctctctcttacatatgttgcttgtgtacctgtaaagtgggacttgaatatggttttagcctttggtagttattttgtatagcggcagctttttttaatctcaagtgtgcactccaataatcaaagaaggtgcttttgagtgttacaaaaattttaatgggtgcttgtccgttgaactaaagaaaacatatcatgatattcagaccatggttcagaacttagtttcctcagcttatttactgtatatttgctagcagttgcaagctcatcctatggaactcgagtttggtagcatctgattgagctggaagaggcattcactttttttgtg

SEQ ID NO: 52067 - DNA, 1330 bp, Oryza sativa
  unsure (1)..(1330): unsure at all n locations
gaacgggactccggcccacgtgcagcgtgcggcccgttctagtttgcctcacgcgcaccgttggaaattggacgacgtcttcaacgaaaaatcaatgacatatgatagcgaaaaagagacaatacaatatatactggtgagaagtgttatacgtacgagtaactcatacatacgactagcgactagcgtacgtcttacctcatcatcagactaatcacgtagcttggattaccttcatgtgagtccagatttttcagagctagttatgaacttgtggttgtacacttgtacgggagtcgtatgcatagttattatgtatgacagtttgagggtctatttgggaaagtttttagcagccgtagcttctcgcataatctccagctcttcaaataatgtagactgtcactcagattataagaatatgaagttataaaatcaataaaatgatctagaaaccagaagatgaaaactcggattttcggaagctggttatcaaccaacagattctcagaatcttaaactctccacacaggacctaatacacactgtacactgctaagaatgattaaggacttttctttaaagatgatggaagagcattttcccggcctccatatagaatgagtaaaactaactagacaggaatatttccattgtttcactaaactattcactattcagaattttcccatccgcccgtcagatatacatttcttgccgtgtgaaacttcctcctatttggatggactatgatgatgatgaaacatcagcattggcaaccttctcccgtagcttttgtacacgagcctgaaacagggggggttgagtgtgtcaaaatggagagttcacagtgttacaattgccgtgcgtgtgatacagacacagaggcnctaaccctgaacgacttggtccggcgaatggatggatcaaggtccagggcatcagcataagcatcctctgcagctcggtactcttccattgcaaacagagcatcgcctcgtgacaagtgagcctgcatagagcagcacagccatgacaaataggcccatggaaaaaaaaaaacagatagtgaatttaaagactggctctctaagaaactccattttatcagtgcatagaatagaacgttatggtgtttcagactttctgttaggcagggggaggctccatctacattatacaagtgaatttcattgaacaccatgtgcgaacgtaagctatatgtcagagacatataaatcaatagaactatacttgctatcgcccgtcatcttttttttgagaatgcgcaaaagagctgcgcatcttttttattaagattggggagaaa

SEQ ID NO: 52068 - DNA, 3424 bp, Oryza sativa
  unsure (1)..(3424): unsure at all n locations
tacctgtagcacgggagatgcagcttccttgacgccattttcaagagaaaagaaaaaacagatcggcaagcacactttgcttggtaagaatggggtgaatcctctgcagagacctcagtcaggagggcttccgcttctgcggcgccacccttctcgagggcggcctccgccttctcacgcgccgcgagcgcggcgagccccgccgccgcgtcgaatccggagtcgccgagcaggtgctccaggagctgcgcggcgcgcgcggcggtgcccacaannnnaacaccgcggcgccgccgccggagacggaggcgccgaagtttgggcccgccccgcagcggccgaggcaaccgcaggaggccacgtcgacgcgcggcggcgcgagcccctcgagcgccgccaggacctcgcgcccgccctggcgcgcgcacgtgcggttggtgcagacccgaatctccaccgccgcccccgaagctctcgccgtcgtgggactccggcggtggcgcggggaggcgaaggagcaggagaaggcggttgcagccgctccgccatgccgccgacgaactctgatgaggcggggggacacggaggtggagtaaagtaataatacgttttttaaagggtttctttgcaaatttccgcggacatttcccgggtccacgagccaaaccggatattctgatctcaataccgacccatgtttttggtgggccttgcgaaagcctgtctctagcgagcccaactttagtgggcctaaatacggttagggaggatgtgcggcccatgaaggctcggcccattatactgcaactaggcccaatacctagccattcagagtttcggacctgtggctatcgcggaagggagcggcggcgaacccagctcggtgagtcgtcgtcggcggcggcggcgacggcgacggctaggaccacgtgacgcggatcagctcggaggcagcgacgacccatctctgatctccctcacgttcagaggcgcgaccaagcgtcgagggggagcgctcgacggcgaggtacgcgtgtgcagatccccttcaactctaggtcgcaacgaagcctcgacagtgttcccaaattttcttgatttttctgtcacctgctagtttgttgatctgcttgatttgtttgtcgcctgctagtatgttgcaactatcggtgctaatcgatttaggcgattcttgcacatctttctgtgttgactcgctggtgttagcctgttaggagtgatgctctctagctgttcgatgaaatgcctgataaaagcatctttccacgccaatatatctatacatttattcgcacgatttgttcccctttgctaatgtacctatcaccatcgatttgcatgcgataggatcattggatcattagattactggtgaatgtcgtataatgatttttaccatacaaagtattgaacaagaatgcaagtggcttaatggttcattgttctttctgatttctttttggtttgtagagtcatgcagggggcgcgtgttaatctgaaggggtggcaacaggctgctgttgcattcggttctgcatttggggccttgcttgaccctagaagagctgatctgatagctgctcttggggagactactgggaagccagcatttcagcgtgtgcttcagcggatgaggaacagtgctgaaggcagggtaaactcatgctaccctatatcccctaaaagtgcaggacgttatgtcgatgcatccatttgttgtgcttgaccatctctttatatatagcctttattactagcatattctgtaaatagtatacatatatactcagcttctgaaacagtaacaatttctctgccaacaaatgctaaggagcatatgatgattatacaccaatactacgaagtagatttttttgtgtgaagtagcattatcctttttacttggttgtttcagggagcaatgttatactgaaaaatggaatagtgtaggtcttttcataagctgtccattttttttgttgttcatttgttatttatgcatttaactctccaaaatatcttccttgtttggctgcagtctagacttacccattcaataaatttaaacctgcaattgctatactttgatgattttttccttcttgttacatcactgccatgcaatagcaacacatgccagctgaaaatgtgtactcaacactgtggacttctttcccaattgacttaactaagatactattcctacaggatgttctcctggagcgtcctcgagttatatccacacaagtttctcatgcctgggacatgcctcagaacacatttggtgcagcatatgctcagttcatgggatcaaggaacttctcaccggatgaccgcccacctgtccgtttcatggatacagatgagcttgcgtatgttgcgacccgcgcccgtgaagtccatgacttttggcatgtgctgttcggccttcctacgaacctgattggagagactgcccttaaggtcattgagtttgaacagatgttccttccaatgtgcatgctttcagtcgttgggggctctgcgaggttcaatgagaaacaaaggacactgttttttcagcattatttcccatgggcttcaaaagcaggtcttaagtgcacagatctnannctgtgtactatgagaagcattttcatgaagatttggatgaagtgaggaggaactggggaattataccatgccctgatcccaaaaggagcagtgtttagacttttagatcggtacattttgcatgaaagatgtctgaacttggttttcactttgtctacgttagtattagctcttccctttcaagaataatagcaagagttatgctattgatacctaaaaaaactagtaattctctttaacttagcatagcaactaagcttgcaatgttgatgttccctttaacaatagtgtagatgagttaattacatttttatgtgtaatactagctgaatgccggtacttcgctatggacagaagaaaacatatcataatattgtctgaaataaataaattatattttccgtgagatgtgttgcccatcctctttttgcagcacaaggtacaactatccttgcatagttgcatgtgcaaaagcaaaattagaacctcatactggatcagaatcaaaattatttggcaggccccttgttgccagtggctgaggcaaaggtacctgaaacctccttgctgagttgctggtacacggctacaccacctctgaagagagagaactgcagattggtgcgtatcccaaaacgaacggcagaagtaaaaaaaatgagaccaaatggtactagtagtaggtagtacgtccaaaagctgcactgtaattatggaccaaatcaccttaaagttacagcaaaagaacagaagaaagaaagcatgcagcaaagggacaatggtgaaaaaa

SEQ ID NO: 52069 - DNA, 1606 bp, Oryza sativa
agaaaggcagtggatgcgatgggaaacaggaagcacaaacatgtaggagaggattaaagaaaggccatttgcacatagaaagcaccgaagccaggataaaggcaaaatctgggcagaccgggcacttgttaaagcctccctaggtttcattgctgataaacaaattggcgagatctcagttgcaaaaatgatcggttggccaagacgaaatggtcaccaatgtgatgggctaacgacagtgtcatggatcaaaagtgaaacgcagacagggaaaaaggttaaagtttacgtctgcatgcatgcaaataaagcttgaacgactatgtcagaaaaaagcagttgtatctatccaagggttgccaactctgcaactgtgaagaaacaaaggaccacagtccacagaaaaaaaaatgtgatgcagaagtgcagaaatgctgcatggattcctgaggtaagtatgtgatcaagacatagcgagtttcagtaagttgaaattatcaacttatgattttgaaacaacttaaagttagcatttttgttgaaatgggatcagacttcagtggataggactggtaggacagaggaatgtatggtggccaagtgacaaggtttcagatctgacgaacgaaaagctcacactgcacagtgcaaaagggttaaaggcaatggaattatggaaattggacaaatgaattgttctacccataacacaaagtactaggcgatctctctgtccatcattagcgtcccatgatagtactatcaaactttattcagtcctttgtaaaagaccaggcaagaacaggccaacacacaggaattatgcagtggctaagaaaaaaacagttcgaaacaaagttgttgcaaagaaagattggaaagatatgcagagtcctggaggaatggtatatccatgacagaagttccaatcaaagaagctgtattgaagacagaactgacaaaaatgtaaatgttgaaatcatagccattacgaaggtgaccttcaggtacagcaaaagcgtactaccagactactacctaatatctctccaactattaaccttcctatcacagttcttgccagtgtttatcaacattctaactgcctattgccacctccaggaactcatcatggctccaatcatagcgtgagagaatgctcctattcactgtcagtgtcaggtgaaattcccggtgccctaaactacctacaagtctgtttctacccagtcatgatcaatcattcacgaagtcagaagctcagagcagaacaagtaaacctcaaaatccagctaagggggtacagagaaatacaggattcacgtcgaattttccaaaatgtaaaatctggatgcttactagacgaccaaaatgccgtcttgtcccatgcacaacggtaaactttaccttggcaggcaaagaattttaccactgctcctactaatccaagactagactggtacttttttttttgccgggacggccaaaggatggccggccaatttcattaagataggagaaaagactagactggtactgcccctataattagccactcaatagcatcaagctttttgaacagcctatcaatcatgttcccaatcat

SEQ ID NO: 52070 - DNA, 1847 bp, Oryza sativa
ccctcaggccatggtccggcgagatctcaccgaggtacttgtcgaccagccttccaaccttcctcatcctctgcgacggcaagtcggcctcctcctcggagccgacgaacaccctgaccagccgcatgaccaggttcacgtcgtacacgccaccgtcgtcgccggagacgaggaggtcgtcgagcgtggcctggtccagcatcagccccatgagcctctccagtttgtgcctgcactccttgctcagccccacggccgacacgatccggagcacccagaagaggccccggcacgagaacgcggtgccgccgacgagcgccacgccgtgcacggccgtgtcggcgagtccggcgagtccgccgccgccctccctgcacagcgccggcctgcgcgtggcggcgcggaggtagtgcagcaggaaccgcgtcaggatcaggttcttgttctcgatgccgtagcagccgagcaccctcatcgccttctcgatggtctgcgggcacagcgacgtcatgtcgtcgaaccaccactccctggcgaagcacggcttcatcgactcgggcgtcttggtggacgacgaccggccgaacccgagcgtgtccggcgacgacgagcacgacgacgacgagcggttcggcgtcccgactgcccccgcggcgacgggcgtctccggattggcggtgatcttggagaacagcgcggagatgagcctctcgaggaggccggaggcgtcggccgccgcggcgaatggctcgcagctcttgacggcggcgaggacgtcggcccatgtccagtagtagaggccgtccacgaatgcctctgcttgggtcaggaggttgcaggtgcacacctcctcggtcatctccaagaacacggcggcgcagtgcaggagcgggaggttggacgggcagagcgggacgcggccattgttgtagcagaacctggccacgagctcgaacccctcgccgccgccggggaagtcggcgagcttgacggacaggctctccgcccggctcgtcttcctcttcttcttctcctgcgtcaccattgtcctcaacctccccgagaacgcacacatgacgctctgcacatgaaacaacaccaatcacttgtaagaatagatgattcttgattacgtgaaccgatttcaaagatttacgcaggtggcaggtacctgatgaagaagaagcggtgtgatggccattgatgtgcaccttgaggtcgcagagctcattcatggctcgagagagaagagaaagggagggagagagagagaaatggaggcaatggcactgcagagaatggagtttaatagtatctaggagcaagtgagaattgggaagatttggttgcttggttgctgcctcagttcagttacttgggacctcaaggcagatacagtcacagctcacaagctcacagtgtagtagactagtagtaccacattgcttgagtgcatgtgtcctgtggagagatatggaggaacacctcatgatccctgagaagaaaacaaaagcaagttttggtctgggtaggcaacaggttctctgaactcttcactcttcaatgctgggctgatgggctctgcatgcagttcaaagaatgaaagggaaaaaaaagcacccctgccttccaaaggcacgagagcaaacaaacaaaaacgtccccttgttctattctaaaacagagagatctcatatgaaaataaagaaaaaaagagaggaaaaaacagaggaacagagagatcttgttcatggccactatggattgagtgtttgcactgctcaaggagatgattcagcatctggatgctaagattgctagtgcgcctggctggaattgattggcaa

SEQ ID NO: 52071 - DNA, 723 bp, Oryza sativa
agtagagaggaataacggtattggaagttagttttagagttgtctgacttacaaatgggcaatgatgatccatgtctaacacacacattttgcaagatcggcagtgatgtgcccttgggggctttggtttactacagtatgtacagaaggtatagttttccaggtatttttccaaccatgggatagctgccccaccgcatgtctgccggtgcaccagcagatttaaaagaggccaagcaataacttgtgatggtaaatacagctagtacacctgttaatatgcagtgaaagatgccacaaaatgtgctgatcgagaaaacaactggatataccgcccagaccccaccacctgtgagacaacaagtttagtcatgtggaacagcagcacaaattgcatgaataaacaaataaacatggagagatcaagatggaaagttttatctaaagcagatgacaatagactcggaacctacatatgacgaagagcatgaagaggatgagcacagtcacaaagaacctgtcccggaaattcctccaatgagaaaagcatacactgtcaggttttcgtgaagtttggttactttatgtgattgctccacaccagccacacttaaaaacaggagcataacttgcaaaaatgagacggagtccacatcccaacaagtggcctcatgatcttctggtatagatgttacacattgctctacctaaatggaaggacaa

SEQ ID NO: 52072 - DNA, 1316 bp, Oryza sativa
  unsure (1)..(1316): unsure at all n locations
agagggcgatgccccgacccattattaattatcctataggctagaaattccctcgcgtgttggcaacggagaccaaaaagatgggtgcgaaacttaggcaagaccgagagccgacggttgcaaatcaggcgcaatgatgctcccaatcatggacccaattcgcgcaagagcactagaacagcacggaacccctacaaggcgatgccgccaaagcacgcggcaaaagaaaaagggggagacgggcaaacctcgagcagcggctgctgctgctgctgctcctccatcgcggatccaccagaggagaccgggagcccgcggatcggaggagcggaggccggcttgagagagcggaggcggtggttgggaaattcgcagggttctctacacttcggaatagaggcggagacggagaagaggagagaatatgtttcggtaanacaggtttaagggaagatgacttgaggttagttagttttaaacggtacaaaagaccaaacaaaaagaattgcttcatggtggaggctcttaatcccttttctcttttataaaagagtacttcatgtagtgcttaccatgtcatatcatgtaagattattcattgtaggtgcttaacttcaaaaaaaaaaagttgtaggtaaacagagaggttcatgaagctcaaaaattgctatttaatcaagcattagtgtcattcttattcctatataataataagcagcttgactattatagttgaaaaaacatatatggtactgtttccttgagcacatgtatgatgtatatacaaaaatacgcatgatctaaccccccgttaagttctagaccgggtcaagtgcgacactggtacaaggaaaacacttaaggttatgtttagtgcacctccacgtttaaagtttcaagttaaattatagtaatttagattttatatttgtagaaacaaaatcactcattaaaatattatcaattttgtcacaacttcaggtccaaataatttgtaaaaaaaacttagggtgtatttggtagtgctactagttgacggccttgcagcagcaggtatagtcccaccacaagaaagatgctagggaagcgtcagcgctgcggttgtacaaccgcagttcagcactaccgaacaacccttagttacagagtaatgtcaaacatgacgtgctaggggacgcactcgtgacgttagtgtagcgttgcattggtaatagtgtgtgtacatctctaccatgtaatcgcaaaatacaactctggtttttttagaacaaaggtattttacatgatttttttcatataaattagttcaatttcaa

SEQ ID NO: 52073 - DNA, 4744 bp, Oryza sativa
  unsure (1)..(4744): unsure at all n locations
tttgtccctcgggaggacatcccctcgttttatacatctcactcaaaattttatcaatttttttttaaaaaaaaattgtcaagatagattaatatatgacatctttcgtaaacatgcgagttaaaattcaacttatacaattcaaaacaaaaataacaaatttaaccttaaattacacgttctattcattgtcaaatttattatttttgtttttatttgtattaattgaatttgaatttgtatatttattaagagtgatctatcctactaattttttttatgatcatgcaaaaatgaggagatgttttcttaaggatgatttgagttttccatccttggaagaagaagaagctagcaaggatgggatggattaccaggggtcatcttgacgttgtggccgttgttcttctggaggcaggcgcagaggaagaactcggccttggcctgatactgcttcagcgtgtcggcgtagccggcggcgctgccgccctgctcgaagaggaccttggagaggaggacctggaggccggcgtacttgttgtcccaggagaactcggtgacggcccagccggtgccgccgaacgcctccgcgttctgggacacgtagcggaggtactgctcgtcgccggtcgcctcgtacagccacgccgccgcccacagcagctcgtcctggtagccggacgccgaccggtagaacttcttggcgctctgcagcgagtcgtcgtacttgcccctgaacgtgtccgcgaacgtgaacagctgcccccccaaaaaaaagagaaaataactcatcanaatgttgctgctgcatttgctgattgctctcatacgctggctgcgttcgacagcccctcctcccgtcccccaaaacaaagcttatattattataaaattaattaactattaattatttttttaaaaaaaatggattaatatgattttttaaaataactttaatatatatttttttaagattaaattgcactttggtccctcttttatttcccaagtttcaatttggaccacccttaaagctatctttttaatttagactgggtaaatttaccactgttacggtttgtactatcataaacaacttttctcatcatgtataacttccctttcggcaaacatatgaaccatatatagaggagttcggccgcatactagagttgatgtgtttaagctcgttggttgtactgaaaaaaaatcgttcgtggtaatccaaattacaacaatagtaaatttattcggtccaaagtaaaaatatatgtttaaaggtggtctaaagtgaaacttaggtaataagatgtggcccaaaacgtaattcactttttttttataaatcataccgtttaatagtttgaaaagcatgcgtgcgaaaaacgaggaaggtgggttggaaaaatggacgaagatcacagccacatgtgtctctgtacctgcttggagtggaggaggaggaggtcggagtacatgcggtcgtagggcttgaaggccttggcggcggcggcgagagcggcggcggtctcgccggcgacctccgacccggggttgttgatgtcgatcttgaacgccgtgcgcggcgtcgacatgtcctcggcgcgctcccagcacaggtggtcgctgtcgccgtcacccacctaatcaaagaatccagaaaatttttcttgagggcactagtgggccgtgttgggctcttggtgagatgggccttgagtgcgtgcgtacctggacccagagggcgttgtgctgggtgtgggccttgacgaagtagttggtgccccagcggatggcgtcgaggacgcggtggagcttgttgccgtcgaccatctccttctcgaactcgaccaccccccacgacagcatcgtcaccgcgtacgccatcgggagcccgaacttcacgtggtcgccggagtcgtagtacccgcccaccaaatccacctgcaaattcatccatccttcgattcaattcgcgccgcattactcaacccgatcgagcatttacccggccttgccttttacatccaactggatatacacggccattgcaatagagaactttgtcccgtggacaacacaatctaaaatttattctataaagatttaaactcaggactttaaagtactactctaacgactgtaaccactatcgagcatttggttgattgaaccggaggcggcggagatgtatgtattaccccctgggagaagccgtcggtgagggcggagtcgccgcgccaccggacgaggcggtcgtcggggagcttgccggagcgctgcgcctcgaagaacaggaggcacttgtcgaacgcgccggcgtagtcgaacgccgacgcctccaccgacgcggccgccgcgaggaggagaaccagcgacgccgccgccggtatcagcaggaaggtggttgccggcgtcttgttcatcgtcgccgccattgctcgacctcggtagtggaatactggattgagggagaggcccgcacggcggaggagttttataaggtcgccatgatcgacgacgtggaggacggtggcgcgcggccgtggcatcgtgggcgcacgcgatgtgcctcgcacgtagcgaggaggagagatacgacgacgacgacgacgaggtgagcttttggcggggtttgagccatgcacgtcgtggagccgaaactgcagaaatggttgcaactcaagcgtgtaatagtttaattggtaatataataatagttgaagattagttttttttttaaggtaatggagttgaagattggatgcttgtagttttaagggaagattagaaaaaaaatgaaaggctgggtgcctgggtctgatgatcattgtctttttttttttttgagaatttgatgatcattgtgtcaactaccaattgtgtcggcttggatcgacatgaagtccactccagttacactgcgtgatcttgtgttgcaaatgattttccaatcaattttatcacgtttgtgccattgatctggatatttgtggaaggtcaacccagatattatgcatatatattcaaggtgagctgagccaaacatctctgtaccttcctgctgttcaagagctttcacagcaccatctgcactcgatctccagtgcatcagaaccgaagtaccttccttgctctcctgtgaatcctgctgtatgagtttcggtttcctttatctcctgagacaggcagaactccgtgcatgttcttaggaaaatgtgtcattttcaaaaaagaaaaagaaaaatgttgtgtcctatagccaactgttggcttgaaatcatctataatcaacttaatagccaactcatacaatagttacctataaatatatactacataattaatatttggtctcatctatcatacacacatacaccttgaagtctgtgctgcaactggttataaatctgtagccccgctgtcattctctctctttttttattttttcgaaatgtgtttatagctggcttatagcctgctattgcacctgctctaagcagaccaaatgcacaactgcacactggttttattcagtgtaactgcacatcgactccgccatggcacggcatcgatctaccatgccggccaggccgatttactgaattcatcagcagccaagaataaaattatcgatcacttcttttggttgttgccaccaggagtgatcagccgacgactagatgtgccagctttcagctctcgagcgaagtggcaatggtgtcggagctacgcggctctggatttccggcgaaggagacggcgcggctgacgtagagccgcaccaccctggccgcgagattcgaatccaacggtgtatgtacgactacgagccatcaggatagcgatctacggacagtttccactcggccgcggtgatcctgagttcctgaccgcttgattcggatccgacggtttccgtacaggcccgtacggtcgctaacgatgcgcagcgtcgcagcgatccatgtcgagcaaggactctaaagaaaatactaacaacaaactgagggctcttttgcaaaagtcaccctgtgcttacgcgatcgcagccatgaggttttgatccaacggtgtcagttaatgccactcctcctctctcttcttcttcttcccccggcgatctctccgtcccagccgccgcggcgtcgctccggcaggcgcatccgccggaatgggacggcctcgtcgttatctccggtaaactcgcctctcagagcctccgatcccctcacctcctccgcagcggggccgtcccaacacgctcatcggccggaatggtgaggcctcatcgtcgtcgtctccgataaactcgccacccaacaccgccctcgcctccgctctcaccgtcatcaactgcggcccggcgccccagatccagcatgcgcgtcctcagaacgacgaagcgttgtcgtttcctccagtcaatccaactcgcctgctcacctctgtcgcagtgtaatccttgtaacgtatgcatctttcactggtcatggactacaccccctcccaccaaaaaaaaaaaaaaaacttcaaactatatatttagatatagactatgttcaaatacagaattagaagttactctctccatcacataatataaggcgtccacatattttaagattccaccttcaaaacattttgaccatcatttagtacaatataaattgaattttacttgctaaaaattatatcattggattaatatttgaatttattttcatatggttataattttgtt

SEQ ID NO: 52074 - DNA, 1322 bp, Oryza sativa
catacttcaaggtggtggttttctttttgataaagtttaagaagatggtgggtgatgtgttctttgataaagaagtttaagaagatgttcttcttaaggaaaccaaagtgtacttgggagcaaaaaaaacatgataatgctattgagtattggcaactctttcaagctagacaaagatggtgattgtatgattgatgcttccaaactacaatgattccattgcaacttgatcatccggaaatttaattagttgtggagtgattttactcttcagcaggtacagtgaggtatcctttttttattaagaaacttggtatacctcttctcttaatacctcggctattaagacataccaaaatttacattaaaaaattgatctctttaggtatccacaatacctcggctattaagagaagtccaaaagtataaaacataaatgatctctctaggtatccacaaagacagtaaaatttcttcttgttctacatatgggatatattcaactgtccatcacattccgacattcctcctggtggcaaaaaaaattgcctcgcgaaaataacattgagaacattcaaacgagcccatcctagctacagaactcttctactatctggcatataaaaacggcgtggaggatcgatctgcatggacaaaaattcccatttcaagcaagcaacagcatacactacaggccttgaacccatctgcaggtacccagaagcaacgctctaagtcttaaaggatttacttaaaggggcaagcatctgaagtcgaaaacccacgggccgagtcgctctttcaaaaaaccaaaaaaaaaaacccttcgggtgttctgctaccagtctactactagaaagagctaaagctcatcaacttccagccttggtatgatggtaccgcgctagagcatagtctgaaactctgaatgttgggactatggaggtgcttctggttctaggacccatacagtacaggtaatggagagaacatgatgtatttcgatgccgtggagatcatgcaaccattcagttagaccgagataggaagaattcatagtctggatgacggttgatagacttctccccgttggccttgggtatcaccatgcttgacataactgatgcaccatgtcttaaagtcttcagcctctgtttcaggacttcagcacgatcagttttggggccaacgtctaatgacattggcttgatctctgggtttctcagttgaaaccattgctctccctgtaaacaaaaaatataaataaggatgagttcagcattaaaatatctatgaaaatactaccagcaagaaaactaaaa

SEQ ID NO: 52075 - DNA, 725 bp, Oryza sativa
ttcctgcagccaaattcagagagagagagagagaatgcggctaagttaactgcaggtatgtatgtctctcagatcttaattccttcacatgctttccttcgatcgcaagcaattttatcaattaattgcctgtccttgcattgcatttgcatgccccgttgtcccagcagcaagcacgctacctctctcatctcatctttcccatgaattaatcatccatctctctttcttccttcctttctttttttttctttctctgcagccacatgtcatgtacagatgtactgctatgccatatacatatgctctcttctgcaacagcacaatacgcaagctgcccattgctacgtggcactacgattccgtacacacttacgaggttaaacaatggcgcattatttgattacttctgatggaattttgtgctctgagctgcacatgcaggggcaagtagcatgatttgtgcatacgatgcattgtatattcatcaccgaagagtacacagaccaatcagcagctgcaaagtcaacatgtaaaatggcaaaagaaaaagccggccattgctatgtccggccggtgggaggagagacagtgcagtgcaaggctaaggccaaagccaaggcaaggctggctggccggtcgtcgaatcaatcgatcgatcgccatgttgccatgtgcttttccaccgttgctgtgccgcggcactcaccggcagccgcaaatat

SEQ ID NO: 52076 - DNA, 1071 bp, Oryza sativa
  unsure (1)..(1071): unsure at all n locations
ccctcccccgcgcgcagacagctggcgagcccctcccctgcgggcggacggccggcgagcccctcccccgtgtgcggacggccggcgagcccctccccgcgcgcggacggccggcgagccccaccccgctcgcggacggccggcgagcgcctcccccgtgcgctatcgtcgtcgccgcgccacgacgcctcggcgcatggccgcctcccccgtgagttcctctactgggccgccttctcgttgccatcgtcgtcgaccccccactccctccgcacctactgcctcctcgtccacctcctctcccgcaccgccgccgccggatgccaacgccgctcattctcattgtcccancacgccaccggccgaaggggaagaatgggatagaaagagagagaagggagagagggaggaggaagaaagtctgacatgtgggccccacatgtcagtaggcccacatttctttttgtgtgaatgactaatgggtcccacgcatatttttatttctaccgccacgtaggtgcacgtcaacgccacgtgtaacaaagactcggtcaatattgccacgtaggcgccacgtggcgccacgccagcaaaaccgcctcccaaaaccgctccgggagtcaaattgtaccggttttaggagtttgggggtcgagatatctggttttgtagtttagggttatggtttagatttcgatcacttttgagggtcatgaagtgaacttattccaaggaaaaatggccttaggatcgaaagcggcacaaggacaaggagagatttatttttaaatttttcattttaattaactctaaatttggtttttgttgttttaaaattatttctggtgctttgaaaattcaagtaaaaaatttagggacccatttaaagcatggaggatttaataaaaatactccaagccacttttgaatttttcttgcacgtattttagtgtttgagatttcttttagacttttaataatttatattactcattttagaaagtgatttttaacttgggatgaatttatcaggatatgaaaatgttacccccgaaggtgaattccctgttg

SEQ ID NO: 52077 - DNA, 919 bp, Oryza sativa
tcgcccgccgccggccatgcgctgtccattgtcgcgccgcctgctgccgccgtgctggacgccgcccgacgagaggagggagcagagagatggggagagccggagagaggaggaagaagatattggattcggtcaacgacatgtggggcccacgtgggcccaccatatttattttgtgtagctgacatgtgggacccaccatttttaaaatattttttggggctgacatgtgggcccatgatttttattattttaccgagatataattgccacgtcagcgccacaccagcgccacgtgggatggagaccgagtcaaaatggccaaaaatggccaagtaggcgtcacgtcagccaaaaccgctattaaaaccgccgagggatctcgtttgactgatttttgtaagttggggatgggtcgtatacggttttgcggttcaaggatgaaaattagactggcgacaaataaagggaactcaagtgaacttattccaacgttgaaattgctcagtcattgggccgtcatgagcagtgggaaacgtcatcctgcacatgcggcctgcactaccagcccactagttgttgggccatttgaggctttgaacgcagtgtgctcggagaaggaaagctgattagctgagcctttggtattattcaggcccactcgtgtacattgccttcattgttacaagaacaacttcattgttaccaagaacaacttcgaacccgagcagggaggtcagttttctgctatctgttaactagttctatctggtatgcatctgatatatgctaatgatgctatgcaggtaaactgtaactcggatgttctccttcttttgataacaggtaactgtataacagaatgcttgaaacctgatgttcagtaaaccgtcatccagcagctaatcgaactgccgtc

SEQ ID NO: 52078 - DNA, 1637 bp, Oryza sativa
  unsure (1)..(1637): unsure at all n locations
tctgaaagctagttgaaatcgtgacaattgactagctcaccatctgtgcaggcaatttaaaattcatcctagaaaagcattcagcgtggagtagtagactagtagtgtaactgttatttatctctatatttaggagaacgttgattttaaattttgtaggtttgcaaactgctacttgtatacccaaaaaaaaaaaatctgctacttactatgctatatccatgatttatttcagaatgtttggacacgccaaatgttcaaacagtattccagcaaaaattttaggcactgttccaatcaaaatcccccttccaaactaaccagccgcttgtacggctaaactttttgcctgtcctcctactgctaaatttgaacgccacattgaacaatatctgaaaccgtgaaacgtgcctctctggctaaagtgctaaacagttaatccaatgagaccaaatcacgcaggcaacaaatatggatataagcaaatcgaggacgcgtgaacgagtggggaaatcaggatatgcgatgacgacgtacgaggaggctgaagccggagacgctggcgagggaggtggcgatggcggaggcggagagcgggaggacgccggggaggtgccccaccatcatgttggacgccacctgcacggcgttctgcgccacgctcatcgcggccatgggcagcgccatggaccccacctttcctgcctcccgcgccagcccgctccaccacctatctccgccctcctcctccctccctcctcccactccggcggtgccgtccgccgggaatcgtttcgagagcagaggtattctctcctccatggcggcccgagtgcgcgcgtcgtcgtcgtcgcctccaccgaccgagctctctctctctctctctctctccctctcttcttcttagagacggcttttggtgtctgtgtctcggcgctggtgggcggaggggttntaatgggagaggactctcgcgatcagcggcgggataaaacaggagttatgggaaggttgttatgtcaaagtgtcaaatgtggcgtcctaattttatactgcgggttaaaagtagaatgcaaagttttatacgagtgacatccccccctcaaaaaaaaatactggctatataaaacaactacactgtgaatattttaggaatgcttggaaatactcgctctgttttatattataaattatttttactttactctaaatcaaattactttaaatttaattaagtttgtataaacaatataataatatttataacactagattaattttattaaatctataattaaatacattttcatagtttatttgtattgggttgaaaatgttactacttttttctacaaacttagataaatttaaagcggtttgattgtaaccaaagtcaaaacaacttataatctgaaacgaagagagtaaggtttataaaacataaataaagagagtaagatttataaaacagagaaagaaaaaaacatactaatagaatgctatgctcttgtctgcagaattttaggtcacgagaatacgaatcaaacataggaatataaacttttcaggaaatttgtttggataggggagagactagatagagaaaggaatataatgcatacaagagtttgagctca

SEQ ID NO: 52079 - DNA, 2649 bp, Oryza sativa
ccaatatggctcaacgacggcgttgttcttactgggtggagtggaatcacggtgagcatccattgcggagatgatgacaacagctgtgcattcccatccttcacctcagcagataactggacacaccaagttctagaatggaaggttgatgataacaacccaatatcatgttcatgtttgcttcttcagctcaataggaagctttgccggctaaatgccgcaaggatagactggcaagaacatgattttggactcagtgccatctttgcattagaagcagaggaagatcagggacttctgtatcagcagaagcagcaagaaaacgaggagttgaggcttaatgcgttatctctacctgggacactatcagggggaggggaaggagaaggcgagtacagcttgttgtttgaatctcctgaggaatctgattgggcgaaggtttcagagccatatgtacccaagtttccaactgaagaagaaattcagaagagggaagagtggcgcaaggagcagcttaagctggtcatggagccaatcatacaaccagtgcaggaaccgagaaggggtataaattatttcatgtgtgagccacgcagcaggagcactagggaagcagagctcccaatgcatgaaccatactcagtgttactatactactggaccttgtccgacaaatcagaatgtaagtacacatctatattcatctgaattgcatttccatgagcactaatatttacacatatttgctgatttgttgttatactgggtaaaaaaatggtcattagtaggaccaatacatattggtactgaaattaactagcatgatagagtgcttacatagaaaattcctaccaattcatgtaacatagataaaaatacaacatatcttaatcagcagtagtcgctggtttactaagtggacaggcaactttcttttgtcttcattgcaagtaataattgccactgtgcgaacattgatgtagataggggagaaagacatatattttagcactcaaaaaatgaaacgggcacttttccttaaccatctctccgtgtattttataacttgaggaattcagttactgcttggggcttcgctaaggagccttaactttgcagttcaaataactaaacagatgcacgtgtgtaagacttcttctccaaatcatgcattcttttctctaagacaaagttctggatactagttattgtttgctttggcccgatttgtaatccaggctaattaagtaactctttgaatccagcaaagttgaaacctaagaggaaggtgtatcctagacttgtttgtttggagtggtgccttgtgcacccagcagcatcttgcaagtttacaccctcgagatcattgtagctgattctcttcattcctgcaaactcgacatatccggattcgtcgcgattagggacttacgtgatggacggcgcaattacattttcaacagagaaataggccaccctttcaccgtcgtatcacgacatgtatgcactccatctcttccacatttcttttcaggacttcttctctaagcggaaataatgaaagctctatatgggcatattgctttactctgcagggtgttttgcggctgccaacattgagccctcggagagccattcataccaatcctgaaatcttgctcgagttcaacctgaagataaagagaacaggtaatggcattgacagttaccgtgagctgatccaaggagtagtagagcatcctagtatatatcggcacgattggtccagagtcaatgagctgtccattctaccttgtggcaaccgctctactccaatgatgcgcctgaagctcgccaggattctgaaaggcgtcgaggccactgttgagctccagccgctcaggctgcctcccggaggcattgatttgcgctgcacagctcggtcaggccgcatagctgatgacattgagcttttcgatggcaaatacggtggcgacgacgacacttccctacagtttgtggtagcaacggagttgcatggcaacatggagatccacttggaaggagtatgcaatggcgtgagcaggagatggtgcattggttttgtgccaaagttccatgctttgttctctcaggaggtagacttacaattcgctcagcttttgctgactgttgcctggtccatgtagataatgcatttttttcttcttttatttattttggtaatagtgtcatatctagattgcttaggcatagtcgcatagaactttttttttcttttttttggaataccaggtatagaagaaattgtttctgcgtcgccgttggtgtctgagactgagaaaatgtattatttaaaaagatcgtttgattgtctcagatggacgagaatgcgaaccgcgcgtgggctgttgttcttttacgtgcgtgttggtgttatgcgtcccttttgcctggcaaaagaaatgtcagaattgaatctagagcagcagcaggagtataaaatgttgtaatgaaaagacaagaaaatgtcgtctttgttgcattgaccactgctgtgtgtgcaggcattcaggtggatgatcgtagctagtagactgtatatgcctgatgagttctttgctaaactgaacggacattcagcattccataatttggtcattgaagcaa

SEQ ID NO: 52080 - DNA, 1928 bp, Oryza sativa
  unsure (1)..(1928): unsure at all n locations
agtttagagtaatctgacttaataatctagattacaggaattttaaactgaaacaaacaggaccgaaaaatatttaggtgagcgattattgttgattaattgaaagtatagtcattttaaatttaaaaacaggttaatgtatttcttttaaaaaataacttatctatattttaaaaacacaacatttaacaactaaggaaacatgcgcgtggaaaacagtcgctttccgttattctctcattctcacgaacgcacgaacactctcagtaatagtgagatcaatgaatcgtatatgtgcatctttcgtgtgcgcgcacccaaaaaaaaaaaaaactctgtaccacgtacagtcaacttgcatatcgcgaacagggaactcgccccgtaaggtgagtccgttcagtgtaccctcgccgccgtatcagcagcagcagcacatcgtcctcctcgtccattcgtccgtcctgttacgctgatttccgctgcgagcgccggtgatgaggtgacgacggtgtgacaccatttgactcaaacagcctctcctcgggcctcgtgccggtcaaatggcacggccggctccaagccggacatgccgncccgcccgcccgcgccacccgtggccgtcgcctgcgttccgcgggcttgggcccaaccccaaacaacacgtgccgatcgggacaggggccgcacgtacggcccggatcgctccggacgcggatcgtacagccagcgccgcggttgtcgccaccaccgtgtcttcctctccttatctgctagtactacgactacccgcggctaaccgagaaaacgaacaagcggaatcgaacaaattgagctcaccgtcgtcatagtagcttttacctaacgcttactctatttttttttcttctttaacaaggaccccatgcgattgcagtgtaggtagactggtgccgtcatttatccctgcccatgtatctagaccggatcgtttctacaaacaaatggtgtgctagatacggtcgaaaatgatcaaaaaaaaaaagagatacggtcgaaacctgcttaaattcggcaactgtttgctaaaaaatctgttcggcatgccgtatatgagtatttggtgcattttgggcgaatttttttcgaaaaatgtaaatgaaactcacgtgacatgcaccatcggagatacgcaaggagtttacatatttttttgtatgcattaattcggttctctaatatattttctacaaatttctttcttccaattttagtgctccctcaaaccgttcagttcatcgagtttaatgagatatctgaaatttatcttctcactagggctcatatttaaacaagatcaatttaacttataaacatttgggagtgttcggcaggccactgccacagctgcggctgcgcacagcgaggatggcactgttcatgccggctacgccgcagccacaaaaataatagccaacaggtcttttatattcaatataaacatttaaaggatatgaagctttgctaaacagagcaattataagccgccataatgcagaagctaccacaccaagacatccgtgtgtcaccagccacgtgacacggcgatgaatgggattttggatacaagacgcaaaaatacaacaaaggtagttggaactcggcgacgaaatccaccgtaccccgggttttgccagcccaggaacccccgcccgggaccctctgccagccagccccgttacaggtgcggtggccacccgcccacacgacggaccagcccaacaacgccgcggcgcctgcgcctcctctcggtctcgcggagtcggtggcgccgcggccgctgcggcgttgggcggcgcgcgcgcccccgaaggccgaagcgttacgtggaggccgcacgcacgccgaccccccctcccctcgtctccgtcgtcgtcatcatccactct

SEQ ID NO: 52081 - DNA, 751 bp, Oryza sativa
ccgttcaatcaagctgtttctgcttatggtaagtaaaaacctttctcaaggatcttcctttgtctgaagctcccttttgtcttcgtaactattaggagtagataactaaatagtcattcagaattaactaatgtatgcggacaaccctcataactaaatttgatgatctaatttccttacgactaaagtgagaaggacaaatttaccattttctgctttttattttccttatggtggtcacgatgtaatgcataagtggataagcagtaagaaacctgaatagtaatgcagtatgcaagaggatgttactagcattcacagcttttttgtgacgtgcagaatcacgcagtcctgaccggaaaacaactatacctcaggtgacaggaactgtatgggaagcatgtcttgctctcaacaaggtaccaacaaccaactgtgttgccataggacgagccatgactcagataggtgtgtatctgaaggatattctccgagagatgaaagaactaccaattggtgattctaatggcactgctgaaaaatcttctaatggagctgtggacaccacaagttgttctgatagagatggatcgtcaagtgaccttgagttagatgaggacttcactgaagaggaggttgctgttgccaaattggttgtcactgtggcttccgatgcgcttgttgtggtgaaagaaacaattcgtttcattacttgtttgcttaagatctcaggtaaccgaagtggagctaa

SEQ ID NO: 52082 - DNA, 718 bp, Oryza sativa
ctcttgtaagtcgtaactcaagaaagaatcgatgaggaaattcttacaaaaagcacaatagcccaggaaaattcagcaggtacaaaaaaaaaatctaggcctaagggccatgatgaatgaagattaaaagaacagtcctaaaaaaaggtactaacctatttgcaaataagaaacaatttgtttgtttggtaacataccttgcccatgatgcttggctgtcggctcagtccaacccactcatatgtttaccgtcaaagtaacggactgtgtgcatccccgcccatatacctgaataagaatattagcatttcagccaaaatatttagatgaagctgaacacataaaacactccatagcctactgctaagagtgaggcttatatggcagatttgttcttcctccattcacatttacttgtcacttttgaccctaacgtgcatatgcaggtactctttcaataactggttactgaaatagaaagattgctttcaacccatgaactgatagaagaagataaattatattacttcataaacagtaagtgtttaatgtcagcagtatgcatgtgcatcaggtctaagttttcttcttaaaactctcagatacatcacatcgctattcattttctatattatcatgttcagttgataagagttagatccaaacaaactgtataaaatatgcaaacccaaaaacactatattattttaatctgcct

SEQ ID NO: 52083 - DNA, 719 bp, Oryza sativa
ctccggggaacgacgcgaagcaatttttcgaacaaccttctcttcagacagatcatctccaaggagacgaagatcgctgacaacaccctggagacgaaggctgaaatcctccaggtgttcgccattcttgaatcgcatggactcaaaagtttggcgcagcttctatgctcgggactccttaacacgatctgcgcccactcgcatggatttgagcgcgtcccaggcgtctttggcactgtccttctcggcgagcggccggacaatctcagccggcaccgctcgcaagatggccgaaagtgcctggcgatcctcctgatacgggacatcgccggtgtcgacagcatcccatagaccttgagcctggagattgactcgcatcaacaccgcccaatcagagtaatttgagcgtgtgagcgttggataggagaccgagccgccttccttaacgatccgctgcacgacgagctgtcgcctgcgtggccgtggaggagacggcgagagccgatggcctgttcgccggggagtacgagacgtgccgccggtgggagcggacatggctttgataccaaatgaaagccaagcccaagatttgtgtaaactcactatctctctctcacgcgaattcactggtctcggaagaacgatgaacacgaacagagtttttggtgccgcttactcgctgtgacttttctgatgctcatatatatagccaatttgta

SEQ ID NO: 52084 - DNA, 1817 bp, Oryza sativa
  unsure (1)..(1817): unsure at all n locations
gtcccatcgggggtttggtcaatgcaactcgatctgaatgggctggaagaaccggcccaaaccatcccatctcaattggaaaaagtacaccgaaggtccctcaacttgtcatcgggataaaatacgtcctcgaaccgcaaaaccagatatgcgaggtcccttaactatacaaaaccggtcacccaaggtccttcggtggttttaacaccgattttggtctatgtggaggctcgaaccgcaaaccagatatgcgaggtcccttaactatacaaaaccggtcacctaaggtccttcggtggttttaacaccgatcttggtctatgtggcggctgagtcagcgtgggacccacatgtcagcgtgccacgtcaaatttcccctttcttttttctctcttttttttagttctctttgctgcggggagtagcaacgggcggcgcccagcgtgctgagcggcggccggcggggncggcgtgcgagcgcgcggcggccgggaggcggagcatggcgcagaagaggcgacgccgcggacgaacgcgttgccgacgatggtgtcggcgcacgacgcgaggccgagctcggagatgacggcctcggcggtggcggcctcggcggtggcgggcgcggaggtcgggagcggagcatggcgcagaagaggagcgtctcgcagacggtgaggtgggggtggagcacgtcgtcctgcgccacgaaccccgcgcgccgctgcacggcacggcacggcgcgcgcccgcctgccagcaccatcccggcgtgccggccggcgagccgcccgccgaggatggagaccagcgtcgacttgcctctccccgatggtcccagtacagccagcacctcccacggcctcaccttgtcggttatccccttcagtatcgtcctctcctcctgcgcgccaccaccaccgcctcctgccccggcgtgcgatatcctccccagcggcgcccccctttgccgccgccgccgtcgtggtcgcccgctccaccttgacgccacgtcgatgaactgagcacatcaagcatccaaccaaagatcaaaatcacctcaaccacacagagcagcatctatctatatcatcgatgtgtacctagagattaagtggcgtgcaaacggaggacaagaaacagtccatcttggacggagggcgaagcggggcgacggcgggcggagcagcgacgcgcgcgaagccggcggggcggcaacgggcggagtggggcaatggcgcatgcgggcgaagaggggcgacggcgggcggagtgccgacgcgtccgaactccgaaactggcggggcgacggcgcatgcgggcggagatcggcgcggggcgtacagcgatcgacggcggcctgggggccccgacttgctgatgctgttgaagacgaacaggagggcgtatacaacttgctgctgcttgtggtgatggacgacgacagcgggagcttgctgaaagccaagcctaagatttgtgtaaactcactatctctctctcacacgaattcactgatctcggaagaacgatgaacacgaacagagtttttggtgccgcttactcgctgtgacttttctgatgctcatatatatagccaatttgtacagactcaaattaacaccactacgccatcattcacgatgacgcgaccacgacgctgaaacccggatgactcgcacacgacgcacgacccggaagactcggcttacatgagaaaaaaaacagagaaacagactctgacgaaactgaagaaacgacaacgctagacgcgttacagtaaccgataatatggcacaggattatagctgaagctaaca

SEQ ID NO: 52085 - DNA, 718 bp, Oryza sativa
cacacaaactttcaacttttccatcacatcgttctaatttttactttcaattttagcgttgaactaaacacagccataaaaccaaagcacattaagttcaaaagctacataccaaaagccatcatcaactgacggatgaatgcatcgcttattcgcttcattgcttgagttaaattaatcgcaagtttaagctagctagctagctagctggggagttcccacggactgatcaaatagcagaccaatctaagtaaacttttcatcgagcaccttgtgtgcatcggccaaagcatagcgaagatcctggcatgcatgcttggagcaatcctgacatggcctctgcagagagaagaataaggatgtggtggcgcacagctagaaggcctaagcatctatggggtcgccggagcatgctctacatgggccacagccgcatctacacggaccactactacgaccccatcgagctccagggcagccgccgccactgctgtgagtctacatggcactgacctcaatggttccatttgagtttcatggctttcgccgccgccaccgccgcgtggaaccagggcgcctctttgtgatggctggcgacgaggggttagcgctggccggatttgggatgggctgaccggtgatgctgtgatctctttatacctagtggtgtgccgcaatctgtgaatggggaagaaacggaggggattgggaggagacg

SEQ ID NO: 52086 - DNA, 1187 bp, Oryza sativa
  unsure (1)..(1187): unsure at all n locations
atttttcacctccactgaacacatgctaaataagggtggcaatcaaatttgctgagggttggcggcctaacaggacggctgtatggcccgtcactggctggaaagaagcagctgattctagcttctcccatgttaacctcctctttgattccagtgaagctgcccgttttncgtcctccttgtacttgaccaggcacgccgaaaagagcacgtcatccatctcagaaaacatcttctttacattatctgtgagattcaggacagcttggttccaatgattctggctattatgttccaatgctggaacaatgataggcatgatcatttggcggttttgtgcaatcaagctaataacgttatcgttgttccatatgaaaagcgcccgttcagcaacctgaaaaaacccatctcgttgaggcaattacttggataaaaagcattagtctgtcatggcagacaaatgtcttcaattcttaatgctggtccaaatatctcacatttgtgatattaacagtacagagcaaccccatgcccaaagcatgattagttgataacataatggcccactattgttgtccacatttatttcggaccatcagacatctattatctcatccatttggcaagtcaacaggtaatgctttcataccttacataaatgatgcaaccaaaaaaaccctatataccatgtgagctttacgatcatgatccatttcaactgagtgatgtttacataaaattttaccacctatataataaaatgtctaggtgaagcggtagagttagcgactagtatagtaattcatcagcgtggcaattgatcaatcaaacagggccacaactactttcatatgtagtactccgatatattatttttaccacctatatattatttttcttaggtgagggaaatgcatagtggcaaaaacagaaaataaacatcgataggttatatttatttgggcaagttacctggaagtgagagctcttgatgcattgagcaatccgcctaaacaaaggtaccatacatttctggaattccgccgtgctgattgtctccaagatctcttcaatctcactcagaaacatcacctccttctgactatttgttattggccaatatcttagcaaaccaataattactgagctagcaagcttgggatccttttctatgaactgtgtcacac

SEQ ID NO: 52087 - DNA, 1825 bp, Oryza sativa
gaggaggagcctaagaggggtgtgtgtgatttgtgaaagagatgggaaagttaaagaaaatattttttttttgtgtctcgcaaacttttacattagggtccttgcaagattggaaatagagcataagaaaagtatattggagggaagttattatacgtttattgtgatatggaattactctcccttaattttgtttaattctcttcaaatcaaacaaactgacctatcttttttcgtttatgtttatacttatcagccaaaatttaaatttttaaccttaaatttaaacctggttttgaggttttcttatcaaagtttagttttcagtctttacttttatgcccctgagaacacgtatataaaagttttattaataaattacttctagtttacaaatatttccacgaataagccaaacaatgaagccaaaagacatgctaggttcactgaccggtttaattttcttggtttaatactttaatcgccatcgggtctggaccgcaaggaatggttcctttggtgtctcttgtggaacacaatttttaaacatgtggtagtagtacggacatgatcattatagaagagctgtgcacgccttacgatgtccatgttgattagaaaaccagctgcaaatctggatctttttcaaagcttcatcagatccttggtttacaaggagagattagccaataatcacatgctaatgctcaatgagaacaacaaaagaaaccagtactagtacgagcactacaattttcgagaaagtgtagggtggtatgtgcaaatatggtcctttaatcggagccccggcccatcagcacgggcagggggggacgggcccggtcggcggaagcccccccctttaattcgaaagacacggtcacgggcggagcgaggccgaccgtccgatggggagtggcagaggccgcacggcgcggggagggtcgtacacgtgtccggccgagccgggcggtgcggccgccggcacaatcgatggcgagcaaacgtcacgggtggcggtgggcacggaccaccctgacgggcccccgtgccgtccgtctcgctgctctttccatcgctcggtcgccgacaggtggggaccgtgagacggcgtgagagcctagatgtttcctgagtgggtatgtgcctgttcaattcagataattgtcaagatcaatctttcaaattttaacttttagttacttggtataattttcaaactttgatagtatagaataaaaatatgttgtgccaaaatttcttatgcactatcactatttggtacttcctccgtttcacaatgtaagtcattctagcatttcccatattcataatgatgttaatgaatctagatagatatatatgtttagattcattagcatcaatatgaatgtgaaaaatattagaatgacttacattgtgaaacggaaggagtacataaactaaatgcaactatattttttttaattttactaaatattggtatgatttaaaatgacactaatttaaacggccctatgacttctgattcacggtaacatcttcggatacatgtgtgtgtgagagagaggatcagcgatattttcttgtagtcatatcgcccgcaatcaatggcgctgatcggtattgctggctgcagccagcctaatgcaagttcattttctaccgctgcaacaggatgcccagcttgctggctgcaacaaccagcagaaacgatcagcgccaatatggtggtggtctggctgcatgatctgcaatgaaataatagcagtagttccttgcttgatccatggggaattggggatggacgtgcaatgagtagagt

SEQ ID NO: 52088 - DNA, 1298 bp, Oryza sativa
attcctgcagccctgaccattcgtcttattcaaaaattttatgcaaatgtataagatataaatcacacttaaaggactatgagtgataaaacaactcataacaaaataaattataattacgtaaattttttgaataagacgaatggtcaaacatgtgagaaaaagtcaacggcgttatctattaaaaaatggagggagtataagaaatgcatgcatgtaggcaattaattatgaccccttctccattaaattattacttttttaaatcctccactctcatgttctctaattctattggatgcatgcattgtatttattaggataatccaaactacaagatgataataattattttcttggtttttgggttaagggtggttatgacttatattttggaatggagggagtaggatacggcaaaaattgaaaagggtacgggtacatatagttctttctgtactcttcctgctattctcattctcaagagtgttggaagggtccagagttttaacggtaatgtttgctttttgactgctcctgctctcttcgatccaacggtcttttttcatttcaattgtgcatctgatgagtcatacttgtttgatggcgtggcttattctggtgcaatccatggatttactttcacttgagaagattagcatcagctacaactatttgaagattatggaaagcatctgcttacctctggtgctcctttgaacgctcaataaactcagcaggtatatcacggccttgataggacgcaagaacagccctgatatccgaaggtcttgccatagcaacatctgccgcacagattgacaagaatgaaaaacagaaataccaaggatgcaagtggggcaatcaagcatgcttcaaaaaccacaggaatgaaataatatgaggggttagttggctaatgcacttgcattcctaagaaccacaaaaatggaaaaaaaaaataactggatgacaggataataagagaaattgattaaaagtcttacattcaagaaagggaataagatcaagcagttgagtgtcatcattttcaagcttccaaggtttgatctcaacacaattttcaggctgcaggcatgattccagagcatgcccactgatataaatgacttgtgcgggatttctgtttagctttgataaatcctgtaaatgacaacataacataaaagacacaaaaaaaaagttatatgctgcaaaaatacagctgcccaggtgttttaattacaaaagaataatattgcctcgtactccctccgtttcacaatgtaagtcattct

SEQ ID NO: 52089 - DNA, 12527 bp, Oryza sativa
  unsure (1)..(12527): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaccataattgcagctggaataggaatgaagaagtaaagatagactagtttctttggatacaaaaagatgtcaagaaggataattgcattagcagcagcacttgcaccctgattcacatgaatataataggttatgttttgggtgtaacaagtaataacttagtactagtacaggtagagatggcaacgggtaatccccgctggggaatacaacccatccctatccctgcgggccacaaatttccccaccctcgtaaactgcaatcaggaacaattttcccatcccaccccacgcggggaattaatcctcatggagggcccgtttaaaacaacatatacatctcaaatcgaaatgtaattaacaaataatatccacactttatataaatatactagcatatatccactaatccacgtgacaacaacacaagatcttcatccactaattatggctcgattggacctttaggcctacataatttgcaatggacttggatccctatcccgatttttaatcgggtatcctcacgaaggacagggatgggcaacagaagatcatccccgcccatgctagacccaagggggcataagtttttccacatttaatttcccgtggagaatcagttgcaaccatccccgtcccctgtggaagaattccctgtgggggaacagggaacgaggctccactgacatctctgagtacagtagcaaataggatatccctttgttggctatatatacattaaattaaactatcatagcgattcaaatttgcagtactgctttttaattaattatttgggtgtataagatgaacacataataggtaggtgggaaaaaatcgctgccatcagactactgatgtgattatgtcataataatgcttgttttctgaataccagcgcgaaataaagtgaactgcaagaacaagaaatcaataaatcacatacaagcgcaggagttcttgaattgtcccatccgccataaaactgcaaaataaatattacatattagattagggagattattgcaaaatcataaatattgaacccttttcatgcaggatatgtcccacacgagtgccaataccaagaggctggttggcatctagtagctagcagcgaactaccaggtactagcattttcacaggttagcttttcttaactagaaatcacgttgacataggattttgtttcagaattggatgacataggacatcctggtccaggattagaaatcctggttccctgatgcataagaattcacatcatatccaggcttacctgtcttcgtggagctaggaaggctttctctagcaagaagaatgcagatccagcaagtgctcctgctacgtacaacttcagtagaaaagcaggaccaaacatgttggaaatctgattcacaaaggaaaaaaaaagcaattcagcacatgcaatataagtaataaatggccaatagaaaatcagagtacaatatatatactagtcccttcatttggagaacgaatcttaactacactaaacatgataaatagaaatactaaaattagaagggaatagttatatgctattgattttgtttttataaaatggataaaccgtatctagtacattcaaaccatggtagacattgaattcccatggcaaatcattgcaggatctctctacctagctggctatttcatcagacctgaaaaacagcctcacatcttctcctgcatggtgccttcatcagtcatcaatacgtacaactctgattggctcggttgaataactagcacaggaaatgtcaataacctctctgtgtgtctctggactgatggaggggggcttggcaatgaagtattataactcttcattacatgtgacctttgcaagaaactaatgaaacaaagaattgttttacaaacatcaagccaattttaattttttttactagagaaaaaatataatcaaaatttgattggtcaaattcaataatgtcaaaataaagaaaaattgctagatcaaattcaatactccactaccaaatatattactctttcttaattttacacggtcaagttcacccagcatgaatcatgccaacaagttgatggtaattcagacttgcttgaaatattcaacaaaagatgctggaattcagatgagcatatattatagcaacaagatcatgtcttggatcaagtgttagataatgtttttagtctacactcaacttatgattctttgactgatttgataattcaaaacagctataattcaggtgtttcagaaagcaaactagtaatagtaatgatttccactatattgacaagtcaccatatccattcctttgtttctatttaggatttgagaatgcataaagttgcacataggtgcatagaaggacaaactaatcctttttacttgtcgtttaggacatcaacatagtcaccaatgcacttgtttgatcattgttttttttaatcatatatttataaagattatcgaagataactacatgaaaatcatgaaaatctgctgatgtcatttgcacacattaaatcttaatattttgatattaaaatgttatctatttgataatggagggagtacagacttctgcattgtaataacaagagagaatggtgagcagctgaacatcttacacttgatccgaagaagtagagaccgatcatattgctgatgaggtgaccactctctgcgtggctgaaggcattcgtgagcaacgtgtgtaacctcccgcttttgaagttatcaagagaaatctgctcatcaaacaataatcaagccacacttaatcaaccacttctgaaacaaaagcagaagctcttcgactgatcactaaccataaaatgcctcctcatgaagctaggatcagccaggtgccatagcatgaacacgcccacattggcgcccacgagcatcaacactgccccatcggcggacggcaaccacttcgtccttcattgaacatcaaaaccaacccaaaaaaaaatcactaaaccaccacgaaaatcccccatttcaaaccatacgaaccgaaacctcaccaggacacgccgctaaggaacatggacgaggaggggaaccaccccgaggacctgcgccgctgcagcgagaagagctcgagcgagcccgcctcgcgcgcggccatcagccaccgcgccgcggcggcccgggcggctgccgccgccgccgcggccgccgccgcgctcaccggcaggagcgagccagtgctgcgccatagggggaggcgggagggcgaggcggccgcgggactggatggggcgtggaggaatcggtggggggggtttggttggggtttaggtctcggggcggcgcggaggcgtagggcttgctgcgcgaggagcgactggaactgcaggaacctcctccccgtcgccattcccgcctagctccccgccgcctactcttcgctccgccgccgtctcctccgcctcgggctttcgcggcggcgcggccggtggctttgcgctctccggttgatcagctccaatttctcaacttccggcttcgggaaggacacggaagggggaatcgctgggcctactgcttgggccgcggcccatcaaacgtccacgaccgctttccccgcacgtaggccgttgatttctcgatcgaacggctgctgctgtcgcgattgcgtagccgacgcagcgagaaggttttaagggtaggcggcgccgcggcggaggggggctcagctcgaggaggacgacggaaaccttcccggcggcgcgcgagtctcgcggggggaggagagcgatgtcgaagcggcagggtcccccgaagcatcagaaccgctacgcgtggaagcccaacctcgggcagaagatcaacgagaccgtgagtcctcgagccgcctccctctccttctttatcctctttttttcaaggcctgagtctcacggctggaatcctcgccgctgcaggagcccggcggcaggttccgtcctttgtcggagatcaccggcgtctgccagcgctgcaaggaccaaatcgactggaagagaaggtcgggagtccccttctgtagtcgtcgttaatcttagctcgtaattttagcttcttggcctctcggtccgatctgtttgtctcttcttggcagatacgggaagtacaagcctatcgttgagccggcaaaatggtaccttctcttgccctttttcgtaattatcgcactcactcgattgatggaactatggaggagtgggcagtgatggatgctgatagttctcgtttggtttttgcagtcagaagtgtgggaaacggaacgtccgacaggcgtatcacaacgtctgcacgggtgaatttcggctactccaccatgtcgtcttttgctatgatggtgttgatgttgttactgatttctctgttgcatatgctcaatgcagcttgctccaaggaccttgggatttgcgcgaagtgctgcacttgtgttaaagcgcttgtcggaaggtgatccctgcttgtttactatgttgtggtactagtattagcataaccaaatgatatcctaactttgaaacttaggtggctaacaattttctaccattttctagggatcttagtgaacaggagagtgagcgcaaggaactagaggaggtttggttgtgctatatttgaatggagattgttgtgaacgttttcttttgtgctgactattaaattattttgtaggccataagaggtgctagggagagggagaggcgcacacttcttcgccttgtgagtacttactatggcatgtttttaatgatatatctttatctgattaggtatagcgaatgtttgtcttcaagggatgcctaatcacaatatatgtttcccatgatatctgaaggcagcactgcaagaaattagaacaaagattttgtcataattgtattgtttgatttatcatttgaaaataatccccagttcaccacagtatttcgcatatacccttgaatttttcccttttatgtgtttctttggatgcatcgttattttggacaacttaaattatggagatctctaaattatgtgtattctagtattaaggtgccactgcctttgtttcgatgtccaagttgaatgaattaatattatgcaccttctcttcttgtgctattcatggtttttgttgttccaatatgtagcattaaatgtgaatagaactttgattgttttaaattcttgtacacaattgtttgctctggcatcagtggttcgtttaactgtaaggattctttacaggtctttatctggagttctattatattgctatacattaaatctgagcatgtgaatataaatggctggtccatgttctaaagtttcacctgtcttgaaacattttgacctgtaattactaattagtagtatcagttaagattgttttataccccgctccctgtagaatgtaaatatgatctgttaatttagcttttcaggtatggaaaaagaaaaacatagcatgcttgcttagaatggttgcaatatcaagatccatagtacatgagatgtactattattattattcagctttggaacatcaattcttaaacaaactggttgccaaacttttgacttgaaattgtcgagatgaaagtgcattaagattccaaattatcatggtaccttattggaactgaagccttagcttattattctaattttcattttggtaaccaaatggaaatcatttttttagaattgctggtccatttagttattcacgtgaactagtaattccatgcatatttattaacatcaacattttgttgcagatgaacaaaggtggcggggagagcggaccgtcggttccaaagattgctgacagaagtcgtgaaggggacattttccctgctgcatcccttgacgaatatgctgaacaagctagacagcaagatgattcagatgaagaagaggccagggattttgtagaagattaattttagaactcagaaaccttttcttttgcaaaaggatttatatagccttatgtggtgatttacattacatggtgggtaatcccacccactgcggaaaacaagtgtattagttttggcagatatatttccgtctatcagatgtttatcagtgtgtgctcccattccgtctgtgcttgttcaaactgaagaattggaaagtagcatatattgcggtttttccggtttacatgtcttttccccataatgcagcttatcggtgtgtccggaactccggatcagcttttttttattattattccgaggaaaagctcttctattattctcttttttaccaacttattgcgtgcatgatgcccttgaagatgttctctgttctgttcttccctccatgtcaagcgaggttgttttcttcatgtttacggttttatttagcgggctgccaaatttttcgtatacattgaaacgttaaaaagtatactattgttactaaggctgtgtttagttcacgctgaagtttggaagtttggttgaaattggtacaatgtgatagaaaagttgtgtgtgtatgaaaggttgatgtgatggaaggttgaaagtttggaaaaaaaaactttggaactaaacagggcctaagagcacccgctatggtaaagtagggtgctctctataaaacatgtacatctcagcaatagactagattaatagtaaatcacctcaatagtatgtctacataggtatctatagctctctcatgcattgcctcgtttttctctatagactatctctaatctagtagatagctttgctctctctcttcatttaatatcttccaagtaggaaaatatgctgacattgatctcttatagatagcttatagataaccattgtgggtgccctaagagcatgtccaatagcaggctataagccagctgcaaacatattttaaggagataaataaagagaaagaagagcagcaagctacagatttgtattttaaggagataaataaggagagagaagagcagcgagctacagatttgtagctagctgtagcacggactctaagacgcaatgtgtgtttgacaggtgggaccaggtattaatagtgtagtatgtaactattgtatggatgagctattagattggttatagatgaattgtagctactacttagctatactattaagcttgctctaacaggggcttccttcttgtagctcgggttcattaacccaaaaatcttgcccacgtttgctactgtcatgtcagagcatggccaggacatcaaaaccttccataacaaaacacgcaaaaacagtaaacaagtgtctcggcaattcggcatcgtccgccgcccggtgccgttgtgtgcattcgtctcccatgatcccatatcccgtcggcgtcgagacatggaccagactccctccgccagtgccgcacctgttcctcctccccctctttcaaacaaaagaaaacaaacgagatctcatccgaacagtagaacccaccacgtaacgttactctcatctcgtgccaaatcaaagcaaggcaggcaagcaagaggccgttcgagctgcggggacgatatgcaacggccggcccagtcgagatcgggagggccggagggggagtggtgcggccggcgggtgccctgcacgtgagcgacgcagccgcctgcgcccgtcacgcgcgctcccgcacgttcccgacgttgtgccctctgcctgcggccgcgtgtctcgccaaatgggccccgacaaatccaagccgctgatacacaccaatcgctttccccgaaatgccctccccaaagttggaaccctttttggttgccggcacactgcccgcaccaccggtggttggcacgggttggatatggaccagctgtgactattccggcgatcgagtggtgttcttgattataaaccctttgtgtttcaagaaccttttctttttagtttataaacccttagtacatgactgaagttttatgatgctaagcgatatttgttaaaaataaatgatgctaagcgatatgactccactagtatacgagtgttgatttaatgttaaatattatagttaacacttaagatcttaacaagaaagaaagggattgtttagtaggcggacaacggcggctatggctatgccgtcgttgtgtgcgtgcatggcactgttgatgtcgagtatagtgcagtcacaaatctagcagccgaacaaacaaaaatgataaatatgcatccgtgcattatgacagaatattttaaaaaattataacacatctaaaaacctaaaactatttaattaccaaactattcacgtgatgagatgaaaagtgctgagcagtcaactatatcgataatagactataagttttgcatggattattgccccataagcagcgatggcccatcaccgtccaaaaagaagtttttaaagtagtgatataggtttctagttagagaaaacaacaaaggtaatggtcacatcgttaaagatttcataacgatatctttattttttcggcaatagatataacggttacaaagtcatttaataaacattttagcggtaacatggttcacgtcatcttattttgcacttcaatttagcgcacaaataatacacgtggatcaaattacttggcaaccaggggcagcataaacaaagctgactccagagtgagggcattttggtaaactccggacagaaaggcaggcggagtcatccacagtccgcaccattcccccggcgctgcaagcaaaaacatgcccaaaagagcacacaaccttggctggaggcggcggcaggccgaatctccttatcagtccgggataaccccaagctctctctccccctccatccctttccccactcaccagtagccaccaccacatctcgcaaggccaaaagccctagccaccgtagtagtagctagtagctatagcaaggtagagagagcgctctagatctctctctcgcggggcgctgggcagatcgacctggcgatggcgaccaaggggaataagctcggggaggtaatgtgggagcaccggctgcaggcggcggccgtggtggcgctggtggcggccacggtggtgtcgatctccgccatcgggcccaggctcggcgccgtggtctccttcttctggccgctgctcgtctccacggggttcttcctcgtggccgtggccgtcctgctccggatctcgccgcccccctccagcaccatcgacgagtccggcaaggagctcatcgacttcgtcgccgggtgccgcccggagcaccaccccccggaggcggcggaggccgccgtggacgtgcctccggagccggagatctagaaaatcgagggtggcgggcgtggcgcgggcggccggcggaatcagcggcgcctcgtcgccgggcggcggtggggttgtgtggggtaatcgccagcatgggcccacctggaagtgcgtgccacccccggtgtacggtgcggccgtgggctctgtgttagcgtaggattccgcctccgttgtggtccggggtgtacaataccattctcaataaaaacatggcataaattcgtcctagtactactcggtatcgacttccattatgatcgcgtcttgctttgagttgatgcaacgcaggttcgctgtaacgccatgaagatgaaggcgagagtcttaagcagttaagctatacttacgctcgaagaatatgcgagtctgccaatcctcctcgagcctcaaaattctcctcttcatcccgctttagaaagctagattcactcatcgagagctgaaagcaaaagaaatggtgcaattgtaaatctcatttcgcatcattgatgttccgtgagaaaagctataaagacggaaaagagaaatggattgatagtagcgtggtagcaggatgccctttcggcgtaatcggagaccgacactctttcggtgttaaggagttgctaaaccggtcactcagccgtccagttttgctcgtacgcgacgccggttcggacggtcacggacgcgcgtttctcccatcgttgtcgccgtagtaggaccccgtcttactaattctcatctgttatcgagcggacgcaggcctgatggtcactgtcacgaggctgaacttgatacggtttttataaaggaagacgaggccgtcatgctatattctctggtgcataggtcaatgcgtctgacgtggccaccgcgtggtctggtcgggtgcttccatggtgctgacgtaatggtctctttgagctttggattccatggtgacatttcttggcacaaatgaatttagttggggcatttcttttcttgaatatgtttttttttcttgaacaggttgaagcaggttttactagctacgtagttatatgctaatgagccaattctattgattaactgacatcgagaggacgataggagaagaaggtgaccggacaccgaaaaatgcacaaacatttttgtctcgaatggatttgaatatggtcatgatggatgtgaagttctgtagttagtaaatactccatctgttctaaaaaaatgaatctagaactgtccagattcatcatatcctagtacgatatttgatttttcttttggaacgagaagaagtatgtattttccaataacttgaaagacacacatgcacacacgtcatcacgcacgcacatcacagtcacacatcctcgcaaacacgctaacacacgctcaaacagaagaggctagtggcgtaactgctacaacttttgcgcaatatctatggacattaggatttaaaaccttagaatacaagattatgcacctatgacatcactaacacatcatcgatggttcctagttagaaaactatcaataacatagcaaacatatttttgacaatgttatcctactaaattttggtgttacttatggtgcttcacagctagccaaatgctacctaaatttccaagaccaccaaatgtattttacacagtgatatcttacaaaaaatgataattttgaaaatgtccaccactaaatatagtactgcaattattaaatgttctgaaccagatttaccgaaacacgtactacttgttgtagcagtgaggactaggtgtcatacctcctattcgaccaagacacgacttcaggccttgatgggcatattcctgagtttcaaagcaggtgacaaaaaaagagttcaagttgctatggacggaaacatgttaattgggcaaatagtattcaagcttgttatagaaaggcaagcggtgcgtggaggatggagaagaagcttggcggctacgttacccagcaagaatattctcttacaagttccctagggtttctagtcctttggattatccatgtaacttcgcatgtaactaccatggctatataagccgatctaattatatagcaacacgatttatactttactgaaatagcgatcatgagtgtcatttgactcatatcaagctcatctcgttacaaggataggcgagggaaacacttcctcatctatccccattatgttcatgacgttgggtcacaacttagggaagactacgcgtcggatgtatggagaattaaaaaaaatcggacataccccagtacctaccattgttgcatgcaccgaacgaatctgccctatcgatttcatcggtgcttattcctacatgattactctcttcaccactctctctcctctatgaccactttatcaacaacctataaacaatttttcctcttaaattctttatctgatctaccatctgattacgtcgttatacttatagcaattaaatctttacaataagatgtcacatgaatatattttgattatatatatatatatatatatatatatatatatatatatatatatatatatatatatatatatatatatatatgttccaactagtgaaatttgatgtttcatgcgagggaagcaaatgtttcacatgaaattcgagtttgttgcagattttaagttttctttgttgcgatatttatttaattttaatgttgcacatggtgttgtttggatggtttaataactattttcttatgtttcacttattcatttgaaatgttgcacatggtattcttgggatatttcaacaaatgttttgtaatgtttcaacaattataagtcgatgtcatgtataatgtaaaaatattttagttaggatttaacaatattattttccttatttatttgttcttctacatgtgtaggaacatgtatacgtaaatatctagatcgttcaact

SEQ ID NO: 52090 - DNA, 10250 bp, Oryza sativa
atatatatatatatatatatgttccaactagtgaaatttgatgtttcatgcgagggaagcaaatgtttcacatgaaattcgagtttgttgcagattttaagttttctttgttgcgatatttatttaattttaatgttgcacatggtgttgtttggatggtttaataactattttcttatgtttcacttattcatttgaaatgttgcacatggtattcttgggatatttcaacaaatgttttgtaatgtttcaacaattataagtcgatgtcatgtataatgtaaaaatattttagttaggatttaacaatattattttccttatttatttgttcttctacatgtgtaggaacatgtatacgtaaatatctagatcgttcaattctctcggccaaatagtgtcgatacgtgcaacacagtaaaatgcttgttgaaacattttgctcatatgcatgaaacatcaaatataaacaattgaaacatatacatactttttattagaatatagtcaaacgagatgtcattgtaaagatttaatcataagaaacataattgtataataaaattatagattagataaattgtttagaagaaaaatcattttaaacaaggaggtgggagagataaaaagctaatagttggttacatcatatccattgcatgctgcagctcatcacatcacatccttccatgctttgttgcatgctgccattatctccaccataaataatccattttcgtgctacgttttgcttgctccgacggaatgttcgattttttgtcgggcgtcggatgtctgataagaagcattttcgtcacaactcacaacacaacctaaaaaaaatagcagtccaaaagtgtaccataatttagaaaggaataagtccattttgcctccctcatctcttgcgcttgcgtgaataacatccctcaaccggaaaaccgggtataatgcctccttcttctctgaaaaccagagcaaatcacctccctcggcggtttcggaggtggttttgtcctacgtggcgggttgacttccatatggcatcgacgtggcgcttacgtggcactaaaataaaaacaaatgtaaataggacccacatgttagtgagtaaaacaataaaaataaaatattgggcccacatgtcagttacctttccccttcctctttatcctcacggcaagcgagatggagagagctagctcggcggcagcaggacggcgggtgctcggtggagcggcggggcggcgggagcttggcggagcagcggggcggtgggagctcggtggagcagcgggagagtcggggcggcgggaggtcggtaggagctcggtggagcggcgggagaggcggggcggcgggagctcggcggagtggcggaatggcggggcggcgggaacgacagggcggcggaagctcggcggaatggcggggcgacgagagcggcaggagtgacggggcggcgggagctcgctgcctcccctcccacgcccctcctccgccacctcatccctatcctcgcctcttcggcctcgccgccgcctcttcttctccttccccggcatcctggcgaagatggacgccgacggatacgcaaagttggcatggtaggatgcagcacaggggtcgtcgaccacgcgtcgctagtccgacgtggacggagccagaacgccgccaccatgaccttcccgcgcttcggcgtcctccatccaacattcggcactcttctcgctgcgccggcagcgactggtagtgtcgccatccaatcttgcgttggggcagcaggcaacaattggccgatgacgtgtgatcatcgtaggcgcgtcctcttcgtgtcacggcgatcctcgtcgccgtagtagccgtaagcagcaccacaacagccgtaaggcacgccgtagtacatgtaaggatcagctccgaatggcacgccgacgccgaagaaggggtcgacgtagcctggcgccgggccgaacgggaagccatagctgccgtggtgatcgccgtcgacggcgagggctccatattctgtggagtggtcacccgccaccgtctcccacgcctttcttggtccgaggacacctgatgagatcgtggcgcttttcttggaagacacgttactgcggctcacctgcgaagcggccaggctctgcggcgccgcctctgtcgcgttgctgctggcggagctccttggcttctcggttccacttgaaacgctcgctgtgccgctggtggtggcgagaacgttggcgatggtggtgcggagcgttgggttggggatcaggtcgtcgacgcacgcctgcgccccgcacgcgcacttggacttggcggcgatgtggtcccggatgcaccagtcgcagaagctgtcgaagcagcacttgctcgccagcaccgcgtcggccatcacgtttcggcaaatcttgcagtagagttccgatgagatgacgccgctagatcccccggacggcgtcctccattcggcactcatctcgcagctgccacgggggatggaaaagataatagaggaagaggagataagttgctgacaagtgggacccacaagttgactcagctgccatgtaggacaaaaccgtctccgaaaccgccgagggaggtgatttgctctggttttcagagaagaaggaggcgttatacccagttttccggttgagggatgttattcacacaagcgcaagacatgagagaggcaaaatggacttattccatttagaaatacaaaatttggtagggttggcttaggcaaccaaccaacccaagccaaccaaagaagccctcaaatctttgtctcggcccataatggccagcgtttatggctcacttctaatgggctgtggcccacctgaaacagaagagtatcgtgtaggcgtatatgcccactcgttaaaaagtggccactctctgacaagtgggccacatcggaacactcttgactcccctccaggcctccacggctccacctccttccgctttcgcctatccgccgtctcccccctcccccttcctcggctcctcgccatctcgcgctcggccgcctctctccctgcttaaaccctctattcgtcttctccaagcaaaaccaaaacccgagcccacccaccgaggtcctctccccctcctctcgctgggccaccacgccatggacggcgtcgcgaggtcgcgcctcctcgtcccgctcctccccaggatctccgcccgctccttctccgccgcctcccccgcgtcagagccagcggcggctgcggcggccgtcgccgcctccgacgcggccgccgccacggactactcgtcctccgcgggcgatccctcgtccgcgccgcccccgccggcccgcaagccgctgggcctgctcaagggcggcgtcctcgcggttgtcgccgccgcgttcggcgccacaggctacgtcagctatggtgcgatctctgatccctaaaactcctagatgcctctcggccctgctacttcgcattgcagtgtttctactaccattctcaattttaaagtgggaggggttcggtttggtgctgtgcgtatgattcgtgctcgtgtttttgtcttgtgtagcttattctctggatgaaattgatcagaggacgcgggagttccggaagaactcgaagcagcccatccgtgatgacctgtccggtttcgaggtaatatggtagcatgtcaatatgtcatgtttgggtgtgtgataacttgtcgctagctggttagtagcgtgactgcataagtaagcagtgatgcccttggaaatatgaccgcataattctgatttcctgtgtaaaaaaacttggtttcatggggtgaatatttgtacacagctatagggtagttgagatttgggcatctgaaactaaaagttattctagtacgacacaatatgttctattgtagacctgcattctgagagtatggataaaagctaaatttctgaattgggttaaagaatttggatttcagccatgtctaatagacgatttgcttcctctctgcagaagtttcaggctatggcttattcagcagctatgaaaggttctgaccacatgactccttcattatcttaccatattacctcgggattatagagtttcaacatgtcatgcatacctttcttcatccacatcaggagcaatttaccattacatgttattttttctttgtaaaatacttgtttgcagccaaccttagggaaatttaccctgcttcacagtgaataactaagccttgtcactctctgaaatataattttgtatgcactaaagtaatggtagtcagaaagatctactttactgtatgcatggtgctgttgttaagctgacaataaattccaaatatgtaacccaaacttcacaactggaaaaaaaaactaggggtactataatctcgtgtaaaatagctagggaatacccactttgtgtaacaatcagttagctagagcaactgtgatctaaccattatactatttacatgcgctgcacctagttgctacggagggcatgtgtctttggtacaaagctgtttgttaaatatctagtaaattgatgcattgtctagagcgctctatggctctagacaaacatacaccacagggaagaagcatggtatgagtgccctagatagcaggggttcgtcatttaaccctttcatgtactataaattgttatcctcctgtttgcatggcataattattgttgttccttttctttgcgtctcaattcttaaacacatatgttttgttttgcagttcctgttgctgctattgagttctatttggataccaggagccaaatagaagatcaaattcgggtcagtaaaaaatattaaatcttttgttctccattatccatgttggctattgtgaacagacgtgcagatcatgctaatactcatttttattaaagggctttagtgaaccatcatcagataaacttcttccggatctacttcctcaagagcagcatgtcttcaccctagttctggatctgaatgagactcttgtatactcagattggaaggtgaacatttatgttttctacgaagttacttatcttggtatttgatatgtagtccttatgtagtatacaatatgacccaatcctaacagttacgcaaactcttaacgctctggcttccccgtctctccacaaatttgcacttgaactttaccatctgtgctgtatggcataactcgaaagtgctcatgctgattttgttttggatctctgattctctggttttaccagaactgttttgttacacggatttgagaacctaatgccttattaaatttcgtttgggacacataataaatatgttatgtgatccaaacaaagttttaggttgttagcctctaaaatcttttttttacaagatctagtcttggactcttggtacaaccagagatccaaacaggccctaagtatcgtaatccccattcagattgatctaaaaagggatggttatttaaaatggttttacttatttgcttgttcgattggaagcttgtgatcatttttcttcagttcactcatctatcaattgtatctctgttctcctatatcaactttgatctaaatttaaacttcctaagaaacaatatataccgtctttttgtgctctctctctagagaagggtaatcactttctgtatgtctactgcaaaattgccaaactattgtggaagtccttatgttttctagttaagttttcaagcatgcatatcatatagtataaaatgtttatgacccttgggaggctgcttgacccataatttcttttatgtatgtatagcgtgagcgaggatggagaacttttaagaggccaggagtggatgcctttttggaacatcttggaaaattctatgaaattgttgtgtactctgatcagctgagtatggtaggtttaccagaatttcctcaacaatttggttgtttctgaaaaatatataaacccagatgaactttttttacatggacagtatgttgatcctgttattgaaagactggatccaaagggctgtgttcagcacaggttatcaagagttgcaactaaatatgaaaatggaaaacactatcgggtatggtagtcttatgctcttatcatctgttctcttagttgtattatacactggttgaaacagtttcatatatttatcctttaagcacccttttggtaagctaagttgcacactagcttgttctatgtttttttggatagtattgtgattattgagtaactaactgtatgctacgcatatgtatgcatgagatggattagaatgtgttttatgttcttcaaataactggcaggagtgaaaattgatgttatgacaaagttgtttctgtccatgcattaagcatataccactttgtccactttgctctctgggatctggctttcatgaccgagagaacacatcatgttttatcttgtatagtttcctcttatacagtaaaaatgtctacaaatcatatcaatccaacatgatgggtttatattgtattgtaaataattctggttttttttcgtactcctattaaaattttccttccaatgttcattgaatgtaataaaatctttgaattggagtagtcatttcttatctgcatcttggccaaggcctttgcccttctcctgtgaagtaagaagaccagtgcggtgagcttccctaaatgcttcggtgcagtggaaccttgatagccgtggcatgcgtattaattttatggtgggtcattcaaataactacttaaaggggtgttatatttttatggattacagaacaaaacaattgcttattttcgaacattactgtagaagtaaagaacaaacataaggataaagagaggctttatcatcattagtcgaaagactggacagtacatagcagcaaaacaattgcttgcaatttatttatttagttattctttatccgcaagccgacctaagaggattctgccgcattataaacgtcttggtagctcttgtattggattggagtgaatgcaccgaactcatctcctctattatgcttgagcctctgagcctcttctcttgagatgcgatatgcatttgctagaacatcatttgggagagcacggaagatggaactctttcctgcaatgtggcttaccatagagttaggattggtcttgaatgcaatgtaagcacatccttctctttgtgccttctttacaactgcatagtgttgtggtataataagcagctgtccgcggcgaagctcgccgttgaacactgtctttccattgttgttgacaacttgaacccgggcacggccttgagtaatatacacgacgctgtgagcgttgatgttccaaaatggtgaaaggagtgcattctgcaatagaaaaggtgcacatcattagcatattgtgtgcattaaagcttttaccaagaaaaaaatgtgctgttcattttacctggtatagatttactttgactgcactcatctgtacaagactaagaatggggaaattctgggtgttgagatttgtaacccttccagctcttggattgtatgtatcagcacggttaggattatcgatgttttgccttaccctcagggtgcaaaaggtctcatccaaaccgttagagcagccacttccatattgactttgctgatattgtccttcttgataacgctctcttgattgcacttgtccttgttcctgctcctgcaatgatgcatatggctgcagcaaactgagcccgtgttcgacacggacaatttctcctctttggtcattttgacattggagctgccttgccacttggctgcttacgccaagagcctcgctaagtagttcagtgctaaagccactaaatatgttctgtgaccgctcctcaacctcacgcctgtatgcttgagggtttctcttatttccagctaacaagaaatcctaacagttgattaaaaggctaaatcatcatctaagataagtggaataaaaatatcaaaatagtagtaaaaatgtttagctttggaaaagttctgcttaattaccctttgcctagggtcaagttgattagcaccgttgttgagatcagtgacatatatggcaacaactggcacttcaccatcattgtagcaccaatgagctacaccagcaggcaatgcaattacatctccttgtctgaaacggtggatcttttgatgttcatccttgaacttttgactttggctttgactttcggtcaattgggcttggcctgattgttggaactgttgttggtaggactcaggacagcctgggaaagttggccctgttatacctctccctgaaagtatggcatgcatgttaattacaagcaatataaacatggaagctgatcattaattcattatgcacttaaattgttgcacgaaccttggatgatatatactagagatgcaccattagtgtaatggggtagtagaaggcctctaggttcaataactcgacggacaacagatactccggtacattgaaattgctcattagagacatcgaagaactcagttgtgccagcttgagacctcacactccgaattggctcaaatgcttgcaacctatcgaacctgcattctcttggacttccacgacgagaactctgccattgactagtgctctggcctaatagctgctgggctagagagccattgcacaagaggaacaagcaaactgtgaagaaaactatggggcgatttatggatgccatgttgttgtagtactaatgaacttgaatggttttgtgagaaacaatgctaaatcattgtgcatttatagtgagataaagtctcatgcatttgaatgttaagatagagtttgttaatgtccagacatgaagtgactcatgatatatgaagtgtggtacacggaaggtggatggataatgatggatgtgtaattgacacatcatttgtattgttctctctttctttcttttgcaatatgacatggatgatgttaaagattatatccatgcatgcttttgctttttgttgctgtgccatagctttctatttctttttgaacatggttgttggtgatcatgacttatatcttgaagctctgttctagcaatactttaatatttagtgaagagtttttagggtggtcacatgttgacacgatcaacaccgagacctgtgagtttttggattgttgcatgatatatgggccacagtaggcatgtgaattttttttgagtcatggcttgtcttataagctctcctcttttcgcaacatgacatatagctctgtagttttatgtacacatccttttgctttatcttgcttgactctctggtttgtcatgtgttacacccaattgtcatcagttatgacttatgtatgggaagttctaacactttagcttaagatacttacctagatgactagaaatgaataggttgacagaggcatgaaatgatgcatgacttgctatgtcatagattatatcttcttttgcattatgtcgtggagaatgccaactttgcacattaaacgcttgcatgtttcattgcttaagggtttcttatcctgggtgataacattcaaggctcattgagaacacactgctcataaaaatgttctttttttatttcgtggtcccataatgctcacacattactcataatattgtttcattttctaacaccatcttctttcattactttagtttattctgtactacagaatacaacaaactgtcttgtgcatattttggtgtttcatttgggttgcctacaccataattaacttctcattgccatgtgcaaaaatcttcatcctactgctaactaactctttgaactgcacggcacctatcgaaaagctccctctccttatgacatcgtcagttgttcttctcagcaggttgctgtcatcttagacttttcttgcaacaaatactttacataaggtgtgaactagtagctggtagcattatttggctggggtaaatatcattgcatgttctattgctcatgactgttacttaaagttaacagtgtaagtccaaagtctggatcaccctgtatctacaatttcttcaatggcctttaatgcttttaaacttttggaaatttgcagtataaggtttccttccttgagcttgacatgtattggtcattgttagctattacacaggcatttattttctaagctgtttaactatttccatttatgatgggcacggtgaataggatcagcttgcagcctactcttgat

SEQ ID NO: 52091 - DNA, 3433 bp, Oryza sativa
ggcgtcatctattaaaaaacggaggtagtattatggaacatctaaaaaagtggttgtgccttatattatggaatggatggagtatcttagtataaagttggtatccattaactcctaaagctcaacacgtaaccatgtcacatcatcacctactaacaataggatttgtgcctaaataaactatttttatacattattcgtaatctatatccatattaatataaaaaaatatttatttattttatgcatataaatctcaacataggttatgtcaacatttatgtataaaagtaggtttattttacgatgaatgtactacttagctagccagctcgattcacctgcaaaccaaataaaattaaaaaggaagagaacagaaaattaatttttatgttgatttatgtagttatatttagttagcaaatatcaaatagatcccctacattgaataaaaaaaattcttatgctctgcttttacattaaaatatttattaaactgaccttccatttatattcatatcgtactatcccaaaatgttggcctttatatttttttttctcatgctaatactcaaaattttaaaaatattaattaaaatcaccgtatattttatatgtttttcacacgatattattcttcaatattgttaatatagagttatagttgtgcgaatgctcgaatataggaaatgctgttatgcttgtaactacaagacatttttctttcttgtttggcaacgagcatttcgttgtggattctctgatgtaaacgaacaaactatctgtttcacattaacctggacatggaaaaaaatgtgttgcaagccacatttttaccacaacctaacgaacataatctgccatttttgtaggcgcatgcaggagcaaaagcatcagggccgcttatggcggagatgattatagatcttttggaaggaaatctgagtaatctacaacactttacaggcacgacacctctgttctgagttctgagtgagccttttaatttcggaattgtaattttgtcaacttgggtcccagagataccttttactttgatagttattgcacgttcccccccccccttttttcttattcgtaccgagggataggtatctaaccaaattacgctggaattttatgatcaaagcacattcgatcaagtgaggaacatgtcattaaaagaattttgtttggtattcgctcacatgagttccgggcgtaataatattttgttgattgctgcaatctcgtgcggcgtaacaaggtgaactctacaactcgggaatttttagttttatctggaattgtgaatactcctatgtagttatggacttgtgagtaagcaaagtgttggcaaaaagaatttttttaaaaaatcctcacccctcgccaagcctcacaatgtggataaatttgatgttggaaactcggagtatttatggtggatagagtatttatcgtggaaagaagcatcgtgtggtagaggccatagagcctcgctcccggctagcactgccagaacgaatacaagtggacgctcgcccgaccaaccagaagcagagcccgtgcagattgtggcggcgatgcggcctcgtgcttttgctcccccttgcctgccgggcagtggcccgctgcctggcctggcggtccccgggcgcggcgacctcttcccggctgccggcagcgtcgtcggcaggagggccgctcccgctcccgccggccggggcgccgtcgctcgcgcagtggacgggccgtccgccgctgcggccgttgccgccgcggcggcgtccgccgcggcggacgtcccgcccccgcagatcacgtggcagatcgtcgtcggcgctgtaggtgcgtccatgttgtcgtacgcttcggttcggcttcgcttcctcatcacttcccacaaattgtgatgtgcttgatcatggtatggtattgaccgggttttgtgcagctggagtgactcccttcgtcgtcgccggggtcgagttcggcaagagaattgtgagtgttggtttactgtttccttgctcgctagtcgctagctgcatgaaatctgctgagtagaattgcaccctccagactccagtcctctttgctgcccctctaaactgaacgcaaaaatactactccctccgttccaaaatatagcaacttttagttagatgggacatagaggcatgtccagattcgttagtactaagatttatcccatccaaccaaaagttgctatattttgggacggagggagtacttatcatgaaagtgagggttatgcaatagtgacaaatatttgggaacggatggagcagctagttgttagtactaatgttcattaaacagttcttattgacagtttgacactgaaatacgagtgtgaagaggatagtgcttatcgatcagacattcagagtttcagaccattccttaccaagttttactgtccttcacttgattattgtcttctcctgtatttcagattgcacagaagaaatgtgaaatctgtggaggctctgggcttgtgatgaagaaggattactacgttcgctgccaagggtgtggtacgtactgaatcctctgtttcagtatgtttgcagcagcaatttttcaggacttgaactgtgtggtgtgctgacagtatgataactgacaatgtgtgtcgccgtgtttcattgacaggcggttttcttccgtggcagtcatggagaagattcttcaccggctgaaaatcgttaatttgaatcgtgttgattaacactagcactgcagtttgagttggacaaggaggatatggcatgaccagaccaggtcaatattgtgtttatagttgttgttgttggaaatatagtcattattcggtatattttaatccaagaaattgaaactatgatcatggcataagcagtgtagggtgatcttaacataaccagtagcatactatgcgcatcatgaatgtcagaaacaggaacataccagtaatgcgataacatgctagaggcatcatgtagaacaggaacaagaacatagcgcacacagtatagcgctaacaatgggaacaggagtagcgctaacagcagtagaaggagaagattataccccgagaatggccctccgctggatggtgaggcagaattgcctccgttgttgtagtcgttcacggcacctcctcctggcgcaccagctccggatccagctcctgtcggcgtcggcggcggcgcagctcctgtcggcggcggcgcaccaccgccgccattgttagaataattgggctaggcccaacttataatattaaatctcaaaggcccataataaatgttgaggataataataccacctctggatttaagcgagaaatatctcaacctaaatagggagttattagaggctccctggcgaccacttgaggtgggggtcggaatgccaaacgcgc

SEQ ID NO: 52092 - DNA, 7368 bp, Oryza sativa
ccccgcttctgatctcttgcgcgcaagagagattggaaaaagcagtgcctcacaaaccacaccttcgcgtgagatttgcaccgggtaggcgggtgatcaggtttttggggagtgcctcctgcacgactgctcatcgccatgtctggagttgctgccgccgctattggcggaggtggtgcgccgccgccgacaggagctgcgccgccgccgacgccgacaggagctggatccggagctggtgcgccaggaggaggtgccgtgaacgactacaacaacggaggcaattctgcctcaccatccagcggagggccattctcggggtataatcttctccttctactgctgttagcgctactcctgttcccattgttagcgctatactgtgtgcgctatgttcttgttcctgttctacatgatgcctctagcatgttatcgcattactggtatgttcctgtttctgacattcatgatgcgcatagtatgctactggttatgttaagatctatgccatgatcatagtttcaattccttggattaaaatatgccgaataatgactatatttccaacaatccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggtaaacgaagtgaaccacctctttctcctgaggaagaggctaagttcgaggcttcggattgcctgttccgtggagcattgatcagtgtactcactgacaacatagtggacgtgtacatgcacatgccttctgggaaggacatgtgggatgcacttgaggccaagttcggagtttctgacgccggtagtgagctgtatgtcatggagcagttctatgactacaagatggtcgatgaccgttctgtagtagaacaagctcatgagattcagatgctggctaaggaacttgagaacaacaactgtgagttgccggacaagtttgtggcgggtggcattattgccaaactaccacgctcttggtcggactttgccacttctctaaagcacaagagacaagagttcagtgttcctgatctcattggctctttgggtgttgaggagaaggtgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaggcaagggaaaggcaaagggagactgctttgtgtgtggcaagtctgggcattgggccaaggactgtcctgagcgcaaagacatgaagtctgccaacatgatcattagcgagggcggaggaacatcggggtacggtaaaatattacctacagttctctctgtttttcattcacctgattggtgggtggatactggtgctaatattcatgtatgtgctgacatttctctgttttcttcttatcaggtcgggagaggttcctccttgttgatgggaaacgggtcgcttgcggctgttcatggtgttggtacggtcgatctgaagtttactttgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgttggaaaaggttatgacagcggaggcttgttccgcttttctttgaatgacatgtgtaataatcataacgctgtgaaccatattagcgagaatgatgagtctaatgtgtggcattcgcgactctgtcatgtgaatttcggttgtatgatgcgcttagctaacatgagtttaattccaaaattcactttggtcaaaggttccaagtgccatacttgtgttcaatcgaaacaacctcgcaagcctcacaaggcatctgaggcgaggaatttggcacctctggaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgaggcagttctgactgcgtgtcatgtcctgaataaaattccaatgaagcacaaggaagtaacaccattcgaggaatgggaaaggaagaaattaaatctctcatacctacgaacatggggctgtttggccaaggtaaatgtacctatagtcaaaaagcggaaacttggaccaaaaactgttgattgtgtgtttcttggttatgctatccacagtgtgggttatagattcttaatagtaaactctggagtacccgacatgcatgctggtacaatttttgagtccagagatgctactttctttgagaatgaatttcctatgaaatatacacctagcacttctagtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcgtggatgacaccccaagaaccatagaagaggcatattcatctcctgacgctgactactggaaggaagcagtacgcagtgaaatggactcgattatgtctaatggtacttgggaagtcgttgagcgtccatatggatgtaagcccgtaggatgcaaatgggttttcaagaaaaagcttaggcctgatggtacaatcgaaaagtataaggcaaggcttgtggccaagggttatacccaaaaggaaggcgaggatttcttcgacacatattcaccagttgctcgcttgactacgattcgagtactacttgctctggcagcctctcatggtcttctcgtccatcagatggacgttaagacaactttcctaaacggagagctggaggaggagatctatatggatcaaccagacgggtatgtactagaaggtcaggagggaatggtgtgtaaactattgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttatgcttgtatgtcgatgacatactgatctttgggaccagccttaatgtgattgaggaggtcaaagactatctgtccaagagttttgaaatgaaggatttgggagaggctgatgttattcttaacatcaaactacaaagaggagatgagggtgggattacacttgtgcaatcccactatgtggacaaggttttgagtcgctttggatatagtgactgtaagccagctcctactccttatgatcccagcgtgctattaaggtaaaaccgaagaatagcaagggatcaactgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgcgttcacacttggaggtggcgctgtttcctggaagtcttgcaagcagaccatcttaacgaggtcaacaatggaagcagaacttacagcactagatactgcgacagttgaggctgagtggcttcgtgaactcctgatggatttgccagtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaattattgtgtgactgagagaagagactcttgaaaggggctcattttcatgatgtgcttctcttctttcctgcatggtaggatggcttatgtcttaatgtgatccgagtggcttttccaagcagagatgttgacctgcagaacatctcagaaggaacacacctatatgagttcgactgctagtcacagtctatgaggtttgggcaatctctagatactcatgaaaggcctggagtttgacttatatgctccaaacagaggggatgcgaacggcagcccagtaccagtcaaggttctgagtgaaacctgatcacacaaaacttacaattcaaggcatagtccattgttcagttgtggtctgatgtagctcatttcctaggtggaagttcaacttaacagtctccacaaaaactctgatatatcaaacaggcacagccttgagaacatttcttatgagccttgaaatttggtggggattgttagaataattgggctaggcccaacttataatattaaatctcaaaggcccataataaatgttgaggataataataccacctctggatttaagcgagaaatatctcaacctaaatagggagttattagaggctccctgttgaccagttgaggtgggggtcggaatgccacacgcgcgcgcgcgcgcgccgggccgtgggcgtgggcgaggcgtggctggctggcggcgggcgtgcgtgcgtgcgtcacgtcgctatccttttgcagccactaacccacgttcccacgattccctccgcaacaacgcgtccacgttctttctcctgatagataaggagggccgtgatgtccgatccaagttcctggtttcattcccggtgttagtttctccttctccgcgcgtgagttgctctcgtttccccgcttctgatctcttgcgcgcacgagagattggaagaagcagtgcatccgaaaccacaccttcgcctgagatctgcaccgggtaggcgggtgatcaggtttttggggagtgcctcctgcacgactgctcattgccatgtctggagttgctgccgccgctattggcggaggtggtgcgccgccgccgacaggagctgcgccgccgccgacgccgacaggagctggatccggagctggtgcgccaggaggaggtgccgtgaacgactacaacaacggaggcaattctgcctcaccatccagcggagggccattctcggggtataatcttctccttctactgctgttagcgctactcctgttcccattgttagcgctatactgtatgcgctatgttcttgttcctgttctacatgatgcctctagcatgttatcgcattactggtatgttcctgtttctgacattcatgatgcgcatagtatgctactggttatgttaagatcaccctacactgcttatgccatgatcatagtttcaattccttggattaaaatataccgaataatgactatatttccaacagttgtctataacatatctccactacaaatggccaaataggttcatcgagatgtatcacaatagtacactgtaatcatggtcatggttcttctgtctataccatgcatatgacgcagcatatgaccatcctctgagagtctatcagcccaaaatctcatgggacgtgcgttcacgacaactacttgtggtcttctggagctgtaaacaagaattatctagccatcaagctaaactataaccttccaaaagcggcatacacgtttcgttcgtcatgtatgcaagatctacttcgtgatgcctcagtttattcgttcgtcaatgcaaagcgttttgatcaccgaacaaacccatgtctgcgatatgagcaaactgagtctggcctcgaatctaaatactcctacataggtttcatactttcatcgcaaggactataataactggagtagttaggtttatgtttagttcaacttgtctttcagcccagaagatcacatatcgtctccacgtgtgcgtctggtttgactcgaggaccacgatacaagatgttaattgttaaatgggtcacttcctcatctctctaggctaatgtaaaatggtatgaggctgacaccaaaatccaactaaatcatcggatgatctcacagagtcccgtaatgagccttttctgattaaaaattgtaagttggtgttaccaacacaacaacacttatcaatttatcattttgagtgtgagattgtaataattggttgtaactctttaaaaaaaaaggccgggacgccccatttcattatcagaaaaagaaccatggtgtgttctgcggcttctgccatctactcatggcaagatctacttcctgatgcccaaactgctggtcgcgcccctgacatcaatcgtcgcaccatccattcgatcggtttagatccggcgcgcgccggacgcgcggttctcttcggttccaggcagccggcgcgcccatcccgacttggcgtgattgccgcggatgcagtttagttggttccgtcgcgtaacctcccttatctcctcgcttcccattcctgggctctgactcggacgcccttttgtccccacccgccgatccgccgccgcgagcccgcgaccgcgagacgagacgaaaccaactcgtccccctcttgatcccccgtctcgcttcgctcggcggccgcgccacctccaaatctccaagctccccgactcggcgactcccacacgccatgcccatcgcgcccgcggcttgcagccatcaaacccccccgcgctctttcgcctcctgagcccgtccgctcgcccgtggccatggacgcgatcagca

SEQ ID NO: 52093 - DNA, 8499 bp, Oryza sativa
tgcgccgtcgcgctcctgctgcgggtgcgggggcggggcggcgggcgcgccggggtccgggcgcgggtgcagtccgcgtaccggcgcaagttctggcggaacatgatgcgcgccgcgctcacctacgaggagtgggcgcacgccgcgcggatgctggaccgcgagaccccgcgccgcgccaccgacgccgacctctacgacgaggagctcgtgcgcaacaagctccgcgagctcaggcaccgccgccaggagggctcgctcagggacatcgtcttctgcatgcgcgccgacctgctcaggaatctcggcaacatgtgcaactccgagctccacaaggggaggctgcaggtaactgctctaatcttaacctgtattacgcccgcaaatttgatgcaattagatggttgttaggagttaggatagctaattctcagaacttcagcaatgcttctactttccctttgttacaactgaagtaaagtaattccattacactaaatctgcgaagtggatccacttccattacacacaccaagatagtcttggaaatttttttcactttgttcggatgatttgtttgtgttatgtcagtacggcaacaaattatacgaagtactcatattcatagtgatagcctgataggatccccttttgatgtccccattggagcatctactcaaatgtctattcttatatatcactatgtcatattgccaggtgccgaaactcataaaggagtacattgaggaagtatctactcagctgaaaatggtatgtaattctgattcagacgacttgcctctcgaagagaaacttgcatttatgcatgagacaagacatgccttcggtagaacagccttgctgctaagcgggggtgcttctctaggttgtttccatgtgggtgttgtgaaaacattggtagaacataagcttctgccaaggataatttcaggatctagcgttggttctataatgtgctccatagtagcaacaaggtcatggccagagctggagagctttttcgaggagtggcattccttgaagttctttgaccagatgggcgggatctttcccgtagttaaaaggattttgactcatggagctgttcatgacattagacatttgcagacgcttttgagaaatcttaccagcaatttgacattccaagaggcctatgacatgacgggccggattcttgttgtcactgtgtgttctccaaggaagcatgagccacctcgatgcctgaactatttgacatcacctcatgttctcatctggagtgcagtaactgcttcctgtgcttttcctggtctttttgaggcccaagagttgatggcaaaagacagatttggagaaacagttccttttcatgctcctttcctgttgggcttggaagaaagagttggtgctacaactcggcgttggagagatgggagcttggaaagtgatttgccaatgaagcaattgaaggaattattcaatgtgaatcatttcatagtaagccaagccaatcctcacatagctccactgttgagactcaaggaaattatcagggcttatggaggcagttttgctgccaaggtgcgtgtcaaaaacattccatattgcattctttatttttgattgtttatttacttgagctgtctgtgatataacttgatatcgatttcatggtgggaaggatttttattttcacttggattgctacatgatataactttcagtatttcaggcatgtttgtggcttagtagcctagtgtagaactatgctcagcaaggtttagttcactgcagatattagttgaattttatgtctgatgaataattcaatatactaaaactgctatgggcaagcaggggaggagacaagcctagggaaattagggtttgaactctaggcttgtctccttaatctcttcgaaatccatttaaaaagtgaaaaaactatgtaaaagtttgaaatttaacaaatcagattagttgagccctaggcttatgaatttccttgctttgcctctatgggcaagcatgtatttaagtgctttgttgtatgatctcatagattcttcaatactatctgtatgtagttggctgaacttgctgagatggaagttaagcataggtgcaaccaaattctcgaacttggatttcctttaggaggaatagccaagttgtttgctcaagattgggaaggtgatgtcacagttgttatgccagccacgcttgctcaggtctttaatatttcccattcctttctttcacaaatatccttggcattaactggtaaacttacaaatgaattctttcttgttatcatcagtattccaagatcatacagaatccatcttacgctgagcttcagaaggctgcaaatcagggtaggcgatgcacctgggagaagttatcagccattagggcaaattgtgctattgagctggtactagatgaatgtgttgccctgttgaaccatatgcgtaggctaaagagaagcgcggaaagagcagcagcttcacaaggacatggtcctacaatcagactctgcccatctagaaggattccatcatggaatctcatagcaagagaaaattcatctggttcccttgaagaagaattccttatatctcctcgtacaaaccatcatgcagatggaggaattgctggaccatctaacaaaaaccatcatgtccaacaaaatgtacatgatggcagtgacagtgaatctgagagtatagacttaaactcatggacaagaagtggtggccctcttatgaggacagcctcagccaacaaattcgtcagttttgttcagaatcttgagattgacacagagttcagaacaatttcatcgagggaagacagaactgatgttgtaacaccaaatgctaatttcttggtttctcaggcaattggtagagaatctgttgacaacagtgcaatgcctattactcctgataggagcttgggcaattcaggttatgatcctcatgatagtaatgtccctagatctccatttggttgttcaacaagtatcatggtttctgaaggcgacttactgcaacccgaaaagattgaaaatggtattctgtttaatgttgtgaaaagggatactcttctaacacctacaggtggagttgagcttcagggaacatcgcaggaaccagacgtggaaacaattcagacagagtgccttgatgatgcttcggatgacgacgatgtgggattaaatgctggtgatgaagcagcaattgaccctagagcaaacatgagcagccaaaatacacaacaccaggggtcttcactagaaaatataaatctgtcctcttcagtagattgtgaagctgaaacaattactagtaaatcaaagggttcatctctttttgatattggtatggagattcgtccaacaatcttgagcacggaaagtagtatgtacgagaggtcttctgcaaaaataggactgaggacagtgcatgcagaatttatcagcaatccaggtgctgggaagggagaagttgactcaggggctgctaataaagaattttcctatttttctcaaacagcagatactgttatattttcagaaagctgtgaaactgggcaacatcatgaagtgaatgtagaagctttaacctcataccctgtttcagttctggaagatgataggtctggtggcttcaatttgagtgaaataatggctacaactttcattgccgaagctgatgctccaatatctagaagagatgaagttgagcagcataacggatctccagtggaaacattcctggacacagaaacggtacaagctgggccttgcagttctactttggagggcaacaacaccaacaattccgaggaaatgcaagttgtttgcacctcaggaaccaattagaagtcaagacaagaagggaagttttggatttatcatatgaaaaaacaacttcagtgctcgttgtaaatcatatgcagatgtgcgccatgttctgttgtcgatttaaattcgcacattacggaatatcttgttatgtattgtaggttagtgaactagggaaagaggtcgctgaacttgatgaaattcctcgtaaataggaaaagaatgtcaatggttttgttgaagctgctgcttgacaaaagcaaaacaaattccacttctgcgcagtactcgctcaccttatcactagggtgatgatcagttcgtacaattgtggaagattaagcatcatcagggtgatgattagttggtacattgtactagagggagtaggagtactaggtttagagatacaaaaactaattagttgacccgggacttcaggtgttgccgaatgtcaccgttgcgtggtcgtttcttggagacgtcgtagacggacacgatgatgctggcggtggcgggcggatgagcaaccctgggcacgacgaacgcgtagcagtcggccggcaacgacccaccgtcgagggccgtgctcctcaccgggaactccgacgacgaccgccaccccgtggcgcggcagtggaacgcgacgtggcactcgaacttgggcttcgccttcgcgccggcatggggatccaggaggagcacggcgccggcgaggccggcgggtccggccggcgcgacgtcgaccaggaacaggtggccgccgtccacgtcgcggaggacccgcttgccctcctggacctgcaggtcgaacgccctggcgcgcctgaactcggtggcgggcggccagccgtggccgccggtgaagtgcgcgggcagcgacgaggtcgcgccggcgaagccgcacccgggctccgggcagaagcacggcgcgtgcgggcacccgtcctcgtggctgtcgctgtcgtggtaggccgtcttggcgtcgcacccgtagccggcgttgcggcaaggcaccaggatggacctcaggatttgctccacggcgaagcagcggttgtacgcggtgtccatggcgcagacgtggcacctgttcttgtccgggagcttgccatggcaggacgaacaaatgacatgcccaactccacactaccaaaaaaaaaaaaaagaggacccgaaaaacaggttaatcaagatcaatacatggtgaatgttgctcatacatccatggtagaaagacagaaaaggaaccaattttacaatattagagacaaggatgattgagtacctgcaagactggaggcttgaggggatgacagcagacggtgcagtcgagtacctccagatcgacggtggcattggtggcgacggagctcctctgcccggcgctctgctccatcgctattcgctccctctcttcttcttgattgcaaatttgctgcgcaacggctaaaaactcaaaactttctttgcaaccttttcatttcgtcaggctaggtgcagtaggagtgtggtagtactaaaactggtaagcctgacggatttgacgtttgacagaagccaacggcttttgctcggagggagctgcattttgatttttgaaaacgcctttcatttacctttttttaaagtacattggaacacatgtactaggttaaatcaatattttcacttaacactatactccctccgtaaaaaaaaaaccaacctaagaagctaaacggagcctaagaagtatgggatgagatataatctagtacaacaaatctggaaagaagtctgaccaaattttgttgtgacggagggaatacatctttacataagtctccagtttggactccgggtgatcaaaataagcgaatatgtgagagaacttcatatgatttacacacgtataattataaaaggcaaaacattttatgttttcttccttcttttcggtgtgagcggtaattaactagttttaccttttcttaagtaaattttacattgggccatatgttttgatcaagattttgttataaactagggttaaatcaatattttcacttaacaatatacatctttacataagttttcagtttggactagggtctaagggtaatcgaaacaagggaatatgtgagagaacttcatatgatttgcatacggataattataaaaggcaaaacattttatgctttcttcttcttttcagtgtgagtggtaattaactagttttattttatatttttatttaaattcaaaaataactagttttattttctattttatttttgttcatttgcccctacgtatagatcattttgtgccacttttaaacatgttcacatcattattttagtgtgatttgctaaaaaaaagttgttttgtgatttgcaaatatttttttaaagatatttatcttaatactatggcactatggatgatgatttaaactagcttttctctgacaacttcctttgatgtgctcatcccaagtccaaagtgccaactagtgcaaagatatgtaatgttaagtgaaaaggttgatttggccatttcccattgtgaaactttgttaaaaatgtatggtgcaatgtgaaatttacttcttggtttaggactttttccttcccagtgtcttattgccactttgtccaccaaaggttggaagtgaatcatgtgaagcaatttatcctactagtgttcacccgagaagagaacagaaggtgcgtcccttgttgccttggcacgtaatttagcctctgctaaccaatgacctagagcaaaggtataaaacaaaaggcgatacaatggcattgccttacttactactaggtgcaactaatttgaattcaaatatgcgtagcggtttctacctgttcgagattattgactggattattgttgcgggctatctactttattctgggataaattaaatatttttaatctaaacttataaatggcttagaataagtggtctaagcaatgcattagaagaaagtttttttttaaaaaaaacatattctcaaaggtgtggaacaaataatccacatcaaaaatccagtgaagtagaaatgaacatgttttataccacttatttctctgtcgtccaaacacccaaagataataatacccttgctataggaaatcaatgtgtattttgtctagaagtccaattcttctaagctaaatggatgattgattatctaaatttatgatgatattccaagatataaagtatgaattaactattaccaagttgaaaagttgtttctaaaaaaagtattataagaaacttatagatagaaaacttttgcaaaaaatgcaccgttggggagcttgggaagcgtgctcatgataatcaataatccaaggaataagatcgatcgtgtgtttattggcttatcagctgcaaccaaaatttgaatgtttgaaacttagttttagattttagagttaattttcggatttattcatcatagtttattttgtagtattgacttttaaactggtaataacccataaattgttttggattacttcattcttttttggagtaaaatatgggtactacaatacatgatgtaaactacgcatagtgagtcaacttatgtgattggtttgtgcatgctcaaatccaaaattttggatacgtgttgttgcttttgacatgctgaactcttgtgccacaagcagtcaaagccacagtttttgtggtgctcaaaagactcgccaaacttttaatggaagtccaactagtgatttgagtgcctagccaacttttaatgtatataatagataagtgatatttttttatatgatctacaaacaagctaacacgtttcaatatttgaaaggtttcaaagttgtttgcatctcaagactttaaccgcgttcatagaagtgatggaaaatattcctcacatgttcattatgacatatatgcaagtcactctatctcttacactcctttttatgctcctttttatggatcacaaattaatatttcttgaaggcacatggttatatatgtatcgattgttaattagataaatggaacttgtgtactcataatatttaatatagctatttagacgggaaacaaaattattattgttcttattccaaccatccaatattacatagctacaataagcatgcagtcttttatttcttgtaatttatttggaaaccatccctagcaatccaagcctatactataatgatgcagtcatgatatcttggaagttactgtaggcatgactaggagtgaacacgcctgactccactctcctgttgtgcttgagtctcctagcttcttctcttgagatacgatatgcatttgccaaaacattgttaggaagtgcacggaagatggaattctttcccacgatttggctaacaatggaattagggttggttttgaatgcaatatataagcatccttctctttgtgcttttttcacaactacatggtgttgtggtataattagcagctgcccaggacgaacctctccatcaaacactgtctttccattgttgttgacaacttgaacccggcatgaccttgagtaatatagacaatgctatgagcattgatgttccaaaaaggtgaaaggagcgcgttctacaacaaaggg

SEQ ID NO: 52094 - DNA, 14033 bp, Oryza sativa
taatatatcttgtgattttacctggtacaaatttactttcacggcactcatttgtagaagattaagaattggaaacttctgcacatttagatatgtgatccttcctgctctagtgttgtatgtatcagtgaggttcgggttgtcaatattctatcttaccctcatggtacaaaaggtctcatccaaaccattagagtgaccaccttgaaattgtttttgttgatattgtgtttgtctatactcacttggttgcacctgttcttgttgttgctcttgcactgatgcatatggttttagaaatgcaagcccatgctcgacaagaacaatttctccgcgttggtcattttgacattggagttgccttgctactccactgctaatgccaagagcctcactaagcagttcaacactaaatccatcaaagatgttcttcgaactctcccttgccttggatctatacaattattgaccaatcttattgttgccagctaaaaagaaatcctatcaatccataaacaaaataaatcagcatgtcaaagagagaactgcaataaatcaaacgaattcaaagaatgcttgggttgttggcaataaataagctatgattaattaccttttttctaggatcaagctggttagcactgttatatatatatcagtgacgtatatggcaacaattggtacatcaccatcattgtagcaccaatgagctacaccagcaggcaatgcaacaacatctccctatctgaaacgatggatctgttgatgttcatctatgaatttataattttggctttgtcccttgaatgattggttttgcccggattgttgaaactattgttggtaagcctgaggacatcctgggaaagttggtcctgttacacctctacctacaaatccaggattccacattaataaaaggatataaaagcaacaattatccaatatatacttaaatagatgcacgaaccttggatgatatacactagagttactccattggagtaatgaggtagtagaagacctctaggttcaataactcgacggacaacaaatactccggtacactgaaataacttattagagatatcgtaaacctcggttgtatcagcttgggaccttacggtgcgaatcggcttgaatgcctgcaaatgatcaaatctgcactctcttggatttccacggtgagaactctgccattgactagtactttgacttagaaattgggctaatgagccatgacacaagaggaacaagcaaatggcagagaaaactactgggaatttgatggttgctatttttcttgtggactaaactcaatgctttgtgtgaaacggtaatatattttggtctttttatactgatgtgaagtatcttcgttcaaaagttaagataaagtttgttaatgtccagatgtggaatgactcattagatagtaaggtacacggaaggtggatagatgagtgtggactcacaaacatgcatgagcggcacattgttattttcaattttcttttcttttccttttattttatagggatccttcttgtcatgttctacaattaaaagattgtttttaatctggaccgcatgttgtgtattgctttaattttgtgatgaaatgttttggttgagcatatgatttaaaataatcggttggatttattagtatgttttggagttacgaaagataaataagtcgtaatctcattatgtgatgtaaaacaatcagttgtgcctgctatgtggtcacggaaggtggataaatcatagccacgtcatattacctcttgtattgctacatgacaaacacattgttgtttgtttatgaaaatatatactccctccttctataaatgtttgacaccgttgacttttttaaacatgtttaaccgttcgtcttattcaaaaaacttttatgaaatgtgtaaaactatatgtatacatgaaagtatatttaacaataaatcaaatgatatgaaaagaattaataattacttaaattttttgaataagacgaacggtcaaacatttttaaaaaagtcaacggcgtcaaacattttgggatggagggagtatatgcttttggttttggtttcttctaacctaatatattatttctatgcatggttgttgacttgtcacaaatttatctcataataaatatattttacatgtacggcacctatcgactgtgacatggtagtcacatttttgtgagacttaactttaaactgcagcactggcgtcccattaaacttttgcaaacatgtatgatactgtagctgacaaaaccatcggtaaaaatgctagacgtgggcccgtccatgtctacttaaaaaccatccatgtctacttaaaaaccattggcccctgctatctgtagcctgtaggagtcgtcctgatcagaataaaaaaagaataagtccactttgactctcttaaaaataactcgaatctaatccgtgatcctcaactgtaaaaccggataggatgactccccgaactattcaaactagtgcaatttgactccctcagtggttctggatggcggttttgctgacgtggcgttgacgtggcgatgttgacctgatctgtgttgttgatgtggcacttatatggcactaaaataaaaaattatatgggctccattcgtcattcacatgaaaaaaaatgcgaggcccacatgtcatcctctatctatcctccttccccccctctctctctctcccttctctgtatatttctcttcctccagattcagtgcggaatctggagcggcggcggcggcagggtgagggccggcacgaaggaaggaacttgagcgggtcgagcggcggcttcggcggcgacggccttagctcgccggagaaggcgggggcgtccggccagtggcctcccccacgatggtgccgcgctaggctggggcgaacgagagggctaatgcagaaggcaaagcctgagacgccgctggccccagccgtgcctcccgctctgcgccggcagggggtgcgcctctgtttctttctacccggagaacatgcatgtgcacagcgttgcctagcagatgcaagtgcagtgccggtgtggggtagcaaggcgcagccgccatggaatccagtcgaattttggcaggaccagcagctgcaggacgaatccgtcctaccagcgtggtctacccgagtcctacagatcttgaggtcgtggactggtctgattttattctttgtggtcactgtttgcaaggtcttgaggtcgtagacaatagctacttcatcaccaaggacaacgtcggcatgctgaagctcgccaaggaggctaacagcatcttggttcgtcgatcagcgcattgactcatgttaccaattcgcctatgaaaattgttaacatctaaccgtgacatcctgtgattaattggtacaagtagtttgactgtcgtatcccgcgccggagacggtgggttgcgcagtggcgcactcaaacggccacaccacggcggccatgtccatgggcgggctgataaacaagatgaccgggcgcatcggcgactcgccgttgatcgggtcgggggaaggcaaggccatcatacgctccacgctggcgcgtgacatcgccgccgtgatggagtacaggggcgccgggctgcaggaggccatcgactactgcgtcaaggaacggctggacgaagggttcatcgggctcatcgcggtgtccggcaccggcgaggtggcgcacgggttcaactgcaccggcatgttcagcgggtgcggctgcaggagaaaagagagagaagggagagaggggggaggaagaagggttggagagagaaaggatgacatgtgggtcacacaatatattttgtgtgtaaatgacagacaggtcccacagaatatttttaattgtaatgccacataagcgccacgtgggatgaagaccaggtcaacaccgccatgtcagtgccacgtcagcaaaaccgccatccaaaaccgttgagggagtcaaattgcactagtttgaatagtttggggagtcatcatatccagttttacggttgagggtcacggattagattcgggtaacttttaagggagtcaaagtggactttttccaataaaaaacaaagggagccttgtgcagtttggaccgatataaagcaaaatcattatggaaaaagtacaaattagccccttgaactatcgcagtcgaccgaattaaccctctaaacccaaaaatcagacatcactcatcctaaacttttaataccggacaaattatccccttgacccaattcaggacggttttgtcctacgtggtgtaagcgtggcactccagtcatcatttttttttaatggtggggcctacctgtcatatatactctctcccctcctctttctcgctgaggaggcgagaacgcccgagagaggggggaagaggagaaagaggaggtgagagattatatatgataagtaggcccactattgaaaaaagaaaatgctgactggagtgctgtgcatacgccacgtaggacaaaatcgtcctggatgtcgagggcgataatttgtccagtattaaaagtttaggatgagcgattctgattttcgggtttaggggtaattcggtctgggtaattagtacttttccaatcatttatgatccgtctaaacctgagcacgaaaccgtgcctgattccgtggttgcatgatggaaacgtgtaacaccaaaggtagtaatctcagtgccgattgcgacccaaaacgcccggcgcgtcgacggccggaccgcgtcgatcgatgacggttactgcacacgcacgcacgcaagcatgcccgatccctggaacccaaccgcgcgcacgcgccgtgttccgccggcacggcgacacgtaccacggctggccgttcccctgtctgtcaaccaccaccagccgatggaggcgacggcgtacgtcacgcgccgcggaagacggacacgcggttgcgctcgcgtagtcacgccttccgcgcgcgcgcgccgcgcagcccggccgcctcctccacccacgcaagcaaaagtactaattacggccacggcctccctgcagcgagggtggtttatacgcgatgcgacgtatcgctgcccagacggcagctgtgataggcgtccccgttgggccggcatgggcaagctgatcggtggtgagggcgtgaggccgtggcctctcgcacgacgacggggcacgtacgcgcgcaggtactagtcaacgggaccgatctggtaacaagccggccaccgatcggggctcggttgttgctcacctttccgcgctacgggaaatgctcatagctagaaagagttatagaccagccaaatttgattctgcgtatttccatttgaacggtctttttactccaacaggtcatttatattacatctttcatattatatatacatcgttcaatatctatttagtattataagttattttgatttttccctaattattttttagcgagtttataaacaaattagtaacatatataataccaaattagtttcattaatctaacattaaatatatattttaataaatatatatattaatagtatatttgttttgtgttgaaaaaaaatgtcactatattataaacttagtaaaactttaaaaaaaacttgaaaaaaatcaaagcaacttataatatgaaataggggaagtattttctaactttcataatgcctatattttgaatgactaaattaagaatagatttttttaaaacaactatatttgtacggatatatattttaaggatggataagtttttttatgactcttaattatgtatgcaaattaagcaatctaaattatgtctgcaattgaggtcaccgtagccagcttgaatcaaggatcgaggagggcggggcagcaaggacgcagttgtattcgtcagtgctgtacttgaagcaaggagcgcgggacagaaccatagttggctactgatatatgggtcctgtatttttttttttttcactgaccgaactactacctccgtcccaaaataactgcagccgtggaaatacgtgtccaacgtttacccgtccgtcttatttgaaaaatttataattttttttaaaaaaattagccacacataaagtactattcatattttatcatctaataataataaaaataataattataaaaaaatttcaaataagacgaacggtcaaacgttggagatgaatagtgcaaaactgcacttattttgggacggagggagtaccacagtagatgccatagaggaaaaaatagtgggttttgtaatgagggggtaagttgaacgattttgatggttgaggggtgttcgattgttggttttgaagttaaatggtgtatttttgacacgtaatagctgagaggtgtaaaatagacttatctttttttcgtaatcgctacattttgaaagactaaattttaacaactatgttggtaatggatagatttttttaaacaactatatttgaacggatatattttagaatggatattattttagtggttctcaattatgtatgcaatctcaattatgtatccagtctcaatatgtatgtaaatctcaattaagtaagcaatctaaatgaggtatgcaatcgaggtcactgtgggcacttcaaatcaaggagtgcgaggcagcaaggacatggtggtattcatcggtgccatactcgaagcagagaggcgcatgtcagaaccgtagtggaatccagcctctctcctctggccgttgttgctggtcgaacttgagtggtttacctcgaatggtagtgtagctctggaggactcggtggcagcggtcctcggggaggatctcggcaacaacactccacatggaggactccgatggtggcggtgatcctgtttcgctatgcatcgcagctcgcgtgaaaggggagagatgagatcgagagagaagagagaaagaggatggattaaagagatattgttagcaacttacagatggcccctgtagtttctttacacttttttcgcctaccgaattgccatattggaagcaacatagatgaaaaccacgagggggtaagctgaacggttctgatacttaagagctatggacactcggttttgaagttggagggtgtattatagataaacataatagttgaggggtgtaaaataaatttattcttttttatatcaaaatgactatatgttgatagaaaacacgaggcctgggagatctgcttaactccagtgcaggtccaaagctcgccttcgaatgtatgagcgtgccagttgatttgatcctgtaatcaacaagaaatagagacaaagaattcgtggttaaatctataaatgatagccgatcggctaggtgccgatgacatatcatttatctttgagccgatgtcatatatgaatcgatcgacggttataaataaatagtaaggaactaaatctattcgatcggcagtagatattaacgatatatagttcttatattaatatatacttaaatcaaatgattgggatagatcggtcaccatgccgagacagtataaatcacttagattgaaatatatattaataacaggattatatatgtttatagcatagccgatcagatagatctagcatgtatcggctaatactccgatactactttatataaagatatcaaaacaaatataatataccaaacaaaagcttaatatacttaaatgcaataagatcttgacataaagggcggatttaacatgtcattgaaacacatagaccggatatggttaaatcagataaggtcggctgaaactccgatactaccctaatcggcaaccagagaacaggctacagattgatattctaagcacgacttaatagatcaaactcaaatgatgcagcattaagtatgaaaagaagaacaatatctagacaatcaagccgatgggtgtttcataaagtggtagatatcttatataatctaagacaacgtcgctatttaacctaatcggctgtcttctatcaacatatgttagccgattgtaggttagatgacgatgttgccaaagattatgtaagatatatgataacttgatgaattatatagacaagattagagtgtcataaagatggaagcactaatcccgagaacacaagccgtcataacaagttttacctcttgttgaagatcgaaaccgatgcagctcaacccgaaagcaagaactcgtcgaaataaaactaaagcaaaaaggtgacgatgcgccgagattgtattgaacatgtgtgttaaaaattacatagggctcggggtctatttatacccgagaattacaagatatgtccataccggacacgaccactatctctaacaaactctaagataccataagtctttgcggcagacttttgcccaaacatatctctaagaaagttacataaaacatcctaattaatagatacaattgccttctcaggactctatccatgtgcggtaatcatcttgaagcacctcaattcaacccaatgtcatacaccaaattatactgtcagaatcggctgcatcggctcacctagtccgactctgacccagccgatcctaattatagccgatctggacttcagccgattcttgctctgttctcggatcaatctccgccttcgactccaccttaatctaatctccttttctgatgctgatattaccaaatttggtcgttaacactataattcaacgactaaattttaacggctatacttgtaacacacctatatttgaacggaatattttggaatggatatttttttaatggctctcaattatgtatgcagtctcaattatatatgcaatcttaattatgtatctaatctcaattatatatgcaatcttaattatgtaaggaatctaaattatgtatacaatttacaaacacaagtaatccagccccacctcagccacagccacctaggcatctccacctcaaccgcagacacctagggcaaggatggcgcaactggggtccgtgtgggcggtgcatggccggaggtgctgcaggcagagtgggtatgccgccgccgaccacatccaccaccctacaatccatccctacctacagatttagtatgctccttcctctccaccttcactcctctgtggttccactcgccggtgccccattgttgccattgccgccaaaaaaaagtagaggggggggaggggggctcagctgcaccgagtagtgatgacaacaacaatagacaaggcgtcgtttggtcaatccggatatgggcatgagctcggtgcagaaaaaaagggttgcaatatggcgtgaggagagaattagaaatgctaaatttgtcgcttctttctccaggatatagcagacgcactaatttggaggaccggatggtatatgtgctcgagccggttttttctctccccccctacccccctacactattttgttgatagaggacgtgatagatgagctgctgctgggaatgctctaaagacacacgatagcatcgatctcagttgatctgatagcacagaaacgacaacatatgttacagtactactggattatttttaggcagatgtctattttatcccaactgctccagtgcgcggtgcgccgtctaagtaaaattagacatcattccaaatgtctcaacgattgtgaatgcctcaaatcagctatttaagcagtgttttgctccaacgaacgctatcgacgacaaatcacgcagcaaaaacgtacgacgtgtaagtggatcgatcgaacgtctggtcgatcgttaaagtgggccggatcttttcttctccgatcgatctcatgatcttccctttagtagcgcatgtacctattctcggctttatctttacgtgcctatcgctcaatgcggttcaggaggggacaacaacgtatcgtcctggctcctgtgcacatcttttttctcctgttgatacagctttaatcaattttggtgtaaactggtaccccttggtggaatccacggcatgacgggtcgatgcttctgcagttctctgtgctgtgcgtttcacattatatggtaatacgtccaacggagagagacatggaattctgcgttattttagggtgtgcttggttggagggatatccctggatgggagatggcgatttagtttttgagtgtgtttggttggtgggtgagggtggatagggcggcccgaagaggaaatattccactaagatgctggatgagtgtatccggctaaattggccggatgaggatatccacctttgctaatcttgaccattagttcttgattagcaataattaaagtatatttttgttaattagtaattaacttgtcaaaattagtgttgattagatataattactctattttattgttaattagtacaaattatagctatattaatgataattaacatattttattattaattaatatgttattgttttaattcaatccattctcatccacccaaccaaacaagaaactgaatggtcatattcacttaaccaaactaaaaaattggaccaccatatccctcaaaatatagatggccatatcctatccagccttgaccacgaaccaaacacacccttaagatggttgggaactccttctccttgcacggaaaacggagcggtctattagcgcatgattaattaattattagcttttttttttgaaaaatgaatcaatatgatttttttaaacaacttttgtatagaattttttttaaaaaaaagtaccgtttagcagtttgaaaaatgtgcaatgtgcatgtagaatacgagtacgagggagatgggttgggaacattgagaaaaaaacacagccttgcctgcaggcttcaggttgggcgttccttatttcagtgaggaacaactctcatgaggtgatgtatccaatgtttgtcatgtgcagtgcgtggtatatactagcatgatgaatcgcccattgacctggtcttggcacgacaagccgatgctgcgacgaaagtggaaagaatcatacatgtacaaacaggacaatcacatgcatgtaaaaaagagaacaattatacttccatccatcgagctggctctggctaaagctatagttagctcgccagtttcggcagtgcgggtaagtgttttcattgcttaaagggtattttctaatttcttgtgtaccatttaaacagtaaaataaattttaaaaaaataacaagatacttcctctataaaaaaaaaacttaacctaggacccctcctagtacaatgaatttgaactatatttgagatttttgggacggagggagtacattaatatgagatatatcaatccataaacatgcaagttcaaattctagatagattttttttatttgtataaatcaaatttgacattgcatgtttgagagatatatttatattatatatcgttaatttttttttaatttttttataactacttagatgatataaaaaaagagataaaaatccatctcctaatatgttctcttgatgttgatgcactgctaaaaaagacatgtacagatcggtactataggtgtcggaacaggtaaaaccggcacctatagtgttttcccacctacaaagggtaaaaatataaaaagcgacacctttaagcgattataggtgttggttctatagaaaaacgacaccaatattataattgtcgttttttttaaatccgacacctataatttatcataggtgccggttaattaaaaaccgacatataatatatgatagtgcccctaaaaaccaagccgaaccgaccgctcgttcttatcctcccgagcgcccgagtggatcaggagaggaggaccgcgtctctctctctctctctctcctcgcgcatgcctctctctctcgcggcgccctcccctccaccagatctggcgggaggagaggcagccgtagcggcgtgtgacagctgtggcaagtggtggcggaaggggaggtggcagcaagggcgacaccctcccctccgccagatccggcgggaagggaggtggcggcgccctccccaacatcagctcaatattggtgtttttagtgttcttagtgttcttggatgttcttaattagtcgggggtgaaggggagcttatcgatggatcgggtcgaggttttgttttattcatggaaccttaaaggtgccagtttcactagaaccgacacatatttcccctccacatcagtgtcgtcttttaggtgtcgattggaaaatccgatatctttgtagggttctcaaccggtatcaattaaggttttcgtggttgtgatgctttgtagctaccaaagttatgcttttggcgagtctattgagctatgatataatataccaatggcgtacgatcaaatcatgttatcattaagctaggttcttaattacttaaggtctggcttatacggctgcttcgtatgtagattccaaatggagacagggctttcatgctgaattaagaaaggtttcttaagactaactatagattctgttgatttaattaatcttgtctatatatgcagaagatcttttcttagaacttccccataaagccatgacctgttcatacttcatacacatcaacgcgcgcactgtaccacacacgtgcccacaacacaagtgttcccactaccactaacatacactccacccatcccagctaaagccttaaaagcttcatcgtcatcacattcgtcccagtctcgaaaagacgcctccggccgagcccagactccgccggagacggggagccggtgcacctaacaaaagatcgatcggcgcgcgatacccctcctgctacactgtgctacttcgtacgttcgcgcagtaactggtccatgtcgatatcccctgtacgtgctgttaacgttgatcgtttgccgcgaacaccctgccagaatttaggatcttgtcaagctccgatcgagcggccaccgtcgcgtctttgtttgcttttagctacgtctttgtttgtttctagctacggagagtctcggaaaagtgtcttgaagaagatattctcttgtttcttaccatgtctaaaatatttatattttttataaaaataataattaacaatatagattattttaaaaatatcacttcacaaatatgcaaattcaaatttaatttctacgagttatattaaaataaaaaatttaaatttaaatatgcgttaactatttttttaatgagttccttttgttaccatttgtacagtttgaccactcatgtttgtaaagtgttatatatcatattaattaatcttatcaatttttttaaaaaatactaattatttagatggtccaagagaaacgagatgtgtcacatctcttaggatgaaaatccttctccaaatgtatctgagagtttcagtagcctcgccgatcgacttgccacaccgccgtactacatgctttgtcgtctgttcgtggcagtatatatattatccccttgctgtgtccgtcgacataagtggagtgtactaggtagacacactagctagctagagtgatccagctagcatggaggcctcagccatggaggaggccctctcgaagaagacgacgagcaagggaggcctcaggaccataccattcatcatctgtaagcgaagcgagcctgcctgcctgcatgcattccatccatctttcaccctgattttgccggcatcatctgcacgccggctttgcacgagacatatgtacgaggctggctggcctggatcgagatgcaagtttggtttactttgtgttgttggtgtcagcgaacgaggtgttcgagaaggtggccacgttcgggctgcacgccaacatgatcctctacctcaccgagaggtaccacatgacggcggccaccggcaccgtcgtgctctacttctggaacgcgctctccaacttcctccccatcttcggcgccgtcctctccgactcctgcctcggccgcttccgcgtcatcgccctcggctccgtcgtcagcctcgccgtaagcacaaacaccaaccaaa

SEQ ID NO: 52095 - DNA, 3874 bp, Oryza sativa
gctgttcgcgtcgttcgttctcatgtcggttgggtcgggtggcatccgcccgtgcgcgctggcgttcggggcggaccagctggaccggcgcgacaacagcgcccggaacgtgcgtacgctgcagaccttcttcaactggtactacaccgtgctgggcctctccatcgtgctcgcctccaccgtcatcgtgtacatccagcaggccaaggggtgggtcatcggcttcgccgtgcccgtcgtgctcatgctcaccgcgctcacgctgctcctcctcggctcgcccttctacctcaaggcggaggccgacaggagcgtgctcgtcggcctcgtgcaggtgctcgtcgccagctacaggaagaggaggggtcccttgccgccggagacggccgacgcgtcgcgcttccacaaccgggccgggtacaagccgaggactccgtcgaacaggttgaggtggttgaaccgtgcgtgcgcgctgggggacaacccggacaaggaggtgaaccccgacgacggctcggcgcgcgacccgtggacgctgtgcacggtgcagcaggtggaggacgtcaaggccgccgtccgcgtgctgccgatatggtcgacggggttcatgcccggcgtgatcatcggccagcagatgttccccgtgctgcaggcgaagacgatggagcggcgggtgggcgggctggagatccccgcggcgtcgttcggcgtcttcagcatcctcacgctcaccgtctgggtggccgtctacgaccgcgcgctcgtccgcccgctgtcgcggctcaccggccacgcgcgcggcgtcaccctgcggcagcggatgggcatcggcctggcgctcttcgccgtggccatggccgtggccgcgcgcaccgaggccgcccgccgcgccgaggcgctggccgagggtctccgcgactacggcccgcagtcgggccgcgccgtgcgcatgtccgccatgcggctggtgccgcagcactgcatcacgggactcgccgaggcgctgaacctgatcgggcagatcgagttctactactccgagttccccaagaccatgtccagcatcggcgtctcgctgctggcgctcggcatggggttcggcagcgtggccgggagcgccatcgtcggggccatcaacgccggcaccaggagcggcggcggccgcgacagctggctctccagcaacctcaacagggggcactacgactactactacctcgtcctcgccgcgctgtgcgttgccaacctcgcctacttcgtgtggtgcggatgggcgtacggcgaggagggccagaaccgggtgaccgcggaggaggaagcggtggaagacaccaagaccaaggaagaacagcagcagaaactgtaaaacctttttagtgaggcaggctgctgctgtgttctgcttcagctttctacttctctagttctctcttgtgaaaattgtagtaatatttacatgtatatgttggtgcaaaaatggatggttcgacctcgaatcctatcagccctccggatccaaagatcctacagggcacaggctgctacctgcaacgttaaaatgctagtagtagcagcagtttttttttttctgttacttggatgggttgcatataagtagtgataaaaacggtgacagaaattttctaccgaccgaacatcgttttggtaaaagtagtatggttcgattctactgtagtaaatataaaatttgacttttctaatttcttttaacccttgttcggttaatcctcatgagggaggcaatggagggtatttattccacacctatttgtggtgtggaattattcccccttaatcccctccaaaccgaacaagaccttaatgtgatattacaatggtggcaagtatagctaatgtttttcacttgtaaagtttactcctcctctattcaatgaaattggcagcttgccgattcgttcaaaaaaaaaagtatagctaattctcgactgaccgataatcgtttacatagagatacttccattttcgatcctccgtagagacctactcgtcagcagtcgtcagcattcgccagcatcaaacggacatgataagatgatcaccgcttctcttgcagccttcagcattaatgctgcttgagtgcttgttgctggcgccaaaatgctgatgaaccaacagacaagatagctcccgctaaaaccagttacgcactgcaatcaatatgcagttttgctcgacgtagcgcatggatcattcagtggttgaatacgatgtagacaaaattcaacgaggcctccttgtttcccaattctcatcatggtcttcatcagtccaactgttgctgaccatcataggcattaaacacttaaatgctggcgttacattttgtttgcttgccactatttctgccgatttcccgataagaaagccataaccttggagacttcggatataaatctcttctccctcaggtgctatagcaaattgttgcttctctgtgtgctccgggtaaactaaggtaactgctcgattccctatccttttccttagcttatcttctcttctcttcctcttagcgctatcttgtgtcacgccaactgcaatagtagtatagtactccaccatttgcatcggtagatgattttatagcttgttcttaatttcaagaatacgttttccttgatctctatgggaaaaccatgtgttgagctcggtggttggggtcacgagtttgatcactatctcctaccttggatcaaagaggtgcagtggtttctctgttgcaagatcctttatgcaattttcctggaaaaaaacaggtcccagaaagagtgccctttttctttgctgttcctcaaagttacattttcctgctaggcaacagacataacttgtacattatagcctctaaggtaaacattaacggaaacaaacacataagaaatactgttcactgatagatgcatctgtataaagcgttgcccatggttaatcacctccacccacttaccagctactgcccttttagctttgcagaagatggaagctcaagaaggtgatgtgaaaagctgtgaggcctccaaagtgaaatggaaaggtggatttgtagccctaccgttcatcataggtatgttaccattttttttcgtcttttatgttttacttcaagggtatcgttggatggcagaattttcaaaggaattttggaggattctgatactaagatttttttttcctgcaatagttgtttggaacatacaaacgaagcaattatattctgatgaattggtttcatatgccctaaatttaaaagcaaatattgtacagttttcccccttctacaatacaaatacaccccgtggggtttcaaaaaaaataaatttaaaagcaaataaatatgagctcaaacacccatgtttttactttctaaagttcagtgcattctatcttcctctcttttgactctctattgaaaaaacaaatatactttcttatggattcattatcatttgcttgttggcttatctagtgtagccaaaatttgaattttcaaacttaagttcaaaattgatttgggggctttttcgtcatagactattttctagccaaggcttttagactgctaataatagagatataaaagttttaattataaattattttttgtttttgtttatttttctataacatatcaatcgtagctcaaccgatcagggccagccaaatgactcccatattcatgtgtcctgaaatcttgtgggataaggtagcatgtccaaaattattcatgggttttcccttttcttgcggttttagaaccgtgcattccagtgaggcccttatctttcttgttatagttagatcacctcaaattgcacgcttgaagctgttagat

SEQ ID NO: 52096 - DNA, 18069 bp, Oryza sativa
cgccgtcattgccgacatgtacctcggccgcttcatcgtcgtcgcgatcggctccatcgcctgcttcgttgtgagtgcaaaaagaagatgagatttccattgacaccggaggagatcgaacaccgagctgatgtgctttgctttgcttgtttcaggggatggttttcctgtggctgagcgccatgatacccggagcgaggccgccaccgtgcgacatgagtgcctcgccggagctgtgcgcgccgccggaggcgaggcacatggcctggctgctggccggcttcgtgttcctgtccgtcggcgccggcggcgtccggccgtgctcgatggcgttcggggccgaccagttctccaggcaccccaaggagaggaggtccaggatcctgcaggtgtacttcaacgcctactacggctccatcggcgtggcgttcatggtcgccgtcacggtggtcgtgtacgtgcaggacaacctcgggtggaaggtggggctcgccgtgccgacgtgcctcatgctgctctccgctgcgagcttcctcctcggctccggcctatacatcaaggacaggggctccaagcggatgttcgccgggataggcgccgccgtcgccgcggcggtcaggaaccgtagggcgtggctgccggcgaagaccgaggacggcgtgtaccatcacctcaaggactgcaagctcaccgttccgacggacaggctgaggtaagcgacgatcgatcagcaatgcagcttgacaatggtgcgaattgctgttcaaagatgcatgattcgaagttcatgtggtgtgatcgatctgttcaggttcttgaacaaggcgtgcatgatcagcaacacgaaggaggacaagtctggtagtggcggcgcggacggcatcagcgacagagggcggctgtgcacggtggaccaggtggagcagctcaagtcggcgatccgcgtgatgccgatctggtcgtccaccatcttcctcgcgcaggccatgaaccagtacttcgcggtgccgcaggccgacgcgatggaccggcgcgtcggcgccggcgggttccgcgtgcccagtggcacgttcgccgtgttcaacatgctcaccatgtcgctctggtcgggctgctacgaccggtggaccgcgccggcgctgcggcggctgacgggcaacccgcgggggctgaccatgaagcagcggatcggcgggggcctggtgttcggcaccgcggcgatggccgcggccgccgtggtggaggccgcgcggcgcaggcaggcgctggcggcggcggcatgtcggcgttctggctcgtgccgcagtacgcgctggcggggctcgccgaggcgttcggcgtgatcggggtgatcgagttcttctacaccgagctgcccaagagcatggccagcttcagcatggctctgctctacatggccctgggggcggggagcctggtggggagcttgatcatcaagttggtccacgaggtgagcgggcggagagggaggacgagctggctggcggaggacttgaacgccggccgctacgactactactactggcttctcgccggccttggcgccgtcaacttcgtctacttcctctggtgcggctgggcgtacggcgaggaggggcagaacgtggagtgggaagacgaaggtgagggagagacgactatagcttagtagttttgtgctgaagcatgcatgtggattgctgggaacttgtgacaatgtggaacctttcctatggttatgctaatatgaagcctatggtttggttgccccatgaaaatagcagtttgcagggttgattctctggaccatacgcaatatcgtcacgttgatcatctttgtccattgcagtggcattggccaaggaaaaatatcggcaactcagttggccatttattagaaaacactatatctatgaatctcttatttggaaaataaaaaaccaaatctatgaatatatctctagtgttttgctagaagtgacttccttttggttttggttattcagcaaaattatcaatgcgaaaaatatttattagctaaccattacaatgtctgccttcctggaaccacagctaagctcctaataatttcttcagctccttcttgttgacctgataaaagcaataggtaagtaacaaactcaacacaactgcaaagaagaaaaaattttcagcccgcacctttcccatggcattccgaggaagcgaatcccataagtacaacctcgtaggaatctatcatgcatagaaaaagaattaactccagcggggaaaaagatttcagttcgggatcagataaaagctaagctgtacgtgttaatataagcaaaggatatgtaaacttaaccagaagtggttgagaaaaacatgagtcaggaaccatcccttgcgcacgcaaaatatgaattgagaacttcatagtacttccaaggtaatatgtgtaacttttgtggatggagggagtatcacgcaacagtcaaaagagaacactaaaaaaggcaacctcacaaataaggccatactgtaaagttgctagggaaagggggaaaacatgtagaaaatcaaaccttgtatggagcaagcttatcttttgaccaacttgtcagtgcttccaaggtcagtgctggtttcgagtccagttcagctcttttctttgagtcctccttaggcacaattattgcacagataatctctccataagcttcgtcaggtaagccgagaacagcacattccaggacaatttcatgctaaacaagaaatcaaaccagagtaaacaagatgagtaaccttcaactaaaccattgggctgtcttcaattagataggtttacaaagtgactattggaaactattcaagtaaaatggagattttaagtttttacctttattattgtctacctttattcttaccacaaggaaagtactacgtatcagcaagttctttcaaggcagtacgtttgctaataatgtctagtgtggggatatttacctgtaacagcactgactcaatttctaatgcagacagcttataaccaccaactttcatgatgtcagcatttgtgcctacacaggataatacaaatgagacagataacccaaaacgattacaaatagacagtagcaccacaacttaaacaaaaaaacacaactagtggaaaacgatgaagtggtccttacgccctaaaattatgaaatatccttcatcgtctacagttactgtatcaccagtcttgaagaacccaccatcaataaatgattctgcagtaacctgcaatacaaattaactgtgctgaacaacgaaacaaagacatttgattctcaacatgcacccttcatttggttccttagtggttagcaaattctgctaagtttgtatggtgcagcttagaagtcatgtcaatcacaacacccacaaaaggaatgcaccacactggtttcttattaagacacaaataacaggcaagagcataccaacaagtatagtccatattaacaaagaacaggctacagagttgggtgaaaaaaatatgaagcaacactaccctttaattagcaatctacaacgaatgggttttagtaaaataaggatgcaactcatggagattatttacaaataaataatgtacgcaatcaaaatgaaatgtataagtttatttcttgtgcatcattcacaatagataaaggttgactgttgggagaattagcaaatgattgttttaattgacgaggaaaatactttatcaatcatagacttcatatttttgtttatgaaaacacaaccatacctctggttttctccaatattccttaaaaagggatggacttctaatacaaagctcgccaacttcagatgtagtttcagccccatcctccataataatcttggcctgggaaagaatggttctgtaagtgccatgaggcaatacagaataaattagtttgatgttatcctaacttccatggatcgtttagcatacctcaacacacggaagcggtttgccaactgtaccttctttacgtgcaccatgcaatgggttagacagtgccatgacaaactacaaccaataagactgtcaaaacatgaaaaaatgatatcatatttatgaaatgtaagtccatagaaaaggaagagttcgtgtttttaacctcagtcatgccgtatcgttccaaaagacggtgacctgtcacttcctcccaccgtttcataagtggggaaggaagggccgatgatccacacatctgcaccagttcatataatgttaataacaaaaatttagataataattacatcagtccacattatgatagtgcttaataaagcctacaagccaaagaatactatacatcattacctagagctcgaaaagttgaatacaaacaaagtcatttggcttcagtgcccagcagaatcaaataaaacacctaaaataaatatagatgcatattgcaagctcacaaaggcatcatgcaagaaacttcatctgcttttcaagttatcgtggtgttagaaacctaaagtcagtgagaccacagttatcggatatattgagtcctgaggtgcttaattaagtactttagtgcttgatcgagcaagcatggccaatgaaccagttggactttgcaagttgaatagcaggattgaagggttcatgacccttgatctatctatcgtactaccatataacatacatatatttgcacattttcaacagatagtaatcagattttgtccatagtaactatctactagtcttttcaggaacatagtacggactgaaacacatgagttgtaattttgcctgacgcgtgaagtttagtctaaccaaggtccaagaatcaatacaattacttgcaagatatatatacaactgaccattagcctcaattgctttgcagcaaaggaagatgcagactgttgttcaggatccataccatcatacccttgcaatagccgtgtgtacattgttggaacctggtagtccaaaagtatcgaataaccataatgcctcgagcaatttaaggacaggtaatagtttagcataaatctaaaaaaccaaaaatatatggcatagaaccgtactccagtaaatactgtaattgcttcatcatttttactgccattgttgggatatgactcacgccacctctgccatattcccctcacactaaatttcggcatgaactcaacctgcaacctcagagaatatatattagcatggaagaaattttgacacaagatgcattgtatgtgactcctaaaacaaaattaaaggcttaaagtaacacatcatacgaccagaaaggaaacccaagtgctacaaaagactggttcatttaaacaaaatcacaacatcaatcgatcaagtgaagcactatgcacatgtgaataaagcatttgagatattagtaaaagtaaggtcaattaccactgatccagaatagaggggtgcaaatagagcattgaacaggccatgaacatgtaaatttgaagttaaggaccttaataaatctcgcaaaagaaggcatggttcctccaaaaacaattatagggaaatctaatgcaatccattactataaaacattgtgctaagtacttaaaatagcatttagcattagctttttgtggatatggtgcagtgggagacagtgcagaaattgatcttcacttcgatatccccatgcctctgacagaatttgaacctgccaaaccacatgaaccacaaatacctttagatcagtcaaaagtagataagcagtatcgtgaaaggtggtaaaatatagaaataacatcagtaaagtgaaaattgctaacttcattcagactgtcccaagaggcataatctattaaaagttagaaaaaaatgcacctgagagactatccccttatgagtgtggaccactccttttggtttaccagttgtcccacttgtgtaaaggatgagagcaggatcatctcctgtagtatcaaaccccagcatggttaggcagctttggaattaatattgattattgagaaaatcaatgattgaaaatgacacaaaatacagtatagaaaagtagcagcagaaatcaataggtatgactgccacgaaaaacagaatcactcacctctgatttcctttgaactgtcaatctcagctattaagctagaaatagacgaagtcacttcagtacttgatggttcttggcaatctatatttactggtatacttgtcacagatggaagaagagaacagtgagcagaacatttggtagagatattctccatgatgtcttgatgctccttggtgcttaaaatcagcgaaatgtcctataggtttcagcagttagaataaaagggacatatttcaaaatttatagtaaattgcaaatgtatgcccttgtacaaaaaaatgttgactttgtatttgtgtaagaaggtgtctagactgtcccccagtggcccattgaagaaatgctgcttgctgcgtggccctttttaaacatctatttctaattttggctcagtttacaatattaagatgaaaagaagtgcatagcaagagaagtaaactcgtgatgtgttttcctggtgttgcccctcctctttttttcttaccttgctgctttctcattgaaactggcgttttttttgggagagagagagagagagagagagagagagagagagaggtgtgtagtatgatagtagaatggcatctttcttgtgtaagtacatctattgcaaaaataaatcactgcaacaagttttagaacaaaccgagtcattcatgacatgaaggagttcagcttcaggatagctaagtgctagaggcactgcaactccaccagaaagccaggttccaaatatcccggcaacaaattcaggagaaggtttagccactatgccaatacgagctccaccaaggaatccagttccatttattcctttgacagatgaacctgtacttccattctgtgtcatctacaagaaaaacagcagaagaggtgatcaggcatcatcaacagccattgatcaggttaagataagatcgtgataaacatattataatcacataacaggaaatctcaagtgaacgaagataaaacaacatacagagaaggagagcggtggtacatttttattgcgcagaatattgtagacatccagtgcagatgcaatgagctggacaaggttataactcttttggtcagatctgatggctgcatggacaccttgtgtcgaaccatgcttaaggacttcctgaacaacctccatgaacgtactagtagtattttgtgtggtgttgtaagctagtaaaacacaagatgaaagtttcaatatcagaaaatataaatcactagaatttacagtaaaatagtaattgctaattaattcatatggttcaccgttctggccttgcatacccaatcggcagtagctcctcgcggaacagaccgaatcaatatagaccactaggtaatccataacacctctatgaggcacaaccttaccggtgaactcaattaagcacaaaccaggaaggagtggttatgaatcgtgacgtatcaatgtcgatgtgattatcaatgactagttggaagtggctcggctgttcaacaataacaattcactaatcagtaaccaccgaccaacccatgcgtgctgtacctactaggaatattggatatagagctaactgcattctgcgtacgtagcatcgtaggacccaacagacaggtttagaagcaaattcggaccactcctccatgataacgcagattgtaccactgatcatcatcgcagcagactcatcaggtagccctttagaaacccactaggaccactcttccatctccatgaggagaggacgcaacttattcactgatcaactcgagctcgaccacttgcacaccgaatccctcatcaaaacaacgaaaacgaagcatgacggggcacaccccgagagaacccgcggctggatactgctactaggcgagacaccccgccactgaagcaaaacagcgaacacctcccgatcgtgaacccagagcacggaggagaaacagagtcccccctgaacgaaaacaaaacgcgggtgcggcaaaacgacgaacacctggcgcggcagaaaaaagaggaaggaaacggggagactgacctggcgaggaggagcgggaggaggaggaggaggaggaggaggcgaagtggcgtcggaggcgagagaggagggaataagaggagcaggggaggaggagcaggtggtagggggaggaggaggcgtgggccgcggggcaattgaatggcgtcatcaagcgcgccaccgccccgcgcacccacgcctgtgcgcgcatttacgggcaggctgtgccgggtaggtgaactcccctggccgcggcactgttccgtgctcgtactcgtaccacagcagcggactggcggtaggttgctcgctcgctggtggccgcgggccggtggcgccccgcgtgttcgcgcgaagggggaaagaggaagagccggacggacgggggcacggggccgtcagtttgctcggttttttcggtttttcctttcctttcttttattttttccttctccggctgtactggtttggtcgtcgacggcgtacgttggtacggcttgtcaatcgactgctatcggcgccacagcgtcgtggttgttgtctgacattgcaacaactcaatttgctataggtgtggcatggtaaataaaggggttgtttggttcttaactaacattgtcacaatgttagacaagtgtggcttgccacactttttgtgtcctataaattgtaagccacacttgtgacaaagttaggcaaaaaaaattaagtctatgacatgcgtagtaagatgataagaaagtgtggcttgccataactatggcaatgaaccaaacacaagactaaagatgtgtggcagcctaaagtgtggtgtggcaagttgaagtattgaaccaaacagccctaaagtgtggccaacaatttgttagccacaagtgtggcaatgtttggctagaaattgagtatatgacatgtaggcccatggaacaagaaagttgtggcttgccacaactgaaacaagcaaccaaacgttaagctaacaatctgtggcatgtctaacatgtggtgtagtaatatgtggcaactaaccaaacagccctaaatgtctgctgaagattatcaatgtgagacatacatctgttcagatttattatactaaaatatatcacagctagtcctagatttttttttcaggatggagggagtatgttctttccttgtttatccatatctctaataaagcgttccattttttttataagtttattagtttaaatttttaagctattttttaatgattttatactttaattcaaatgtatagttctactctaattcacataagaaaaaaaccatttaaacatgcatatcatcatcattagtaagatgttttttaaaatcctcaccgctatgctgggaggcatgacgttggcccattcctctcgcccaataggatacgtgtagccaagacctatatagaaagctagtgaagattggtgatggcctgtactatctaaaactacatacgtggttgtacccctcactcgaggttgtctaggacctacacatagtcgggtactcgggtggaaccatttgcacgaagacattctgcaaggtgacacagtgtgcttagggaagtccaaaagtacctgcgagaagactatttgagagatgacatgtggcagtgattgagatagcccaaaggcgcccacgaggaaattgtcctagggacaacacgtggcgaatgctcagggcaactcgggagcactcgtaaagagattatcccaagaagcgacgcatggtgatgcccgagccagcaggtacgttgtgtcggtattcttgacactcacacatggtgtgcccttgcactagggcgtaggctcatgcacgagaaccccaataggggaaccacacatacctatatcctgacaccaaggctcgcatgtcccatcattccatattaataagtgcactcaaagtcggttgaggacattaaatatgggtgattcagtgaatcgcacctccccaaaccatcttttctttgaccgatccattatgttaagagagaggcacggtcaatagcatgtttgaggcggggctgcgtagcatgacatggaagaatgaacaagggatagacggtatgacagcaggtacagtgtagatcatgatgtatatctacagtaccttagcaacgcacccccccttcccccgagttaggtagaccttgaaaggtgtataaattgacaagggattgccaagaagaaggttgaacacagttagatacacgataatacacaaaagctctaggtgccccagatttagccgaacttccacatattaatcaagagaacgggactacgggagtagatttattgttctccggaggcccaaacctgtataattcgttcgtgtttgtcaaatcttgttctatctgctattacacgttgacaatagcttttgacttaatagtacaagggtgacatatactttttaaaaaattgttgggtctctaacatagaactaagggcatgtttggtagagctccaactcctaaatttagctccaggagttaagtctagagtggggttgtggagctgcgtaaacctagctcacctatctagtttattttgtgatagagcttcacccaaacctgctcccaatttaggtggagctgaaactatttggctgggctccagtttcaagagaggtggagctgaagctagagccgtgccaaacaagccctaagaccattagggttgtttggcagtgctatttgtagccgtcctgcaacaactaaccaactgaatgcattgaagataaccatgctacacggctataatgcggcgtggcctgttgcagccagtgttctcgaatagccccattgtaaatgaatggataagcttaaaaaaactcgtgccttagaaatacacgagtcaacgcccttggccgtcaactcaaaaccttggttgaattatgcctcttcttagttgccactttaccaatcacctcacttgtttgttggattatcaaacgtaaacggaattttaaattctaaaacttaattttaagtatactggggattttgtttattgcagtctactttcaatcttagtgtttaaactgctaataaaagtttcacttataaactattttggttgttttgttattttttaagctcatcaactgtaggtgtctttactgtgaaactttatgtgttccgtatcatacatctattccaaaatacctttttcatatgcgatatctgaatatacatcacatagtgctatcctagaaactaccagtagcattttttgaaaagcaaaatatgtgtcccatggctcaaaatatgcaagccttagcccatccaaagaaaagcctgcgaacctaatacggcgttaacctcgacggaatcaacaagtgggcctcaaatgggccttactgaaactgacagaactgcaagtcacatctttcaaacccgccacaagagattcagcataacgcacggtgtacatccctttcatctatttacaccaatgacaggtgggtacatcacccgcgcctggtcccacccgtcatggagaataacaaacccaccagcactttccagagaaacaaactccacgtgtgacaggacggatcacatcaacgacgccgacgccgcaagaaggcccgatctccggcccacccacgtcaccccacccactggctgcgcggccccaccgaaagctccagcgcccgtgaccccacgcgtcagccgcggtggactcggcgagcgacgcgtaacgcgcccacctcatcgcgaagggcggaagcattcagccacccccccaccccgtcgaatcgaacggcgagcggcccaacaacctaacgtctatgaattcgagccgcaggatgtggcccggccgcgctccgccgtccgatccccgcacgcccccaggatccggccgtagaatatgaatttgatttcgaaagcgaagagtgggaggagaaagaaagggggtggagaaagaaagagagagaagagggggaggagagagaagctgcagcaagagggaaaatccactaatccccaactcggagactcctcctctctgaaatccgccattccctacccctccgccgcaaacacgcgcgcgtggggagctcgcggcgaatccagcctcgccagccccggccgcgcggggacgccttgcccccgatctggcgacggcggccgcgatctcgccgcgcgcctcggcggctgcggcgaattgggggtgggggtggggtggagtggagtttcgataggtgtggcggggagggagggagggagaaggggcggcgtgttgatctggtagcttcgtgggggttgggtggattagatagatggcggggaaggagcaacaggggggaggagggccgccgccgccgccgcgggcgccggtgcccgcggcgtcgtcgcagccgccgattaagaagctggtgaggcagctcgacttcacctcggcggcgttggcgggtaaccccgcgatggcggcggccgcggccgccgtgtccagggcgctgcagccgagggcggtcccggtggggttcccgcagccgcagcaacttagggcgcacctgccggtgggggtgccgcagcagctgcatccccggggcctgccggtgatgcggtcgcaccacgtggtgcatgtgccgctgccgcggccggcggtggccgtggcggtgcccgtgccacaggttcggccggcgcagccgcagccagtgccgcggccaccggtcgccgttccattgtgagtgtgccagtacctagatttatgtttagcatcaagctttacatttttacttctcaattgggtaatttctctcttctaactcctttttggtgattcatttcatcggaggaagactgtttttctttttctttttgtttgtaagccaaagtttcaaacttggtttcgattttactttgcccttatctttccttggaaatggaaggatggaccctttgtttttttttttcacttgcatctatatttgatattaccctcgttcttattacgatcttagttgatgcaaattccctatttctattttttctcttgttattttgcgtcatgttccaagatgttcttattgtgctttgaatctgtattgtaggaaaccagagtcaccaaagccaccacgggcacggctttatgaagggaaagatggcaccccgacaaagaagaagtgctgcaactgcaagcactccaaatgtttgaagttgtaagtcagattacatgccttagcttgaaaacggtgcaatgttgcaactggagtacccttctgagtaactctagtctggataacgttggatccaaaagagtttattttatttgctacagatgctaggacatatgtaaacttgtaaagtgaaattgtcttgagtttcttttaatccaaaagcttatatagatggatgctcaatccttttttttaataaaaagctggatgataatagcatggtcccaaacttgaccaatagcattcacagtgtgaccaaatacttgatcttatggtattgtaagatttctctagtatatacttgtcgcaagttagctggtctggataattataaaatgttatattatatatgtatccggaaaaacttatgggttagctctgggctctggcttttaccatctaagttccaatatgcatccaaaacgatgtatactagaaatgtggttcatctgattcacggtacatgaacatgatttggttctgcagtttaatgcgtttctgttcgatttccactgtagactcaaaacgcatacctctgttgtctctggtacctctttcactatgcttgtaaggttttgtgtactgatagttgatattatcaatctggatctcatggttttctatgtttaggtattgtgaatgctttgcatcgggtgtttactgtgatggatgcaactgttccaactgttttaataatgttaagaacgagactgctaggcgtgaagctattgatgctacattggagcgcaaccctgatgcattcaggcctaagattgggagtagcccgcatgctaaccggaataatatggtatgttttgagttccatgtcttaaatgagtagttagatatacatgctaagggtgttcaataattgatgcccgttacttctggagtattaatgattcatacaaggaatgtccgtgcatatggtgcaatcacatgtaattctcatttgaaaatcgaaatgaagctataaactaattgaatgcaaatgtagaacaggggaaggcttgggaaattacacaagttcaatgaggaactaaattgctactctctacaactaagaaatttacagtttggatgccatatttcagtaaaagggcatgcaacctagtagttacagtgctcaagtagcacctctaggtcctggattcgactccccatgggagcgaatttcaagcttagttagaaaaggtcactcattggcccctcataaaaacgtgttaagaattgacctatggaggacgagcatgggttaaggaccaatccatagggagcgagtccacgtgtggggggctgggtttagtggcctttctcggtcggattggttgaagcttcttcttaatgaaaagctgtgaacatggtctttccccaactggtcgagtattttttggatgccatgtttcatttttgtacatctcattatctgatttgccctgctatgatgcgtgtacttaatgttagtccctgaaattgccaggaggcggctggtgatcttccattagttgggaagcataataaagggtgccactgcaagaagtcaggttgtctcaagaagtactgtgagtgcttccaagctaacatactttgctctgaaaattgcaagtgtatggattgcaagaatttcgaagggagtgaagaaagaaaagctcttttccaaggggatcataaaaattccattcacatgcagcaagcagcaaatgcagcagtaaatggtgctattggagcagcagccttttcttctccttccgcatccaggaagagaaagcacatagatccttcccttgaccactcggccaaggaaaatggagctcacaggactaatcatgtacctcaggtaatgacaatttctagatttcagcaggcagttcagtttttccctaatacctccgtctgtgcatactgcatagctttgtgtttttgaggtattgacttcagtgatgggtggaagtggtctgctccatcaaaaaaaaattatttataccatgcatacaagtcatctgatgaacggtgtttcagatgtgtggttctgagggataggatagttattgactagcgctattgcttttttgatcagaaaggaaaaggactttccgtttgtatcagtgccgcacgtttacaacgacccactgttacattacatacccttctaattgacatccccatcagtttagcacaactaacacaatatctacctcactcttgggtttgtaccagcaatttatgcactggactgctcttttgaaggggccaacaactgtactatagataaattttgagttattagttctccgtgatacagaagtggtaactcctcatatactgctacttataaatgagtatgcaaatattttcttgagggatacaaattcctctacaacagattcaccaaaaaattggactaacccagataatcataagctgctaatagcaagagttatttcagggttctggtagggttttttgtatactctttgtgatttaattaggttttttatcagaagaatggaatgccatccgatggcccgcttccaataaaccagcctgtgcatcctccaacattggggccctttaaggtcacctacaggtaactgtcaacttctatcacttttccttgagaagatcaatcatacctgtttttgttgatggctttgtacccttccattataggcctcttttagcggatattgtccaaccaggagacgtaaaggaactttgcaagcttttggtggttgtatctggaaatgctgcaaaggcatacgctggtattgctggtcttacattttgggattttattaatttgcttgagaaagtattcatgggcatcctgtgctgcacataacttaatctttgttagaggcttagagccattcaaacaacttgcattaatctgcacatccttgtttcattttaccattccagattcaaactatgttttacttttcttgaaaactaagttgcactagcacataagcttttagttcaactctcatcttttcttgggcttggattttggatacctacgcagtgaagatatttaactatttgccactcttagatgcagcatttaacaatttgccacatgggcccacatatcttagacaaatgagggcccacatatcatagacacatgagtggcaaattgttaaacggcaaatctaaaagtggcaaatagttaaatgccccatctgttggtcactttgaagagagaaaaaacccaacactatagggttccatgtgctgcttcctctccattttttgtatttcaaataaatggttttataagatttcttttggaaccctaaatgaatatgaagctattccaggcttgatttggtgcatgatgcatcccattaacaccattctgtaacttccaatgttatcagggttaatgtcttttccctgttgaaaccatgctgtaataggcgtgatggttttatcatagttaggcttgatgtttttaaatgataaccaagtctttattagcatgttttatgtttgttaatataaggcatgaccacattcatacattgggaactgtctcattgggaaacaggtaagaaatcccaggataaggtggtagagaaggaagatgagatgggagggaagagggaaggtgagattggaggttccctagcatcgacaaaccatgacagagaagaaaacaataatgatccaaataatcaaaaggcatcagctgatgacccatcaactggaggaactcgtgcaggcaaagcttctctagaagagtctaaacatgattgcaatgatgatcagaaatccaataggccaatgtctccaggaacactagcattgatgtgtgatgaacaagacacgatgtttatgacttcccaaaatgtagttccgcagcagccagcacctgtcaaccagaaccagtctgaattgtatgcagaacaagaaaggtgtgtgcttacagaattccgtgattgtctccataagcttgtgacattcggaagaatgaaaggtacatcgaaatttcccatgtgtcatgctaatacagaattattgaacttctccattttttgctttgtaaaacgtgtacagtttgatcctgatggttcttccttgcagaggagaagttttccatggcaatcaaatctgaagtgcctgcccatcccatgcaggcgaatggtgtttcacgaataccttattcaaaagaagtagatgtacctgttgtaaaaacatttctacagagttccagtagacatcctgctgctggaaactccgcaactgggcatttggacaaaaaacccaagcatgaaaatacataggtgtccggggtttgtattttgggtagcatggtcaagagaatcatgttttctccctctaacatgttgatcagaagcttgtatcagtcttcattcttgtcttaggttcaagaaagctccaatttgttctcattggtaaaaataagtgtaatgttggatagttagcttagtcataaatatgcatttagcctttatcttagtgtctacattgtttgttcctttacctttaccatttccctcgtgaaattttgccaatcaccatgctagtattttagatgagattattccactttacgcgattaattcatattggttgtggctggttgtaaatggtaatagttccagactggttcacctacgcttcaaactttttgtgaaagtgtgaagccatacttcatcctattggcaactaccagaattgcagaattgcagaaccatcttatctccaaattt

SEQ ID NO: 52097 - DNA, 12671 bp, Oryza sativa
aattcctgcagccctcttgagtggacaatggcgaaaacaagcttctcacattttgcacatacagttaaatattcattggtttctccaggcctgaagaaagcgaatcacgacggcaagagttaaggctgcttgtgctccattttcgcctcaaattactgccccaagacgcgagatacggaactcttgatgttgttcagaaacttttccctgcagaaaaacaactgggctagtaaagaaagtgcaacaaaagaaactcttcaactatggtgctcagaacgataatacagatgtcccgagctgcattataaagtgtcagtacggtgccagttcaatatatatccagtattctcaatgatgcaggtatgcaggcatagtgcagcaaaccaaaaagaaattgacgttatgttgtgtgtaaatgtgaaagttccataaaacttcatcgtaaagtatatcaaactatcagtatcttctcatcaatgattcaaaaaaagtaagatctctaagggcttgttaatgatacaaagcaagttagatctttcaagcttggaagcatctgctatgtaaatatacagaaatggagccatttctcaaacagatccatgtaaacttttgcaagtgtgatatatggcgattacaaagttacctgtctggcttgaatagtaggttttgatatatgaacaactgcaaagagttcaacagtgaagattcataagattagaaaatataattcataaaggagaatagtcgctgcctaaaacttacccatgcaaccaatatgccaattaattcaaagagtagagggagaacaggaagcttgtcgatgacctgaagttgatttattgtattatcatgaaaacgctcttattccaacaatcgaaaaactgcacatttgaagctagatcatctggaagttacctctacaagatttatagaagcccataatgcggcaatccctgcaaatcctataccagctagagcaaagaggtcttcaggactgctgaactgtttcagttttttttcaggaaacaaaagtatgatgagaacctccatacataatcaggtgcctcaaacacaattcagaacaatttatggtatcaagttgtcttcagtgcataattactccaggtaaagtagcagactgtgaaagctgatcagaagcgtaagtgcgtacaacgaagctttctgaacttgcgtcagaaaaaaaaattgccaatgtcatcagggttcctgaacttactatctacctcaaagctcaaattgattagtagagataaaaaaaactcaccgaactctggacatacttcacaacgctcccggatgacggttctgaactgtcctgcgcagcctttgcagcgacgacattgcgactcctcatcctccctgcatacgagcacattagagcacatgatactcaatggctcgtttgcaaagaaacaacaatataaaaagaagtgcaagagaaggttgagattgattgggacccttggaggaaattaaaaagaaaaacacctgaaacaaatctggtgcttggcactgcaggcagcatggggagattcccggtgatgctctcgctgccgccgcgcggaacgagagccgcaggccgagcaacggcgagagcagaggccatcgcggttagcttcccccgagaatacggtggaattgcggaggtcgcgagcggtggatattgggaagaactactgcttggccttcgtctgctgcagcggatgcgagtggaaggctcctcgtccacgaaagcaccatcggttggcagatttgcagattgccccttgccttctgcagatattctgattaatttccattctacgagtattactgtaccgcctgcctgtccgggagaccggggaagttcacgctgggatacagcttcagatttcgctaggtttatagtgactgactagtgacacacagatgtttcagtttgtatcttttttggagtatattaaaaaactaaaccgtcacaacttttttagtaaaaacattcaaatgtgttgactttctttttaattgctcgaaccgaaggtcctgagctttgttttttgcttcacacttataaagtttactcctcctctattcaatgaaattggcagcttaccgattcgttaaaaaaatataactacaatataattaaagtataactacattgcaattgtattgtaaatacgatataacttataaaactcgtattcaacttatgatttgattagctaacgttgagattttacgcgtgatatgtgtgaacatttctttctattaaatccatttttttttcctttatttatactacgagcgctacgtaactggaatctgtacgataatgacaaaccagcactgctgcaagctcccctgtaactctgcataatactgtagaaactaaacgagcagtaaacaaacatcggattccttaacttacatcggggtcgtacaatcgacggcgagctttaaccaaaattctcgcggaagagagaatctgtctgtccgagaccacctgcgactgaggctgtgatccctgtggcaccggcaggacggcagtacacgcccccccgtgaccccgcccgcgcacaggcgcagcgtggcgccgtccaagcgttcgagtctcactcacctccaccacctctcgcgcccccacgttcctcggactagccgcggtgtcgcctctgtccagctcggttgcttcgctacgcgtcgctcgctgctgccaccgcgccccgcttgatagattcgagcacgcacgccgggttggcgctcggcgccgcgccgcgccacggagggtgtcacgagaccgcctggcgcgcacaggcgcagccccccgtgtcgtcttcctccctggttccttcttgtcaccgggacgggcgaacctctttcccgcgcgtctgcacatgccattttcagcttccatcatcaccatcactactattcactacttggcctagtagcgaccgagcagtgcccactccgttgctgcctgcctgcctgtccgtcctagctagcatcctacgctcgcgtgtagagagggtgaactggcgaagggctgagcagagagatggaggtagcagaggccggcgtcgacggcgtggcggggaggcggcagcaggaggaggcgtccggcgcggcgccgttcggcaggtcctcgtcgctcatcggcgccgcgggattcgacggcgcgctgagagttgagcacttgtttggcttcttgccttcttccccgatcgtgtctcccgtgtgcgttgtgtctctgaccttgaacatttgggctggtcttgtgatccgcaggagctcaaggaccttcgctcccagctgcaccagacggcggactgctgcgagaaggcgttcctcgacaccgagaagaagaagctgtcagtgcaaagcttcagctatcacatttaattatacacttctcccgccactgttttgtttctctcgtgcctaacatgtcctctcacttgccactgttttgcttgaagaattctggagagcacgaaaggttacatctgcgacgcgattgtagcggtgattgatcatttggggaccgtctcatccaagctcgagcaacagctgcaggagaagattgagatcacacaaacagagaaaaagctcaacttcttgaagcaggtcaggacatccgtcgactgaacctattttccgtgaatttcgcatgacaataagagtcagtgtagttacagaaaatagcactagtagctcgcaacatgactagtagcttgaaccatttcaatgatgaagaagtagttgaaagaaacagagtactcactgcttaaatgcttagtactttagtatgattaggtaacttagctcattatctaaaaaaggcaagtgaagatcctgtactccttcaactttttccgttctttgattcagggataacttttccgttccaatttcaagaagttagtgtaatagattttgaaagtgaacggttcatggttactgctgatgaacatcgatcaaacgacactttagtactgccacttattttaatttttagtctcttcatgttcatggtaccagaggctcctgacatgtgaacagtatgcaattactctcaaactattgaccgtacgtggggacaatgatgccattcagtatcatcgccgttacctctcgcaatgtaaattctctaactcatttgattttgtgttgtcgccattacttcttataaaaaaaagggttgctgatatgtggtcatttggacagcttcaactctgttatcattgactaactatattattcactacagctactggaggaaccaaagaggaaaatggtgctaactccaggtttatgccaactaaaattttcctttgatcattttactattatagcatgtgacctgcatcatatcgatttataacattagtagttctgcacacaggaaagatgatgtaaaatttgtggagtacaacagcccaaccatacctggagcaattcttactttcaagccatatgatattcagtcaaccattggtaaattcggtatcttgctcatgttatgaagatatgtatgcttattattgttttcagtgtatgatatacatttctcattgattagtactccttactatcttcaatttaagaactaggaagtagtaactatgtaaatctgtttttttttacaagtaactatgtaaatcttagaagaaatgttatatgaaattctgatatgtttctgatgagatcataattgtctagtttccttgtgttatgaacttgaagaaaattgtgaagatccctaatcaacatgtattacgtaatgacacaaactaactgatagaggaatctgtacatttttttctcctaagtgtgtatgttttatgcatggaatagatttgtcatcaaccttctatagactatagtttaccacagttatagttttgttttccgtataataatagcatttgcatgttatcccgagttatgtgttaagctttctctcttgatatttgtggtagattgactgtttgtttattttcatgatgttgtttgtctttagggagagaacgttcggtggcaactacagactctgaaagcccaacaacggatgcaaagagttcattctctttcagagcagaggtattctctttaagagcaaagagctccttttttttttcaaattaaaaaatatgtttttaaacattatttactttaccaaatcaaaacgctggcgaatagtttcatactagccagttagcgtgctaccctttttgtgacaatttagcataacaagatgcccgtttgcaggacgttcccattgttctagctgaacacaggaagaaggcaaatcatggcagcaatatcttgtcatttatcaggaaaggtagacggcatgcgtaagagccaaaagcgccaccggaatagctcgagactggatatatgcacgcatactttaatgaattcagtattgattggcaacaatgtacaacctaatatcactgaatccccaatttctgtcaaaccagtgtccattgaccatcatgtatgtttagctttgcatttgtgccagcagtaaattcggcccgatcatcctgaacatgtaacaaacttgaaggatcgagcagtaatatctgcttggaaagctagtttttcttcccctctacaaactctcaatatcatgtaacaaactttaatctgtctccttattatcaatgacaaagattcaggtgaggaatctctcccctccgatgacttcgtaaaaaggaaacctgaacacgaattcagcaaattctgcatcatcaaggaaaaatacatgtacgttcagtacttcagggcatcttttcctttgtgcttgagaaatcaactcccgaatcccgatatatcatatatatacatgcagtaattctcataacggtgtgaatcaactctcgtactgtactgtggcgtgctactactagtagtagtataaaggaatttcgctttttacgcgacattcttgagggtagctggcccatcataggactaattaaaagcactcgcataactactaattaagtagtaagctcctgccacaagctatgccaattcgatgagcccgctcaacatcatatcgatcgaccggctcacgcatttcattcaagaagcaccgtccggttgcatgaacgccccgcgccgcgcgtacgtagataactaccattcaaatccctaactgcctgtctgccatttctctccatctcggtctgtaaaatgccatgtatctagtaccagtagaacagttgtactacctcctgatggtctcacgtaacttctttgttccctttctcttcaattacgccattgccgtcttgcccggtcgatcaaccctagctttctaagccctacaaaagacagcatccatctgctagtgttagcttagccttcagagttcagagagagatggggaccaaccggccgcggccacgaaccaaggacttcttcgcagctccggcgctctccctcacactggttcgtcacatcgttctatcgacggcccgatctttatgtagatcattttgtctgaaattttcacctaatcacctgtgtgcttgtttgtgtttatgtacgtgcgtaggcaggcgtgttcggccggaaaaatggacctgcggcgtcgggtggagacggggtggaggaaggcgacgaggaggtgcaggctgcaggcgaggcggcggtggagatcagcagcgagaacgcggggccggggtgtagacagtcccagtccggcggtggctccggggaagacggcggccatgacgacgacgacggagagggtagtaataagaagaggaggaggaagaactaccacaggcacaccgccgaacaaatcaggatcatggaagcgtgagaatttcctccatttctgttgcgtgaatatcagcgtcaggtgtttcctgtcccctgggccgcgggtgaaaggggtgcttcaccaggcccatggatcagatagggccaggcccagaaaggatgaacttgcatgagagggagatttttttagtttaagcaagcgttccagtagttcctcaatgatctgacatgaaaatatttttcaaaatggaattttgttctgaatcggttgaatgagcaggctattcaaagagtccccacatccggatgagaggcagcggcagcaggtcagtaagcagctcggcctctctgcacgccaggtcaagttctggtttcagaaccgacgaactcagatcaaggttaattactagcgctcagtcttaactataccagtgtgctcgtcccaccgatcaacagcaaacagcaaatgaatcatgaatgcatggggattttgatctgtgcaggcggttcaggagcgacacgagaactcgctgctcaagtccgagctggagaagctccaggacgagcaccgcgcgatgagagagctcgccaagaagccatctcgctgcctaaactgcggcgtcgtggcaacctccagcgacgccgccgccgccgccacggcggcggacacccgtgaacagcggctgcgactcgagaaagccaagctcaaagctgaggtttgtatgccgccgccgcgaagccgcgcccgtcctttccggtgcgctacactgcaagacactgactccggcgaactggcgatgttgaacttgtttcagatagagaggctgcgagggacgccaggaaagtccgccgccgatggaatcgcctcgccgccgtgctccgcgtccgcgggcgccatgcagacgaacagcaggagcccgccgttgcacgaccacgacggcggcttcttacgccacgacgacgacaagccgaggatcttggagctggccacccgtgcgctggacgagctggttgggatgtgctcctccggcgagcctgtgtgggtgcggggcgtcgagaccggcagggacattctgaactacgacgagtacgtgcgcttgttccgccgcgaccacggtggttccggcgatcagatggccggctggacggttgaggcttccagggaatgtggactagtttaccttgacacgatgcatcttgtgcacactttcatggacgtggtatgtgcatggcgatatgccgatattgtgaacacacggacactagctcatacatgcatacaccttgcatgatttttttttttgtgcaggacaagtggaaggacctattccctaccatgatctcaaaggcagcgacgctggaaatgatcagcaaccgcgaagacgatggccgagacggcgtcctgcaactggtgacccgtcttgtgtctctctgcttctgaccgacgaaattcatagtgctaaacgtgtcataccttgctcgatatggtttccagatgtatgcagagcttcagacactgacaccaatggtgcccacgagggagttatacttcgcccgctactgcaagaagctggccgcggagagatgggcgatcgtcgacgtgtccttcgacgagtctgagactggcgtccacgcgtcgtcggcggtcaggtgctggaagaacccatccggctgcctcatcgaagagcagaacaacggccggtgcaaggtatatacgtagaacacagtatggttcaagctggcgtacggccgtttcaactttcaaccaaatctctgcaccgtggtttgactagatgacctgggtggagcacaccagatgccgccggtgcacggtcgcgccgttgtaccgggcggtcaccgcgagcggcgtggcgttcggcgcgagacgctgggtggccgcgctccagctccagtgcgagaggatggtcttcgccgtggcgaccaacgttccaacgagggactcgaccggtaaaaccattactgacacgtcgcatgcagcgccgcgtgatccatcatcatccatggccgtctcacggatctctcccgtacacaggggtctccacgctcgcgggcaggaggagcgttctgaaactggcgcaccggatgacgtcgagcctctgccgcaccaccggtggatcgtgtgacatggcgtggcgcagggcgccgaaaggaggcagcggcggcggtggcgacgacgacatctggctgacgtcccgggagaacgccggcgacgaccctggcgagccgcaggggctgatcgcgtgcgccgcggcgtcgacgtggctgccggtgaatccgacggctctcctcgacttactgagggatgaatcacggcgaccagaggtgagccgccgctgcgcgcatttcaacttaccctgcatgcacattatgcacactctgactcactaatcaaattgttgtagtgggacgtgatgctacccggaaaatctgttcagagccgcgtgaatcttgcaaaggggaaggaccgtaccaactgcgtcaccgcctacgtaagctaaccttccctggcagctacatgtgcatctcgtcgacacgtacattattgctttccttcggatggatgaactgcaggccgctcgaccggaagaagaagaagagagaggcggcaagtgggtcctccaggacgtctgcaccaacccctgcgagtcgacgatcgcgtacgcggcgatcgacgccgccgcgctgcagccggtcatcgccgggcacgactcgagcggcgtgcacctcctgccgtgcggattcatctcggtgatgccggacgggctcgagtccaagccggcggtgatcacggcgtcgaggaggggaggcgaggcttcgggggccggatcgctggttaccgtggcgttccaggtcccggccagcccgtcggcggcggcggccacgctctcgccggactcggtggaggccgtgacggtcctggtctcctccactctgcgtaacatcaggaaagccttggggtgcgactcgtgcgaggaggaattctagtccacgggacgcggaaatattctactcctacttcggattcgttattcgtatgatactccacgactccacgtgaccatgtttgcaaagtaaatttgcatcgtgacttaccatgaacataagtgtacagctaaagggatactcgtactatagaactacacggtactgtaaagtcaacaattaagcgttaaaaatcccccgtcttgcagacttctttatggtcaccgcaactagcagagagccgtgccatgggcggtttcttggaactcgatcatatccgttgcaatggaacgcaacaaaacgtaaagaccagcccaagacgtaatgatatcacgtctccacaccgatgacgttgggccgctgcgtcggtgagcccgtatcatcttctacaaatccgaccaccgcgtcgctcctgctcggcacgtcgtcgccgccgcttcccaaatcccttctccctctcaacaattttgcgtgcagcgctggtagcaacagtgcacaactaggctggtcaaaggtgtgcacggtggtgaagacaggatttagtgatagggggtgctggctacgagatgtaagaactcaccagctcctcggtaaacctctcggtagacaatggtgtggatcttgatggctcagttcatgctgagtagcagattggcctcacctcacctcttgttcgctctaatatgcgtagtcgccaaaagaatcattttttaaaattaggcaactaaatagcaccaattttacaaaatacatgaatgacaagacatcatttctattcatcctttttagttttggagacttgcaaccacatcgcttagttacgttaactcaggtaatcacgtaaagctaaaatctattggtcagttatgtataggctcaacttgcaactaactaatgagttaattgtatggattagatgcctaatcacccggggggtttgcagtgcatggggatgggggtgtcaggcccaccccggcacccccggtggcttcgccactgggtgtgcacacgaaaataaaaactcaaacacaataaaaattcgtctaaaagcaggataaaaagagataaaaaaagagagagaaaagcaacggactgcagaactatagccagctgcagcatgaactccaatacgtaatgtgcgtatgacaggtgggaccaggtatctatctattatataattaaaggaatagaaaaaggagcatccacgttcgctttcatggtctagaaattctcttattaatcggagaaaaagaaaaggcagagtccatatagaaatacaatttgaaaatagttgaaatttggaattaaaaataaggaatattagaagatgagactagagtctatatagaaatacaatttagaaatagttgaaattcggaattgaaaaataaggaatattagaagaggagactagagtccatatagaaatacaattaggaaataactgaaattcggaattaaaaataaggaatattaaaagtagagtatagattccatatagaaatacgattaggaaataactgaaatttgaaattaaaaataaggaacattagaagaagtagagtatagagtctatatagaaatataactagtaaataatagaaattcggaattaaaaataaggaatattagaagtagagtatagagtccgtatagaagtacaattaggaaataacagaaatttggaattaaaaataatgaatattagaagtagagtatagagtccatataggaatacaattaagaaaataatagaaattcggaattaaaaaaataaggaatattagaagtagagtatagagtccatataggaatttaaaactaactaaaattcggaaaaaaaagaggcctccacgttcgctctcctggcctagaaattctcatattaatcggagaaaaaaaagcagagtccatatagaaatacaatttagaaataactgaaattcggaattaaaaaataaggaatattagaagaggagactagagtagttattacacattagtagtttcgtaaagttattgcaaaatttaaaattatgttgtcattgtaatatattttaataatataatgagaaaacatatatactattatatgagagaaaatataatgatgctagccgcgcaatctgcgctggccaccatgcttgttaatagtatagtaagcaactattgtatgaattgactattatattggctatggatgatttgtagttagtagttggctatactattaaacttgctctaaatgaagttctccaatttgtgtgtttagttcacgtcaaaattagaaatttggttgaaattggaacgatgtgacggaaaaattggaagtttatgtgtgtagaaaagttttgatgtgatggaaaagttggaagtttggctgtatttattccacaccataattgaaagtttgaataaattaaaacgatgggataaaaaaattggaagtttatgtgtgtagaaaaatttaatatgacggaaaagttaaaaatttatagaacaagattggaatctaaacagaacctttgtttaaagagtttggaaataaactcggcctttgtcgcaaaatttcgggccttacctcgtggaggcgtggagctggcccttgccgccacggtacgctttccctgacggatcgggccaagctgcctatataaaaagtcgtcgtgccacactgccacgggccacggcaccaccatcgaacaaagaatagcgcgcacgcattcgcctcgacgccgcatactcgcgtccacgagccccgcgagaaacagctatccacgtcatccgcggcggccgcccgccgttttcccttttccaggcgcgactcggcggccgcacccggttgcgcacgccgctccccc

SEQ ID NO: 52098 - DNA, 12136 bp, Oryza sativa
cccccccccccccccccccacgccacgctcccccgcctcgtttcccccgcgcggccgcgccagaaaggggagaaacgcttcacgcgcgcggcgcaccctagcttgggccacgatgccatccgctaacgtgcgcggggcgcagcctagcgccgaccgcaggttaagtacgctggtgcgccacctactgccttcctccgcacgaacagcaaccaccaccagcacctcctcctccgccgccgacgccgactcctccctccaagctttccccaccatggcgtcgtcgtccgtcttcgctggcctcgcgcaggcgccggaggaccccatcctcggggtaagatccccctctcgtctcccaatctcactcccgctccccatcgctgtcttcaccggtttcggccgtgatcgcgcggttttttgggttcgctcgacctgatcggtgctcccgttggtgttgtggtaggtgacggtcgcgtacaacaaggatcccagccccgtgaaggtcaatctcggcgtcggcgcctaccggaccgaggtaaggtgttttgggggaatttctattgattttttgctccttcgtattttggattggattggtggtggatttgacttcgattttgtggtctgatcggagtaggaagggaagcccctggtgctgaatgtggtcaggcgcgctgagcagatgctgatcaacaacccgtaagtctgatttgaaaaccagatgatccgcatgatttcggacctgggaattttttttaggctggctgagtgtacagattccgtgttcaacttgcctctagatctaacctgtagataatacggtatactccacctagcttgcaggttatgtactttttttgcgaacgcttgcaggttatgtactaataatatattagtatttggcaccattcttgctttgaatcgtccggctgacttattttattctacgaaaataattgttgacctttggtcttttagtgacctttcctgctctacctacctgtttttataatatttcaggtcatttttttgctttgcttttgttatatactagcgtgtaggattgattgatgttgttgcagcgctgggtatccaactgggtttgccttatcagtgccacactgccactagtttgtttggcccattattaccacttagatatatatttttagtgaggggcacagtatgttaatttacgagtactgcaggtctgcagctttgtgtgtgtacacagtatacatttttttttatgtatagacaatttcttggatgggtttacaggaagaaaaaaccattgactattttttacagcaaacttatgatgatattcccagttgtattttacctgtgattatttgctttgactaggtcacgtgttaaggagtatttgccgatcactggactggccgatttcaataagctgagtgctaagcttatttttggtgctgacaggtgcgttcctgctctcaagaatatatatggtcatatggtttcctcatctgttacctttgaccaattgtaacaaacagtaaaattatctcactaagataacttcttcagatcctttgctacttttggcttattcttgtattaggtaattcacaaaactgattatactatttattggaacagtcctgccattcaagagaatagggtggctacagttcagtgcttgtcaggaactggttctttaagggtgggaggtgaatttcttgcaaggcattatcatgaagtaaggaatctgccttggctccttcatagatactgatatggttctacattacaatgcaaagtatgatcgctaaattataaacgtgttctccagcgcactatatacatcccacagccaacctgggggaatcaccccaaagtgttcactttagctggcctgactgttaggagttaccgctactatgatcctgcaacccgtggactggatttccaaggtaccaatttcaattttccatggaggaacttgttcttatgaagaagattaattgcaagattgtttgcacctgtctgacttgatcaaggatgtgttttcgtgttacagggctgttagaagatctcggttcagctccttcaggtgcaattgtactgcttcatgcttgtgcccacaaccctactggagtagacccaactttggaccagtgggaacagatcaggcagttgatgagatcaaaagcattgctgccattctttgatagcgcttatcaggtaaattattggcatccttaatacttatacttctagttcttaggaagcatgacattggttaatacttatacttctagttcttatacttaatacttatactaatttttctttctgtagccgtaaattccattggtttttgtccatacgacattttatttcaaaatagactttgacttcattattgtgcctgctatgctttatttgttcagggatttgcaagtggaagtcttgaccaagatgctcaatcagtgcgcatgtttgttgctgatggtggtgaattgctcatggctcagagctacgctaagaacatgggattgtatggagagcgtgtcggtgctttaagcatagtaagatatcttcactctaatatttgtcaagttcagctttgtggcttgcccatactttgttcgtagtcttgaccgaggttgctgtcatcttcatgctgttcatagtagcaactgatgtacctgtcatgcatggaaatttgtgtgtctattttatttcatctcacactggctattttactactagtaagagatataatcactatgagccatgatggctacaattcaagtattataattgtttttttgtcttgtctccaaaaaatattggagatgtttaatgaggttgagagtctttcaaggtgggaagttctaaacgaaagtaggacagtgaatttttattctttccagctccaaatatctctttcaattttgtcaatcacatgccaccgatgctttaattgttgaaattaaattttgattctaagttgatgccgacccagataataatatcctatttagttgcatagaaaaactgaacggaatgtaactttgtatttcaggtttgtggaagtgctgatgtagctgtcagggttgaaagtcaacttaagcttgtaattaggcctatgtattcaaaccctcctattcatggtgcatctatcgtggctaccatacttaaggacaggtaacattgatgtcataataattctagtcaaccatagaaagtgagctatatgttgagaaaggcatgcctagaggcagattcagggaataaaagtgtgtgctaagttctttttgattatatttttactagtgcaatgttcaatgaatggactgtggagctgaagggcatggctgataggattattagcatgaggcaacagctttttgatgctctgaaaacgagaggtaatagtttctgtcaactcctctatatcgtccttgctggaagtacataactaatgctatgtacaaagaaatttgatcattggccttttagtctttacgtttatttcaagttctgttttgacagcaattttgactaattctgtttatgtttagtctttacgtttatttgatctggaggcgttatttcccttttttctgtgaatgctacaattgaattttgactaatgtttcttactgtcaaagcagtaatgttgttttaaactagattttctttggctatgagaaaattttatattctatttttttcgagttgattaatcaagctcctgagacaagttccctgaattccaaatagtgcactaaaccaatagtatatttttaaagcatttatatgattctacttggcttgcacttataaccttaatgatagaaggacattgttttacatggaaaagctgcaatgcgtatttggctcgttgatctgggttttatgattgctcaatatttttgttttaaaaaggagtttttcttccctttttctgaatccattctctatggctaaaagtgaggtacattgtcagaaatattaatcattgttgacatgataacatcatgcagaaactcctggagactggagtcacatcattaagcagatcggaatgttcactttcactgggctcaacagtgatcaagtggctttcatgaggcaggaataccacatttacatgacatctgatgggtaattgtctaatttagctattgtgcaacactcgcaattatgtttgtatgatctaagtctgcagttatacaaactatataatttttagttctataacagtagatgatctatcttactgtttctatggtagtttcctttgctaaatgttcctttttagctcatctttacaagccaaatatttctcttgcaggaggatcagtatggctggtttgagcgggaggaccattccgcatcttgcagatgcaatccatgccgcagtcacaaaactgaagtgaatgatggtagcatagcagctccctccaagaataacatcttaaaaccatccgcagcagtgttctgaggattcagacagtgatgtttgctggctgagcacatcctggaagtttccttgtaatagactcgtgtgacttgcttttgggagcagttttgtaccagtggattcagaaaaagtggtgatttcgaatcacctaataagctccatcggtgatgcttttaccatatgcagcgttatataatcttagaattctaggaagctagtgcttgttttatgcgaacaaatgcgtaccttccgttcccttccattggcggacagggtatacgacatacgctgatacagagcatcagtgccattcagatgcattttttttttcgcggagttggtcacatgtggatttggtggaacctggtctgtgatgcacaagtaactcagtattgattactcctatttaagtcgggttatgtagggcacgccatgttctgccctttaatatgaaatgaaacatgcgttttgccctatatcaatatacacagggcaaagctcttgcctttgtttaaaaaaaggggaaaaataaagaaagaatgagggggtgtttagtttcagggctgtaaagctgtaaagttttgacgtgtcacatttaggtattatataggatatcgaaaggggtgttcgggtactaataaaagaactgttttaacgtgtcacattaggtattatatagggtgtcgaatgtggtgttcgggtactaataaaagaactaattacaatatccgtcagtaaaccgtgagacgaatttattaagcctaattaatctatcattagcacatgtttacggtagcaccacattgtcaagtcatggagcgattaagcttaaaagatttatctcgcagagtagttgcaacctgttcaaacctttgatgtgacatggtgtaaaattttaaggtgagatctaaacaggccatgaatgaaacatgcgttttgctgtggccacacttccagtcttctataccataccgttcattgttgaagactctggatctttactattaagaggaaactaaagagctactcccttcgtcccataatataagatattttagagggatgtgacacatactaatgctataaatctggacagacgagtaataagctaccactttcgtttagagggcctgcaaaagtgcaaattacttcgttaaagaaaaagagagatgcacatgtccactcgcgacggcctagaaactacaatgttaataataaagaaaagttaaagaaccaaatcaccttcacttccacatccagaagttaatcgtcttgatcagatcatggtggctccatatatcatgtagattaatagatataattgtatataaaaatatttctagaaatgggttcaaatatataactaaaacaggttatataagtaaacatttttgcgaggatatatagcatgtactcaaacttcagttcaaacagccttacaattgcgtaggaaatttaactagttttagttttaaactctgatgaatctctacatatttttaaacccgagcgtcgcaacagaaattatagagtttctaacatattaaatcaattaataaccgaataagtctaagtaatactatggttttttcttattgaacaggtaggtgaatcaaaaatttggtggagccaatagtaaaataggggagtaatttttgaaatgtgggttaatattatagatttgtggagcccaaatgttagtggcaagggtggtgtgggaatggataccatagctactaaaacttttaactatatattgagcaaatgtggtagtcctaacttttaatcaatatatctattatcccctactctatggctgataaaccacaaaaaatattgaagaaaacaacaaaataaattattagtaaaactgaacaaacttgtcttaggaatcttcctagataaaattcaaaccgaagaaatacccagagtaagacaaagccaagtttcgaggaacttttaacagctggagaggtactcccagaatctctagctctaaaggttgcgttcgaatgtggtgttggttagctatatgtgaaatgaggcaaatcatcattatcgcatgagtaattaaatattataaacttgaaaaataatttgtttttataagaatatatatagaaaacttttatagaaaaaatatattgtttagcagtttgagaatgcatgctccaaaaaaagaacgatgaagtagctaagtcaagtatttgattcaaatgaagcctaagtatctacttatagaaacttagtacccacaaactgaatagactctcaccatatacccagtgccgtcaggaggatgttgaattggggtatatttgttcaactctatgctgattaattttttcttgttctgtccctattaactcataaataaatgagttcctcttgaaaatatgtccccttaaaatgagtggatactagcaaatgtttgttccaactttttatggcgtgatttgattaatagcggaaagagattccacattccagcatattttaaatttttttatcggatccctggaaaaggttcccggcccaataccaacccgtttacactcctaagtcctactaagtcctaataaccgagtggtttcagatctcgtttacatggaaagttggttcctcctccagccaccagctcgatcctttcttcctcgttctcgcgatctgacctccccatctctcctcactcgatttcccggcggctagcgacgcgggaggaggcgcccggccggccggcgagcacgtgctgatagcggccgaggaggcgttgcggctggacgaagagcgccgcgtgcagcgaagcggcagtccggcgagcaggaggtggatctggacggcgtcgtcttcgcctgagccagcctcaccacgcgtcggcctcccgaggcggggagttcatccgcgcgaacggccccggtagcggggcgaggcgttccgaatctggcggcatcctcggaggcacacggcaacatctcggtctgcttgttcttcacgctgcgccacaagctcaactgcaatggccgccgccgcggcgtcaagctcgtcgccggagttctcgtagtagccgaggtgccttgctccttccatttcctccatctccgtcctgtcgttctccactgctctagctactagctagcaggatatactccacgaatcgcagaaatggtattcaatgccttgtaatcgttcagaaaactaaaaaaatattccgcaatcgcccacttcaaccccaaatcccctgttttccaatccccttcaccttttcgcttacaatccctataccgaactccatgctattttctgctccacccatgttgattggcacggtaaagcgcacagctcatatcaactttttttttttgttttctttcttgccggcatctcagatcaacatatcaacgtcctgaactgttctatttgtctgcaagtacctgccgagatgttatggttatttttccttggacagtatgatgcgcttttcaatttctcattcagtttttcttttcctgtttctccgattttcactcttcctgattttctatttaaacggtaggaaggtagctgtccttgcctgaaatagaaatgtttagtactgctcaccttttggcagtttctgcatcatgaaggtcattgaaatctggcatttaagttgtaatgctcatgcgtcgtgttgatcagtaaaaagtgttgctattctcaaagttctagtttgagtttatgaaaatttattctagaagttcaaattatggagggaatcttttgtttcttctgcagatactgattttcacggggatgcattaagctacggtctaacttgtgggagctggatactgctgaaaaggggaccaaatggagcttcagcaggaaagctcggatgcggggactttgttctcggcgccatcaaggaacctatcatcctcttcatcagcatttgtttctgctaaccaatcccctttcttcacgccacgatgtctatctgcccgtgtctcagatcacgcacatcctgagaacaatagttccttgagtggtactgtgctgaaaatcagtgatattctttccagcgacactctgttaaagcgggagcaattaccatcagccactgtggggttattgccatcggatgcttctcctcctcctagtatttgcacttcaagcaattttgacactccagcaattgtctataacaatcctagcttcatttccaccttcagtgacccatgtcaaggcagttcatcagcaactagcactggtgtccgttcaactcagaaggagaagcataagagacagtggggattatatcggaaatcttcatcctctcaacctacgacatcagctacctctgtcaacagacttcggagctttgatgtgtacataggatttcatggccgtaaggcttcactactgaggttcactaattggcttcgtgcagagcttgagatccatggaatcagctgctttgcttctgacaggtctagatgccggagttctcacagccatgatactattgagaggattatgaatgcttccacatatggagttgtcatccttacaagaaaatcatttggcaatccttataccatcgaggagctgaggaacttctttggcaagaaaaatctgatccctatattctttgacttgggtgctgctgattgccttgccagagatattattgagaagagaggagaactgtgggagagacatggcggcgagctttggatgttatatggtggaatggaacaggaatggagggaatcagttgatgctctttctcgggtgtcagatgtgcaattagaagcaaatgatggcaattggagacattgcatacttcaaactatcattgttttggccacaaaattgggcaggagaagtgtggttgatcgggtgaataggtggagaggaagggtggagaaggaggaattccctttccctcgtaatgctgattttgttggtaggaaaaaagagctctcagagttggaactcattttatttggagatgtcagcggagatggggaaagagagtattttgagatcaagacaaagcagagaagaaagggcctcgtaattggacggtctgttaacaattatgagcaagtaaatactgatgatggtaaaggaaaggagccggttttgtggaaggaaaccaaggaaaacattgagatgcagagactggggagtccaccacgacatggaaggccatcgagaacaaagaatgatggcaggtatgggaggaaaagaagatgtaggaagatactctacggaaagggtattgcttgcatttcaggggaatctggaattggcaagacagacttggttttggagtatgcatacaggttctcccagagatataagatggtcttatgggtcagaggggaaagcaggtacattcgacaaaactacttagctttgcggacttttctggaagtagatttaagtgttgatagtcacttgcatgagaaaggaagtgaccgatgctttgaagagcaggaagaggaagccattgccaaaatacggcaagagctgatgcgggacataccgtttttagtaatcattgataatcttgagagtgagaaagactggtgggataagagagtcataacagaccttcttccacattttggtggagagacccacttcatcataacaacacgccttccacgtgtgatgaacttggagccaatgaagctttcttatttgtctggtgccgaggcaatgtctttgatgaagggaggcgtcaaggattatccactggtggaaattgatgcactaaaggccattgaagaaaagcttggaagactcactcttggccttggtattgtgggatctatactctcagagcttccaatcactccgagcaggcttcttgatacgttgagtcggacactgcccataagagattgttcttggaatgagagagatgctatcagtttgaaaaatcatgaaatccttgtccggctcctggatgtctgcctatcaatatttgaccatgccgatggtcctaggagtctggcaacccggatggttcaagtgtgtggttggtttgcaccttctgcggtcccaatacatatgttggcgttggctgcacataaagtcccaaagaagcatcggaggggtccaaggtggaggaagtggtggcgaacgctgacttgtggcttggctacatctaggatgaagagatctgaagctgaagcagctgcaatgctgatgaggtttggaattgccagatgcagcacaaagcctgaatatgtacagttccatgatctgatcaggctatatgctcgaaagcgaggaggcacacgaatggcacaagctgtggtccaatcgatctacctccgaggctcaattaaacattcttctgaacatctgtgggctgcctgcttcatgttttttggatttggttctgatcctttcctggtagaaccgaggccatcagagttgattttctttgtgaagcagatcgtcgtgccacttgcaatcaacacattcatcacatattcccgatgtaatgcagcactggagctgctgcgtctatgcactgaggcattggagcgggcagctgactcaatgctttctcatgctggcaaatggagagaaacaccattgtcctgtttcaggccaactcagtcagaagcccaatacacctacctttggcaggagctggctcttctgaaagcatctgtattggaaacacgggccaagctgatgcttcgaggtggacagtatgacactggagatgacctaataaggaaggccatattcatcctgacttccatttgtggcgagcaccatcctaacacggtttctgctcgagaaaccctcagtaaactcacaaggcttcttacaaatgttcagcttagttgattcatatagcttaggacttcaccaatatattcttttcagtgtggcttttcataaacactgtacaaaatgccccagatcatcaaataacaaaagaaaatttgtctacacaatttgcacaggtttgcttctttggttaaagcactctcttgttactttcacctttgtgatgtgatcctagtcttaacacgcacaaggtttcaggcatcttcctctggtgttgatcttagtaattaataactggcaaacatatacatttctctccttttcatttctcatcttattggtcattttattttgggatgtcttccccctggctcaactgttctttttattagtcattctattaaaagtatcagctcaggtagttctgaagtgacctagtcagatgcctgaattgtatatctcaattgtgtcaagatgaataaaaagaggaatattctatcaggcaaaagaaactagtcgtctccagcagccactgatccctacagttttagtctctagctagaggtgatttcttctatcatataattagagatgtttcacgatgttggatgggagtcttgcattatggtaactgccagatgaaagttggtgaacaattatttatttctgtcagctccaaagatcatagtacaaattaacaaccatgtgatgctgatacttcgatgttgaagtaaggtaatgttctacattgattcccattcaatttaattgtttgtagcgatttatttttgataaaaagatacgaggtaataggcatttgcattgagaaactaaaactgcaattttgtgcttattaagggggctgcagga

SEQ ID NO: 52099 - DNA, 6661 bp, Oryza sativa
  unsure (1)..(6661): unsure at all n locations
aggcattcaacgaatggaccgtggagctgtagtcatagcttttggagaatggaagtataagttctggtctcttcttgcagccttgcacagaaccatatttgtggacaccaagatctgaggcaacagctatacgcagaaaaccatggttgaagtttcaaccaactctatttcgttctttatggcaatttaattaaagttatatgtaaacttggtaaggcttgatcattgcccttttagtctatgcttttttctcaagatcttttattacaactttgagttgcttgccccattttctagaatttatacaactgctgtgaactaatggttcttcagcaactgggttgacagattttacatcaatttttttgaacgggaaaactcagagcagttctggcctattgatatgttattttatgattattaattctaccttttctattttttttccagtgctttttaatcctgccgccaatgttctgaacattaccttgttagcttcatgaagaaacacctggaattggagccacactattaagcaaattggaatgtttactttcactggactcagcagtgatcaaacgacctccatgaggcaggaatgcctcatctacatggcatctaatgggtaagtcgatctacttcaggaattttatgttgctatcataaaaaccattgggcgtgtcaagtttacggttgcacagtatataatataaagcgacctgagtgaaatatgtcagcggtccttaaaacttgtaagcaggtgccttttagatccacaaacttgtataaagcaaatctaggtccctgaatttgcttaagtatgctgtctcgatccaaaatcactatatacctttctagtgctgatgtggatgttgaggtgacacactatgcatgtgatgtggcacataaataagaaaaaagaataaaaatggtgagacgggagaggtgcgtaaggcgttaggtacatcagtgccacatagtctcctagtcctagaaggacacatggcaggcagctctggacttatatgctattggagtactgtaataagtgggatttggatctgtcttttacaagttcgtgaacctaaataattatctatttacaagtttaaagactactggtgtattttactctataatataacactctccgttccataatacttcctccatttctaaatatttgacaccgttgactttttagcacatgttttaccgttcgtcttatctaaaaacttttatgaaatatgtaaaactatatgtatacataaaaatatatttaacaatgaaccaaatgataggaaaataattaataattacttaattttttttgaataagacgaacggtcaaacatatttaaaaaagtcaacggcgtcaaatatttagaaacggagggagtacttggtaattttgacttggcattgttttagcttgaccactaatattttatagataaacctacaagagtattgaaaaatagaacatattattgaagtatgatcacagtaaatatgaacatataaatcccgttcatcgtagttaaacaatttgaaagatatcaatgctcaaactagagcaagtgccaatcaaaattgccaaatactccctccatttcaaaatatttgacaccgttgacttttaagcacatgtttgaccgttcgtcttattcaaaaacttttatgaaatatgtaaaattatatgcctacataaaaatatatttaacaatgaatcaaatgataggaaaagaatgaataagacgaacggttaaacatgtgctaaaaagtcaacggcgcgaaacatttcgaaacggaggtagtattatgaattggtgtttgtgttcgttctgtgttcttgccctcggattacgatttctgttgcatccaggaaatgttatatcttaagtttttcggttgttgacacatctggggattgtccttttcttgcacacctgcatgaacgtcagtagatgtctctgtcgtatacattggtcaacccctcaaccccttgaaatggtacagaagattctcagctctacaaacccagaagccgaaaacggcgggctactcaagcgagagcccagtttgatcaaaatatatatgtacactatgtgataatacatgcaaaatatcgtgccactttttaatggcgacctggtgggcttctatgcgccccgaacaggttgtccatgtacgtctgcttcaggttcgtcatgatgttgggcagcttcatcagccttccgtcctcctgtgcggccggctcaggcgccgtcggcgagggcctatcggcgtcaccgttccagtcatccatgaagtcgagcgcgtcctgccgttgggtgaccctgtcattttgcagggggcatccacctcgccagcctgctggtggtggtgctccgcggcgtcgttggccatagccggcgccggcggcgcctccttcttggccttctccctggcgtggtcgtcggcgttgaggacgtcctctatccgggacatgacgttgaaggccaagctctccagcaccctggagtagctctccaggatggcgaacccgacgtcctggcagcccaaaggcgaaaagtgcgtgtgtcatcaagctggacactaccccgacattggtcggacggctcacactggagtaaaatcgtgtgtgatcttaccctgttttcctgtatcttggcgatgtcgagggtggactgggggatgccggggtaccggtgcttgatgatgagcaggagcgtctgcgcgcgctcctcgaactgctccctcttctcctggctgacggccgatccccacgccgacttgccgtccttgttgtgcaccttcctgttccagatgatcaccgacgcctcgatccggtccttgaggtccaggatcttgtgctccgacgtaaggtccaccgtcgacaggaacacgtccgggtcgaactccacgtcggtgatgatccggtacagcgcgtcgccgaggctcgccctcccgttctgcagccacccacattcttgccattgtcaacagatgtcttcttgcacggtggatggatggatggatcgtgtgagctgccagttctcaccttggggagggattcgaggtaggattccgggatggccatctccatgaggcagttggcgttgatggccatggccgccttgagcacctggttcaccagctccttctggtgctggagccaccctctggacgccggcgagagcccgccaggcgggaccttcacgatcgggatccaccatttctcgtctgatctctgctcgtcgctatccgagcacgagtcgcgcttcacgtaccagaactcgttccgatccttgaagttgtccaggtaatcctgccacgcaacgcaatgggggaatatcacgctgttcgtctcggtagctttgcgagttctagcgatggtgagatcgatgtatgtcgcgcttttaccaggagcatcgtgtcgatcttgcgcaacgccggtatgttcgcctggagatctctccgctgctgcgtgcccatcacctgagacgagcagagagagaaagatagcaggttacttgatggagctgcacacctgtgacttgtgtgagctgtgatctatcctgagctacaagcggctgccgctgctgcatggctgacctccatctcaacgccgttgtccaagacttgtttcttcgcgacgaactcgacgatgtgatcggcgacggatagaagccagccgacctctttcttccacctccccttcctgtccggcgccatgggctccagcttccgttgctcaccaaacacagaagctgatgacaaaagaagttgctctcaccactgctacatttcttgcgtgtgcccccccaagatagagatggaatttgggcaggcagtcaccttacctgcaagattggtgatggcgttggacacggccagcgccgacggcacgcccttcccggaccccgacatgtcctccccgagcagcagcttggcgaacttctccttcatcagctccatctctgcacgcaagcgtctagcgtcgcttcaaaaccaaagccgttctgtccatgcgcggcggcgggccgtgttcgatcatggcgacgacttaccggaaggtcctccgccgccgtgttcgccggtgtccttggcgagccgcgacttgggcgccgcgctgtccttgtcgagcacggcgccaatcttgagcgtgccgccgccgccgagatcctcatcggccggcgtgccccggccctcctcgctcaccatactctgcgaccgtcgcaccgagcttcgtctctctagcagcgacccaccgccgctcgctgccatcaaccgatcaactccaccgtggccagcttctcggcaaccaaccaaacagcaacaacaacaacggcaacaaagaaatggatccggtgacacgacacgtcgaaaagactggaaatcccaccatgatactacccaaagtgtatatacctgtaaaggacgcagctttctgcggcctcgagcgacgtgtgcagaagcaaacgatgatgatccaggattggcgctgcagaacacccacgcagagagagccacgagaaggaacaaaaaggggagggttgaaatgattaatcccgaggtgatgatgattgttgtttgtcccggtaatccaagaaccgggtggttcgatcgatcgtccgcattgtcgcggtaagaagaagccccggggaagagggggagcataattagggagcggcacatgctttattattagaaagtgccttgcctgccatagcgccattcttagccaccctgctttcctgggagctacctagctggaggaagaagacgaacacaacacatggagaattcgtcggggtcaatttactgaacaaagtttgttgtcctacttaaatagttaaatacttcaagcatgttcggtagacttatgttccacctcttatagaactgaagtcaactaaacagttttagcttcatccttttattacgtgaaatttgtcacgacacatgaagacctgagagatctgaataaatccagtgcaggtcctatcaatcgggttcaggacgtgtcaattcgtttaatcatgcaactaacaagataaatagacagatcgtatcggatcaaggagctgatcagccaatgggctgatgtgaagtcgagtgaccagccaatatcgataaggtttagatcaacggttatgggttcgatatagattcaaatatcagataaacaatgggattcttgctatcatcggctagaactaaacttcacataattatcaataaaccattctttgtcaaatacaatcttgatagatcggatcgaaccgagacaatataagattgaagttaataaagagagatttaactagtgagtatacgagtttgagtataagccaatacatcacttagaaatagtagcaagataactcatcacctagaactccgatgaaacgttgcataaaaacctatcggtttactagaatcagacttactagcaataatctaatagatcggagctgaccgaaacagtataagattgaagataataagaaaaccctatttagccgatagatctacaaaaccgtgatggatatattgaatcaatctaaaacaacaatgtgattggagaaatattaacttaattagaatatcggacctaactgagaaagatctaactaagccaatacgactctaaacaacggtacagttaaaaataggatcgatatatcagataggcaactgtcgaggggtgaccctctctagcgggaggctgtgaggcccccctttgagagttcggccgggggcagcgggtgagattcgaggatttggtgagcgaaactgtgtgtgatcttgatctcggaggctcctccaagacgatgagacaaaagaggtttatacaggttcgggccgctatgaagcataataccctactcctgtgtgtatgattcttctgtgcttagaaagtccatgaatccctggtatgtaagctagggttagacaagctttggctcagggatcctcagtccgatcccccttccttgctaggcattgtcctccttttatactctaaggggataccacatgtgctgcgagtgctacctagggagaagggaaaatattctctaaattaattacatgtcttgtgccttagcccagaatctatctgcacgtcggttgctgcgcggggcccatcaaatcatgcagggcgcccttgtcattcgccatttaatggatgaggacttccgggttctcgttcacaccagaaaacgggaacccgggtcagttcagagtggttggaccagctctgatcggggtaagaggctgtgaagcccctcatcattatgatgggacgggacggagcacgccgctcatcgcctgacacactggcagggcaggggtacacagtcgccgtcacatcggtcattcaaccggtcacagaccggtcagatgcgcagcacgttgcattacatgtggcatggcacggttgcatagaccgctttaaatgcagttaggtgggcgttaggcgcgcccacctaaccctgtacacgtgggctgatatgtggagggggtcggggcanctcgaccccaagcgagggcggcctcctccctctagcttggaggtggcagccgtcacgccaccccgggctcgacccctctcgggggaagccacgtgggtttggaggcggcccaaccccaa

SEQ ID NO: 52100 - DNA, 1760 bp, Oryza sativa
  unsure (1)..(1760): unsure at all n locations
gtgggtttaagggcggcttcctccctctagttgggagggggtaaccaccgctccaccccgggcttgatcccctctcgcggggagccacgtgggttggggggttgcccgaccccaagctaggagggggcagccgccgcaacaccccgggctcgacccccctcggggagagccacgtgggtttgagggcggcctcctccctctagctgggagggggttgccaccgctccaccccgggtttgatcccccctcgtggggagccacgtgggtttgagggtggcctcctccctctagacgtgatacccctgggcccatatcaccgacagcaacgcttgcttcaacttgaatataatattgaacttaactgggaagttctagccacaacgatacaaagcttgacaaaacttacttttcgctggagatcaaacttaaccgattcagccctgctcgaaagtaagaactcgccggaataaaaggcggcgatgcgctgaaggtaattgtattgatatgtgaagatgtcttacaaagatctcaggtgtacatatttataccctcggattgatacaagttctaattgaatacgatactaagacttcctaataaatgaaactgtcttgtcatggtcttcacaatttctctttaaattcagcttgatctggataaactttcttctaccaattggcttattttctttaaccgagtccactggtgaatcataccaaaatttaacgttaacgtctttatagtggagctggatagaatgatctgaagatgaggtggaattgttgagacgcttcacaactctactccgctccagacttggttactggatttagacctctgggttgatatcgctctcattatgtatcatgaaatctgttgcgaggtttggggttgctagtgtgtatagaacgtacaaaaaattatttagacgaacatgtgcagaaaccgaccttagctcagttggtagagcggaggactgtagtatgtgcagattaatccttaggtcgctggttcgaatccggcaggtcggaattatttttttttctttttttttctttttagtccttccaagtgaaacctaagttcccctcttctctgttgtcttcaatttgagatgtgttattattattatttttcctgagacctttatttttcctattctttttggaggaggagaacaatgacttcgatgagagttacgatttgaactcgtcctagcgcatgttgctaaaaaaagctttaaagacgcgaatttgattccagcaactccagcaattcgtataccgattctgaataaactcgagccctgttgctctcgatccaattatgtactacaagggaaaccaagtcattctagaaaaacattacacaacaccaagtggaatcgcatgtttgaccagcaattccaatcttttgcacaccctacttccaattttctactgtgctatcgtgcgagtacaattcacgctccatgtatcgtgccagccgacgccgcctcgtcgtcgtcatcaaaaaccgggagagtaaacttgtagcgcccgctggttattctgattgattattccgaatcagatgcatgttagcttctcgactcgtggatgtcgctttcagctcatctgctacgatgctgcgcctttgaagacgaggaacctgagcgcccccagcttgaagtagatgnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 52101 - DNA, 1125 bp, Oryza sativa
cgatggtgagaggtttttaaccattctattccccatggtgagtagatattaaccatccccgtcacctaataggtgaattcaccacggggaaacggtgaacgggtccccattgccatctctaattgcaactccagttcaaaattttggacccccggggggggcaagtgattattttggctaaaattttcggtttttctcgatttttttaatttgatcaaaatttagtcaaattcagtaaaattaggctaaaatttcaaaaaaatctgtccaaaaagtgttgaaaatcctgaaattttcggtagaaacgaaatgagcgaaatttcggacatactagcttgctaagatactatgccacaaaagttataaggtttattatggttgaaacagtggtgttttagcaaactatgaattcatttgtatggaactccagtaacatacataccctcttttgagcattccatagaattcctttcacacacatgtgcagcttgactagtaacgtgtacaactccgtattaattgcacactgaacattgtggaatactccactatatttcatcaggacaaaggtgtgtataatactgttttgttatcacaaaacaaagaaaatttaatacctaattaaaaagtcctatcttgttaatttacatgatcttttgattcccataaacacgtacggatcataacccccaaaattatccaaattatcccaagaacaaaagctgcacaaacaagatcaaatatatcacatcacaaatccataaataattaaaaacgagctgacaaattcccagaagcaatttttccttgccaaaaaaaatcactccgaccatcatcagctcagagtgcaagcaacgctcccatcagcagcagcgccgccatcgtcgccgcggcggccgggacgacggcggcggcggcgccgccgctcggcgacgagcccggcggcggcgaggtccccggcgcggagctcttgatcgggcacgcgtagccgcactccgccgggtcgaccacccggtagacgcccttgctggtgagcaggtagacgtcgccggcgttgtcctcgccgaaggagaagatgtagcccagcgacggcaggtgctcctcgccgcggcggcgtcgcagggg

SEQ ID NO: 52102 - DNA, 1793 bp, Oryza sativa
aaaactatcattttacgttgtttctctctcatcaattgaccgagtattatattttaatgtgtccagtgttctgcagcaaattatcacatttttggagtgtctttgggcaaattcacgtctttagggtgttccagctaattacacattttttttgagtgtcctgtagcaaattttaccaacttatatatacatcatctgtgccataaaaaatcaatatgtgtagattcattatactaaaatgtgttaaattacatatactgtgccataaaaaactaacatgtcaagattcgttatagaatgtgtcacgtccgatcctaagttgttattttgggacgaagggagtacatcacagtaatgtataaaatttactgcaagtaccgtgtatgacatgactttagatgagatgtttgatattttaacatttcataaagcgggtttcgattatttaacatagtaggcatagataaaaggagacaatctaaattgataaatcctgacggatttaattagtatatatttgtataagttcatctcatagtgttatatgtatttttctttaatttttccctctcatacatgctagcttttcctttcactaaaaacaaaaggaaaagagggataacctaatatttcctcagattatttcttccttggaggagactgttaatttctaccgcctcagttaattgctctcaacttggagcttaactctgagcatatgttgaggtattgaagctgtgggccagaaagcctcttcagatccatcaggtaattcccttccccttctgacttgtacagctacaataagcacaagaggtaaaatttttatcatgggtaaaaaaaaattaaaggaacggttaaacacatgtttttttttgcaagtattaagatttggagggagtaataattgtcaaggggagaaacactatcagtctcattgtttggcttattcgaggaacaagccaaatgatatatttaaaaatgaaaaatatttttttaataaagttcttatatacatgttcttaacgatataaatgaaaagactaaaaaataaactacgatgaaaaactttaaaatcacctctaaatttaaagttaaatatttaaactttaactgataaatataaatataagcgaaaagatgaggttacgagagtgtatgaatgatgcgcttgaggagaatacctgaatttcaaagaacacagccgcagacaagctctcgaggacagcatcatcgacgggagctccaccgccatggccagcctcacctctgccactgccaccaccggcggaggaggaagaggagggcgcgtcgtcggtggcggcgaggtagctgcggatgatgcggcggacgccggcggcgccggcgaagcgtgcgcagagcagcttgccgtagcggccgcggtcgtcgtcgtcgtgcgcgtagacgacgccggtctcgcgcagcgccgccgcgatggcgcgcatcgcctcgcgggggcactcgtggaactccacccctcccagcgcccatccgttgttgcgtccgtcgtcttctccggcgacggcgaccggcggctctccggcagcactgctgccagttgcttctgctgctccctgtccagagcaaataggtgtatgatggtgttgaatcagttgatccaatacagtgttagattttttaaaaaaaaggaaaatccactttgtttagtacaaagaaatttcttgatcattattgtgcaaataaaacatttttgtctataaacattactccaggttgattatacttattgttttggataagagtattgtcaa

SEQ ID NO: 52103 - DNA, 1050 bp, Oryza sativa
actgcttaaaagatagtatttgaactgaacaaaaaactattttttttgtgtgaaattcactgttaaatggacctcatcattgcaactaggttctgacttgctgacatctctcctgcacacaacggtccatttccctgcatttcttctccaacttttgtctctaaattcatcccatccaatcgcaattactggcaactgttcagatcaacatgttcacaggatcaatgcaattcctgttgcgatgcaatgccgcaattactgaacacatttagatcaccatcagtggtctgctgtactaatactgaacctgggtatccggcaaccggtgaacatacaggccggcgtcagttactggaccactggctctcctctgagcagcagttactaaggatgcagatatcagtagcatccatccatccatctattgctgcaggaactgatactttctggcttagctagcattagcaattggaatagtagggaccagatttggtagtaacagtagttaggagatttggtaataacaatggtttgatatgcagtaatttgttttgttgcttgctctcgtactttctaatggattctgtcattctggggtgtaatgtaatggaaatgcgtttcttgttttgtgaaggatccagtggtgagcaggattgaaaaaagaattgcagcatggacctttcttcctgaaggtaactcttctgggcttcctcagattgtctcattgtttggttctattgattgttcaagtagcaaggttttccaagttaatgttactgctattttttttcatcagaaaatgctgagaacattcagatactccgatacgagcatgggcagaagtatgagccgcactttgattatttccatgacaaggtcaatcaagcactgggaggccaccgttacgcgacggtgctcatgtatttgtccactgtcgagaagggaggcgagactgtgttccccaatgctgaggtaaatttcaaatatcacgtccttcacttttccaaatccaaatgatgtatgagtttttgtaacattgctggtgctaat

SEQ ID NO: 52104 - DNA, 1513 bp, Oryza sativa
ctggatctggacaaggaatacggaatgaagagatggtgtacccgccgagatagaatttcttgacttcaatccaaattctcgattacagcaagacatgagacttagtcgtacactctgtactttcttggttgacatcagagattgactcagacaaaccctttaggtacccgcacgaggctgacaaaggaagtctaacgttatctctgaactcaccgagaacggtcacatgagctagataacagttactccaaggtctgcgcgtggttgagaatatgaattcgttcatttgcattgaagtcgggggttactgtcagggttatggatacaaaatacctaatagtagttgactacatctcggcaggacccaccacataccatgtcctatacggaaacaaccttcggatataggaggagttatgataaggaaagacaaccagagttcttcatggaaacgacaaggactattcggattgtatccatattggtttccctagttctacttggacaaggggacacctatgggtataaatacaagaccccctaggaggggaagagggcggacacctaccagggagaaccaacacaatcaacacggtcaccacgatcgagacccaccacgagacaatcaactcccaacacaatcaacatagaagcctacatacgccaagacaagccgccggatatcgacatcagagatacgcctagatcgaccctatccggtaccttcagaggccggccgtagggatctagcactatctctgattccgtcgggcgcgagcttgaggaggaaggctaccctgttgtcgactacgagtcagaccttcagaccgccatgtcgacaacagttagatagactaccccacatattatactggtgtgattatggtgaataaaaagcaacatcggctccggccaacaggatgtagcgctattacctgattgctcaggggcccaaacctgtataaaaatccctgtctccatctcttttacctcagtctcgcgtataccctagcaccgacgatccccatactgtccaaataccgtagtcgagacatcaaacgtcaacaggcgcagattggacggaaccctaatgacgatggcattttttggacacacacttgtcaatagcatttcttggattttgacatttgtcaattgcatttcttggattatcacatttaattaagtttgaccaggaaaaaaatcaaagtgacatagagtattatattttaggatggacgtagcattaatctatcttactaatgattttttggacgacaataatccatctccgaggtatgtgacctggtgccagtcagccggtttagcttaatatgttcagcccccacctcctccccacccacacaaacttttctattttattgttggatccgcctctgtagctactgaagtgtaacagcagcagcactaggccaggatgccactgaacagctgcagcgccggtggcagtgtcgatgtaatatgtgttcccttcgtcttgaaaaaacaacat

SEQ ID NO: 52105 - DNA, 2943 bp, Oryza sativa
ttcgcgtgccagagaagatcagcacatgcaaaagagtgctggccatagaagagcgcctggtacgccgaacgcaccgagtagcattggtcactcgtccagcgctaaacaagacgatcaccgacacccggcgaaagctgaatgtgaagccccgcatcctaaacaaggagaaactgggagatgattgggacattgagggcgccgcggatgtcagaaatccaggaattgtttgcaggccagaagcaattgtgcgcgaacctttaagccgcaggggcccagcgaagacatgtcaaacactcataacttatacttataccatggcccacatgtcagtcgcagttctgccaatcaccaccaccattatagattttaggttccattaatagagcgtatttaggggaaaaaaacatgctccatctgaaactgaaaatggataggtatgctctgctgaagaacatcaggacttcactgccagaaaatttgatctctcgtgtgtgaattaagtcaactaggaaggtggcccgcgcgcatgcgtgggcacttatattattgaaagataagattattgttgttcaaaaattttgtctcatagattaagggcaaactaaagctcggataatgtcattttatgattatttaagggttctatttttcttaatgtatcttaaaaaaccattcacaaactttgagtaggagatgaattaagtacttacgacttttgaatcatttttttctcgagtaaataataaactattgctagttaaatatcatacaggccattcatatacatatcgtgttgtatggccacaaatgaaaaatacgagagcaagatactcaaaattcttgtgataaattgtctcatgaaggcgcatgatatagtaggaaaggggggaggggagtgtatgcatagaaagaaaaagaaagggaaaaatgaaaaaagggatggaaagcgtacgtacccatgtacgtaggtgcgtacctatgccaggggatgagaggtgggaccttgcagtatttagtttgctctaagatcaatttaatataacggtttataatattgggcgtaccgatttaaccgaaaatcaagtaatggatactttgcttttctttccatagaatttctaatatttcctctaatttattagagcaccacgtgacagcttgagagcactttaagaaattttaaaggacttaacacatgtaattagaatattaaccgcttaatatatatgtatggggcatatggtaatatttgttctagcttcgtgcatgtttatatacatgtcgagagaaattaattatgtggctagcaagccattagatgtctaattagtagcaattaattttgacaccaatttacagatgttgatagtagtttgtacatattcatcttacgactttgattatccgttgatccctaatttaatgatcaccatgactcgcatgaaaaaaatatatactacttagggtttaggacagctgaaattgatgaattatcttatttatgtgatagctatttgagggtatacatgaatgaattgacttctaaaaagttaaaatgttgtttaaaaatgacaccgtttagaaacttggaaagcgtgcaaacgaaaatccaactatagaatcaaggaaaaaaagagggtcttaaacttccttatagcactcttgtctttgtaagagttctattgatattcgttaatattttgctcatattataacataatgatttcttttacgtataccaacaaatagtacaaaatccaaatatgacataacacaatacattataattattatgtaattaactttcgattccaacttaaatagagctacaaatagtacaaaatccaaacacgacataacacaatacattataattattctgtaattaactctcgatttcaacttaaatagagctaagtgttagaaaaaacgcaacccatattgcttaattctgctcttgctgcatcacacctctaattttcttttcatgttattaataaattaatcttctccatgtatgaatttatatgtggcaaaacgttagtgctgcggcagtcataatcaccttagatgcctcagacacgatgctttgtcacgcgtgcaaaaggtaaaggtgcagacgtgcattgtgtagcgggccaaaaagagaacttcggacgctttatttattagcaaataatatatcagatgatttaaatgatgagtccaccggttctttataagtgtacattagttattatagattttaaatttttaatttaatgggtacacaatataatgatgtagactttagtgcattatttgagaataatagtccaatgtaataaaaaatagttccgatgatttaaataatgggtccatcggtttaagtgcacatataaattagttaatatagattaaaattgtttatttgataggtacacaatataattgtgtaaactttattttaaaatagtgtattatgtgaaaataatagtacaaaataatgagtacacatgtttatgtagaaaatatataacattattaatttaatggtaacatataatggtgtaaattttattttcaaaaattgtagagctaatttagttacctgtgagcattctttgttggtgaaattatgattttatatatatatatatatatatatatatctattatataaatggggaaaataagaaaaaaggaaaaaaaagaagggaaggaagcatacataccatggtacatacgtatacccacacatgtgcgggagaaggaggagaggtgggaccctatagtacttggtttgttttaagatcaatttcatctaacggtgtgtaatataggacccaccaatttaagtgtaaaatcaaggggtagatgtttttcttttttcttagaatttttatgattttctctaatatatcagagcgccacgtgatggtttgagagtgtttatagaaagtt

SEQ ID NO: 52106 - DNA, 8607 bp, Oryza sativa
agatgcaagggaccaaataaatcatctactgtaatcctgattccatatttcaacagcagataactatcgatctctgctagcccttgatttagaaacagggaattgtgtgaaaaattgctgtgactatcaggcatcactcaaaagatttttcttcaaacattgtttagtgttatctctcaaagcaatgtaatttaaatctatttgtctctgtaatacctgtctgaagctttgagcaaatacccaaattccgccatcgctgcttctcagcaaatctccaattatctttccctccctgtaataaaatgtagataaacaaatttttctcagagaaatttgtgcttgaagtgtgagataatcccagaataagaggaataaatcgctgtcctgttgcttctacattccaggtacaccgtcgaatgcgatggtgcgtctcatcacttgataaaatcgccattcaacaaaaacacactgctgcagtgcaggtttcagacatcagcgataaacagatgaggtgatggtgtgttctgaattctgatgcgatcatggcattcgtacggagatgggtacagttcttacctggctttggcttgctacggtgctgtacttccgggtgctaggcgacgcaagggcggagcggcggatgtgctcgaagagagaatccatggcgcttttgggcttcggctgcggctggccatctcctatcccagtgaacgagaaagctggcaaaggtatgatctgctgatccttccgtctcggagaaaatccagtttaaattcatcgagaaaatatggcgaatccgatttaagtctcggagaaaatccccgtgttactaaggctgtgtttagatccaggggtaaaaagttttagcgggtcacataggatatacggacacacatttgaagtattacacgtagactaacaaattacagattctgtctgtaaactgcgagacgaatttattaagactaattaatccgtcattagcaaaagtttactatagcaccacattgtcagatcatggagcaattagacttaaaagattcgtctcgcaaattagtcgcaatctgtgcaattagttattttttaagcctatatttaatacttcatacaggtgttcaaacgtttaagggtgggatctaaacatggcctaaggatatgtgattggattcatgtgcacaaatcattgctgctagaccattcgtaaatattgatcaattggatccgaccaatcgtactagagaaatgtaagaagcaaagtcattgggaacccaagcattgtattgatctttttttcctttaatctgatttacgaatgttgcaatgaatatggccgttggtaacttgaaactccctccgtttttaaatgtatgtgacacccattgattttttttgcttaaactcaaacgaattaaaaagtaacatcgtcatacgtttgaaaccggagatagtgttattataacttatggggagatagatttcgatcatttttaaatgttaccataagctcatacaggtcataattgttataacttattaactacttcttcctttgatgaattttcttcagaaatgatatcaggatctcccgtgctgcatgatccttctgagcttcgatagaggtgaccaggtggttgtagcatcgacgttcgaactcggagaagatatcctggggaggacagaactcacagtcagccaaatcaatggcccatatctacattactacagcaagcaatgtgaaatgagctaaagaaaaggtaacatcacgggcatactttcaaatcaagcgccgcgtaagtcctctttacttcggaaacagaacttgaatccttcttgccatagttcctctgtgaattgcgcaggaggttattatttctgttcatgtccatactttttcagatagaacaagatggtaacttacatgtagtacttctatttgattgttgtcagcatgaccaagagcctgtactattaacccaggaacacttatgatcttcgatgtcagtttcaatcttcaatgtagaataatgtcagctgtcagttgttctcttagttgctgaaaactattttgatctttgtccttaccttgcctatggtgttagggtcagcaaaacagtccaagtagtcatcctgaaaaggcaaagtaaaggtaaaattgactttaaggtttcattaaagaaaaaaaagcatgccatatacctgtatctgaaaatatatgcccatttcaataagtatatcctttagaccactgagtcttcaagttttgcgccagataagagcaaagcatggccacctatagttgtagaggaaaatgtgaacatcataatgcactaattgaagatacatagattaccaaccaatgtactgcacgccacaattatcatctgaagaacgtaatttctgtctgaaaaagattcatgtagcaactgaggacaggtatgatcagaatttaggatagcctacttcattcttcctcaacatgtttttcctgcaccttttttcaagagtttgccgcaaagaaacccctctatttatctgattcatatgatatcgtgaacttgaagaacttgtacagttctacagcctatattcagatacatgacgttatgacaagtgaaaagtaggactgcatctgagtttcggtcttccagacttacaggaaggtaaaaggagtagtacgctgtcttgtacttaacaatgcgacggtagctacatgacaagagaaaagatagttattgaatacgagcaacatcccaatattatcataagcaaatcaaatattaaataaaagagagggagaggtagatggatctagattatgtacccttcaatactgtattttgcaagatcatctgctccagtatgtgtgctaataagatcaagcatctgccccagagaagtctgcagagctatctgaacaaaatatccattctaaacagtatcaaccaccatcagaaattatgataattgatgtttcagtagtaattcagatgtttgctgacctcgctccatatttctaagatatcaagaaagtaaggcttttctctgaaatacttttttatcattatcaagatgtgacattttagtatgataccatcgtttatacccctgaggccaacctgtaacagaaatataggtggaagaactaagtggcctgttttgttacagcttattaagagaatcagagtatcatgtgaagatgggttgaagaacctcaggtcgccggtaccagcaaatctgatctctcctggtatgtgaatcgtccatgatgtcatcaagtagtagtgcacatgcttgaaactacatgcatttttgatagaaccaaagataattgaaacctgttagtatcggcatgagcagattcaggaataaaaggatgatgagcagatggattgagcaacattacccattctacacaccaaccaagcacacaagcaaggaagaagtcatcttcagtaacctcacttccttgtttcaacagcaggtaactgtctatcactgacagccctcggttcaactttcctttagagaaacagaagattgcattgaaaattttgtgacttgagagttgagacacttgtaaaaggttttttctctttttttttttttcaaaaccgaaactcagctagattcacttgcactctctgaatgtaaagtgtgcactatatttttttaacacttgtccaattttcagatcagagatgttcagacttgcaatgctttagaagatgcctcctcacctccaggtacattgtagtcgatcatctgcccaaagaaaataaagataagaaggaatcaaaacttttagcactgaaactatatagaagattaacttcactttcttcaacaatgaaattatataaaatattagcttcagtttccccgttacaagtgaataatgtatatacagtatacctgagcaagccagcgcctggcttcgtcggtgagctcgcacgagtcgtcgccgacgagatcgtccctgaggcggccgtacgcctgcacgaacctctcgcgggcgtcgacgatgccatgatcagaccgccaccgctgctcctgcctggtgcatttcgccggtgaggcatcgccgcgcaacctcagcttctccttgagctcgcgttccagagcatcgctccggccgtcgtcgtctccaatgcggagcatctcctgcatggacatggttagttcttcttccctttttcacgttgatgtcagtagctgtctcgatcgatctgtggtgatgttgcttgtgatttgcgaggtaagtgaagtctatggaggagctgtatttgtagaggcccccgaagctggatcggttgcttgttgactgcacaagtgcagaacgtggcgggagaagatcgaaccagaaggtaggccttttgctgagctcatgcgagtgttcaattttctgccaaacaggtggttcgggcggtggtagctagctattgctgctcgtggaactggttactgaaatactgaaataccaatgtatttcctacttcgtagctccattggcgtcatcatagcgaaaagaacagcaagctacgttgccgaccccttctgccaccatgagcacgtgatgcatgatgcatcaatcatcaaagtctgcgtgacgcatgttgcaggcctgcctgtgaagaggtacttagaatatcgttatgttgtttcaaaatataaggattttcaagtatttaaattaacagcagttactaaaaggaaatattattttgacttaaccttagtatttactaaacagaaccaaaggatcttcgagcacaaggaaacggcggcccccaatcttatagcaaaaataaaggaagaggcaagaacctggataatggcaggcgcaaggcgacttggagaattcctaccaacttaatcatagcgcttatgtaattttgtacagctcttttttttttgcccctaggggttgtatttttttacgcctatatctaatgaaatagcacaatctcgtgctgattcctttcaaaaaagtatttactaaacaacctaaaatttttcatattttagagtggatgaagtactaagttataatcaatcaagttctgaagtctgaacaagttgcatttatttctcagcttgttattgcctttatcgctcttatcctctgattacagaagaagagaagctaaacacaggttcgatcgatccagcgtttcaggccgtcaggtacgtacgtcggccgaccaggtattatctcatcatcgccaactaaactctacagcacgtacgtaggctcaattctagagaatttttttcatttttattttttaatatttacagaaatattgtaccgcgaaaatatttacagaagtagggcggcagggtgacgtgagggacagacaagttgaaaaaaaactagaaaaatgcatttttagtacggcaaaaattgcatttgtgtaaatattttagatggtataatatttctgtaaatattaaaaaaataaaattgaaaatgaaaaaaaatccaattctagacgccatttgggccaactttcgcgtgcttggctcgatctaaggccgctgcttcacgtgacgcctaacatgcgagcacgctgcgtctctaactacgcgtactgttgcggcaacggcagctgtggttgcctgttgctgcaacagtggcaggtgcggaaaccgctgagattatgagccggttgatcgccggaacatgcatgttcgtccatgaactttgctggatttagcgtagtgtcagtaaagccgggacgtggggttgttgggcctgaatgggagcgaattgaaatgatttgctggatgatttttttttagggaagccatttggcgcgttttattgatatgaaaacacaattacatctttcactagaacgtttagcaagaagctagtggattacaagaactaattgagatgaaagcatatctagctggatgtttgctgtgttagctttaatctgggactgtcactctgaagatgcgcatcagctaattagtagttgatcatgaatgaatgcatgggccggttaggcaggtcgtccagtcctccttccaattagcatggcccaatttggatcggttctctaatttatgatgggcctaatttggctctgaataatattcacaatcaaattgctacggcccagacaagatctaaggaaagacctaatttggtgggagtgtgacattttgaatttaggatctctcattagagttggctatcctaattttggaataagttcactttagatccctctatttgtcgcccagtctgattttcgtccctgaaccgcaaaaccggatacgacccgtcccccaacttacgaaaaccgggcaaacgaggtccctcggcggttttgatatcggttttggctgacgtggcacctacatggctaatttgactcggtgtacatctgacgtggcgcttacgtgacaattcgatcccaaaaataataaaaactggacgtccacgtgtcagttaaaagaaactaaagatggtgggacccacgtgggtcctgcatgtcattctcaccctcctatcttccttctctctccccgcctcccggtacgacacggacacctcggcggcggcggcggtgccgccaacctgcacggctgcacctccaggtacgccactacgcctccagccaggctccagcacggccaccgtgtcctccagcaccttcacctggtccactgccgcctccacgatctcctccctgcccgctgcatccaaccattgacaagatcaaacgacgatctccctcgcagccattcgccaagaaacccgaggaagacgacgaggcgaccatcgcctccggttggcaagaaaccaacgaataagacaatgcgaccggccatcgccgccgttggccaagaagccagaggaagaaggcgacgacgatgacgagacattccctatcactgtcatgtttggcatgtgttctatgtttgtcttcatggcggcaatcctgcagagacggctaatggttgtttatgacctacacaaatcatcgataagtatgtatctttcttcattattactccacatatgagaactaaaatcgctttgccattcaatttctttgattcctaactgttggggttaacatttgctgcagaagcacaagagatggttgatgaagatgagccactgaatccttacggattgataggatcatacaaacaaatcgaatatcctccgcgtacttctcgcccagggagacactcaccgccgagccgtcgccaccgccgccaagggctgccgcctgctgcccgtggccgcacaagacgtgcgtgactcgcgtgtccggaggggcggctggcgggcgccggaccgcgccgggcttcctcgcatcctgctgctgctgcgtgtcagagaggagcatgacggtggcgacgggttgcggtcgcggcggtcctcaagcaccttggtggccttgcgcagcgcgtcgctaatgcagacggcctgcggctgttcctggccctgggcggcggaggcggtcgacaatctggcgcgtcatccggcgcagcggcaggaggcgcttggcggcgccagagaaggcgacgatggcgaggcggtcggtcgggccgtgagaggcgatgacggggcacatccctctcttgagcatctgaagcttgtcgctcatcatcgactcgctgggcaaggtggagccgcggtgaggtccgtcgcgacgcccgatgccactccgccccgcccgtttctgccggccgccgctcgccccgctccatcgaccggatagagagaagggatagagagaagaggggagagagaggatagagagaacagggaggagtgaggatgacgtatggggcccacgtgggtcccaccattttttattattttgtgtaaaactgacatgtgggtcccatgggttttattatttttttgattggattgccacgtcagatgaagaccgagtcaaattagttacgtaggcgccacgtcaaccaaaaccgccgagggacctcgtttgtccggttttcataagttgggggacgagtcgtacccggttttacatctcagggatgaaaatcagactgggcgataaatagagggacctaagtgaacttactcccctaattttacatgtgttttggttcaacgagggtggatgaacgcaatgctaattggcgcagagggttttataactttgactatcaataacttaaaagttatgggactatctatctatatgacgccatatttttcatgaaaaaatagtcagaatatatttacattgtaagtccctaaaattacatatgtaatttcaatgtatttacactgtaagtctcaaaattacatatgtaagttctaaaattacatatgtaaatagtatgtaattatagtgtaattaggaagtaattatataacactaactattttatccctctctcgttacgtgttctcattcgtccggtctcttactttgaccaatgtgcaactgtgtacgagcatgtagcagtacccaacgtaacacatctgctcggtgaagttatcgtatttctggtggttatgtacaagagcacgaatctcggcgtcaatcgtgtgggtcaaaaaatcgactgaaatcaaggtaaaaatgtggcgccccaaattta

SEQ ID NO: 52107 - DNA, 22103 bp, Oryza sativa
  unsure (1)..(22103): unsure at all n locations
tgtccgaactcaagcagccactgtggaaaggtgtttctacttcttcctcctgtaaatcttcttcagaaacgacttcaaaatatcccgaattgcacggtcagtctcggcgtcgatggtcgaaaccaggtgcttgtaaactcttgactcgtactccaaaaatatgtcctacataagtaataaaggagcaagaaaaacgttcacagttagatgtctcgtttttctgtggttggaaaattcacctttcgagtaacaatcagggtggctaatacagaaccagatgaacttgttaaaagggtcatggcattgcatatcttattatgctttctaactagtctggttagaaagagttgtagtacctgaagatcaagctccctgtaaacgctcttcacttctgctacgcattttgggtcagacttcccgtagttctcctgagaaatcaacaaatttacacgcaaatatatgtgcagttagtacttggaaaaaatctgtggttgctttctccgaagagatcatagcatagaagaaaaaaattgtggtttttcttacatatagtattttcatctcattctcattggcgagttccatagcctgtactattagccaggaacacttgtagtcttcaatgtctgttccaacctgtaccacattgagctcagtaaagcagagcattttaccagcagaaacaaaatgtaaagacaagtttttatgtaagtaccttgccaatcacttctgggtcaccaaagcaatccaagtagtcatcctgagaagtgcatttatgtcagaattaatcatgaagttgaggacaatacaaccatttaggaagtataaacggacctgtatctgaaagtatacgcccatttcgataagtacatttttcagctcaacatagtcactcaatctcgcgccattcaagagtaatgcacatgcaacctgatgaaaaggaaacaaattcagaactactggtctactacaacaaacagttgtcttttcagaactagaggaatttcatcattcatttaactgttcagtttgaagctcagactcaccggcaggtagaacgaatagtatgatgtcttgtacttgacaatgcgacggtacctggcagaatcaatttgggagcaaattaagagaaatcactaatgctattttaacttgagtagagttacttatacactgcatgcatacccctgaattctgtatctggcgagatccttggcgccggtatgagtggtgatgagatccagcatctgccccatggcagtctgcaagcctatctgtcccaaaaaacaagatcaaaactgagcaatatatgccaattaaagatgaaatcctaacaagttttgtgtttgttcaggccctccaattacctcgttccatagctccatgaggtccaggaagtagaacttctccttgaagtatctcttgatgattgcctggacatggcacttgagcagcacaccatcgtttatagcagacatgccaacctgacaaaattgtcaattacacgaacatttttcagttaatcaatcattctcaggacagagattcagatctaccacaaagagaacacagcaagaaatggatcgcaccgttggtagcttgtaccagcagaggttatctcgcctcgtgtaggcgttgtccgtgatgtcatcgagcacaagggctgacgcttgcagctgcagaattcaggcaccaaaattcatgatgaatagtaccaagatctgacagactgacacaacagagttttgtttcgctagtgattgggcagggatgacggtgttgtttacccattcgacgcaccaaccgagcacgcaggcgaggtagaaatcctcgtcgtcaacctcggttccttgtctcagcagcatgtagctgtccaccaccgagagcccacggttcagtttcccttcagaaaaacgtcacgagacatgtcagcttagctttcagggcagcagggccagatcaattctgcatgggcatggatgctagcttgctcacctcctggcacgttgtagtccatcatctgcaacagcaaagaaaacaacagaggacgcattacatttccattttcgtcagaaacaacggagataacaccatataaaagtattttaccaaacaaaccatcaaggttaaaatatttctgcaggtttgattagattgaagtattgaacatagaagttacaaacaaaagaaccattttttcagtggtactagtaccaagaacagttaaagaactcatcttgacaggcataaccatcaatgtgaatttgatgcgtatagagaagccatatgaattaagcaaccaaaaatattttataatgtccccgtctcaaagtataagcatgttcataatagtgctaagtcaatcatttttaactttgactatttaatagcaaaaaaaataaaaaagatcaataatataaaattgatgttactagatttatcattaaacaaactatcataatatacaactctttttatttaaagcatcttacttttatagatgttattggtcaaagtatgtattatttatagttaaaaaactaatgctaaaaaatatacttggggtgaaaaaccccatcatggagtttaaagttaggtttgaaattttgacatttgtccgtgacagaactatgtatgcacagtgtttgggagaaattaagatggagataaagtcagagcacacaaaacgaaaaaaaatcaattaattgagctttagttattttaaacttaaaataaatttatttgatattttaaagcaatttttatataaaaagttttaaaaaaacacactgtttaacagtttgaaaaaaaaatgcaaatgaaaaccgagttaaatctgcatctaaaccttaacgatccatggatcaagcatgatttaatccaaaccacatgtatgttgtacagtaataaacttgcaattaatcgtgttcattaggtatagagagagtaagacgtaccttggcgacccactgcctggtctcctcagtgaagtcgaagttgaaggctcggtcgttgagcagctcactcttgagccgctcgtacgcgcgcacgaacctgtccctcgtctgctcgccctgcccctgctccgccgccgcgccgccccgcccgcgcccgccgccgttcagccggagaagctcccggagctcgtcctccagccccgccgccctcctcaccacctcccccgggctcgccgccagcgccgccaccgccgccgacacccccgacggcaggtgcgacgcgatcgacgccgccagcgcccccatcaaattataccaacagttttccggaaactctgatgcgatcttgttccaactggtgattaactgacgagtttgatcaatctctgcgtggagatgacggaggctgctgctgatgtgtttgggggttttaaccgctggtgatcagtacgtggatagatcgatcgcggcgagcgagtggcgttggctgcaggtgagctagccaacaaaagaaaaattcagctcgcggcgcgcgagaagcatctgcgaccgagtggtgcagcacgcaagaacgagtgttcgttcgtgtcagtgtcagtgatcatagcaaatctgaagtgtatgcggaggatgcatctgtcgtctccgtggacgcagcatatcccggtggcttttagcctcagattttgatgcggccgatcgctacatcagccataaaaaaaaatgcagctcttttttttctgaatattgagaagagactacttcaggttttgatcaggcttcagatttcagagttcaggtgaacgaacgtgtcatcctttctcattctcggctccaatcaatccatgccatgaatttatatttttcaaaattgaattcagttataattctgatcagctagtattttatttcactgtttccatcaaatttcccccttttgtagtatagaacatctctgaataatcctgaacgtttgtagtatataggacttctgaatactgaaccttcaaacatatatgggtgctatatatgactcatagcagcgaagcatctaggtagcgttatccttttcgggcattcgctacatcacataatcaaagcaacaaagttccaaaagcatataataattcaagtacgagcacggcgccaatctttctacgcttggcaaccacttcaaaagtagttagtgtcaccaatctgaatcagaattattcgaatcgtttcatacaaaactactcgagtcaattttgcaatcgttttcagtcattgtaaatgcccggcattgacccgtttttgagcttatactgcgaggtttttttactgttctttaggttgtgcagtaccaaattctaactgttgatctggcatcattcaacggtcagaaatcatccgtacctcatggtactgcacctccccattgaagcggtaccatgggcgggagggtatttctgtccttttgtttgtttcacgagaaaaaaaaactcctcaggagagcagcagcgtgacggcaggctcgagggggacggcggtggcgcctggatgagcgacggcggcggtgggcggctggatgcgcgacaacagcggcggggtcgatgtgtgacggcggcggcggggtcgatgcgtgacggcggcggccggctggatgcacgacggcggcggcggcctcgatgggcgacgatggcaacgggctggatgcgcggcggcggcggcggcctcgatgcgcaacgacgtggctacctcgatgcgtgacgtccctggccggcacggatgatgaagagagaccttatttttgttagtccgatcgtaccgtgctaaatcaacggttagattacattggtacctcatgatatctcgtacctcatgataccttctcaaggataggaaagatgctcgtatattgcaagatgaaagtaatagcactacaactgtacaccggatagctcgatcggttatcctgaatcttggaacaaaaacaagtgactatctcactgccacaaaaaactagtctacagtaaaccacaaacaaatggtcgcaagatatccatcgaacatacgagaagagatgctccagagccaatgaaatatgtgaacatttttttttcagatttcagagatcttctaatcagtcatggctactcatccgaaaaaatgttacagtccacagctttattttgtgaacgccatttaatttattttactcggcctgcatagcggagaggtagcgagaatgctagatagatatctggagtcgtcgtcgtcgtcgtcgtcgacttgtcatccatagccattgacgacgacgagctctactagcaatcgatcgatcgagttctcgccgccatgagcaagctcgactactgcttcagcaatgactacatggtgctgcgccctgacagggccggcgcgtacgagctcctgcacctcctcttctcccccaaggtcggccggaacaaggccgtcgactgcttcaccagcaccgagctccacagcttccggcgccgcctctccatcttcctcaacctcctcctgcagctcttcctcctctcgctagtcggccccctcgtcgccgtcctcggcggcgcgctcgagttcgccctcaacctcgccagcaacgtcctccatggtcagtggtgacactagcttgcatggatgtctcggatagttaaccctaattgtgtgttggtgcagggagaatggagtatcctgatcggaagtcggcgtcgtaccgatcaatcaccgggctcatcgacccgagggttgatctggagaggagcatcacgccggcggacagccggtaccacgccgcgctctgcgtcatggcgtccaaggtggcgtacgagaacgaggcgttcatccgcgacgtcgtcacccgccgctggcagatggagttcgtccagttcttcaactgctggaacggtaagcacagcatcaaggacaggttctgtacagctccatgcgcgcaccggcgcacgcacgcaacgtgtttgatgttatgcgtgtggtgtttgttgtattgtgcagagttcgagaacgcgtacacggcgcaggcgttcgtgttctgcgacaaggcggcggacgcggagctggtggtggtggcgttccggggcacgccggcgctggacgtggcgcggtggtgcgccgacgtggacccgtcgtggtacaagatcccgcggctggggcgcgcgcacgcggcgtacacgcacgcgctgggcgcgcagcggaacatcgggtggcccaagtgggtggagcacgtgaagggcaagccgcagcgggtgcacgcctactacgccatccgcgacgccgtgaagcggctgctggaggcgaacggcagggcgagggtgctggtcgccgggcatggctccggcggcgcgctggcggtgctgttcgcgacggtgctggcgtaccacaaggagaaggcggcgctggaccggctcgccggcgtgtacaccttcgggcagccgcgggtcggcgacgccatgctcgccatgttcgccgagaggaacctggacaggccgaggaagaggcacttccggatcacctacggcgacgacccgctgccgcgccttccgcacgagagctccgccgcgcacttcctccacttcggcatccgcctccacttcgacagcttatacaacctcaaggtgaacatccatgcctctcttctctagcttgatcactgtctggttatatttccttcagaaaaacgttcatttttttttctccttctgatcatatattgatcaatgcatgcttttacaagcacgtatataccagcttctgatacattggtactcgaggtattatattcaggcttaaacaggttaattttaacccaatgtagtatagaaaaaaccgatctgttggatcaaaggcaatagatgttcgttttttggtgtaggatacggtaataaaattctaggttagttgatactcatggaagaggattttgatccctcgaggggatattcgctcgttgtttgcatgtcactcaaatggttatgaaaaaatttgaaaaaatttaagaagatgtattaatatgtgatatatcactccacaaacatgcaagtaaaaattcaacttctacatctcgcaacgaaaaaacaaatttgactctgaatatacgttaactagctgcggttcaatttgtttttttcgttacgagatgtagaaattgcatgtttgtggagtgttatatcacatgttaatacaccttcccaattttttccaaatttttttataaccatttaagtgacatgcaaagaacgaggggatatcccctcgagggattaaaacagtttcccgatactcatctataacatatactccttccattttttaatatatatatatatatatatatatatatgacaccgttaacttttatcgtgacatttaactattcattctattaaaaaatatataaatgttatttattttattgtgtcttgttttatcatcaaagaaactctaacattaatttatatttttataaatttacactaaatttttatataagacgaatggtttagacagacaaatcagaaacgggtgatgtactgatgttgaccggttggccccaaagaatgcttggtaaatttagctatacggtaaagaaatttctttcagattttgtgttcattttgagtggtacagcaagcacatcgtatgaacaatccagacagagaatccagtgaaagtgagcttttgttcggttcttatgacactagtacatgcaggcaggcagtcttgatggtggcctgaataatctcattgctgatgtaaggacacaaatttctggttgtatgcttcagatgtagtgatgagtagataaatgaagtgtggtggatagtgattgatgtagggaaattcaacgagaaccactgagccagagttgtacctgaattcagccccaagattcgttatcatcgtctgaatgaaaccaaatgaaaattaaacggaatacaatcttcttctgttctgcagttatctgcaatgtcctgtctgaaggttgtacatttggttgctgttcttcatgaaagatcttgttgctgcatgcatgtccccttccatgacacgatctctgaatattgctcatcaatcgtgctgtacgtgtaacttatgcaggtggtgaaggagttgccgggagatgggagctcgtcgtcgtcggcggcggagttcgcgacgagccgcatcaacgcggcgtgggagctggcccggagcgcgtacctggggtactggaggagcgcctactgccgggaagggtggctgctgatggcggcgagggcggcggcggtggcgctgcctggcctgccgttccacagggtgcaggactacgtcaatgccgtcacgctcgccggctcgaacattcccaaggacatgtgacgatgtatcgagtttctgaatgcaatgctgcagagactgcagctgcaggcatcaaacttggatgagagattgcaactgcaatataatggcagatgacgactgcatcgagcaggctatgggacttgtcacttgtgtaactgtaatgtgacgtacgtactggtagtaattaattacgggtgcaactgtatgttgtcgcgactaattctgcttctactgaataaacatgtagtgataagtgatatgcttgtgagttgtgacttgtaagcatttgatgtactgggacaagtactactagtataactatgagaagataaataattgaagttcttgttttcgtttctcactcattccaacattttttgggtagagccgtagtggtgttgaagttgtgggtatataacttccctcgctagagtttaaatcgtagttttcttgaattttatatgcatcatttatagacgggcttttagcatgattttattaaggttgagacaacatgtgcacacaagtcttctcgtgagcgcaattaattacaatactactatcactactagagaaatgatcttcaatcacggtttctaacccactttcaatcacggttcataacccactataatcccggttatgagagagagacgtgggagagagatatttatttccaatatcaaccgggattaaagatatgatctttagtcccagttggtatcaccaatggagactatagttcgctcgatgcctgacatggcctgacagttattgaaccgggactaaaaatgatttttagttcttgttggtgttaccaaccaggattaaaaataaaaaaaatacctctaaacttataaactgggactaaaagtgctttttagccccggttttttaaagaaccggggctactgtaagaaagcatcgacgagttgttctcatacctctcataaacagcaattctcatatgtagacatgtttgcaaatatgagaaaaaaaaaaccactatgagttcaatagtatcttctctttactgtctcttactataatcttccgtacatataattaattatcctataattattgtaaattagtactaaaatcgacccatatactatagtctaccttctccgatccccaaaactttcttgcttcttcctgctgcccaactttataggaccaaatactcgtattagaggtgatcttctcgatgctatattgcgagtgtgactttggtataaatgctggttcgccatcacgaataacaaggtcaacatgaatggtcttaggccactcatacaacctcgggaggaaaaccttgttctgcatcgacttaagcttggtttttctcatcattgtcgtgtatgttccggtgaacaatgcccgtccatccaaggattccatcttctcccactccattgtctcctcattgagtttgaggacatggacaggcgtaccagtgtagccgacgaggacagccatgagctcaccttgatcagactcgaacaggtagctgtcaacgcgatcatgctcaatcccaaatcccttaagcttatcaacaaccttgaaattatcatcgtggttgcacggatcatacaccgccagcttcccgtcttcaccaagaacgtacagcaggccaccatggagcaccgggttgctgatcggcgaggcctgaagctgtgctccttcctcgacgttgaactccgtcaggtcccatggcccccactcgccgtcctcgtcttgaatcgcgcgggcgagccgcaccacgaagatcgtgttgacgcagtacatcctccggtcggcgtcgtcgtagacgatgaagttgaaccagtagaacggcatctccggtagctcgtcgacggcgccggtgacgagatcggtttgcaggaccagcttaggcaggcacagcgtgaggcgtcgtccgttggagcagcagagattggcttcgggcggcacgttgagcgtgcagccgtcgacctcgaagctcctgtggaagtacgggctgtagtagctggcgttggcgacgccgacgtcggcggagctgaggaggagcggggtgatccacgccgggtagaacggcgacacggcggagcgccagtggcggcacgtcagggcgaagctcgggtggttggaccagccgagccggtcgacgacgagcacgagcatgtcgaacgggagggacgaccagcgatcgtcccgtcgtcgtccctgcgccgccgtcgtcgcatccgcctccatcttttgctttctcgatcgatcgttcaacaccagcgcactttacggcgtgcaggatcggtcgagaattcgagggagagagctctctctctctgttttttttctctctgttatatatgtgttgcatgccgcgtattattatgctgctttcttttcgtgttttcttcggactcttggtcatgagtcatgaacgtgatccactcatccacatcgatcgtgcatacgctagctcccgtcccatcgtatacgtatttcccgtttttgattcgtctgatgcacatggtgatgggtgtagctatatttatggcgtcatatttttcatcaaaaaatagtcggcatatatttacattgtaagtccctaaattatatatgtaattttagtgtatttacaatgtaagtcccaaaattacatatgtatcgatttggtgctaacgtgccacccaaattaagtcatctcgtgttcgcaccctgtccgcgagcagctggtgtcccatacagatttactactcaaagacatgttcaatacacaagacttaaacagctagctatttccagtttttttcatgcgacttctatatatgatgttacaaaaaaaaatatccgtgcattgcaataggtaaaggtatttttttccagtgataccacgctattttttttaagataatggaatgaaacatcctgacatttgctcaaaagagctacagccaattattacaatctagcactctaaaagaagcactctaaaagagtgtagtctaaaataaagcgaaacacaccaaacctgtagcgcccgttccgtcgtggcgcctagcgggaaaattatctcctaaaaaccctaattgcgaaatttgtttctttgcttgttgtctagtgtccgtgccatctcaagatctcaatccccgatctatcgtcgagttcaattccgaatccaaatccctccaaatcaaattcctccgcaaaagtctattttgcctcccccggggttgatgggccgaaattctctcggcccatcttctcctctcccccggccctctcctctccccggcgcgctctctctctctctctctctcgctctctctcccccggcgcgctccctctctccctctctccctcccctcatcacaaacaaccgcccggtgtgctcgctttcgcccgtatcgccgtggttcgctctgccgctcgccgccgccgcacgccgtccattcgcggctgggtcgtcgtctacctcccgccagcccacgtggcagccacgtaggcgccacgtcggcgccagctcagccgaggtcgggacgggccgaccccggtcagtccctccccgtgcgcgcgttccaccgcgagccgtgaggttgcgcgtgggcccgccgcacctgcgtccaccgcgaaccgcgtgcgtgcaccacgtccatcctccaccctagcgccgcgccgcgtgctcccgccgcacggtgagccgagccgctgacaagcgggtcccacccgggaccgcgcgtggtgagcccggtccaccggactctctctccttcctccgcgcgcgcgcgtcttgggccgctctgggccgcctttttgggccggccggcccgttaagctcggccgagctgccctttctctcgggccgcgccctagccgcccgagggaagtttatattccctccctctccctttttcttctctttatctcttccaaaaaggatttaattaaatcattttcctttagaccaaaaatccaataatcttagaaattcaatatcttccccaccgtaaatccgtttgactccgttcaacttccaaaactccccaaatctcgagatctacctaatggcacgcttagaggtcagtaatagggctttattttcgccgtttgttgagttgtcccgtttcgcgtgtagttccggagcccgaagacccgcagtgcgaggatttcgaggatcaagctccagatctcgagcaaggcaagccacctttgaacatcttgagcctatatttgaatttaattatgttgcttgaaaaatattatgcattgataggatcgcacttaatctgttgtcccgtctgcaaggcagattggcggacctacctagtttgttgcatttgatccttcctttgataattgttataccatgtccccttgtaaccatccagttgcgtctcgatattcgtgcacccagtgcgagtatcgacggacgccttcaaacttaaaatctgaaaaacaacttgggtaaaacttgggttttacaagagacttggaaaacccgacacctgggtcggtgcttgcgaactaaatgaatttccaaaaccgcggaccggggaacgtaccgggtgtacggtttcccgctcttgcacttaaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgctgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtggaaaggggttcgatgtttgaaagattcagcagctgatgggatcagctaggcccgggtggccgtttgaaaagttgttggcccgggtggccgtttgaaaagttgttggccgggtgccaaccttgtttcaattctaaagactgatacatttgcacatactccgaccggacgagacgctctgtctcatccgagtcgtttgagaagcactcacttagttgttttcagaaaagagttcaaataaaatcaattgcaaaaacaacagccttcccttgaagcctgcattaaacacttaattcccttggcttgctgagtactcccgtactcacccttgctctatataaataatcccccccagttgctgaagaagatgaagcggatccggctgatgaggagttcttccaggagcaagccggctacgatgagttttagggtttcggcctagttcccaagtcgcgcctgtaatgattggtccaagtcctggcttccgctttccttttgtaatgcagttgtgagctcgggatctgtccgcagcccaacatgactgtacttctactctataataaagagacttctgttgctgtgatattctgtctccctgtgataccagcactatttcctgggactggtatcgattaacaggttaatttggagcgtcacgggctagttccggtcggtactagttcggggcgtgacaagagatggtatcagagcacaagcttggccctaggacgaaacccgacgcctaggacgaccctaaggatactaagttcaaaactacttgcgaaaagctaaggtttcttttgttttctttattttcaatagtttgtttctaaaaatggttactgatcctttctccctttttcaaaattgtagatggcagtgaacgccagcttcagctcccacggttttggtgagggtcaccacgtcgctcagcttcgtgacctcgcccgtttccttggcttctcgtgtcccgagtacacggggtactccgtggaccgtgttccccctcactgtgagctctctgtgtacctttacccccgtggaggtatacacggagctggccttcgtccacaccacttcaccgtggccaggcccactctccagatcgcgtaccaggacctctcctggactgcgcttcgtcgcctggcccacgactacagccaccgtctcgggggctccgccttccggcagcttccacgccttccttctggccactcagacgccaggtacccttgtccgtacagcgagtctcagccagtgctgactcgcatggttgagctttcggaggctcaggccactcagcacgacctactcctggaggcttaccgctcccttgcccgccgctacgccgccctggaggcccgtctggccgaggagggtgtcacttcagttgacactgtctcttgggactcaggccgcctctgccacgccagccacctgtcctcccacagctcccgcggctctgcccgcactcccagtggcccgcgctcccccagctcgcgtgcgccgtactcaccagtgtactccccctacccacacccagttagcccttcctacacccccggacacaccccagttgcttcctcccgccgtggcccacgctttatccgcaccgcgcggaagcgtgttgttggttcttccaccgtgttccgttttcactacccagctcccccaccgccagcggcccgtgctgctgccggccctcgacaggttccgccggtcccttcgcgtcagccgatcgacgtttcttcgactgaggagccgaccacagggggcagccaggccgacgaggagtagaggaggcagtcttcagcagccgtccgtgtgttaggcccttttgttccaccgccaactcttttggagtcgtggcgaggtagtgcgtgcgtgtgtttgttgtgggtgttgtttggtagtctggttctcctaggtggtgtgcgcgcagtcaagctcggcgtagctctgtgacttgtccacacccgttgtatcaggtgtctttatgatttgaaaaatccagtttatgcctagtgtgtgctatctgagttgctaattactttgctccttgccctcctaagtgctatctgactcttaccccgccctcttctgggagtttagatggctagccgtccccgccgtgcagctcgtgcaccagcccgctttggttttgaaaatggtagagttgagccagaagaaaatcatgagtcagctaatgagcagtctcaccacagcaaccgttcgcaccgtactgcttcccgcaacgcagaagttgagcaaccccgccgcagcagccgctcgcatcgcacagtttcccgtaatgcagagatggaacagtctcaccgctctcaccgcactgccagtcacaattctggagaagaacgcctcccttccccacctcatgtggaaaacaacatgcaacacttaatggcagttcagacacaaatcttgcaaggattagccgcagccgtagccggttttcagcataatgcgcatggaaatggccaccctcacatgagcaacaatagatccaagctgacagattttctgaggtcacgtccgccagagttctctcagaccgtcgagcccgttgaggctgacgattggctgaaagatgttgatagaaaactcaacttagtgcagtgtactccggtcgagaagacgctctacgcctctcaccagctaagaggacctgctgcagattggtgggagaattactgcaatgcacaccctgaacccactaacattgcttgggatgagtttgctacggctttccgtgcagctcatgtgcctgaaagcactattgacatgaagaaagaagaattcaacagacttaagcaaggcaacagcagtgtcaatgagtacctaagtatgttcaacaagttggctcggtacgcccctgaggaagtgggcacagacaagaagaagatcaggaaattcttgaaaggaatcgcagttggaatgagactccagttgcttgctcatgatttccccacttttcaacatatgatcaacaaggcgcttctacttgaggatgccagaaaagaggctaccgaagaatacaagaaacgcaagtctaaccatcagggaaattcttcccgaggcgcaccttgccctcgctacggtcaacccatgcaataccaccagtcggtcactcaggctaaccgccagccaggctacgcccctcgtcctcagatgaaccgtccggcacctcagccacagcagcgtgcccctagtggcaatactgcgccaaacagtgttacctctttcaagtcaccacagggaccgtcagcagttcagtgtttccggtgcaaccagatgggtcactatgccagacagtgccctcagaatcctaccaacaccagcttaggtcatgctaatggcagcactgccagaactcctactccagcggcagctcagtctcgtcctagctctcaggcaagtggacaaggttctcgtgcatccaacaactttggtcgaggccgggtgaaccacattcaagctgagaccgctcaggatgctccagacgttgtgatgggtatgttctctgtcaactccatacccgcaatagttctgtttgattcgggagcttcccattctttcatatcacaagcttttgtgaaaagaaatggttggaaaacccaaaatttacgtgtaccaatgatagtacattcccctgggaggaatataagggcaactcaagtatgcccggaagttaaccttagaattgaggaagttgacttcctagccaaaccgatagtcctagactcgcaaagcttggacatcatcctagggatggattggttggctaagcacaaaggacagatagattgtgccgaaaagaccatcaccttgcaaggacctggaggaaagcaagtccgctttacctctaacacccctaccgcaagtcggtctatcctaacctgtttacaagtcacctccttggagtcggtgcccatagtctgtgaatatcccgacgtattcccagaaaaattaacaagtatgccaccagaccgagagattgagttcgccatagaactagcgccaagcaccgcaccaattgcaaaaaggccctaccgaatggcagctaatgagttagcagaagttaaaagacaaatcgaagaattagagagtaaaggttatgtgcgacctagctcatccccttggggagccccagtgcttctggttaagaaaaaggatggctctgagagaatggtaatcgactatagagccctgaatgaagtaactataaagaacaagtacccgttgccacggattgacgatttgttcgatcaacttaaaggagcaagagttttctcaaaaattgacttaagatcaggttaccaccaatttaaaatcagatctgaagatattccgaagaccgctttctcaacgcgttatggtctatacgagttcacagtaatgtccttcggactcactaatgctccagcgttcttcatgaacttaatgaacaaaatctttatggaatacctggaccagtttgtcgtggtgttcatcgatgacatcctgatatactccaagaatgaggaagaacatgctgaacacctgcggctgataatggaaaagctcagagatcatcaactattcgctaaattctcgaaatgcaaattctggttagaccgagtagcatttctcggacacgtgatctcctccaatggtgtcgaagtagatcccagcaaggttgaagctgtacttgcttggaacccgcccaagaatgtgtcagagatccgcagcttccttggcttagctggatattatcgaagattcattgaaggattctctaagctagccagacctatgtccgagctgttaaagaagggcaagaaatttcaatggtctgcagcctgtgaacacagctttcaagaaatgaagaaaaggttgaccactgccccagttctcaccttgccagatatccgaaaagatttcgagatcttctgtgatgcatcaagacaaggcgtaggatgtgtcttaatgcaagaacgaaaggttgtggcctatgcatccaggcagctcaggcctcatgaagtcaattatcccacccatgatctcgagttggcagccgtggttcatgctcttaagatctggaggcactatttaatcgggaacagatgcgaagtatacaccgaccacaaaagtcttaagtatatcttcacacagaccgagttaaatatgagacagagaagatggttggaactaatcgaagattacgatcttggaatccattatcatcccggtaaagctaatgtggtcgctgatgcgctaagtcgcaaggcctattgcaatgtagctcaaatacggcctgaccaagatcgcctgtgcagagaattggagaagttgaggctgaccatggtacagtcaggtgtccctgccagcttgacagtatagcctaccctagagtcgcaaatccgggaggctcagaaagacgacgaagggatacaagagttaataaaaagaatacaggagaagaaagacaccaatttctccatggacgaccaaggcacagtttgatgcggtccacgcatctgtgtaccggccaggaaggaattaagagatctcatcctaaaggaagctcatgagtccgcctactccattcatccaggaagtacgaagatgtaccaagatatcaaggcatacttctggtgggctggaatgaagcgagatgtcgcagaatacgtagccttgtgtgacatttgccaaagagtcaaggcagagcaccagaggccagctggtatgctacagcccctaccaattcccgagtggaaatgggaagaaatcggaatggatttcatcaccgggttgccaagaacccctagcgggtacgactccatctgggtaatcgtggaccgactcacgaaatcggctcatttcgtgccagtgaaaaccacctatgatggaaagaaactagcagaactctacatgacccatgtcgtatgtagatttggctgtcccaagaagattgtgtcagaccgaggcactcagttcacctcaaggttctggaagcagttgcatgaagctctcggaaccgatctaaattttagtacggcctaccatccgcagaccgatggtcagacagaaagggtaaaccaaatcctagaagacatgctacgtgcgtgtgccctggatttcgaaggcacttgggatcgttgtttgccgtatgctgagttctcatacaacaacagttatcaggccagcattcagatgtcgccgaatgaggctatgttcggaagaaagtgccgcactcccttgtgctggaatgaggcgggcgaagcactagtattcggtcctgacatactcaagacagcagaagaacaagttaagctaatccgagaacgtttaaagacagcgcagaaccgtcagaaaaatttggctgacaatcggagacgtgaccttgagttcgaaaaaggagatcatgtgtacctgcgggtatcacccctccgtggtatgaagaggtttgggatgtccggcaagttagcaccccgctacatcggcccctacctcataaccgccagacgtggcgaagtggcttatcagcttgagctacctgaaggtctcgcagatgtgcacaacgtgttccacgtatcccagctaaagaaatgtcttcgagttccagaagagcaagttcccctgggtaatatcgtactggaaaagaatctgacctacaaggaaagaccgatcaaggttcttgaagaggcagaacgtcagactcgaaggaagaccatcaagttctacaaagtccaatggagcaatcattctgaagatgaggcaacctgggagcgagaagatcttctccgcgccgagtttccggagctgctcccttaggtgctgaatctcggggtcgagattcttgttaggggggttggtctgtagcgcccgttccgtcgtggcgcctagcgggaaaattatctcctaaaaaccctaattgcgaaatttgtttctttgcttgttgtctagtgtctgtgccatctcaagatctcaatccccgatctatcgtcgagttcaattccgaatccaaatccctccaaatcaaattcctccgcaaaagtctattttgcctcccccgtggttgatgggccgaaatttcttgggcccatcttctcctctcccccggccctgtcctctccccggcgctctctctctctctctctctctctctctctctctctcgctctctctcccccggcgcgctccctctctccctccgctccgccccgcgccgcgcgcgcgagcgcgcgtcgccgcgccgagtgcccctccctcgcgcgccgcgcgcaagcgcgagagccgcgccctgcgcctctccgctctgcccgcgtgcgtgcgcgtgagccgcccgcgccgagccgaatcttccctctccgctccctcgctgccgctccccgcgctcgttcgcgcgcgcgcccgcgtggttccgcccgtgtcgcgtcgcgtctgcgccacccggtcccgctgccctgccgcctgcagccgcgcaaccgcgtggccccgcgagccagcgcgcgtgcccgagccgcgccactccatccgccgcgcctcccgttgcaagccgcgcgcacgtgccgtggtggccgaccgcccggtcgccgccgtcgtcagcctctgcacgcgcctgtcgccagtgtcgccgctctgctccaaaccgccccgccgtcatcgccgtcgtcaccgcctcggccccgccactcccgcgctagcctccaagggacggaggcagagcctccctcctccctctgccgcgtcgcccccgctcacctcctcctttttcccgaatcggcaaaggggcaagccccctttctccccctccttttcccctttttcctcctcgccggcgtcatcttccctgtcgccgctttggccgcgaccgccgagcgccagctcgcgcccttgaccgcgcaagtcggttcccaaaccgacattgccgcccatttaaaccccagcctcccctttccctccctcttccattcgcctccgtgccattgccgccgcccccgtgctctgtctcgcctccgccgtccttcgccgagcgccgggagaaccggtgcgttcgaggacgcggaaggggacttcggccgcgccctcttcttcctcttccccggcccgaggccggagagattactcccgcgccgtcggnctctcgtnacagcgcccccgacccgcaccgtagtgcctcttctccgttcttccttctcgcnttcatctccccctttagtttcgggagaagctcgagtagcccccccgtagctagccggcaccgccccgacccttgccgtcgttcgccgagtgctcgccgccatcgccgctcgagctccgtagcacccgctcgtcgccgacctggctcggcgtagctccgcccaatccgacgctagcatcggattcccgtggccgcgtagatgctctcgccgccgggaattggcccctcgtgacctcgtcgccgttttccccttttcccgccaccggttgccgccgccacgattcgccgccgtcaagctccctccggcgaatccgagccgttggctcgtctcccctcatcacgaacaaccgcccggtgtgctcgctttcgcccgtatcggcgtggttcgctctgccgctcggcggcgccgcccgccgtccattcgcggctgggtcgtcgtctacctcccgccagcccacgtggcagcgcacgtagcgccacgtcggcgccagctcagccgaggccgggacgggccgaccccggtcagtccctccccgtgcgcgcgtcccaccgcgagc

SEQ ID NO: 52108 - DNA, 8916 bp, Oryza sativa
  unsure (1)..(8916): unsure at all n locations
ctagttcccaagtcacgcctgtgatgattggtccaagtcctggcttccgctttccttttgtaatgcagttgtgagctcgggatctgttcgcagcccaacatgactgtacttctactctataataaagagacttctgttgctgtgatattctgtctccctgtgataccagcactgtttcctgggactggtatcgattaacaggttaataaagaatctattcctttgttatggccaatttgcattgattactttattcctggataccttgggttgttataacttgactagttgagctttatatattggttcagctagatattagatgtaattgcttagccatgcttagaaacattagcacactattgggataacttatgactcattattatttaaggatggcttaatgatacttcacgatggtcaatcgtgattggttaattaattatttgccaactaaaacttgataatggtgggttgtgagcatatggttttgagagtcgtgctcatgacaattaaggaccggttcgcgagctactattgtgaaacattaatcgtgccaaccacaagctagcgtgggcaatggctttaccttttgtacagcatggttcattgcggagcatcagactgagaagtggcagagataagcccacgggggtcgctggggagtccatgcctctggttattgagggggtgattatgatccaggaaaggtgcgctgtggtggattgtgttgtgcaaggggtattgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgagttgaacaatgtttttcgtgattagtcccacacctctcacaataattatggatgttatacctggtaataatttgcttagctcctggtttggagttagatctgtacagccgggtatggttgttcaggatggttgggcctgtgcagcatgggtgtgctgttcagtgttgattaaaatttctgattaatcactccactgtttttacttctcttaaaagttttgctaaatgctgcttttgcaaatgaacctatattatgccatcctttggtatctttgtgcacttgcatatttgctgtgtggcttgctgagtatgtcatatgctcattcttgcaataatcgatcaacctcagttgaagaaaaagaattcagaaggagaagacgtttggcttataccccagttgagctgcctgtgggagtggagccggagcttcgctagattttattttccgctgcagttttcttcttggtgaggactaagtgcctcttaagtaagtatttatcgttttagttaatttgatgaatctgtatattaaattgtcaatttgtgtacctcggttgattcctggacgaggattttatgcacaaataagttcggaaattactagtgaatttccgggcgtgacattcggggcgtgacaaaaccaaaatagaagaaaaccgaacaggacaaggagaacattattccggtctattggtgaatctccatccataattagaaaaaagttgcataaccgtcgtttcaagcctacgatatgcaacaatcaggaactctccatcttcattacatttatgtaattgtgcccactaccggagctaatatattgctctgaaaattacctgcaagctgtcaagccagacccacccgttttcgtagcgtcctccgaacaacagtctcgtgcttgtacaatgcggagctgaccctccccatcaaatccagtcgaatctttcttaatctccaaaatttggttgagtgttttttatccactcgatctcctatttccgtttcccctaatcaacgcgaatcagcaaaaataaaaacaacccgaggaagctcgtcggctccatcttttgctttctagatcgttcaacaccagcgcacgtgcggtgtgcaggattggtcgaggcctcgaggagggagatcgagagggaggaattcttctctctctctctttcatttggagatgtcgatggatttttatccctcgaggggatatcctctcattttgtacatatcatttaaaaaggcattaatttttttaaaaaaaatattaagataaataaatatatgatatatctttcggcaaacatgcaagttaaatctcatcttatacaattcgaaacaaaaataataaatttaactgcgaattacgtgttatattcaatatcaaatttgttgttttttttctaattgtataatttgaatttgaacatgcatatttgtgaagtgatatatcacatattgatctatcttgatttttttaaaaaaaatttgatgactttttaagctacatgaaaaatgaggggatattcccttaagagatgattagtgtttcccttttctgttatacgtgtgttgcatgccgcgtattatgctgctttcttttcgtgtttcctccggacacctcttacttacgacatggaaacaaatctctgttactataaatcatggaatacgtacatgtatattgatgagtttttgcttcagtttcaccagccataccctctatcaggaaaaaaacaccaagaagaggagtaaattgagatcgaattcatggaggcaggccacaagccatctgatgcattggatcgccggcttgctccgctgctgctgctgggagtgggacacgccgccgccgccgacgatggcgacggcatgtccgtgtatagcctgccacggggtgagatgctgcatcttccgtgccttcacccggggagcgcgttcgtcagagaccaccgaatctgggccacgccgcagggctggctgctcatggcgcgccgcggctctccggagaccttcctgtgggaccctttcaccggcaccaggatcggcctgtcgcccgaccaggacggcaccgtcctcgccgtagaccactggcggcgccggtgcctcctgtcgcgccgccgccccacggaccccggctgcgtcgtgctcgtcgtcgacctagaagacacggtgctttggcattgccgtccggcgcccgccggccgtggcaacggcaccgacgaaccaccaccaccaccaccagaagaagaagacgaccagcaatgggcgaggcacgagtacctccagcccggcacgcctcaccacgagcaccgcgacgacgtcctccgcgcgatagggcggctcacggcggtagacggcagcaagctcctcgtggacctcgtcgatcaccgcctcgccgtgctcgagctgtcgtcgcaggagcccgtggtcaccgtggtcgccgcggagggcgtctcggtggcgtgcacgtccaactccactaaccttgtggaatcggacggggagctgtactgcgtttggtttagatacccgatccgatgcctccggatcgttgcgcgcgtcagcgtctataagcttgattacatggcggcgaagggatcagcgacatggatgaaggtgaagtcgctcggtggacgaaggtcgtttttcatcggtcaagatagaattggagcgtcgttcgatgcggaggaagctggcctaaaaccgaattgcatctattattactggttgctgaacaacagagctgctttgtatgctcatgacatggaacgagggaccacggccgtgcacaatctatatccagacgatctttcctatcatctgtcgccagccatcacgatgatgcctaccgctcgctcgatgagtatatatagtttaattggacttacgcatatcctttttacagttctgtatacaagaattaatgaaaacacagtatatatcatggtgcgtatcatatcaccacaaatgcatgcaattcaaatattatagttccttttgaatttctaaacatacctttgtgcttgggaatatatgagatatgaattttcatcctcgagggatgccccatcgttacttgcatgtcatctaagagcatcgccaacagaatcctaaagtttcatccccaaaatttggttttccactagaaagaatgcccgtgcgttacaccgggtgaatatttttagcggcacatgttttggtttaatcgagataaaaaaaaagagagatgatacatggtaggtttttcttattgtcatttcaccctaggcaatctagtatggtagaatgaaggactcataaatggacattgtatcttgagtcctttcgactatagctggagggtttcacctccgaagaaggacatctctcaccactacaacagtaggtgnatgtggagcacgtgcaatgacatccaaaaacttaatggtgtagagctctataatgtcacctgttcccttgatcaaattaattcaattgacctttgatcgagcatcaccagctttgatctaacttgaacaacctcgatctgcgtcctcactcgacctttatgtgactgtcacccaccataggcttaactaaaacttatacgtctaataaatgaattactttattacatggtaggttaccactaaggtaagataatggtaattgcacgagaaccatatcaaattcaaataaattaaaaaataatttaatttttttgataaattttatcttcacgatttgcaattgttaccatatatagtttggatgacactttttatatttctagttttttactgcaaatttgcacctattgaaaattgaatctatctcgtgttttgttattttctccacaaccagctatcgtgctgggatagccttctgacctctacgcaatgatccctgagatcttgctagccagtcattatttgctccaggaaaatatgagtctagctgtgatttgcatgcatgcaaaatctatctacgtgcaaagataattaacagtacatcttgatccggactggccggcctttgctgcgcacggaaaaccttctcgcattgcgtcgaacggaacgatcatacagtcgactaattaaccagctcacggccggaggaaacacatgcgaaacggactcggatgcatgcgaacgcgacgtggggcgtggcgcatgagcgagcagaatcggataccacgaggtacgaaaatagtttcggcaaaaacatcttaaacttttataatagtaaagataatcctaaacaaaatttaagatgtgaaaatatcatctctccaagagatgagctataattaattctctgaaactgaaaagtataggccctataaaaactaccaatagaaatatgtttcttccctcctactgcagtgatcacgattggcctcgacgcttactgtcaccacgatcacattcacctcccatcccacgacgttgctctccccccgccacgactatacatgttctgcatattatggcctgcaatgtttgtaaactaccatatgatgaatttgtacttgtaagaaaatatctcagtataacatcagcaatcagatcagtacatcatcaaagggtgtgtagtggtatatttcccatgtatatctaaaaaattataatggcatgactctaaatagttgaatagtataatgacatatataagattggtttaaggtgttatcaactgatatatgatatcacttgatgcttttaagggcacgtatataaatatactgtttttcggagggtgtttgtgtgatcgacaaatgctgatacgagtgacggagtgagctatctgaattctggatagggttacacaggctactggagtagtggttggctgagaaaaaaagcttttgagcctctttctcatcagaaccagtaacctagcggctagcgctcatggaaggtgtagccgcgcagttcgccggtccgatcctcaccatcgtcgccgccgccgccgtgaccttctacgccgtcagcttcatggagctccgagacgtacgtctgctatactgctagctctcctcgtcgtcgtccccatcttcaaccatgcatttttctcaccattaattgatttcgtcggtggttgcatgaagaaatctttcgaggaactcgacgagaagtactcggagctcgacgacgccggcggccggcagcgccgcgcgcgacggcgggccgagcgcaagtccaggaagaagtgactgaccgacatctcgatatgatgatcagatcagcccaactgcctgagaacaggaggatgatgaaccgtcgttgtcgtcgttggtcatttccttgctagatgctagtagtggttaattatcgaatgtaaacctgatttcaagcttgtttcagtactggtcttccatctcatccgtttttgtattgaaatttggcaagttcaaagttgcagaaaatagctgccctggatcgataactttgttgcgactttggtttgacctgaaaatacaattccaaataaatctcatggaggaactcaatcagatttccgttcatattttaagaatttctagctacaaaatccaaaaaacctgaactagcagcttggaatcggaatttcttagcttttggcgttcaccagcggaatgctcatcaacgacttctcaccatctccggacttttctcccaaacaaacaggttcacagtgcttccctgcggcccgcccacggcagcggagtacactccgaagtccgaatgggccaaacgatgagatttaagtggcccaaaaagtaattatggcctcctaggcccattatgtttcaggatcggcccaattcccatcttctggtggcctgaccagatgcccattggccctaggccaacagcccactcgactacttcagctttatcctttgcttaaaaaaaaaacttcagcgttatccgtgcaataatcgtctgccatataccgggagcagcagtcagattgcacaaggaattgcagtaattagataatcactttaagctggaaccaatgcccgaaatactgttcatccccctacaaacagccccattatctggcttattcgaggaataagacaaacggcgtatcgcaaacgaaaaataaaatttgctgaaaaataaattatgatgaaaaaacattaaaattattttaaaattaaaaatttaaatttaaattttggctgataagtataaatataagcgaaaattctaaatgggcttatggatctgaatactgcactaattgtccggctaatcggnntcaatcgagatctacgggtcgccgtcgccggcgccggccgcccaccatgatggcaggcagtgattgacccatggcgcatcatgacgacggcgacgtacgagcaatcgatcgatcggtcacctgacggcggcgtggcgcgcccgcgtcagtcaccgctaacatcactggatcaaaacccatctatctgtcttaattagccagatggagtatatagattactggaagtaacacgctgttattatcatccgatgttggaacaatcgatgatcctatgactgcacacagcttgctggtcaaagctagtgtgctaaatcgtcttacataactaatttacaagacagggggaaaagagctatatatgctttatttgtaatcctactcacagaatctttctcgggtacacatcagacacatcaactaataaattttatcaaaaatttaaaacaattatttatgtacttccagtactacacctatgtgtaaatacttagcctcaaatttattatattttaacgttaataaaaagatgataattctgacaattttaagagtataaatgtatctgaattttgttttttttactcactaaatataatgattttgaagatgaaactttatacatatatgtaatactactaaaattatagatatatattttttctagaatttttagtgaaatttgttaggtggtgtgcacacaaaaagatttatgtgcatatgatacttttttttacttgttcatcatattatttaactattaatttcatgcttgaaaaaaatacattctaaaaaacattttctactgtattacttggaccactttaaactattcatcatgtttatttcttaaaatttctaaatcaaatcgataatccgctttaatagtccgttcaataatccaaatcaaacgtaccattcggctttcctttatgtccttccaacaccaaagccaaattcaggcaaccggcaccttatctgaaatcagttaattactttgcaagacatttctttatctgaatacaggttaattctgcatatacaacaagcgatcagtgggggtgtatccctgatgttcacagcatatgctacatgggaaaccagcaggttgcgattgtacagcatggaaaccaccaaaaaggcttgtacaccgacaaaatgcgtcgaagaaacgccaaggttttttatcgcctttagcggttagcgcatcagaacgcaacagcaaagcaaaacccaatcaaatccttttcctccaaatctcgccaaattcttcgagcgagacacgtataaactctcactcgctcactcacacctcacacgctgctgctgctgcttctcgatgaggaatattttttttgcttcggttaaagcaacgctaattccccgcgtcgcaagcatgcgtttctaggagaaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 52109 - DNA, 2190 bp, Oryza sativa
aagaacgtttaaaggtataaagattagaagagcacctatgcacgtaattgcaaccatgaagatttgattcttagtctatggatcattgaactcacctttgggcttcctttgttgtatgagaaattttatggtccttaaaaataatattttgaagtatttaaatttgaccttaaaaattttagtacctcgagatatctagtatctgaaggtatcaatttttatactagaaaatatgatgcctctcaatatcttcttagtgatagtaaaattctcagtaccttctcaataatagtaaaattacccttgttgtatattacagtttgatcataatttaaatatcattagattatttctagtctcttgaagaaagctataagaattataaaaaaacttaatcaaacaacacattaatatatgttagtttgaccaaatgacatgttaattggacaaggtttttgtgcttctttgggaagttgctctatccatcctaaaatataatagtctcaacctcttggtgtctgaagatacggtaaattattttttctgaaaaaaatacagtacatccaaagaaacaccaaaaaaaaaaacctcttgcgacagtgtttcctccaattttggtctgaattcagggcttaaaatccaattagccaagtcaattaattataacagaggtcgactagctagctagcatgtgaaggctgcacgcctaagcaattttggcagcactaaatgtttgcaagtgccttgacgcgcaaactttcgattaattgcccaaataatgacacgatatatactctctcatccatcgatcgatcgatcgatcgatcaactaattaattaatatttacagctagagatcgatcgagcaggaagcaaagacacacttaattgcatacccatctgtaaaaaggaattactagctagagccgtaatccgtagagccagcgcgagcgcgcatgacgggtaggcagtacacatgtacgtacacacgcgtccacctctttacgcaaatacagtagcagtcgctggatcatcatcaagattaattatcctttgtggaaatgggagggctcttgcgatgatctgggggacgatgtatcgatcgatgcgatgccacctcactccgatggagccaccaccagcaacagctgcagttagccatggatgatatgatccattggaagagtagctagctagctgctgctgctgctactcctagctgaggtgatgaggtcctccgttctgtacgtacctgtccatgagatcacatctcatgaatgggaaccgtccggcccggccggcgcccccggcgtcacggagcgtacgctccatcggcgcaagcgccatgtacgtacaccacacaacacccccccccccccccttctagctacaaccttcttcagttctccatcccccacatgctacaagctactacatgccactagttgcacatacctgcactgcatttgcgcgcgtgcgatcatatttatgatgtacatatgcgtcagatattttgtttaggttcgtactaataagatatgttatattcatattatgttgttttattttggaataaagcgagtatgctactaaggccttgtttaagttcccaaaacaaaaaatttttcacccatcacatcaaatgtttggatacatacatggagtactaaatgtggggaaaaaaccaattacacagtttgcgtgtaaattgcgagacgaatcttttaaatctaattgcgccatgatttgataatatggtgctacagtaaattttgctagtgacggattaattaggcttaataaattcatctcctagttttctggcagaatctataatttactttgttattagactgcgtttaatacttcaaatatgtatccgtatatccgatgtgataaccaaacccaaaaattttcccccaactaagcaaggcctaaccctggccggtcgatatccatatatcatggatcgatcagcctgttgcattgttcaaggcgcacacatgctatagtgacgtaccatacgttgaaacaaccactactactaccactacgcctaatatacggatggaagcaatggaaaaacggtggccaagcataaagcgggagcagcagaggccgcagcagcagcagcagctatcaccccctcacccactccaattaagatagctcccggccaccccaacccaa

SEQ ID NO: 52110 - DNA, 3070 bp, Oryza sativa
ccctagatagatgaaaaagggccaaaccatggcatatgccgcgcgatccatctctgcgcgctgctgatataagagatccatcgagtagtagccctgttagctagagagagctcgatcgatggagaggatgatggtggtgtccttgccgcgtcctctcttccattcctagtcctttccgtgtgtgtgcgactgcgtgagtagtgagggatagataaaggagggaggaggagacaggccgcgaggatgatgaacgttccatccgccgctgccgcgagctcctgcgatgatttcggctacaacgccaccccgccgccgccgccgtcgcttctcccaatcatggaccaggacggcggcggcggtagcatccagagggatcaccaccaccaccacaaccaccagcagctcggctacaacctggagccgagctccctagctctgcttcccccttccaacgccgccgccgccgcagcacaccacgccaccatcgcccacgcctccccacatgacctcctccagttctacccgacctcgcactacctcgccgctgccggcggcgccggtggcggaggcaacccctacagccacttcacggcggcggcggcggccgggagcaccttccagtcgtactaccagcagccgccgcaggccgcgccggagtactacttcccgacgctggtcagctccgccgaggagaacatggccagcttcgccgccacccagctcggcctcaacctcggctaccggacctacttcccgccgagaggcggctacacctacggccaccacccgccgcggtgccaggccgagggctgcaaggccgacctctccagcgccaagcgctaccaccgccgccacaaggtgtgcgagcaccactccaaggcgcccgtcgtcgtcaccgccggcggcctccaccagagattctgccagcagtgcagcaggtcagtgttcatcgtcgtgtttagtttgctgctcgaattcactattctccgatccactgttcatcgatttcccagaagaggatgctggcccgatttaatttgctttgtccgattgattggtttaattaatgagacacacatcttgttgcggcgtgtttaatttgattggagaatatgatttgtaggatcagagagttgcattaattaagtgatctggaagttccattctgctcactattgagatcatatcgaagggtgaaactttaataataaatctcctaatttaactacctaggatttaagcttttctttttttttcatacaagtaatttcagctcatcattagccgcctgtttgccctcaaagtaattacgttagttggaacagtcagatgaaattgaagacggcaattgctttgaactttaattggatgtgtggtaccatctttggcctcttttcctgagttcttccggttccttgcctcatgaacccatgagcagttcaatgcttgctctacatttgcccagatttccttgcctttacatttctttgaaagagagatttcttcctatacaattatctgattcttaactgcttaaactgatatttctagtattttttgatgaacaattccctaatctgttctcagaaatttgagctaaattggatgcatttagcaagctattgctgcatatttgatatatacgtttagccgatttcgcaattagctatggtgaggagaaaattttgcacccattttatattattgcctacactgcaggctaattaagataattcgtgtactatagttattaatctgttcggacacaatatataaattttgaattatcgctgttctgaacacataaacgttcattcgctttgcaaaacaaaattacaaatagtatgcgtgcatgtttctaggtttacccaggtgatgagctagagattcatatgccatctttttctttctttgtgtttcaaattaaagatctttctttggagaaaattgtgtttcaaaatattgatttctgtttaattaaattgaatcctgatcactatctatcacatgctgggacttgggggggaataaccaatatctgtacaaatacatattgatcttgtcctagatagagttgcttattttctcctcctttggttattgttccttgaaactagcccttcccatttatttttcttgacttctccttcgcatgtttgagtggttacttccaacagtattcgagacgtctgtacatgtattttggcctcacaaagtcagaaacaatgcgactttctttgcaagtatagcaaagactttgtacagcccgctcacgtacatatgtacgtaccagcacaagttgcatttgcaagcaacgtgttctttctctctctctcattctttttttaccctgaatgtgtggccggccgtcagtaacatttacctcactgagatgaacggctcggattgattgagaaactgaagaagaaactaccttcgatgcctcctaagcatgcacgtgttaagctcagcaatgcatttaagggaaaacaggaaccttttgcagtatggcacaccatatggaaacactccatatgagtcagctgcaaaactccaagctgtctctgggatggaacagtttaggtgtatgtgcttctcgtgctcaggatcatcattagcttacatattggtccccagaatgttcttttcatcagtagtttcttctgaactgaagtttgatctggcctgagcaacctgtcattttgtcttcgctaatgtgcacgtttatgtaggaaatatgcatgcaggatcatgcaacaagcttctcaatcgtagaagtagtacttcatcttccatatcctttatcgttgtaccgtagtatttcatgtgtattcgtcttcagctcttcgtagttgcatgcatccctctcatttctgtatgttaaccttttctaacctgttcaattattcagattccatcttcttgatgagttcgacgatgccaagaagagctgcaggaagcgactcgccgaccacaaccgccggcggaggaagtcgaagccgtccgacggcgagcattctggtgaaaagagaagggcgcaggcgaataaatcggcagctactaaagacag

SEQ ID NO: 52111 - DNA, 18476 bp, Oryza sativa
taagatatgatgcatgaatgggttcttaatctgttcaattcctagataattaaccgatattctacaccatttccttcataattgacagaagcaggaagtagcagcaagaacgcaggcattggagacggtttcgagacacagctactggggggtgcacacatgtccaaagatcaagaccaagccatggatctgggagaggtggtgaaagaagctgtagatcccaaaggtaaggcatcgatgcagcagcagcagcagcaagcacatcatgggattcatcagcagagccaccagcagcatggcttccctttcccttcgtcgtctggctcgtgcttattccctcagagccaaggagctgtctcgagcactgacacatcaaatatagctcaagtgcaagaaccaagcttagccttccatcagcagcatcaccaacacagcaacatccttcagcttggacaggcgatgtttgatctcgacttcgatcactagtataattaatatttatcaatcatctcgatctctccttctctctctctctctctctctctctctctctctctctctctctctctctctctctctttctccctcgaagtgtgtgtgtacgtccagacatctcttttcatcttgtctctattaataactgtaattgggatataataatgatagcttatgcgttattgtcatgtgtactggcagttttcctcgttggagaagctggttaattagccggtacatcaaatttagtgtattttatagtttggtgccacaagaggctagttggtcaattaatttcatctaggaagaatgcaccacatgaaagttgtacgaatttctacataactacctgaatttttcgtgcaattgcacatggctagatattgtagttctttgactatatatatatagttttaatttattttctattgtttttgtatttatttccaaaataaaattgtatgtcttatacaattgaattacgcatcactctaacatatatatgtacaaaatgatctacatatctttgtaatatatggatataccctgatcaggaaataaatagacatttatatttttaatattatagtcgacatataactagatagggcgctctaaaacaactatccactaccttttttttcatcagcgagaaaattttagtatagtctaaatacatgacgaattgttaattttttgtttaccggaaaaacagtgggggaagcctccacggttaaatttcatatatattaaaaggaaagaaagctgtacatgtaagaatttgacaacttaatttgttaactttgcaaggttaacgcacaatttgcttaactttgctattttccgcgacatgattctctttgttatcttgaacatataatcgcattgtccatcatggtccataaaaattgtcttatatacccatatatctaatgtcaataattgaacgtagggcgcacatcaaggcacatacacatgtacgcaggggatgcgataaccgaaaggttcatggtcgtatataataaacaagttaggccagaagagatatttactatacatcatccatgatctgatgacgacaaatatcccattgtattttaattatattatcatttatcaaaagcattcactgaatttagttggacgcatggttacagtggaagccaaacatgatcaaatcacataatcgtatggccctgaattttattttgaaacaacccgtacaaaatagtgcgacgtttctattgatagagcaggaaaaaaatacaagtctatatccctggaagactatagccagaaaaaagaaaatacagccacaccacatgtctacgtctaatcctactgttagaacaaaacaaacacacagcacccctaagtaatgggtcttctgaacgacgcctccaaggagggaacgacgccaagtgtgccgccatcgcccgtcctgtatctccaggacgtgggttttcacctaaagaacccattgggagagggaaggaaatgcagcaacgccccaagggggaaagcggcacccataggcgtcaccattgccagtatggccctgaattttacaattaatcataacttgttccaaaggtgcattcaaaatgtttatatatagttgatgtgttgcatggatgcacacacggatcaagactataagatcttcagggtcatctctattaattatatactacatttttttagaactaattatatgcacactcactggagttatctttataggattctaagaatctgatgaaaatgtttagatctggccttatccggttatgcatatcaatttacgacaattgattattatcaacatatgtttccagtacatcccccaatggaaaaaaataaccacaagcaatataatagaaatagtccagttaaatttacaccaaaccatcggctaaagttcctagttctaactgctactatacgggaattaaattgaatttgttctttgttagaggaaattcgaatttctatttgaacttacttgtactcgaggattgactacgacatgtcctaaagctagccagttctgcacaaaactttccaatttagtatttacaacgacatgtaaaaggagtgaggttttaaaagccccacgttttatagtcaaaattgtaaaataccacaggtgttatgacttttggcatttaaccatagggttttgtggtttaaatgtttcataaacccgccgtcattcataatttgattaatttcagcatatttggattttctttttttaaaataaaagttgtgaagagtaaaactatcagctttagtaaaaacttaataactaaaaatttcatatgaagttatactgatagttttactcttcactactttttagaaattcaagtaattgagtttgtgctcaacatgtataggagtgaggttttgtgaaactttaaaaccatttacctagcgactggagttatgagccaccagtcataatatcaagggctttatgtaactttgactcttaaacatgagttttctgaaatttactcgataattaatgatattgtgtttcctttactttctctaaggtaaattgcacatgagttttaagtgcaatattgtctcccaacaattaaattgttgtttttatatcacgggttcaaaacaataaatcctttgatcaggattttttgatcatgtaactgctagcaaatcaattatcctcggctaaggtcgttcatatatgtacatagatggaaatattgatccagggtacatgcatgcatatgcccatgctctctttgacgtcatccatagctactatttatgatgatacatctatgtaaactaacgatagacctggtactgtaacttatcttaaaacttgatcattgacgcatcatgacttcatgaggtagcgtcagctacacagcgcatctagcactgcatatcctttgctcgttactatttaattgacattgtccggcatccattccaacattatttattaagttgcatgcaaccatttcatccaaaaacggaattataaaatgcaattagggtaggggggaaatggccctttttatttgtccttcgtacatagttactcgtacttgcttttagaaaacaactaattaagctgtactatatatttgttttgggtaacagaacaaatattatgttcggatataaatacaacgggattaaatcctaaatttaacagtggtgctcgtacttatggttaattatttttaagttgtaggcaatgtatgcatcgccaatgagacagctatagtgactttgtcaatgttaggatatgatgacttagtatttcaaggtgtttatacggatatggtatacgtgtgtgcatttaaaggggcaggcgtttgtgttttttaaaaaataattagtgaaattgatattctctagataaataattgccttttatcaaacgcattgatgtattttgtcaatttttgtgtgaatatgtacttaattattgagagtttggaagatagaatatacatccccgacatctacatctaagatgcacttaaaacttaagacccatctgcagctacaaatgcatataagcagctcgtgcggccggtttcttattcactctatataacttaccaactgcatctgtttctttttttaggaaaaggtagaacctacatattaattggctattgttttggctcatcaacctaaccgtggaacttacaaaggatcgatgacgaagctaatttggttacgggcacccggttgttgaaagttgacttatgcacacaactaaccccaggaggcttaatgcatgatcgatcagctagcttggcctcatttatgaagtagtgcaacgagagctaggcatatgaatgccagatcaacagtaagacccctattatgtatgttgtaccttatattctggtactagcagattcatttggcaccattaattattagaggagcgtacgtggtgttgcagttatttgtacaggtacgtacgtagcttgcgtttgcaatttagctagcatatgcagctctctgcaaggcactgtaatgcatggttggttcatgtgagagcttagctaggcaaggtttagcctcgatctgaagctatctatacttgaattgaaggacatgttgggtgctgtctggtcggtaattgtcatgctcatgcaaatatgcaatattttcacagaaagaggccgcccaacctgcggctgtttggtacacagctggcatgatcatgcatgtagtagctactctctccgtcccaaaaaaaaaagataaaccctgggttttcgtgtccaacatttgaccgtccgtcttatttaaaaaaaatattaaaaaaaattaaaaagacaagtcacacataaagtattaatcatgttttatcatctaacaacaattaaaatactaattataaaaaaatttatataagacggatagtcaaacgttgaacacggaaactcagggtttgtcttttttttttgggacggatggagtagctagctagctagaatccaatactagttcacgctttgcgaaggaaagaaatcaagaaagtcgatggccgtacgtacgcaagatcgatcggttaattgatcgattagccgatataaattaggccaattgattgcacattcatgcttcttaagaaacttaggccaggtgatcgaggagagtgagagtgtaagaatcagctgttctaacttctaagtaattaactagtgaaaatcagaaaaaagatggttccccatcttctatccttttattttctgaattctaaaactatatattctcacaatcctaagtggtgatctaaactatttgggggagagctggagattaatttgaaagaagcttcccatatcagaagctcagtagtgtacacggccttcagtactaactccgcccgccaccgaggcgccgatcgcctcctgcaggcggcgtcgcacgtacgtacatatgcgcggcgtatttctgccgatcggtatgcatgctgatgtggtgtgtttccgaaggacgcaaccgcgggcggccgcactccgcgcgcgcgggacgacgtcccctcgtcctcgtccgcgacccggccgcgtgagaatccgtatttccgcagccagaatccgttcttggcgagaagccaacgcgcgcgctgcgcggcggccgggtaggtggccgggcggagaggaggcggtacgtacgcgcgcagatacggacgttgcgtgggtgggtgggggcggatcgatcgggctcgccgccgtataatccgtggagggatttcgtgcatgggatcgtcacgtacagtaccatacacggacgtactcacgtcggtgattaattggtatctttactaaccgctcacgttttcatcattgttttgattgtgaacctcgcgctacctgcaacaacgccgttttctgggccgtagtgtggcctgccacacatggcctaagctcaaattgggccttttgagagttacattgcaccgtccgttttcccgcggcccaaacagcctgtagacgagaacctccacggcccacggtctcggcatgtgagctgtgaatttttgcgataggtgcgggtgggaataagttcacctcgtgaccctcaaaagtgatcgaaatataatccgtgaccctaaaccacaaaactagatatcttgaccctcaaactcttaaaactggtgcaatttgactacctgaacggttttggatggcggttttgctgacatggcatctacgtggcggtattgaccgggtatcctttacacgtgacgttgacgtggcacttaggtggcattagaatttaaaaaaataattcatttatcattcacacagaggatgacatgcggggctcactgacatggggacccactgacatgtggatcccacatgtcatcctctctcatccccttcctcctccctctatctcccttctctcattctctcccctagcctctcttcaccaccggagcggcaatggggatggcggcggcatcgtcgggtgggagctagagcggcagcggagacgacaagggcggtagatgcagcggccatcgacgtgctcatgctggacggcggcggcgaccatcggcgagcaggcgggtgaggaccggcgagggtggtagatgtggcgaccatcggcgagcgggcgggcgaggactggcgagggcggtagatgcggcggccatcgacgacgacgggctggagctggagtggcggcagctgcgcctaccgctgccatcgccgccgcctgccgaaggggaagagaaatcgtcgggaactcgtcgctcgatgccgccgtcgccggggtggaaggggccgagcctgcctctgccgctctccgtccatctccggtccttcccttctctctctctcttcctctcccccttcctctccccctttgctgcgctggagtggcgggcgaggccggtgaggcggcggcaacgacggacaagggctggagcggcgttggtggcgggcgagggccggagcggcgacggcggcgagcgagggccggaagagagggaggagaggcggcgcctcccgagatttcgcccgcccaccgcccctcgtacgcccgtaaagccgacgactaccgcaatgccgacgacattgtcaccagggtcccctcctacgcctgcacccgccttgccctcccgccgccaccgttggcggatcccgcgcaccactgccgccgccactggcccccgtcagccgtcacacggccgccgctcgccgaagggaagagaaatagagagggggaggatgattttatgtgggcctcacgtgttagtgggtcccacctacacttttggtggatgacaaatgggtcccacacttttttttttatttctaatgccaactgagcgccacgtcaatgccatgtggaaagaagaccgagtcaataccaccacatagacgtcacgtcagcaaaaccgccatccaaaaaccgcccagggagtcaaattgctccggttttaagagtttgggggtcgagatatccagttttatggtttagagtcacggattagattttgatcacttttgaggttcacgaagtgaacttattccgtgcgggtgtatctgatgtcgtgtcatgtttcgatgcaatcccaacccatggacatggcacgttcccgtacctttcgcatgtgacatgtaacatgttcgacccgtcggcacgggcctgttttgtactgttgcattgcatatgcctttcgtctactagtgtgttccatctcccatcacgacatctcgcagaagaatccatcgatctagcgtgagcatatgcagcatggctatacgtacgttgatccattgataattccaaattctctccatcggtgaataccactcacatcacatgtaacgttctttttcggtggtattcgcgtacaatagaacgatgtcaacaacttctgcaactgccaaaagaccaaaaccaaaccctcagatgtcacgagtgcttttctggtcgatcaccgtgtaccacaccaagctggaacaccaagactaggaggcaaggacataacaatgcatcacccatcagcaccattctatcatccattccgtctcagctcaaagaatcggctacaaaatcccaccacaaaacatataaacaacaaaaagaaaccaaaaataaaaagaaaagaaaaaaaacaccctgcatctgcggccgaaattaattaatcgtagtactactactacgtgtttttctttcaccatcctacccagctaagtactccactttttaagtagcagaagatgatatgcaagtactacgtaaacaagctagttgacggcggtgcagacgcggcggatctcgccgtcggagccggtcttgacgccgatcctgccgagcttggccatggcggcgacgaaggcgtcgaagaaggcggtggagttggcggcgaagaggttgacggtggggcgggagcggcggtcggtgaagaggatctggtcggaggcgaggaggcccttgttgtagcggaggttgttgaagtaggcgttgtcgaacgcccgcggcgtcgacacgtccagcatcgcgaacgccgtcgggctgtagttgatcgggcacacccgccgcatcgaccgcaggaagtccaggttcatcggcgggttgtaccccagccgctgcttgaacgtgtagatccgccgcacgaacttgtcgcagtgcgtcaccccgatcgtgtgcgcccctgcagtgcgtgtgcaccgtcaatatcagaatcatttcagtgagaaaaaaaactactccctccgttacacaatataagactttctagcattaaccacatacatatagatattaataaatctaaacatatatatatatatatatttagattcattaatatctaaataaatatgagtaatgctagaaagttttatatcgtgaaacagagtaagtagaggaagtattgtttgttccggtctgtgcctgtacagttgttttaacctttttactgtactactatatgcagagtcaggagtggctctggttcggtcaaaagttaccgctagtggttgtggtggtttcggttttgtcacaagggtagggcctcttgtgtccaaatctagacacaaagattgtttaaactaagcttaggatctgacaggaccaaaaacattcagacaaaatcgccccagttctcatgtagtactaagatcttttttattcttcccttgccccaacccagcaagggtatttaagattaatcaaatatgcctactactacttaaaaaaaaataagaggtgcttccattgtctgtcaaaaaaccgcccaaaaaaaccgaacgagtgagaaaaaaccggacgaaaaaaccgtaactatccgataaaaaaaggcgaaaagaaacaatctgcgacaaaaaaaccggaaaaaaaccagacgagtgagaaaaaaaccgtagttgtccgataaaaaaagggggcgaaaaaataatccgattccatgcaaaaaaaaaaaggctgaaaaaattctccgtgaaaaagaagagcgacaaaaaaacgaaaaaaataatccgattccgtgccaaaaaaaagggcgaaaaaaaatctctatctctacaacttaaaaaaaagatatgtttccttcgtgcgtcaaaacaaaaaaaattagcgaaaaattaaaaaaaatccaactcctatctgattccctctcagaaacgaaaaaaaaagtccgactatagatccgatccccctgaaaaataaaagtcaccactccttttaagtccgagataccagccaccactcctctcggtttcaatttataccgtgatatctctcacatcttggtgaaacaaaatgatgtgacggattgaagatctgtttacaaaaacggaatctacaggtcgagagcattccatttttatattattttaatttttggtttgtacttttgcatttgagtccctataatttttatatttacatttgagtccctataatcttacaataaggtatttgaggtcgtttttgttaaaaataataataaaagagagataacaaaagcagaaagttgcataaaaagaaaaacaacaaaagttctgtttcccataagtggcgaaaaaaaccatagatccgaacgaaaaaaaaatctgattcctataaaaggcaaaaaaaaaaagtggtgaaaaaacactagattcgatttctttaaaaagggaaaaaaagtttgattcctataaaggcgaaaaaaccgaaaaaacatctgacaagtccgttcgttcgatcccctaagaaagtggcaaaaaaaatagttcataaaaaataaaaagttggttcgtataaaataaaaaaatgcacactagaaataaaatggaaatgacgaaacaaagtccgatttctaatcaatatatatctcttctctatctctaatataatctaactatttaaaaagagaaaatgcacgagaaaataaaaacggttcaaaaacacgcgtgagaaaaaagtaagaaaaaagcgcaaaaaaatacgctaaaaaggttttccatcttccataaaaaataaaaaaacacgcgagaaaaattatttccatcattggtaattttttaaaaaaaacatgcgaggaaaaaactgtcagaaaaacgcgacatttctaaaaaatggttttagaaaaccgcgcaagaaaaaaaacagcgtctattaaaaaaatcactctaagaaaattatcagaaaaaacgttaaatcgatggacgcttgagtcggataggatccatcgatttttttttgccacctactacatggcttttattccgtaatatattctcatgtattggaaaaaagcaaaaaaaagaacatttgaagaaaaaacaagcaaaaaacgcgcgagaaaataattgtcaaaaaaaaggcaaaaaacacacgagaaaagaaaatgaaaaaaagggagaaaaatatggtttttgttgtaaataaaaagcaaaaaaatgctaaaaaaacttttagaaagaagtgcgtcatttctgaatggtttgagaaaatcgcgcaagaaaaaaacaccgtttataaaagaacaaaccgctcattaaaatacaaacattgtcattgacatgattattaatgaaaaacttatattatcattagaattttttcacccattggaacgcacaaaaggaacagaaaaatcttttaaaaatcctctacaatgtactacttcaatctatcctaaaatataagtatttttgaatcttgacatagtctttgatatgctactttaactaataatatctataaaagtaagatgatctaaataaaaagacttacatattacgatagtttgtttaatgataaatctaataacatcaattttatatgatttatcattttattttatttttgctattaatggtcaaaatagaaaatgtttaacttagcactattatgaaaatgcttataatttagaatggaggaaatactccgtagtacactttgttcttttttctgaaagaaacatgcgtgtgttttaaaaacagcttcggttttatagtagctacaaagaatatttcatcgctttctgccggtcttttttacatctaaatgtgaaattccctgcaaagcaagtactactactccacgcttgtgtttttttgtctactttgctttataatcaaacaaaaacaaacgagcctcttttcgttttcgaaaagaacagatgaaaccagtataaaacagcgaactgctttgtcttctgttgcaaacagaggatatgtcactcacgtgaagtgcagaggccacgaaaaaaagatgcttgcactgcgatcaacctgctactaatacttgtaataaaaaaaatgcaaccctaacgaggaattgttaatttctgtgggtaaccggcaaccatgctattgtcgcctcaacgttcacaaaacagtaacctgatgctttttcagaacggctagtatcaaccatgtaaaatttctccacgtcaatggaaattttgaggcaggaaggaagaagcttaccggaaagcgcaatcatgtcggtctgcgttaggccattgctggcgaacaaggagttgagctgatccagattgaagccagggccgggcaggacgtgcttgacaatggctctgttgaacgtcttgccgtccagccgtccgagctccacggagtagctcggcccgccggtctacaacaacacaaagcaacatatcatgcaatgtcagtaagtgaacaaattagcgaatgcaacgcactaacatctctgcttcaacggcaatcgttacttcattattagcagtttcagaatgcaggtagatatgcatggcttgtgattattcagcaaccttttcttggctctccgagagaactgttaatacaacgtcatgtctagatgtctacccggtggaaattttgtctgcctgcttgctgagaacgaggaaaatttccagccttgctctggcagcgcccacgagcccagccacgggactgtttttaggcaagggtaatacggcaagcgtcacgggcaacacggacaggagcagcgtactacagttcaggagaagtatttacccagttggaccgaggttacaatttagaaaccactcctacgggctacgagacgtcgctttcgcagaaatccatgccgcagaaaaagcaatactcgttcaatagagtcatcgtacgctcaaagcaatactgtgcaggcagtagccgcagtacgctcaaagctgttgccatctcaaaagatagcggatagccggagacacaggaggagaatacccgcctcgtacgctcgtatgctcgggcgccccgcgccccgccactacgcgatatcgcctatcaaacccggcgaatgcgccacagtgcgcgagccagcaaaccacgaccgtgcgcatgcgcaatcgcaagcgccgcgcggcggtttcctcgcgcggaagccgaggccgacacggctcacatgtctccgtaagcgactttccccttttctttctttttttcgtaggagggggccaaactgcgaaaggccagccagccagagcgaccgaactaaaccgaacccagcacagcgcctgcggctactgcctgcagccactgtgcgggtcaggctgtggagacgtggagcaccggaaccaaccggggagacatggaccatgcgtggctcgtgtctgcggtgtctcatggccggagtcagccatgactcatggccatgggctcacggctggatagatcgatcgatcgatggtccagtttgtcaaaaaaaaggggttactggcgcgctggatgcaacagtagctccgtcggccccacctgtcatcgcaccggcgtggtgggcccccggctgccctctctgcttaaaagcgttagcacttgcaattgcaacgtactaggagtactccacacacaggatgatggggagtatgaacgctagtactactacgccgatgcttgagcttgccaatcagggtgggtccgtgcttgctggcgactgacaagggcgtgccctacactacagtcgagccggcggtacaccgcattgtagtactagtattgttgaacgcacactaggacgtgacgagtcgcgacaggacggggatttgtgtgtacagtagtgtttattgttaccagggagacgacgtcgcgggcggccatggcgaggatgtccgcgcaggagaccttgccggcgcagccggggagcgcctcgaccgccgccttggccttgttgatcgcctccaccgcgtccggcgacagcgtggcgtccgcgccgctgtggctctcgtcgtcgccgttcggcgccatcagcatcaccgacgcgtcacacccctgcaaacgcaaacgccgagaagatgaacacccaaaacgccgagagaccgagaccgagagagaggacgtaccctgacgaagcagtcgtggaagaagaggcggagggtgccggggccgacggcgaagctctgctggaggtgctgcgagatgacggaccggacggtggactccgcgttggggcacgtgctgccgtagtagttctgccgcagctgggccctcgcgccgccgccgacgcccacaagcgccacgaatgccacgagcgccgcccgcgcgagaagccccatgccgccgccgccgtgcgccgccctggccatcgccgaacaagctcaggctcagctcggcccggtgtgtgtgtgacagcgacacagtgtgtggtctgctttgagggtggtggtgggacgcgggagcgaggagaaaaatgcgggagttcgggtggcaatatatagcaggggtttagcttgagaaaacaaaggaaaaaacgggcgatgtgggggaggaggagccggaaacattacggcgggaatcgagatagagactgtgtttagatttcggttaaaagtttaggtgtatcacatcaggtatagggatatacatttacatttgaagtattgaatatagattaatataaaataaattataaattccgtctataaaatgtgagatgagtttattaagcataattagtttattattagtaaatgattactgtagcaccatattatcaaatcatgaagcaattaagatttcatctcacaatttacatacaatctatataattagttttttttatatttgatactttatacatgtgtcaagtatttgatacgagcggatctaaacagtccggaatcatagaagtggttacgatctttgcgcagatgggacggaatatctttttcccttttccggttatcgatgaactgaaacatttttctagcgctttttttttgtgcggcgtctgatcagctttggtgcggggctgactcagccaacctagctagattgggggattactacgtgcatttgccactgacaccgtgtgatgtactgcaacaactttacttgtaagattcagcaacgaaaactaaagaccagatagcagcacaaagccacagaactagggtacatctactgtagactatagcactgtataagtgtacatctgaagaaaaaaatacattgtactccgtataattgtacattgtatacgagcagcgagaaaaaagaggtcgcgtgcgtgcaccaggtctaaggtatggctactggggcagcagctagcatcgtctcctctgcagtgagctgaagaaccctctcggcttgcacgcatattcagagtagctaccatccaaagctttctcacatggtctcgttgcgtccagcttgtggccagcatgcacctcacctccctccacctccatggcatggcagcaatgccgtctccctttccctgtctccgctacccaaggcgcaccccggagaaaaatacaagattcacggacatgttgcacagaaacacgcccgctttccctgcctatacatttagctagtagtatacaataagcaacactccagcatcgtcttcggctgtgaccaacttgtagcagcagcagtgtactagctagtgtctgatggataatggactaatggtgcaagcgtttcttccgcaagtttcgatgagattgaaaccatccatccttggaatgatggcagcaattagccattactgggaaaaggtttcatttcgtttgagaaacatattcagatgaagcaaatagacatcggtttatctgacagaacaaaatatagggccttcatgaacctcttgcttaatttgttgcaaattgagcaagatgtagtacttgttaatttgaccctctcagaaaacaactatggaagcacacaacagttaacactagttaacaggatagaaaaaactacaacgccttcgacccataccttgggtgcagaaaacaaatcccacatctgagtgtttcagaagaccaacatgcaatgcgagtggtgcagtgcaggggagttgttttcttgggggaaatgggtggatcagtggatgtactcaaacattggagaatggagaagcaaaccttactattagtatgttatttaccatggaagcaacttgacagtgtagattaatgctatataagaccttctctggaccctctacactctagtgcattggacgtgttgttttgtagtgtctcgaacgggtgcatctgcggtctgcatcctcgatctatcacaaggaaaaagcaaaaatatatgctttgtttatttcaccaagcagaatacgagggattctggacatttctgccggaatcgtctcgcctcttgtgatagctggtgtccatgtcttgtgttaaactactgcacctccgtgtgttctctctcggtaacgtttcctgatactgccaatgccaaactgtttagcctttactcgatttacactacgtatgaggctttgagaaactctccaattcaggccctctctgtcactgtaaaatgcaaactgactgactaagcttttcttcacataacttgtgcacttgtgcttgaagtatgggacacactcagaatatgaggaacaactgccatatcttccactaacggctggctggccattccatattgaacttgaagctggcgaaggtatgtcctgccgatccttcaatcacggacaaaatcctgtcaatttcggcgagccagttcccaagttgccttaaagatgacaggaaatatttcccttcaatcacggagggaaatgttagcaccatgcacgatcagaaggatatgatagtgcacatgtgcacaatgcatacagctagcccatgcatcagaaatacggaactgaccatttgaacaagagaaaattaggaaacaagtcatccggaacccaagcatcatctttacctgattttttcgcgaatgcacaaaaaatttacacgataatatattagaaaaaaccagaattcaaaatacacaacgcaatggcgaaaagagaacacacaatcaagtaatatatagttcgccgtctcaagctcttgagcatagaaggggcaaaccaaatggtcgtcgattccgcgctttaacagaaggtcaatcgtccatcaatgccgctgaactgctaattagaggaagagcttgtgtttagctaggcctttagcttcccacatgtcggcgcaagcaaaaatatggagatccagaaagaagacctggtttaagaagtttccaatggatatggctaattcatagcctgatattattaactcctgaggatctttttaaaaagatagtagtatacctcatggcgtgtgaaaggtctcaatcttttttatgtaatcagcaggccaataaaattgcgaatagtcttgagtgttaactactacttttctttcgatgaatttctgcaggtagaatttcaggattagtggattacacatcccccttcttcccatagctgtactgaaatacgaatgcaagatacctctgtttacataaaaaagattagtgccttttcacgttcatttctcagaaagagacgaggactagcatgcagtacctctgtttgatgcaatagcctgtacaagcatccagaagtacggagtacttgtgattttcattgacaacttcagtctgcaacaaagagccagacggtagatgtcaccgaagtctctgaaaactaatttgaccagtgttgtcaccttttcctacagctttgggttcagcaatgcatgatagtatgtaccaaaactgtactccctctctttcaaaatataaggccatgtttagatgggactaaaactttaagtccctatcacatcgaatgtttgaacactaattataaatattaaacgtagactattaataaaacccatccataattttggactaattcgccagacgaatctattgagtctaattaatccataattagcctatgtgatgctacagtaaacattctctaattatagattaattaggcttaaaaaatttgtctcgcgaattagcttttatttatgtaattagttttataagtagtctatatttaatactctaaattagtgtctaaatatagagactaaagttaagtccctggatccaaacactacctaagtatttttagctataaataaaaataattgtatgtctagattcatagctaaaagttattatattttgggatggatgtagtatggcaaaagcaacatcttgcaatacgttagccacctagagccacagaaaataaaaggtgaacatttcgagtgtgcaacgaataaagatactgcatgtagaattgtgtttcacaactaaagttatctgagtaaagattttttttttctaaaacgaattcatgtcggttgtgtaacataaactcttttcttctaatatactgacgtacaatatttttacacattcgtgaaaaaaattaaaagtattcatgcagcaactgatgataggtactataaatttaaggattaggattcagagtatgactctgattgagccaacttcagtttaggtcccagcgtcttaaagaagcttccagtgcctggttcatcatatatcaaaaattttctggacttcagcatacccccgtgttgctacgtactattcaaaatagcaacaaatattacgctcttgttgaaaaaagagtaaaatccatcaccggtctctaaacttgtatcgatgtttcctcccggtccctaaact

SEQ ID NO: 52112 - DNA, 1402 bp, Oryza sativa
catttcgaaacggagggagtatattatagtatacaaactgatatttgtttggttacttgttgcattccatcatatcatagtcatcaagatatgcttccgcttctgcgcacgcgacgacgtctattccacggcggtcaacaacgtcgtcaattcatcaggtcttctgcaccttttgctctctgtatctctttttgatatgttggtaggtcaagggtagcaagtctgatctactgttgttagtgttgttttcagttcaagaatggtaggctcgagacccaccattggatgctgctgcttccaccttctgaacctgtgcaacagtaaaaatgattcaaagccggggacattattgccaatcgtttcaaagcaaggaaaagagaaaaacagcagaagcagcgtcagtcgcacgacaaattgtctacttatcaatcatcgcaattgtttatccacgtaccaatgcaggcatttccttgaaaaaattcaaccgtggccgaggaattcctgacatcgttgagcatgatttccacaccaaatacatcatctacagttcagattaagaggcaaagatccatccacggtagtataatccttcaaatttgaccaagactactccctgtaccatcagggcttctgaaaatatcgatcctttttctttgtcacggcaaagttcctgaagaaaaacatttgggaaactagccaagcactagcacctagatgaggtcgacgcccatctttagcttccatttttaagatagatgtaagccaagccggcgaatgcatcatgaatgagcaatagttttgcattggttgcgccggcgacaatgtaagcgccatgtactcagcagatagctctacttgcgacacatcatgccattagcacattaatgtatatcctttgccacgatttttcaaatggagcacaagagatgagattacaatgccatttggagctggtagatgacaacggttgtttcacaaagtattcatgcttagctaagactcctgttcgtgtttggttgccatttgtttagtgctgagatcatgtggacttgtttgattaattacgatgagttggctcctgcattcagtgtagcagctttcagatatttcaggccttcctcaaggtgacaaggagatgcactctgaatcattatgctcgtacttacataatactcctacataatgctgtgacgttctgtacgagagttacctgttttctggactctctgcagaatacacaagagattgtttcttcagagcaagattgtttttgtacaactgaactcgcgtcctaataggctgcagcttgcagaattcaggactacgattaaggcaatcaatcgtacactgaagatgatatgacaagatacactcctctgaatggaagaatttaaggaacacg

SEQ ID NO: 52113 - DNA, 11657 bp, Oryza sativa
  unsure (1)..(11657): unsure at all n locations
agcccattcaagtctcagtaaatcaagaaaaatgtgtagaatccattaaaaatggttttgttctctgtttcagtagtcttatagcctgtttgcaatgtttgccttgtatgtcgctagattccggttcttccgacgctccggtgtacttcgaaatagtcgccgaggttcctccagcagcagagcaaggcaagtcatgctcgtcacttgaacatgttgatcctatattgcaaatgctctattgttttccttcaaatattgcattgttttataatgttactatggggtgtttacctattgtcatagccatgcttagttcaactagtgcacaatggggagaatctattaatgtttagactgttggttctaatggtactgttggattagtgccaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttagttagaaggggttatgcgaagggtcctgttacggcctctttccggtatgtcgtggtggcatgtcggcgcacggaaacgtgtcgtggggctgtgtcttgtgggtatagttgtacacctctgatcagagtaaaactattcgagtagccgtgcccgcggttatgggcggtcaaccagattcaccgtgattagtctcaccctagtgtaatcttttgaatttggatagtttaggtggatggttgggcctgtcgcaacgtgggatagcgttggacagtggatagttaataataattaattattacaacggtttaaatctttcaacttctgtttataaatgctcgctttatgcaaatgaaccactctagctctcctttgataattccctgcatcatacccctattccggtatgacttgctgagtacagtgggtagtactcagtcttgctctattttttttcccaaccccagagttcgggtatgtgtcagatggaggtttctccgaggagtaggcttcatccgtgccatcgagggtgcctgtggagtggtgttcccgctgcagttctagtcaaggcttagctcctgttgtcttcctttttccgctgcatttatgtaagacttttatgatgtttgtaagacgtggatctgaatgtcaacattatcgtttgtgtaccccggccggtcctggacggggattttaatgcacattctgcttggaattctattcgggaatttctgggcgtgacaaaaatgcacaaggttgtttgctaagaaagtagaaatgtagaaggtcgtggcaaatataacagtgatgtgttggcaaaggaatgtgatggttcccgaggaaagccgattgtggcaatatgttcatgataggcacttaagaggggggaaatgaaagttaggaggttttccaagggaaatggaagatggtggtggtggatttggcaatggtaggcattggctaaggggtaagacgatagtgctcaaggtgtgtgacagaagggaagtatgcccacagtggtggatctagatattgtggccacttgagtggtgaaaatggtaaggggggggtgtgtttgccacataagtggaagattgtggtggtggatctcaaatggtaggcattggagaaagggatgacaatggtgcatgaggtttgctagggaggggaaagcccgtggtggctgttgggaagggagaagacaacaacatgagagaggtttgccaataaagagaaagtcgacagtggcaaatcaagtggtggtagccaattgaatgaggaacgcaatggacgatcgcaggaggggagcaggtagggaagcacggtagtcagtgggtctttactcttgagagggtgtcggcaaaattaggccatgaatgttggtagtggtacatagattatgtatgagagggcgggcaagagacagagagggagcggagtccttaaggtttataaagggatggaagtactaggaccatattggattaagggagtaactatataacattttcgacaattatttgggtgaaaccttttcaaatataactataatataattgaagtgtaattatagataactaacatataactactaggtaaaaacacgtgtgtggcctaggctagaaggaccggtgttcacgaagcatgtcacaggcttgactctttgatcccacatgtgctagcgaatgttttttattctttacccgcacaaatctcgaggtaatccgacggtcagaaattcaaatgttttagagggaaaaactagccgatgtttttttagtaattctgttggatcaaatggttaaaaaaatatagggtacaatgcttagattataaaaacacatatgcgctatacatcatgatttatgtaaaaaaaaagagccactttacatgcacttcactaaaacaggaggcatgtagcaccatcgagatcctatttaggagagtttctagcggctgcaattttcactagaacctctaactccccaaaacagttgaggttcttacttggtttctaaaaatctatagctatagaatgtagaaaatatactgaaaatccgaagccgggaaaattagctactaatcagctacattttagcatttgaactttctaaacagatcccaaatcaaatttcaggtcgttaccccgttcgacagtgaaacaaaacggtcaatcccatcgcccttgcgaagctacgctgcctacgcacacaggttaaactgctgcagacgcaacgtggcctccattccccgccgacacgttcctctgcacccacccacgcggaccgttcggcctcgtcgaacagcagcacgtactacccgatttctcaagcgcgcacgcaccaaaatctatctatagattgcgtgcgcgcgcgcgtgggggcaaccccaattatcccccggtgtccggtgaggcggtgagtgctacctcttaatactctcctatctgcaagaaccaagtaatcctcctcgttgatgtttgactgtttgtacgtgagatgagtctcacgtggccatggtgttggtgcgtatatcatcccgagaagtatagcggcagcatccatcccatccagccgtccaaaaccttgctatctcttgcagccctcccgtcctctggcacagtatataaagcgtacctgcaggtgcagcacctgatacctgcaaagtgatcgatcgatcgaggccggcattgtgcgtgcgtgtgccaaaggatgacgaagtacaaaggtgtcaggcagaggcactggggctcctgggtcgccgagatccgccaccctctcctgtacgatcatcattcaatctccctttttctgccatgaactaacatgcatcatacggagatgtacgtgtactacgctgacgatgtgtgttctgactggtacatatgcatgtaccgtgtgtttgtacgacgtttgtgtgtgtgtgtgtgcaggaagacgaggatatggctggggacgtacgggacggcggaggacgcggcgagggcgtacgacgaggcggcgaggctgatgagcggcccagcggcgcgcaccaacttccctctcagcagcagcggcggcaacgcccgcagctgcctctccccgaccctgcgcgcgcggctggagaaatgctgcggcgcggggtcatcagcgcaggcgcaacagggcgccgtcgctggccaggacaacgacgatgctgctgcggcggcggcggcgatgggcgtcgacgacggcgacgagtacgtcgaggagatgatccaggagctcacgttctacggctccatagagatcgtccagccctgatctgcttaattagcaaaagcctagccggccaacaaccgcagtgtaacttaaaacttaaattactagagtatagacgtatagtatataaaaaaccttgtgctagctacttctgtgccgtctcgttaggcacattgcgttggcaattagtaggtgtcaatggaacaaggtaatggacgagcattgcagagtgtgcatgcagctagccaggacatctccctgggatcgcgatgtgtttgcaaacaggggaaggggaccaagaatctttcaggataaggcctcctgatttggttcatgatgtgaagttgggtcgggctctcgtcttctagcttctttggatagtactactagtagcactcctgtcttccttcagtcaccaggctacaatttctggtacggcgcccagagagatggatgatgagatgtgacgacgcgacgcaatgggatggatccgatgcatgcatatcttttgtgctagagccccggtacgtcgacgagccgtcgtttccactgtctgctccatttcgagatgtcaatgggggattgcaaaatgccatgaacggagttaaagagggaatggctaggcacaaaacgtagcggagcttttgagccatacaagtggccatgtacagaacaagatagcaaacgaacgcgacgggtgaggcctctctcctatcaacatggctcgcgtcagcggttagacacatctaaggagatgatttagtatgggcaaacagtgcccgtgatggcggtggtcgtgccccaggttcacgttttcaatgataaccgacagtagatttcaagttaattttcaaatggttttcaagaattcagattcgaaacagtaaatgtgacacaaagatttttatcaaaattcagcaaaaactgtcatgctgcctaaggttgggatccggcgctcgctcgaaaaggtgaaccatggtcgtgctgcctgaccttgaaccaacaaacattaacgttacaaaatgcaaaccgtagccgcagttcatttaccacacaatgaatagaatatccgtagtacgaaatactggttacatgtcgagaatcctcagcgtccagcgctgcatgatactgaagtagtacatctctagtcacctagatggctagccatttactgctacaacaatactacaaacaaaccatttgttcttccatctgcacaaactactcataagttttacactgagaagaaaaaaggaggcatctaccagtcctagtaatcacatccaaatcgtgaaacgtagtcagtatgacgcctacaataatacaacatgggtacaaagagtgggtgcacgataaaatccaccgatcaatgctaactctagttaacctaggtatcattatcataccacccatttgggccgttaatattagtggtatacaaacaattgtgggtgcagtagatgctcttctactttgctcttcctctcgtgcctcggaccacccttttccgtcctcgccgaacgtaggctggttttgggtctacctgcgcaggttcttctgaattcaatcgtgtgccattctccacagaatcaccatctgcggcatcagctttaggatcattaacctcgttattggtgggaggcacaccggtgctcgagttggtgcaactgggattatcattgcccgaagattctacccccgagttggcatttgattgatcccgaaggctgcagtagaggaaacagacgaatgccaaacatgtcagtccaaaacaacaacaacaaaaaaaaacttctgcacttgaaatataagtggcttgtgcacattatgttacccattggcagaagtttttttggtcgacccatttaagctcgcatggatgtggggacctgtatcctttgttctcaactctgaagaaagtttgaaaataaaccacgataagcatgcatagtaggtactacattcaacttagagagaaaaacatctaaactaagatcaagtcagaaacagaggaatcatatgcacaatttctgctttagcttaagtgatagaatcagataagacatttcaagccttcaactaacaaaaacaagaagagatgttacaaaattcattcatatttacagtagttctgagtgtttggtgttatatgacctgaaggattatacccttgggtcaatgctcaatagtttgtactgtcatccaaagcttcagaaaaagcatagctgtgctcttgtaagtcatttgggccggttgctggacctattcaggcaattttgtttttctacctatgccacagtttaactcagatggaaatcttgaagaacaaaaccatttgtgcaatcgaaattgacgaagtactaaccacaaatagcacttttttctgcttttcttttatgcaaatcaaccataattgcagacaagcctgtttgattaggtaggatttctctctaattaggcaaaatccagtccttcccaaaccgttgtttactagttagctacaatatttgtcttccttattccttaaaaaggaagctgttagcttccgaccttaggtaggagcagtagtcatatgtcgcctacttgatagattgaccaaaatttaattgcatctcgtcgggccagcgtatgccggacgaattttattaagcttgggaaaagagttataagctacatgttgcaacgaaagccaaccaacatgatcccatgcaactggaccacacaggaacacactggcaaatgacagctacaggttacaaaccaggacgctacatcggcagctccttgctgccgcaaaagttaataaaatctgaaattatacccacaacatgtggtttataaaatgtagtgactgactaggaaatacagttgccattagtatccaacaccttggagttccaaaacctaataaaatcatgggttgtgatcattttcagggcataaaacaaattacacaatatcagcttggtctctataagttacaaaattattgcagtggagcagacgaacatgattcaaacaacaaaggagtaacaagagtaaaaggaacttctccaactacatcagatcatgcaacaacagagattttattggaagttcagagttaagaaaaatcaagctgattcaacaaaaagaataaaatgcataggcacacgagtgaaataacacacaaaccatggcaaaattaatgtcagaaaagggacaccacacaaacctgacgctgagtttatatctgactccatgtgaatttccggttctgcaacaggagctttaacatccccatcacggtcagcatcctttgtaacactgagacaagacagcaaatatcttctttgaggaaccggctatttgaagaaacatgtgttcaatgacaaaatgaacatacagaaaatatctccataggacccaaaaaaaacaagttcaatttcaaaaaaaaaaaaaagttcaggctacataagggttaagaatgaaacgcagcacatattgagagcaatttgtgctggtgatgtaatcacaaagcttacaactagatgttgcaagtgcagcaaatgttagtcattttcaatgcaaaagctgaccttgtggaagatatttggttcccctgtgatatctcctctgcaccataaacaacaacccatgtaaattagtccaggatatgcgtaaattttgatttaagtcatatacaaaaattatacaagtcaaatagctgacaatattttttatcatcaaagaacacaaacaaatagtgaaggaaaaggagagtctacctatatgaactttggatgcagcattgcattctttgacaacattccctatgtcatttgcagggtccacaggatcaacaaacaccttaagattgattaaaaattgcaccggtaaataaaaaattgatacttgtgatatttaaaacatactatagagcaatattttgacctcatatttacaaacagataagaatgtccaataagataatgctatacatacttttttttttctttaccaaactcttacaaacgctgacatggcatgctatgagtatatctagttttcctattacttccatctagctaaatcaaacggttgagaactatgtttgtgagtttcgtaagaaccttttgtacgtatagcagcattctttccaatatatctaaattacttccatagatatttgaagttctacaaagttcaggtgagtaaatgacccatcatcgtgaagggcagccaaacaattttatatcacaaactggtgaaagtcaaagtaattttcgcaaaacatacaacagaagcaataagcaatatcaaacttagtcaaatgtataaatacaaaaactaccatgactcacatgatttttatcagtgataggtgaggagtgcccattagccggttctgctcctgcaaccttatcagaacctaaaatatatgaaataaattattttttcaaagccaaaaatttctaagaatgagaaatgatccataatattcatgtcaaggaaagttcaggtgagtaaattagtctcacctttattattttgctcaggtttgtcaactttcttatcagtacccgatgagaatatagatgtatcattctcaaacaatctggaagtagaaccatactgcctgactttagaagcatctggagaacttccagatgatcccaggcgagacctacgagattcctccaaattttcccaaaaattggaaagatattcttccttggtggtgaccttcaaaaggtaaagcatataattatgaagtgaaaatgcaattttagttgacataaccatgtaggtactaactaataaaagaaaagcctgcggcatgccaccccaaaaattcattaactttcagttaattttattccgttccgaaattttataaatatctgcagtatatatgatacatgaccagtagcattttctcaatacctcgtattctacagtagctcaagactccagaatatgaatcaagacagccaatgtagcaatatttacagtatttcctaaaaacctaaaagggatacagtatatccaaaaaaaactgaagttcatcaagctccgaaccaaatgacattatctgaaactaagcatcaatcaacatataataatcaaagacaatcatgcatcccacatttacatcaaggacctagaattaaattgccaatgctttttaacctttgcattacctttgatgaggggagagaatatttggacttcccttcataatcatacatatgtaacccagcagagggtggtgttttaaacttctggctacctaagaatggagattgccaaggaggcaatgactgcatgtatgattttgctaaatcaactggagaacccatgtcagattcaaacccctgcaaaaatgaaaactcataaaggtaagtcaacaaaggaaccaaatattgctgtgacaagcacataaagattgatggctataaagatgagaatgaaaacacattaatactaacagagttaagcatatcagtgtttaatgtgcaagggtcatggtcttcaggctttgaacctaatccctgccttttctcttctaaccatttctttgcttccataactgctgcgcttaatagctcgggcgatgcatggagaggagaaccaggagaaaagctaccagatccaatactagagaatggaactggttcagtgccatttctgtggcgactcaaggaacgccaagctcccgtgaaatcatttccaacaacagtattcctggttggaatttctttcggcgttccatactcaggtgcttcaggaagtgcagcatctgtaactcgtgactgtatgagctttaccattttatcacattcatccctataaaaataaacatgaataattgagaaggaaagtaataggttataaggattttatttagagtaaatttcagataactacaactattttgccaaaattatcagtttactgtaacatgcaatactcatgcaaccatgtgcacctttagctaggcatttcagagaactgcaactataataaaggattttatcagaaagctgcaactttatttgtccgacaagtttttggcccacctgtcacacccatgcaatattcatgctggtaagtcaggcccacatgtcatacacacataagggtgttgctgctttgtgataaagttgtttggtatgattgcggttttgtgatatagcagttaaagttgtagcaaagtgatagttctgacaaaataattgcagttctgtgaaatttactctgtttaagaaaacgtagaatatgtatggatctattcaacataaaattctcagtatctcggcagcacacaccacaggcagaattgcatgcttagtactttgaagtgcaattttcctcatcctactgctacagagtgtctatcttatccagttgcaataatatcatgactttgattccttctccaactcaaatttgaatagttttacccttttaattcatagtaccctatagaattcatagtacaaaaaatcaaaagaagagtagctccaacttaggccatatgcacctatgcttgtattatcagaactgttttgtaaatgagaaataaactagatttctttactgttaaatttaatcgttagcagttgtccagggaaaaaaatatacatctaagcacacatgtaaagaacaatagcattacagttaccttgagaatgtctccttcataaccatttcctcaatggcaagctttgactcattgtatgaaactattgctccatgattgtcttctgtttcatctgcacaggtattacaaatgaacgcactcataaaccatcccaaaaatagttcatctgaatgtgggcagcacaatgtagttgtgtgagcgaacagtttacgaaaggtaaaatggctcaacagaattggaaacactgttccttcatatgcaaaagtacaaaacactgattagtctgcagtgcatccctctaaaatggtctaaggtcaattaaaagtgctgtccaccattacaaagctaaagatcgagcaccttctcaaaccacaatagaactaacaggtcaataacaaatagctcaactattctacattctggaaatatctagcatatgtgacaaaagatggctcaattattttctgaattccaataatatgcaccatgtcatcctaactcgatgttcatgcaagtaactgtggttcccaaatgaggttgattctgaaaacaaccatgccagatctaaattaagccctctgcacctcgtatcataattttcaggacattataaaccttaggatggtggcagctaaccaaatacatgcctttaattttgtgttgatgaatcaatgatggtatcttcgcaagcataccaaatggaagtgtgatgctgctgaagcatcgattgatgaatacagcagccggagcactccacattgtaaacttcaaattctaattccacaacactaggactgtgtaattggagtcaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 52114 - DNA, 1563 bp, Oryza sativa
tcatatatggaaatgaatttcaagatctaaagggcatgtgattttatttcttatgaaatattgtaggacagttcccttcaggggacgacatacttaaagacccacgcccaatgcactctctgccaacgccacatatccaatgccctcctcctcctcctcgtgtcttccccatcctcctcctattcctagcccatatgccagccaaaaatggctcgccactcctcctcctgcccttcgctggccctagctcatcttcctactctctacttcctgttgtggctccatgttcctgacgtagccccccgcttcccatcggtgaggtacctggtacctaggtacggacacggcgagagagggggtgtggtttcatggatttggtcgaggatctggaggtggaggtactatcaaccccaccgtcgtatggatgtggagatggtggtggtggaagttgggattcctgatggccatgggtggcgatcaagttctcggagcccatggggacgggatgtggtgttctcccccacgatgatggtagacaagggcctcaccccttccttcttcgaaatgaccatatctggagctttgattggctatcaatgtggtggtatagccatcatgctccttgccaacccgttttgctgcttgtcagtgttgtgtgcaggtatgtcgtatgacacattattcttggttagcacccatgagtatcaagtatgatacccacatgtatcaggcttatcaccagtgggtctgggacctgcatatatgaggtatggaacttaggtactagccggtacccaaaggtgctaggtacgatacctacgggtatcaggtttgctacccttggtatctagggatgaaaaacggagcggatagtttccgtccgctccagataaaaacgaatacggatacatctcggatcggataattctcggatagttcggatacggatacgaatacggatattttctatcggatacgaatacgaatatggtatcaagatttccgtcggatacagataataattcggatatccggtgaacagtgctattcggatatccgcagaagccacaagacatacccaatttctttataactctatgaccttcaatatacctttttagattttaatagtagttcatctcttaacactagtccacattattaatattatttaaaattttaaaaatatttataaataatactacattttatataaaatgagctaattatatatgttgatatttgtttctattagaagttaaattggttttcgtgttccgagaaaaatttgtttccgtattcgtgtccaatcatattcgattcttattcgtattcaagatagtccgtatttgtttccgtattcgagctatccgtattcgtttctgtatccggcaaaaaatataaaaacgaatatggtatgagcattatccgtccgtatccgctccgttttcatccctattggtatctagtataaaggtgtagagagctgggcgcattatccccacctgactagttggcgagccaccggccattggcgcctcctctcgcttttccctttctttc

SEQ ID NO: 52115 - DNA, 3304 bp, Oryza sativa
atttcctcgcaaaaagaaaaaaaagaagtcctcatgctatccacttgtcgatcagtttgactgtatgtgccgttcccgtaaagcagttgtggcttaggctgtgtttagttcctgaaaaaggttaaaagtttgagaaaagttactagtttgaaaaagaaagttgggggtttatatgtgtagcaaagttttggatgtgatgtgatgtgatggaaagttgaaaagttaagggttaactaaacacggccttaatccggcaaccaattaataacacgcgtgaatgtcgtagtacggtacatagatgctgtggtcgatcgagaatcacatcttgtcgatgtcgccgttggacaggggcacagccctgatgggcctgaatgcccccctgattcaatgcttcatcgtagccacgtctcagggtgaacagggtacgtatgcacattgacgtaggtccagcctgtggatcggcaatgcttcatcgtcgtcagagttcaatcggccaggcagccagaggcaggggaacgtggtgtcgcgcggctcgtccgtctccggtctccgcgcctatgttgtccggcgttcgggggaggagtagggtcgccgccacgttcatcttgttgttagtttcctcatctcgatcagtcgatcgcggctgcgattctaccgatcgatgtcaaattgtcaatcatggtgcattgcggtgcagtgcatcgcgcgtccgcgtcaggattctgcagtgctgggtccgcagcagagatacgctccggcggccggtgctcgatcggtcggctccctaacccaccaccgcgtcctactatggctacagaatgcaatgtccgttgtttgtttgctgcttccatgtcaaatgcagtacgcggtgcaggaagaaacggacagcaaaaaccgtcgatcgatggaagaaggctacttgtgtttggaaactcccaacaccatgatcgatcgccgagcagcgagagattgcaattgaaattgaccgaccgatcggtattcggtcaggttcgttcggtgaggccaaattaaaagcggacgtacatgggactgcggggcggcaacactcgtatcatatatatgccgctttccacgtacgctttcgaggaatagcgacggcacgacgggctgctgctgccgctgcgtttctctgtacgtgcccatactccctccgtcaaaaaaaaacaaaccctgatttccgtgtctaacatttaaccgtccgtcttatttaaaaaaattaaaaagataagtcacgcataaaatattaatcatgttttatcatctaacaacaatgaaaatacgaattataaaaaaaattatataagacggacagtcaaagttggacacgaaaactcaatatttgtcttttttttttttgggacggaggacgaatgttgtatcggtcggtcggctggtctgacatttctttctcatctcacaaagtcaagagtctcaggtcatcctcctgcgtcagggagcgtcctcccccgattgttgtgtagccaactgcatttgtacacatcgatcgatatcctagcatctgccgagctgcagccatgcaatcgtcaacatcactgatcttattatgatactagtattatctatccctaagctagcggtgtgtgcgacatcatcgtccattatctgaccaggttggcatgcaggttcccatttccaaaccatcttaccgtctgttactagattttactaccagacagaattttttttcctttgaaaaatagtagatttacagtttgtgcccagaatgttttgttagcatggtaaaagagataggagtaccagtgagcagcaagcaggtcgacagttaaagcggtactccctccgtcccaaaatataaatatttttagcataatggcaagttaaacattattaactttaactattaataaaaaaaataaaaaaatcaatcatgtaaaattaatgttactagatttatcattgaacaaactatcataatatacaactctttttatttaaagcatcttacttttatagatattgttagtcaaagtagcatcttggagaccgcgtcagagtccaaaaattcttatattttgggatggatggagtacctcttttcaacttactctctccctcttttttcttaagcacgttttttgaattactatactctgtgtgggttttaaaaaatatatatagaaaaattgattttaaaaatcatattaacctatcttttaagtttattttagctaatgcttaattaatcatgtactaataatttttttacacgtcggaaggtaaagtttccaatctctactttcaaacgcagccttatagatgtatcgaaaatgcagtggaaaccatgggaatacaattgttagagggtactttcgtcttcgggttcatgtacggtgggaaacggtcggaaatgatatcatgtttatcaaacgattcacggctgagttgaaattttcatatttatcaatttaattaatagtggtgatttgatgcttcaatttcaaattttatatactatttgaattggaacagtccagaaaaggacatcacctttacagaaaggggcccttacagaaacaatatatgctccgctgatgggaattttagtcaccattttcatttgcgtgcagcaaagggaaattgctatgtatatgatccaacggttcgacttatgttcgattgaatttaatcaacagttacaaacgactgcaatacacatgaacatactctttttgaatgatctatgatcgtatgcctctagttgtacatgagttgtacaactgagtcatatgtacatgagttaggaacagacgtggcttcgtggcccagctcgaagaggcccgttggtgaaatggcctcttccatgatcttcacaaaatttcggcctttcagtcgtcagccgaagccagcaaggccgcaaagcctgttccgcgaaaaccgcagaattttcgggcccagcctgttgaaagcgctccacggtccgtcggtcccggttggaggcctggaagtgggttactgggcttgtgatgaggcctggaagtgctccaactgggctttctgggcttggcgctcagtaatgaggccgtggcccacagagagacgaggccaccactactattttgattttccatgggttttagtactttcagcaaattactgttcttttcatctaaacaaaaatgaaactatacgtgttttcttcttcttgatggaaatatatactccctccgtttcgaaatgtttgacgccgttgactttttatcatatgtttgaccgttcgtcttattcaaaaaatttaagtaat

SEQ ID NO: 52116 - DNA, 1233 bp, Oryza sativa
cacatcatctacaatttcaaccaaaatccaaactttgagttgagctaaacacagccgtagctaaaaatatgcagctttctcatcagttacctggaagaacctgtagtaggatggatggatggatgagaatgggaatagttctagtcgagtgatttcataggcctcattgataggcattggaaagagcgaggagggcattaaatcattgcaagatttgagggacaaaagacgagatgctcgatccaggcaacttgcatgtggaccaaaccatcagagctccaagtgggtgtgtacgttgtgacatctgcatatggacatggcctatgaagaaaatggagccattgcatttgccttgcatttgccctagttgacccgggactacagtctcatcggctgcacacattacacgcaagaggagatcaggagcatcaaatagggccggtttagttcacgaaaagaaaatttttgttgtcacatcggatgtttgaccggatgtcagaaggggttttcggacacgaatgaaaaaactaatttcataactcgtttagaaaccgcgagacgaatcttttaaacctaattaatccgttattagcaaatgttggttaccgtaacatttatagctaattatgggctaattatgctcaaaagattcgtctcatgatttttcccctaactgtgtaattagttttttaatttatctatatttaatactccatgcatgtgtacaaagattcgatgtaatgtttttgggaaaaagtttatgggaactaaatggggagtagtactactagtctgcattggtgatggtattctaaacctgattgattagtacgtgtcttggggcctcccaatcccgtgaagttgcttgtgccaatgtattcaacactgagtattagtttttcttttctttctgaacttattgttaattaggtcacgagttgatttatttgctctcacaacttctgggagagttactctcagccgctaatcggaaaacgagtcaaccccgttgaaattcaggttgagatctgctcgattctgtgatcacgatagaactaaacaaaacctggttaagaaatggagtactcctaccatatcttaaggtgttttttgtagtgtctttttgtagcctcggctcgatgattaatggtggaacgaaatcaggttcggtcagccgaggtgttctctgaaactcccgatccttaattcgttcaaaatattcaaattggatga

SEQ ID NO: 52117 - DNA, 2066 bp, Oryza sativa
caaatatgactatatatgttgttcaaggaaaaatctagttactggtaagcactattttgcacttctgatttcagagttcatgttttgcaacaaaaaaattccacatgaacaaaaacttgtacaccatactaatatatttacatttgagaaatcaattatgttgttgctcgactaaccttgatgacgctgcgcagcttgcagctgcaagccccgtaacagtgctccgtgccttagcaatgccaaccgaactaattgagatcccctgcagtacatgcagtactgctcattgatacgtggatccgaggggctatgaggtccacgtgtcaatgatcagtactgcacatgcaacactgcaaacgacctgcatcctgaactaactgagatcccctgtcaacaaaattaatctgaaccgtgtacagtaagatcaatgtaaacttcacaactgatcgatttggattaatggaatccccattcaagcacaatctagctagatccaacaggtgtgtcattggataggaccactatatatatgcctatcatctatcagtgagaaggacaagcattaccagcatgcgcatgaaaacaacacccttctcaaaaaaaaaagggaaaaaataaaagagaagaaaatagcatgcatttacttgaactcttcattgagatgcattgtccccatcctttttagctctttgatgagaataactttttcttgtaccatcctgtgcctgtcacccatgatctgatcatatcaaaagggaaatggattgaacaattgtcatgcattagcagcaaacgctggcgaacgttcaaaagcagcatgatagggtgaccacaatgagtctcctctcaagataaaagaagagtatccacatgcatctatcttgacattattgactccaaaatgttaggcataacatgtgaaatgccttttttgtttaatgtcagttacaatcgtagtacaataatggagtaattgcacattgtcaaattaatagtagtaactaaaaatttgagctagtgctggctgaatttccaagcagtgtcatggatttaattagtcattattgcatcacaattaggagtttttgagcccatgcgtttccttaatttgaccaaaaccaaaggcggctgttcggacgaggagagggctttgtgtagccactgtttgggaggcttgacctttgaggtcatccaatcagacgctgacatttgtaattgaagtgttccttgataaaacaggggaaagtgttgggtactgatgttagaaattgtttgtccatatactccctccgtcccataaaaattgcatttctagctctaaggctttgtcccacaaaaattgtatttctagccatgtgggacccaaccaattgattcatatgtataagtttcctttcatcccacataatttgggctgctaatgcttgcaattttattaagtatgctaattatatgggttaattctctcaaacttccttttaatcatttatatatatggaatgtgtgcatgcagtgggttcattaaattagattattgttgtcattttccaatcctactattttgtcctaaattagctagaaatgcaatttttatgggacggaggtagtaattatttattattaccagataacatcgatcatatttattgtttgagacataaattttttacatatgaaaaacttataacaataaattttacagtcatgcatttccttttgaattatacaaaataattaagtagtcttttgttgactttgaaaagtctaaaatggcttcatttcgtacctagacaaaaaaaaatccacaaaacaatcaataggtccatactcaaacttcaaaaaatggcatatcaaactgtccccaccagtttcaacgaatagaaaacaatgcaatattctcacatgagttgtaggtacaaagaaagggcacaataatgaccatttcaaactgtcagttatatttaccccaaagaacacaagaagtccatctcatcttccaaagaaggaaacgggccgttgttttgggtgccatttcgaccattacgaagattaattttggctgcttc

SEQ ID NO: 52118 - DNA, 15937 bp, Oryza sativa
cgtactcacattgatgtactctcaatatccatctggctgttcctgacaagataatctttgtaagcatatggtacggacttaaggatttcccaaaaaatatatatattcctctctatccgtgacctaacaataacacagcaagagacacctagctaaatccaagccctgaagcatccctcgattgctccatccagaccgccgagatggctacaaatttcgagagatttttttgaattttttcctcggatggaaaaaaccagccgaatcttccccgtttttgtacggcctcgcacgcgtatggaacggaattttgtcgtgaataaccgtgaggataaggtgaatgaacgggggtgtgcgatagaagggaagaagggtcgctttttttagatctcaagttgcattcatcgccgaccctgttctgtcctgaattattgtccacaaaagattttactaatttgcatgccaaggagactttctcttctatctgcccctatataagttttttttattttatgtatttttcatataaaaaaagtggatgctgctagcagctaggtgatgcttccgtcacctgcaaattgctcgttgaaaccggctttattcaagtgaattatttgcccattatgtgcaggggattagaataatgctaggggatggtagtacaacgcttggtcggctcttacctctttgagagcagcagggttcagtttgacacttgcaattttatatgtaaacccccaagaaaaaaaggtttagtggaacagatgggaaatagctgaactgaggcagctaggcctgcactggaacatccctgatgaactatttaatttcttttaaatccagcaactacacagatacaatcatgtcttgtagataatacttctatcgaacggtacgcaggtgccatttgggcgaaaataagatagtacttctagagccggccattgtaaattgaacaggaacaacaaatttagcgttagttcatattaaagccaaattttatcacatggatactttgtaagagcgagtttaatagtatagcccactattagctccaattcatctctggccaatctaatagtcaattcgtcatataataattgcttactatactattagtatatggctccacccatcatacatacattttgtcttagattccgtactgcagctgactacatatatgtagcccgtagctcttatctctcatattttattttattaaaatatgtttgtagctggataatagtctgctattatacctgctctaagtcttaaaatatttcgatttagtcttctacagatatgagtgtacgcgcgtgtttatatgggtaggtgtacgttcatactgtgtttgtaatttaatccaccatcgagatcagctagcttcgttcgtccgtgagccgcacgatccacatccatcggacggtccagcttgtaaaatgaatctcactactctactcactccaggcacaacacggacggttccccacggagttaaaaaaccacacacacactgtacacacccaaagcccgaaaacccgttatctctcccgtgatgcggcgtggggcccaccaccacacaccaccccaagtggctgacatccacagctccgtgggcccgggtcccacagcctccctttcccctccccctccaagagtcaaatctccacctcccccctacgcccacggcccaccgacacgtgggccccacgacccagccagccagagtcccagaagttaacgggggcacgcgaacagagaggggggccccgcgcggcgaggtggggcccagtgcgggtatgaagcggggaggcgctatatagagcgcacccatcctcctcccccttcctccctctcctctccactactaataccaccaccgccgcgccggaggtggaagacggacggggtagagttggggtctcgcggtgagccgattcctctctagtggtcgcgcctggtgtgttcgccgacgacgccggcgtcgcgtcagccatgggtgggctcgaggagatcaagaatgaggccgttgatctggtgagaaaatcactcgccgccaccagctacctactacttcttcttcctcgcttcctccctctcgcgtgttgggttgcttaggctttagctctagctttagttcttaccatttttgactggcgatagaaatagtctgagaattgaaaattaatgataccggctagctggagctgagtagatttctgatacgcttaataaatgaaaaggaaaattttccatgtaaagatgagcacggatcgttcgtcgtcggcggcggccttcacgtcacgctctctttctcaacgcggcttttcataacagaaggggccagttgtccatggccgcctgccatgttcttctcttattcttcttctctctcaccctgttcgctcctctgtactgttttgctgctgttcctctcaccatcatcaatttgttcatctgtctccggctcctccttttttttggttgaaatgaaactttttgaaagatcctgctcacatgcgtgtttaatctgtcatgtaggagtacactataccactatggtcacttctccaccaaactatagtataaaaaaaattgaatctcagatctacgcgtaattaaatgcccacctccagttattagtattactcttgcctctactttcctttttttttagttcttcatttatacaaagaagcagtgaacaaatatactcaaatagttcttcagcttcgcaagtactcctactccataaaactatttttcagcttcacacgtaaaattaaaattattcatgagcttcatacgaatttgcatgtacgtaaagtcaaaagtcacttgagcacgggcgcgagctaatcacgcagcggagattagtggctaaccaccataaaggcaagctaaacacacagtggaatccgtgcgtgcctagctgagctgcggccttttttttggtttgctttgttttttttttgttcttttttgttgaccaagcggacagcccaatccaagagcacaacgtataccagccgctgctcgctttatcttttttttaaaaaaaataaaaatagattaaaaatcagtttaattttgggctggttttgttcccttcggctcacgcgacgagaaaacgaaaccgcatcttcccggcacgcatctcaaggacgacacgaggggggccacgggaagtacgcgcgcctcctctgactgccgctgagccgtctgatctccatctgacggccgtactttctccaatcattggccgggcactgcaacccccctgttgccccttggactcttcctcctccgtgtgttcctagtagatcctgaccgcttggctggtaggcgctgacggcgtgggcccacacgcaccacctgggagatattttatctgtcaatgacaggtcgggcccatccaccaatagtaatagttttttgataaggctgtaaattgttcaacacgcgaatctaattataggtcgaataacgagatagtgataattaaggatttatcgctgtactcgcatatcatagacccgactgataaattcttaattgtcacgtcttactcgaataactgggtaacccgagttcttatttctcactctgttgttgctgactagtgtggttgtggcttttgttgttgttgcaggagaacataccgatcgaggaggtgttcgagcagctgaaatgtacgcgcgaggggctctcctccgaggaggggaaccggcgtatcgagatgttcggccccaacaagctcgaggagaagaaggtgcgtgctatgctttgtcaaagccttttgcattctcttgttgcgtgtggttttctttcatttctgacgcgaatcgctcatctttgttgcgtctttttgtttgtgtgcttgtgcaggagagcaagatactcaagttcttggggttcatgtggaacccgctgtcgtgggtcatggagatggccgccatcatggccatcgcgctggccaacggcggcggcaagccaccggactgggaggacttcgtcggtatcattgtcctgctggttatcaactccaccatctccttcatcgaagagaacaacgccggcaacgccgctgctgctctcatggccaaccttgcacccaagaccaaggtgagctcaagaaacactggataggagtactaactaatgcactttgaactggaaaccgaccttaattattccgttgtaccacacaaggctttgatttttgtattgactagttgtcataatagtattatacagtagtggaaggaagaatctctatgtgcgtacttttcggacgggcactttcaattagagtgcctagaaactgagctctgaattgtccagtggatgggtgggcatatattccattattgcaagaaaataaagatagggacccacctcttggacagtactgttcatttggcgtaaataatagcctaggtgttctgcaattgcggctaatttggatattgttagcaaaacaacgtggtctaatttttctgctctggagctggaagtcaagtttctgtctttcatacgtatgatagattgataggtctatgatatcaggaagtatcctcttggacatgaattatttcaccatcacaattctttaactgctacggagctcatcctcagttagctagtcgtccctttcattgtatttttatttaataggataaggggagaaaaatgtggcagcgcacgcacgcacatcgttgtcacgtggaatttttcttttttcgtgcaacttgtcaactcaaatcagccgaaatgaaatgtgttaggtactaggatgtggtcatgtagcagttggcactttggaataagttgcaataatagtgaacactgattacgtaatcttgaatttttcttttaaccaaacttggttgcttattccaggtgctgagggatggccgatggggcgagcaggaggcagcaatcttggttcccggtgacattatcagcatcaagctcggtgacatcgtccctgctgatgctcgtctccttgagggtgatccccttaagattgaccagtctgcacttactggggagtcccttccagtgaccaagaaccctggtgatgaggtcttctctggctcgacctgcaagcagggtgagattgaggccgtggtcattgccactggagtgcacaccttcttcggcaaggcggcgcatcttgttgacagcaccaaccaagttggtcacttccagacggtgctcactgcgatcgggaacttctgtatctgctcgattgcggttggtatcgtgatcgagatcatcgttatgttcccgatccagcaccgtgcctaccgcagtggcattgagaacctgttggtcctcttgatcggtggtatcccaattgccatgcctaccgtgctctcggtcaccatggccattggttcccacaagttgtcccagcagggtgctatcaccaagaggatgactgccatcgaggagatggctggcatggatgttctgtgcagtgacaagaccggaaccctcacccttaacaagttgagcgtcgacaagaacctcgttgaagtgttcactaaaggtgttgacaaggaccatgttttgttgctggctgcaagggcatctaggacagaaaaccaagatgccatcgatgctgccatggttggtatgcttgctgatcccaaggaggcaagagccggtatcagggaagtgcacttcttgcccttcaacccagttgacaagaggactgctctaacatacatcgatgccgatggtaactggcaccgtgccagcaagggtgctcctgagcaggtgagaaagattgacccttgtttcacttttttttttttgctaatttctttacttataatacgtgactgacatttttttggttgaaatttggacagatcctgaccctgtgcaactgcaaggaggatgtaaagaggaaggtgcatgctgtgattgacaagtatgctgagcgtgggcttcgttctcttgctgttgcaagacaggtatgatggctgccttactgaatgatctatcacctttttagtgattagggaaccatattctcataccaatatgatgtcgcaggaagtacctgagaagtcgaaggagtctgctggtggaccatggcaattcgttggtctgctgcccctgtttgatcccccgaggcacgacagtgctgaaactatccggaaggctctccatcttggtgttaatgttaagatgatcactggtatgtacaaatattataaaaacagaaagcagtataatagaattttgcaagagctaatggttggattttaatgtacatcaggtgaccagcttgctattggtaaggagactggtaggaggcttggaatgggtacaaacatgtatccttcatccgcattgctcggacaaaacaaggacgcttcacttgaggcacttcccgtggatgagctcattgagaaggctgatggttttgccggagtcttccctggtatggcttggatcgatgcagacttacctgcttgtttgctttcaatgtttgcattcctcaatgtgtttcttgttatgcagagcacaaatatgagatcgtgaagaggttgcaagagaagaagcacatcgtcggtatgaccggagatggtgtcaatgatgcccctgctcttaagaaggccgacattggtattgctgttgctgatgctacagatgctgcaagaagtgcttccgacattgtgctcactgagccaggtcttagtgtcattatcagcgctgtcctcactagcagatgcatcttccagaggatgaagaactataccgtaagttcttcctttgcaaataacttgtgttctctgtaaaacatatgatcacatcgcattctaactttgtattattttgtctcgtgtacatcagatttatgcagtttccatcaccatccgtatagtggtaagtaccatttcgtacataaaagatggaatataagctcttttctcgattttccaaactctaatatcaattttattttccagcttggatttttgcttattgctctgatctggaaatacgacttctcacccttcatggtccttatcattgccatcctgaatgacggtatgcattcctattgcccagataaattactgataactattccctccatgtacattcctagtgtaaggatcagttctcacgcaatatttttgcaggtactatcatgacgatctcgaaggacagagttaagccttctcccttgccagacagctggaagctgaaggaaatcttcgctaccggtattgtgcttggaagctaccttgctctgatgaccgttattttcttctgggccatgcacaagacagactttttcacggtatgctctcaccttaccctatctgtagtctgtccactacacttctctctcattatgtatgcttttgcgtgaagttttgttctcactaaagtgcttttgttcaggacaaattcggtgtcagatcaatcaggaacagtgaacatgagatgatgtctgcactgtacctccaagtcagtattgtgagtcaggccctcatcttcgtcacccgttctcgcagctggtccttcatcgaacgccctggtcttctcttggtcactgcattcatgcttgcacaactggtatgtacaagacagtaactactcaacaatcgagctacgtcataacaacgtcacggcaaatcatgcctatcctaaccttactgtttctgtaggttgcgacattcctcgctgtctatgccaactggggctttgccaggatcaagggcattggctggggctgggctggcgttatctggctttacagcattgtgttctacttccctcttgacatcttcaagttcttcatccgctttgtgctgagtggaagggcctgggacaacctccttgagaacaaggtacatatccagatctttcagttgtcagaaatgtacatatatggttgtctgctccattttttgtttcagctggctgatgatccgaaccttgtatttgcagattgcattcaccaccaagaaggattacggtagggaggagagggaggcacaatgggccaccgcacaaagaacacttcacggccttcagccaccggaggtcgcctccaacacgctcttcaacgacaagagcagctaccgcgagctctctgagatcgctgagcaagccaagagacgagctgagatcgcgaggtacattgctcacttccaacactgataaaatccatcaagtgcctaaccacttatgttaattaattaattactactacatcaatgagaaaatgttgctgaaaactaaaacacttgttctggatcataatctttcaggctgagagagctgaacactctcaagggccacgtcgaatcggtggtgaagctgaaggggctggacatcgacacgatccagcagaactacacagtgtgaggaaccccctcggcattcaacgagagatcgtcatcagcgctggagcgggaattgcaaacggcgctctggttaaaggaaattttcgatgaatgattggaagaacaaaaaacaaaaaaacatggctgatctgaacagccctagttgtaaagtgctaccaaatatatggtccggtttccctcttctagagaggttttacgttctagtggagtaccgtacgtacgtgttggagtacgacgacgtgttgtgatcgtttttggtctttttttactcttttccccctaactagcggtcttcttgcggaatgcaagatggagaaataatggatgaaaaattttctgccacgttaattctcactttggcaaatgggtctgcttcaattacttcttaattactctgcaatgccttcctctcgtgaatgaatactgactgatcaattggtgtgttgcgagtttgtgtattctacttccttcatacacaatcatattgtttttccgttgtttcacaatacaagatcgtgtattgtgttttatattttaagacggaagtaaaactaagattcgaatcctaaacctaatgtgtttcttgtggtgcatgctcactaactcaaaagaattagcctcctttggtttggaagttctaaagaaattttgcatgaattgaactaattcatgtgaaaatcctgtacaatcttacgttccaaaggaacctaatataacttatctctttccctattgttttctttttttttctctgtcctaaaaagaaacactattacaattctagcaacgaccttatgaaattagtactcctataaaattaattggttgctcggattacaagtactccccaccttactagtactatactctctataagctactccctccatcttataatatactacgtctagtaccagattgaatatattctagtattataaatttaaacatgagacatgtccaaatttgtaatataggctatccagattcatagtattaggatgtgtctcatccaaaactaggttgctattttatagggacggagggagtagcattgcactcggcatggcaaattttaatgctagaaatgcaattttttgtacacaaaggtagtatcgaatacacaaggaatttgaagaaaccctgtagcacagctccagctgagaacataatgtgaatatgaaaaatagtaaatagttaggtgttaatagaaaccgactaccctattgttaggcttatgcttataaaccaaaattattttttgaaatctaattttaaagttgatgttgtgattttttttatcatagtttattttgtagtacttatttttgaattgctaaggatacaaatataaaatttttatttataaattattttttatttattaataagccatacgaataagtataagtgaaataataggctctgaatagggggatattaactggctaggtgttatatgttcaagccacaaataaagcggcatccacatgggttgtaaaggagaagcttcattggtgtagtatacaataagcaaagatgccttgaggtgcatcaattatattggaggagattctacactccaagactcgtcaattatattgggaggattctgcactgcagactcggacaatacctactccgtagtcctaaccatgtggaggagatgaggcgaatacagtacgctggctataaaaatcggaaaaagaaatatgcctagcactcactggtcactactgctatatctttcctgtggaaaaaagggtagccgaccgaaccgtctgcagatgtagccaatacccaccacagatgagcataagccagagaacggaatctctatcgttttatcattatcatcatcgtgtactactccataaaagaagatatagtggaattcggttcgtacttcgcctacaattccccttcaaaaaaatcgccacccttttttcctttccacaacccaaagaaagatgctccatgttgttggcagtgcgtccgtacgccaagccggcgccggctgaggcctcaccatttcgtttacaaccaaattttaaattttaaatttaaagctgattttaagaggcttttaaagttttagcttttgattttaagtcgctaagaacaagtatatgaaagttttattcataaattatttttcgtttgtaaatataccactttgtttatttaggcaaataaacgaaacgatggttccgtgaaacgccgcatccacccacccatccgagcagaggatttagcgctgcaattcccagcaaaacaccgcggcgacgaggcggggtgcgtgtggcgcgtcccgtcacgttgccatcccgcccgcgacccatccaaccgacacgcattttgctccgcctccgcgccacccatagtgcgcgtcgccgcttgcccttgggtcccgtcccgatctccgccactgccacgagaagagaaaaaaaaaagcgccgattctcgcgctgttcccgcatgcaccgcggacgtcccgtacgtcatccgctgctccaaatcaaaccggcggccgcacgcgcttgtctgatgtccctccctttcccgtaaaatcaccacgcatcacgcggaagatagatatatggattggcagcaagattgttccctttctttcgcgttttatgcagcgagccgagcgatcgctctccgtcgctcgccgctacggcagaaaacggcgaccggtgcttccatcgatcgatcggtctccccgtcactgcacgcacgcctaaatctcacagtatcaccgatcgactgactttacaggttcgcgtcgttttccgggggtcctggaacgtgtttagcagctacggtgacagttacggcgcccaagtgtcgtttgctcctggaacatccggtgaaattaaaatcaacaaacccaaacagtatcagcagtactagtaactgtgctactatagtgctaaaagtgatggtttaggaattgtttactggagctcgtgagccagccaaccagctcgaccgtgcaccttttctctgcaaaagcgtcgtcgttgttgttgttgtcatggacggcctaaatgcgtgatacgatttagcattattacgatccagactgatttggttggggtgttggcctctcgctagggatgcacgaagtgactggatgagcttaaaagaggcgacagcaagagcccggtccgtgcacaagataagattcagttcaattggcatctgttattctccttttttttttcttctctgcatgagcagccaaaagccctgaaagttgtgtggctctactaatcagtgtaggataggacggctaatttgcctaattcgctagctgctgattactaattccatggaaaaagttgtgtagtactagtgctactacagcatcagcaacgctgtcagattggttgattggtcccttcaccaaagtgcagggaaggaggacagggacatgtccagatcaggttgcgaagaacaaatgaattagaaccgctgactcagcatcggcgaacgttgggacggcgactttgttagttaaaaccggcaccagtttggacagtcactagtagtactactcggcacagagtttaccagagtaatttgcggttgaacttagtactcctactaattaagatggtttgattatcttcatgatcacagtttgaagccgtcggagataaacaaatcccgagacggtgaccacatcagaaaattttcgcctttcctttcattttcctccctccgtactgttcgactattttgtgttttttgggtccaaattcccttttttttcaggttatttaattttaaattttgattactatttttttacttttatttttttgcttactaaacgttttggttttcctgttttgatcaagtactttcatccttttgttttttttatgcctgtaccagtttttttccttttgatttgtcagttctccttttgattcttgaaaggagagtgagagcaaatatggaaatgaaaaacggggctagtaaggaggcctggggtcagattttcaacgtggccttataagccattgccaaagtttaaaattttaaatagttaatttggggtgtttttgctgtaatttattttttagcactgacaaatcgttaaggacatagatatgaaagtttgtcatatttttatttcttcgataagccttcagggcagcatgaaaatgttcctagttgcaactcaagcttcagggggaagaaaaagtctgcaataattctcagaattcatggtgggctggacatggacatcagacagcctactttcaggtgagcagttgaaatgggctactttgagttaggccaatatagcccaattacatcgcttcgcctctctgtagctcatcggcttgtaggctggatgggccgaaaaaggcaatggacacctcctgtcctgtatctcgattttttttttcatttttaaatttttattttttaatatttacaggaatataatactggcgaaaatatttacaaaaatagaccctggagggcggcagggtgatgtgtgtgaccaggcgctggaggccgttgagcggtcatgcaaattttgcatgcggcgaaaattgcatttcacccccttacggatctcagcacaaaatgcgcacacggcgccgtgtgctacgtcaccttgctgccctccacttgagcggtagggtctatttctgtaaatattttcgctggtataatatttctgtaaatattaaaaaataaaaatttaatatctcctcctctccagactccagagaaagaaaacgtctgcacatctttccctggctttgtacgcatgcatccatttcataccgttcgatgcagaaactgtactccttttggagtctagcttgtacagacagttaaaagttgttagatgaaatcctcatcgacgttctcatctgccggctagtacgtagatcgatgatgatatcctccgaccgacgcaaggatgtttccaatcataaatgccgcagagacacatgtttgctgcagtgcattgccatgctgccatccaatgaactctggcatatatactgctcccttttgctgtggcaaagcaagcaggatatatcgatcagggtttcctctcataaatgggcaggagactagatccaagaaagaagctagctagcatgggcatcaaactattcatgggccggccaggagctgaagcccattattatatctatccagcttttcaccaagaactagcccacctctacagtctgcactatacatgcagacatgcagtttgtgtatactatcttctctctctcattggttatcactctaagacagttatgttacacagtgaacacaactagctaggtagatatattgatctgtttaattagtgtgggagatgtcggtgtcagctagcagtagaatatcacacaatccttctttttgttaatcgatcgtcacgtcatattcgatcttgtatacgtcaattaatagtatgatgtatatatgtgtgtatcctttcaaaaagaccaaaaaggttcgaggatctctgcgtgcaccatgcatgcaccttacgtaccacagctcttggaaacgaggttctatcagctacagattttattaaaaaaaaaacaagtctaggcacaatgattgagatcacttattggatggacaatatgtcaatatatacacatgaaaattgcctggaacaaacgaattaagataagccagcaagctagcatgccagcgatcccccatccaataaggttttagattctcgatcgaacagtgcgcatgtacttactctattatattgcaaaataagtttgagtttcagaatttaaaatttatttttaaattaattaatttctactctcttacctacgccctttatatatgaatcgagaagttttatcccttcaatatcccttaccttctaccaactaaatatactacttttgcattaattaaatgatatcctttttttctacaagatatcgtaacttcgcggctttagttgtagaacaccacaaaaagtgacttttggaaaatacactctcaaaatatgaaaatttactgttggacactgtactcatcaggatattcatttctggttcaacaggagaaagaaaccgcgtgaaagttctgaaataccccacttgacccacatgtcagatctccatcactttctctctcgatgcctcgatgatcgctagcagagccacctccatctgcgagctggagaagaaggctcaagacagctgacgaggagtagaggagagcggagaggtgggagcctgaaagctagcaggtgccagatccaagctccccacctagatccgcgctcatgcaagctcgccgattggatccgcggctgctagctgaggagcttgtcgactgggtctctacaccagcgtcaacctcgccgtgatgactagatctatctggggaccctgctgccaacaacgtcgtcctacccaacgtccttatcattgcctccctagaacatctatcgcaaaggccctggtgcttgcctgaagcgcaccaaatccccgtcttgctgcctgcgccacggatctgcgttgccttggcactcgttggcagagctacctccatttgcgatgtgtgctcattggccgaaaacgaaggagagctgagagaaagagagaaaggagatggagacctgacacgtaggtctagaggtattttagaactttcacatggtttctctcttctattattgaaccgaaaagaatattctaatgggtatggaatcctacagcgaattttcatgttttgatagtgtcttctcccaaaaagtcatgacgtgcagtgtcctatagctaaaaccataaagacacaatattttgtatcaaaatttgcctaattaataggcaaattttggtcagttctcctatctagctactatttttgtcttattaggattaattttgtgaatcattttttttaagaaaaaacacagtatgaatgcatgtaaatatattgacgtgcagacactgacccctctgaataatattttaggactgaagcagtgcacatcacacgcactgttgaacgatggtacggtaagcaagtatatccatgcttacagctagctagcacgagtgtccccgtcgtcctctgcagcaacgatcgaacatgcatgacaagctagatcgatcatttctgttataacaacgagtcgtccaaaatgctcatatacatgtcggccggcctagctagctccgcatagggcatgggcaaaggtcgccgtcgtagagctgagagctaggataatttcggctaggttttgttccgcgtacagcagcagccatacactaccggccttttcctagctactccctccgtcagagaatttggttagatgtgacatatcttattacaataaatttgatagagaattcttgtttagatttattgtattaaaatataacacattcaattaaaattttttatatttagggatggagtgagtagctcgctgatccatcgatcgttttcccgtcgtgggcatcgcgatcgatcgatcgatcggtcacacacga

SEQ ID NO: 52119 - DNA, 4831 bp, Oryza sativa
gacgagacttgctactgttgggaggcttgcattgcatgcatgtgcgatgggacccggcttttgtgtgtctctctgcgtgggctccatcgtcaccgcccccggccccagcagtggcagagaagggcgtacgtacgctgctgctgggtctgggtgtgtgtgcagggatggtttgccacgatcgtgcaaccccgcagccagcccagcgcagctacgtgcatgcatgcgtcgttgcatctcatgcgtcgtcgtctgcttcttccttggttcgatcgatagctccgatcctataattaattgcagcattttaattttgatgtatatatcagcgtccaatctacatatgtatggattgttaatttcctgtctacaacttaacgactagcaactatatatatatatatatatatatatatatatatatatatataacaaattgagacagtctcagcatgtgtgtacgtccacgtacatgcatttgattaagacgtcgacctcacataaaagtccatctcacagatatatatatgccgaggatctagctagttagtaactacgagcactacattattcatgatatttaagagccaatggcatgtcatatgtgtgtgtagctactatcttggtacacgacagctaaagatcttgacatttggtagctaaggtggtactacgcattcatgtccaattgtaagctgattcactcatcatctttgatccggcccatggatcccaatcaccaacgttttataacacttttttaagtactagaaaccgagaattatcaagaaaaaaaaacccctactggcctactccgcatatctaagatcatttgggagtcgactatttatgtttagtacattttgagttaattaattaagctcgttgaattgactcgactaaactttctattaattgtttatgcctgtatcccaaataaaagaagacaatctctatatgtttcatattatttatcatcctagcatttattttttttaatcaaaatatttttcattcttgcattccaagtttccaacataattttagaggtgaacttcccctctctacccttcacgaatgcagtcacaactcttattagcttatttgctttggaaaaactaatgggatgtacttataatgagagtaacaatgtaaactaccatatatcaattggtttgtgtgaggtttgctagaatgataagtactccgtccgtcactaaaagagcgtagttttagcgagtccactactgaaaaactgatctctgctcagtcgccctaaaaccacaatagtcccggttataaaaagaaccgggactaaagatgatttttagtcccagtttaaaaccccatagccattctacgatctttagttccgattggtaataccaaccggaactaaagatcatcccatgtcagtcccttattagaggggcagggatctttagttccggttggtgtcacaaaccgggactaaagatcaccactttagtcccggttggtattattaaccgggactaaagatctcctatatctcacgcgtagtatataatccctattccctattctctcccccacaaccggcctcaatctcctcaacaaccgacctctcctctcctcagatccatcgccctctcctcctcccctcctccccttcctcctcccatcccgaccctctcctccccctcctcccttcccatccgatctcctcctccccttcctcctcccatcccggccctctcctccccctcctcccttcccgcacgtgtcaggcggggccctgcccggcggggccgcacgcaggccgcgcacgggccgagtagcgagcggcagcaggcggcgctaccggcatccattctttttttctttttttataatttgtgattcactgagatgtataattttgtgatttgttgtatggatctgatatgtataatatgtgatgtatttggtttgtgtgtaatctttttaagatttgtgatgtatttgatttgtgtgtacaagtaacttaagatttgtgatgtgaatgttttgggatgttactttgatttggggtttgatttgggaatatgcatcccactcgatttgggagaaaatacagggattaactctggctaaaaaataacgaaaaaaaagaaagaaaaggagacctaatgggactgccgctacccgctctttagtccctgttggtaacaccaaccgggaataaagataggtatctttagtcccggttatttcacccgggactaaagatagcgatctttagtcccggattcgtagtcccggttggataaccgggactaaaggggggttacgaaccgggagtacaaagggtttctccactagtggtcaaaaaaagattaagcaagagatataaaagactactatgtcgtttattaatgctgagagaaaggccctgtttagatttcaacttttttctttaaacttctaatttttccgtcacatcgaacttttctacacaaacaaacttttaactttttcgtcatattgtttcaatttcttcaaactactaattttgatgtggaattaaacacagccaaagtaagaagggaaaaaacaaagaggaggagggagtaacgacaagaaaaaaaaataaagtactgaagtattaagaggtttactggacccactttaaagatatggacagagagtaaatgagtaggagtataattcagtagttttcatatatgggattatgggttgcctccaagtcgaacccaaataagatggactaattggataattacccatctgtagtaggaggctggtgattaattcacaacttatgtcttgttgacttgtggatcctccagctctagattgaagcttattgccatggcgcaatgaatgaaagggggtttgagcaccgagcccccagtaggtccggcactgttgttcatttctgatgaacatatgaatggattaattatgcgtacgctttctaaacttttgaacatatgatttttaagaaaattatatatatatatatatatatatttaaattcatttttttaattttataatagataattcattcattgttcatttaaataattatcacacattattcaccagccattcaacataaaagaacagggaagaagaagcaactatatggattgtgtccccctgatgataatagatactatgtactctctagcccgatatttaattataaagggggtgatctataggtgcaaatgaagatggtgacctggtatgatcaatgtggacaagtgggacataatcataaaaaggagtccagatactgaccaatgcaaatgctgcgtcagagattgtgatagatggagggccagatcgagtcatgaccgggctgtgcatgctactagctattactcaaggagtactgatccagtagtactacatgggaaggaattaggaataacaggcagcataaggcctcaatgacatgaaaatcttgtatgatgtattaatttgggtgtaagatcactgatcacaatgacctgttaaagttaaacacctatttctctgaaagtttctcgaaaacgtgtggggttgctgcatataaatccaccactgtctcgtcctgctctgctcactttcaggacgtgtccttggtgatcaaaatttcaacaatatatctacatattgcccatatcaccatctgcatgattgaaaccttggtaaattttaattttacttgtgttcagttgatcagttcacatgtgtctgtaccagtgaaatggagtaaaagagtgacagtacccggccgatcgatatgatatgatcgagccgctcgcggtcccctacatatcgatctatctatctatctatcgcacaaaagctgccgaaaattgaaacaattattgggatgataggaccagcaatgtaagctgcatcagaggcgagattgatcggttgatcagagggcgatatgtttgcgccgattgattcgagattttgtggacttcaagggggttttcctgtgctgtgctgccttttcgctcattcgaatcagagcagctgcaacgcatgcatgcgcttctgaaacctgcaaacgcctgaccctcaatgctcaatgcaactttgagtatattatcgtgcacgtggacggcacagcgatcccaatcaggttttggtggatagagtttgtctcattcgatccaatttatggctctgtaaatgctgtttttgcagagaaaaattcagttcattgttttccctgaatcacttaattaattaatctcgtagaggtatattggaaaaaaaacaaagaaaaaaaaggtaggagatcgatcaagaaggatgggcggcgaaaggtcagatttattcggatttaattcgttttgaaaattgtgcaagaccggcttgaaaaacaactttcagctacaaggaaaatcttcacgtcctttaacacttattgaaatcaatatgttttgacaagttatgtaagtgagaaatcgattaatcaatgcgatgttgtacatcatgtggaagaaattgccctttgttttcttgtttaattggtgcactacattactactggtaatgaattcttggctctctagttcattaattataggaaattactacattgtcgtggcaggctaaggattgttctttaacctttttaccgtggacgaaaagaaacacagagaattgaaggaaaggaaaaaaaaaaaggaggcaacaacgccacaagcaggaagatcgaatgtacagcaggctaccaaatagttgattaagaaaaggcactatttaatgtgactattcccctatttgccttggtactcatgccaaaaatagaagaattaacaagtgatggttatttaac

SEQ ID NO: 52120 - DNA, 4478 bp, Oryza sativa
ctatgttatgctgccatattcatagtaagagtagtactagtgcggaattcgaattagaccgcgcatggagaaaagatccaaagcgtctgtttgggggagcttctagttgctgtagctactcctaaaatcagaagctccccaaaacagtctagcttttggtccagatttgagaagctgtaattgtagaatctagaaaatgaactagcagccagaagctgggaaacccagcttttccagattctcagaagctggctaccaatcaactgcttcttcgaattttaagctccctcaaacaggcccaaagtcttgtacatagacaaggaatatgaaatcttttgtttgaaaacttaagttaggtattagcacgtgacatgagcctacacgtctatatcagtttagcaaagcgtatagtgttaagattaattcaaaatgacaacgactcgtaaggttgagaatgggttctgacaatggtcggctatgtacctacaaaagatcacaaaacatatctcgatcaattcattgtgatatttaatgcccccaaagcatatatataagttttcacatttccgccgaattcatccagaaacacataatcgtggaaaaactaagcctattgggtaccgccgccaacgcgccggccacgcgagaccggaagcgcagaagatcctggctatccatggaccacacaaggcaggggcaggctcttccacaatcccgggtctggtgacatgagccacagttgtggcccgaacaaagtgacgtgtgtcgagtcgaacgccaggcctcgcgcacacatgcattgcactggcacccgctgcgcctgcgctgcatgcactgctgcgtcccagcattttctcccccttcttttgtaccggcctcccacacgcaccgcgcgtcctcctgctggccaaaaagccaaatgttgtgctccaaacggccggcggttccggcggctcgacctcgacgcgacgttgctttgcttcgtgctcgtgcatatacgggtcgttctttgcttttgcatatttatattgcaaacggtgcgtgtgtgatgtgtcgatcgaatcctggtcaaatatggcgtactttattctcgcagtttgagatcgatatgctattgcaccgaacgctgctcagagagggggctttctgaccagctggtaggcaggggtgcaaaaaaccagagtctaattttatatgtactctaatctaaattcattagcctgatgatagtatccagtagccacatagccaacaattagacaattttcttttttaatgaaaaatcaggttattttggaaaaatattaaaacctagataaatagacgtgtccagttaaaaatatcactgcacactgtgatataggaagtaacaacagcagcctatcgatgaattgaaccgatgacctaaggttgccgggtttttgggtgcacccatgctttggtactagatattgcaacaaaagagcttcacaaagtgttttcttttagttgtatgtgttgtaaaattgctctattgtagaaagagcgacactgcaataaaagaacttatcgaagtgtattatgtgaaattactctattgcagaaagaacgatcaacgtaacggtctacatatgtgtttgtacgagatttaacgacaacagtcaaagcacaatttttttttaaaaaaagaatttagtcaaatcctatctctctctctctctggaacgttgggtataggcgtgcataaaactgacaatttgatcacttatttctcttaaatggtatgactaaatgttgaaaaaaacctcatcagcgttttatatagttttctgtaaacttcttattaagaaactactatatgtcaaagttagtaatttagaaatttagaaaaaggagggactaatttctttccttgcaggaattaaactagctagctaccggaattcctacgaaaccgtggacttattatctactctccgtcaaaaaatacttatattttgggacggagcagtatcgatcttaaattaaggcctcgatcgagagtaagggacggtaataatcccttccggtacgaaaaacggagcagaccattagtacgtgattaattaagtattagctatttttatttcaaaaatagatcaatatgattttttaagtaacttttatatataaacttttttaaaaaacacaccgtttaatagtttgggaagcgtgcgagcgaaaaacgatctagtagcgggggcggttgcccgcgggaacgagcgcaccctaaatctgtcaaactgtcaaagcggcgtacacgtaccgtgcgtgctgctggtcctcctgggcctggccggcgcgcggctatgtgcacgatcacatcgacgacaaccacgacaacggccgtgcgcgtgtcctggcacacacacatactacaagatcagatataaaaataataataaccatttatctcctcacttaacttctagccatagaatcatgtcgttcgtcgcggccatgcagtgcgcgcggtacgtgcacgaacacacacacacacacacacactcgtactcgcatcgtcgtaacgtactacgctggctggcctggcatattatgcatggtacggcgcgcgatggcgtacgacgacgcacgggggcgggcgatcgaacggtcgcgcgtgcatgaatgcgtgcggatccaatgcgatgctactccagccggcgacgacgacgacgacgtacgacacgaggcctgatctctctctctctctctctctctctctctctctctctctctctgctagtgcttgtcgtggtctcgtgatgtctccagttaatcgcgactgtttcgacgacccccacacgcacgcacgcacacacgcgcatacacacgcacgggcgctggcctctgaccgtgcacgcagacgtcgtcgcagaggaggaggccccctgccctgcagctgcgagagtacgtggccgtgccggctgcctgctgcctgcccggctgcacgcagcaggaatgcatggcgcgcgcgcgcgctgcatcaaaaaaatccaccgatcgaaacaacaacggtctcaggttggtaggcaggatcgcagggttttgctttgctctcctaagctacagcgatccgcctgctcacccactgttgcgtacgtctaaatccctcatccatcagttttttcatcaggccgtacgtcgtcgtttcctcatcgatcgatcgatcgatcatctctcttcacccaacaatatatgcagcaaattaattaaagcgacgacgttacgttcagcaccctgcgctagctttccctgatgaattctgaatctctgatgatatcatacacaccgagatatggttaattatacatactggtatgtgttgtatacatggacacatatatgcatcactgtacctaaagctgatggagtctgagatgagatgactgccgagatacatacatgcattgcatgcatatgcatatgcatatgaatgctagctaccacagcagcatatactgcatatatgcacgcacgcatgcaatctagcgaagcaggattgttcaaatgtggagcgcagaagacatggatagcgacctgacagagccgatatgtatgcatgcagacaagctgattttggcctgtctttttaatgtgcactgctatgtgtgagatccttgcactgtgcatgagtcaatgcgagtgatgtcgccacagtgaagttggataggtggccggctgagatcagctgtgcatgcactgaaaaaaaaaacatatgcatgctagctgctgctagctagctttgcattggccttgccttgccttgccagccacactctctgttcgttcgagagccaggacgacagcttgagccatgaatatttttgtacgtgtatatactagcttgcttccttgacgtacacatacataaattacatgtacgtacaatatatacatggatgtgatacatgcatgcatgcatgctgccatgatagctggtatacatctagctagtcgtacgtacgtatagtagctagaaatctttatcacgacggtacgtttagtggggaatggatatttgtcttattgtcaaaagatatacagtagtagtatctgctaatttctataagaatcttaatttgatcaagtgatgagatcaataatccaatgtagtgtggggacagattcttacctagctagtggatgggatagctacgtaatgtgtataaatgttcggtggttcgatgactaaatctttaatctcatttgggacctttcgatccccttaattagggttcctagctatatatttgttcagttcattaactagctgaagagaattcctagtattgacatagggtcaaggcaatatatgccaatgctctgctgagagctacgcatgcaacatttcttacgatctctgcttttctgtgtacttgtagttgcctttcagaaagtaaaatctttcactgatcctgcaggtaggggcctcactctgtcatttgcatgccaaaaga

SEQ ID NO: 52121 - DNA, 1694 bp, Oryza sativa
taagaattaattgcgacacgcatacatgtagttgacgggttagaatttaaggatgcggtacatatatatatgtgctgtacagggcagtgaggtaaaaagggagcagtacgtggtaattaaccaacttggccggaaaaattacttcgtgatgagggcctaattagagtaagtttgatagtatagcccactactagctccaatttatctatagccaatctaatagccaattcatatatacaataattgcttactgtactattagtatatggtctcacctgtcatacacatattatgtcttagagtccatactgtagctagctacagatctatagtccgctgctcttctctcttatcttttatctcattaaaatgtgtttgtagctagctaatagtctgctattgtatatgagtaggggcatggaatatgtgagccagcgagagtagccggtcgggaccagcaatgattccgtcgatcgagattgtaactgtttccaactcggcaagaaataatacggcacttatgaacaattcggtttttaaactccggtcaaaaagatgtaataaaaagaataaaaaacaaacgcccatgcatgggtacgccggaattcacttgactggatataatctatttttttctctttgtagaagttatatgttgagctgtaaatttgtagagccacagatagcgccgttatcaaagtttaaaatattttcaaattttattattgtttcatgagctttaaaatatcaatgtttaaatcaatcttaattaggtgcttctaacctaggtagagagagaaaattctaataaatgctagtaaggcataagttaatacatctatctacacccgaccaaattttagtggaaaaaacaacttatatagggaggagaaaaattagaaatactatcatggaataaataatattagtccagtgtaaaataagaaaaaaatagtttagggggttaaatgtattggtgaagtttaaaaatgtaaaatggacattttcttccaccaatttcattgggtcactcgttttaccttgggtgataggaggtgtaacatttaagctagtaattaagatatttgatatatctcgatcggtacctcttaattaagaccataaaatttttcatggctagaatgcttatttctccatggaatgcaattatgtattagtaatcttttttgaaaaacatagaaaaaaatatatgcttcatatttagtttacataaagtacaattataaacctagcttgagcttgcttaattaaatatgtaaatattgaagaactcgtggcaggttatcatgaagctagataaagcgcacacgccaatttctcctatttaaaatgaagtttgacttcattgtgaaattatagcgtctgcagatactctgtatatgttttttccctgttgtgtagtacaacttatgcaaaatgaaagacacgtgctgacgtgcatgtgagcacaccacaccgcttgcacaaactcacgtgttactagttaccacaaggtttttctctttactctgctgtctagttggggttgttttctctaagttaactgtgtctgttttttcaccttctatgtgtaaccccacgatcaggtcaactggttgtagttgtacaagtttttctttcttctgctaattaatatatcaatgtgtaaggtttcacacggtaataaaaaaacg

SEQ ID NO: 52122 - DNA, 794 bp, Oryza sativa
ttgcaaccatgatgaaccgtcagaaactgcagaatgtgattctgggggaaatggcaaattggcaatccaacaaaaggaagcaagaattttagtagtagtgcacaaactttctgtccaatcactcaacttaggaagatgtcatgaagcttgttcgaggttgccaatttgccagagacctgatgacctgaatcttcaaggcttcaaactaattaatggcgtccatttctaacaagggacggtgagattgacctgtccatccatgttcattagctaccatccaaaggacagaagggaaacaagaacggacctttcacctcttgggtctttttgaagactttgaagggaaaagaaaaactaaaaagagagaagagctaactgaaactctgaatctttgaaaggatacagaggagcaattccactttgcctcctgagttttctcagggttggctcttcctcatcgccatgtctcccttttcgtgatactacacagctgcagttgcatgaggaggaggaactaggtgaggctccatctgtaaataaaaaaataataataaagaagacatcaattatgcacaattattaaaagggaaagcaaggaagaaatggaacgagtggctataaaaatcagttgacctcacgcataattccagtttaaatatgttttttttttgtaacgttgatttggatcatgggctgaatgatgatgcagtttgaagttttttttttaaatgtagaccaataatttaagtagatgtgtcgaatacataatcgtgcatgattctcgtaacggtgac

SEQ ID NO: 52123 - DNA, 716 bp, Oryza sativa
ccccctccccctttatgatctcccaaacacgaaaccctaggtaggcgacgagacgagacgacggacggagtggtggtggcgtgaatcgtggggcggtgagggttggaataaaaggacacagcacggcgggggtggggcgccggccgagagagggagggggcgtcacgcgcgtcacacgtgaccggcgaggcatctcgtggggtgtgtgggtgtgaccggatcggagacgtgccgccgttggatgagtttgaccgggtaaccggcgaaagcagcgttggctggcgaggaggaggtttgggataaagacagggcgcggcacggcacggcaacccaacccaccggggtccggagaccggacggggcggaatacggtggcggccgcgcgaaattacgcggctgcccacgctgcgctgcgcgcggtgtgtgtcaggcgggcgtgggattgcgggtgcgctgaggtggtcgccgttggtcggctttgcgttgcgtctcgtactctcgtctcgttcgttcggcttgggcgccgaaagaggaggagagagagagactgagacaccgaggagggagaaggccgcgaagagggggtgggtgggtgaggtggtgtgggccccaccggcgcgctggggaggcgggcaattattgttgtctccatcgagcggtggcgagacctgcccggaaaagtggacggggtgacggacggacggcagcggcgtgca

SEQ ID NO: 52124 - DNA, 4744 bp, Oryza sativa
  unsure (1)..(4744): unsure at all n locations
ggctggccctgaaaacttaaaaacaaatcgcggcggtaaaattcaaacagacccggaacttcctggtaaggaactccggaacttccggcctcccaggcccggaactaggaggattaatgcactttcaagatagactaaaatttgcattttgcggtgaacaaagatgtactaattattaattattagacagggcaataccatctatccatttgctcgccatacggccaatcggggatatgctctgcaccatcgtgacactctcgctccttctgtccagtacacacagaaaaacaaaaaaaaaaatcagaaaaatgaggattgcagtcaagagagatgaggaaagaccaaaaagctagattagtaaacaggtcacaaccgatggaaatatgcacaccacagcagtagttgaagcacaaacatgggtgtggaggtggtgccgttgccgatgcccaccatcaacgaggccatggcttcctgatccacggcagcaatggatccgctcgcgcgaggatagagccagacaaccggcgacgcgtgaggataatggtggcagcaccgagatgcacccctaaaaagggtattaggagagccagaaactcttttctatactcttttctatcaaacaaaatatagaagttcatttaccccaacaattgtagtagcaaacaagcgttcaatttaaaacaacactaagtctgtcaatcattgtaagcgatgtgtacttcgggaatttcctaatgattttacattacagcagcatggaaaagcctaaagcatttctggtctgctatagcagcaagtaaattgcatatgggataaaatcaatatggacataccagtattcttttttcataaagatacatagacagcattctatgtataacgagcttaaaatcaccgaactcttgactcccgttgtcagataatagctntcccatgattactgtaggggtatatatatgtccagccattgcctcaattatttctccaacaaaatgtgaaaatacactccgcggtgcattcaagctcctctggtaagctgaaatccttgttttcatgagaatcctttgtcctttggctgtctactcgatgattcactcccattgggcctgaaaccttttccatttacatccttgtttttcttttcttttctgtattggtttttgccggtttcccgtttaattaaccgtgcttgtttggttttcgggcccgatttcccttattaactgggccaattctgttcttctataaattccggcaggagattctcctgccgttggttcctaaaaaaaaaaattacatccttgcttccatttaaggggctctgagaagctgaattgataacataacaatattgatgtcaatacatctaccagaacacaagacggatatctttgtatgaccacagcaagcaacaaacgtgacaaatcacacgactgtaaagaaagccttacgcaattccaatactataggttgatttatatccttttgaaagtcctaattaatctaatgaaaatttatcataaaaattaaggccttgtttgaattttttttgtctgaactcacaatggacaaaaaatgaaaaaagagaaagatgatattagacaatataacagtgagaaagagcccaccccatccacgaataacaacaatatgattacttgaaggagttaatgtacgcagcggctgacggcgtgtgaagaggcggagcccctcgtccaagtgtccaacacagcgacaaggtgcggatggcggcggaaagggtgattccggctggtggcaggacaatggttgctccaaccacctaaccatcgacagccacgagctcaccgccatcagatcaggcggccttgagttcgtgccatcagatctggccactgcgatggcggcgagcggctaggccggccagttgacgacgacggcggcaggttgacaacgatgacgatggcggcgaggcacagctcctcgcaggcaaaggagagacgagagtggaagaggagaggagcgttctcctcgtcgctttctccgcgtccgcctcgaagtccgcactccgcgacgacggtgacgcgaggggggagaaggaggtggaggcgctcaaagacggcgacggcgacgtcgacggcggcggaggtggaggcggcggcgctaggggaagacggaggcgaaggcggaggtggcagaggcgaaggcggcggcggcggaggcgcgaggcgatgcagacgacgatggcgacggcgcgaagcggaggtggtggcgcgaggggaaagcggaggcggaggcggcggcggctgctagggctttgggtagtgggtgccgttttgcgaaaaaacccctcagcttacacattttagagcgcaggcctaattcgcggttttcctctccttctcatagaatatccggattttagaaggggctaaacgtaaaatgccagctcagagggactgttagcgagggacgccggacgaattacgaaaaaacggagggcttttttgcaaaaataccaccccgcgcgctgtacatatactgtagaaaaatccttacgtggcacacctcctcgcccgcccaacctgcgcccctttatggccctctttaggcttataagccaacttataagtcgaaaagtctaggcctaaacttttccgtttggcttttttgaagccataagccactctaacactattaagccaaaagctaggttggagaagcttttttggcttatgtaaggtagatgtatgactcaactactaaacttaggacattaaatccaccggcttataaatcatataggccaataaactgactagtccaataaagagggcctatgtactccgatgacactcagattatgaaaaatgaaaaaaattcaacaaaatcctatgagaaatacagtgtggtcatgatgcacctgcacatgttttgatatatggaacttgtatatcattcgaatggttaaaaaaatattaaaaaatctattatatacttaaaaatccattaaactttctataaacgtttctaagccgccacttagcactctaataaattagagaaatcaaagaaattctaaaaaatctatccattgattttcatttaaattggtagacccaatattttagacattatattaaatctattaaaatatttccaactaataaggatccgatgcatacatatggatggtacgtatgtacgtactactcgtaaaaaaaagaatcattccttctaatatggatccgatgcatatctatgcagaggaaggtatgtatgtactactctacttttaccgtatgtactactctacttttacaaacgtaacgtaaaatacgattggaaattaaaagaggataaagcggataaaaccataaaaaccataaatacttttcttccctctttttcattcttttctccctgcgtatacaggtgagataacaattaatattagtgataataaattttaaataattataattcttacaaacatagagtatatatatcatcatatgactctttcaaaaacatcattcctccgtttcgtaaagtaagtctttctagcattgctcacattcatataaatgttatatgtctagattcattaatatctttatgaatatgagcaatgctataaagtcttgcattataaaacggagagggtacataactaaatttgctctataatgttcagtgataaagtttactccctccggttccataattcttgacgttttgaacatttaaacttttataaattgaactattaataactttaaaaatattaaagatttaatggcatgcatacgaggattttatgtggtattgatgatttgattcttttaccacaacttttaattgtacatccaatttataatcggtttcaaccactgtatttctattaattgaatgacaattaaagacctgtattgctgaattgagtcccaaattaacataagctgaattgttttcaaatatgaacataaggatatcacatacatgacactaaccacatttatcattagtttaattattaatcaacatttttggacaacgcttatttctaaatctataaataaatattcttaatatgctacttctattggttaatgggagatcaccgttaaaaattagtcatgaatgtcccctcttaagaggtggaaatacatgtctttatggttccgtatcaacatacatgtgcctttcaaggacagcgtttagtgcaattttaacgcctaattcactatcagcacctttacagatgattgcatcagtaagtagaaatttgaacactattgtcaacggtggtttccaaaagggctacctcaactaaaccatatatatgcccctactatacttgtaaaagcttctcaattccctttagagaaagcaagaaaatatggatgtaatgaaaataattcttcccataaaaacatagttgtttttttcattttgtgtagacataatttgtttgtagtattaatcagtactacccgtttatggtatagatacaacattctcttttgttaagtgaggttaatcattaaaaaaaaggagagaatctattctacaccactgagtttgttcgagttcaacgatttaccatcaacattgtctttttttataatataccggcgactttatcaattgttgtacgatacgccattggactggacgatcttttcaaaaatacccaaaatacccttagagacatacaagattaacaattgatttatctcatctgaatattcaaaaaaat

SEQ ID NO: 52125 - DNA, 14529 bp, Oryza sativa
aacagtttctcttgtatacgcaagagataaaggaagcgggctaaggtaatggtgtaaaataataggttcattaatttatgtaaaaatcgatggtgaaattacgtagtatcacgtggtggtctacgagcgcttgtagaagcaccaaatgatcatatttgtagagtaataattttatttttatagtatagaagatcctatttaaaaaggctttgatggttataacattgtacatatattttgctttaggctttaatcttgcgtacattggtacctatcctttgttttttcacgggtgaacagtatattattttttgtcattatttttttagcgtattttcatgcaacgtaacgaatgtaactatttgcatgtaggtacgtaaatatttccagtaaacggattatcttggatatagaaagcataaaatttttaaatagatctaatccgacggtatagaataatggatccaccaatttaaatgaaaatcaatagtaggattgtagaatgccacacggcggcctaggagcgcttgtagaaaagccacgtggcggcttaggagcgtttataatatgtttaatggacttatagtatataatagatagatagctatttttagggcatgtttggtttggagccaaattttgccctaccaaaattaattttgatagtacctatttatcaagcttgaagcatttagatttacatttcctcaaaaccccaccacctgtttatcaattgctttcaactgaattgttaaattcgaaaccctatattggaaaaccgtttaaacgaaattaaaaattgaatgcttgaaacttgtggtacgaggagttcacctagggctttctctacacaagaaatagcttgatgttgccgttgacccataatgcagcttgtgcttggtggctagggtgggagagagaactaggggtctgtgggatcctttgcagggaagaaaaggagacttgagagcaagatagactcaatgcaatatattgatctcagtgtgcagagtacatatataagcacgtcctttcctaaccactcaaccaacttatttatgtagaaacagaatcgggagagatattggctagatagcaagagatgaagcatgccaaaatacaaaagatactaaccctctcaccccagtcattctattaaagagaagttccagtggtggattagagatggtagttcggtgcgattgttgtaagacccttggctcggtgggactgcaccggatagaaggcccggcgggtgtccgaacattgagactggaacggaactctaagaagatggtactagacaaacccttggtgaagatatccgtataatgtgacatcgtcgggacatgaacacacaaacagatccgacagcaacatgatcatgtacaaagtgtagatcaatctccacatgtttggttcgctgatgctggactgggttggtatgaatccttagctagtttgcatatacaagaacgaagtatgcttgtgagataaaagaaactgatcgagttattctctgtgtatggacaaatccttccattgataaaataatgcaaatacatggaatatgttagactaactacagatgtaatttggtgcaaaactcttgttggaccttgtgtacaatagaagatgggtgaagtgttgaggttggcacagggaacattgaaaggaaacatatccttggaaactaaacctgctagctagccttgattggtaagtgatcaatgatggatggatgggttaattctggttctgggtggcagccggccttgggacatacttgcggagccagatctggcgatggcggatggagatcttgacgagacgctctccgttgagcaccagctgcacaaatgcctcgctccggaagatgattcgcccgtacattggctgtgagcctcccgctgtcttctccatcaggacacgcaccacgcagtcgccccacttcctgcacgtatatataagtcgttgtcaatgccaatgcatcaatccatcctgcattctgcattctttgctatgggacctagctgcgctatggggaggattgcagactcactgcctgaagtagtcgaagatctcttcacggtcgattggcgctcccctggagaaggtgatgaacatggagcggcagtcctccggcacggcgacggagaggcagctataggcctccatcagctccggcgggttgccgactaggccggtctggtagcggcggagcatcttgttgaggtggttattgaagatgagcgagccgacaccgtctaggatgtctgcgacaccacgcaccaccaggtcctggtggaatgtgaaaaagcgcgggtccacatcgccgtccttgcagagcgcggagatgagcgggatggccggcactacgggctccggcccgcggaggcagtccaacaccgagttggcctccgcggcgacgaggctgacgacggtggggctcagccctgggaggtgctggatggctcggacgttgcactggtccagccacaccagcagcgccaccgcgttgcgcgcctgctccgggttgctgccgatgccgacgaagcggtcgtaggcggtgcgggcgtcgctgtacatgtacagcacgtcgcggacggtgaacatctgttcggccatgatcagcgtcgtcgtcgccttccggaagctccgagaactagatagcttagattcttgtgctgtgtgtggtaggctgctaggtagcaatagctcaggatgatggagtgctgaatggggctagctgaggcctgtatttgtagccggtggtcgccggcgagtggttgcaaggaggagttgagcaaacggatgtgttctcgctacctgcctcgcatggcaacctttggcctagcttagccaaaataaggaggaaacgaaacaggtatgatggtttgaaacggttgcagcgtcggtctcctctgctttacgattcgtgcttctctggcctgaagcccattttgtttcctatttttttccctgtcctttttagatgagcttcctcttttattccctagttgcgctcaaactagcagctatatatgaatggatcaacgggatagtgctatcgtatgtatattttggcggttaattataccttgatcatgcattgttgctaagtatacctttatatatcgtcctatctttgtttcagttcatatgtatctttggctacaatcgacttaatcattattacttgcctttatcaagtcatggcaggacatcaattttgaagggcaattcgatcatattgtttgcatgcatatacacattgccacgtacacgtacatatatagatccaaccagcaagacaaacgttcaaacttcattactccctccgtttcaggttataaaatattttgactttggtcaaagtcaaactgtttcaagtttgactaaagtttatagacaaatatagtaatatttgtaatactaagttagtttcgtcaaatcaataattgaatatattttcataataaatttgtcttgggttgaaaagttactatttttttctacaaacttgaccaaagttaaaacgtcttataacctgaaacggagggagtacatatgtaaatccatatatgctatgacctattaccaaataaacaaatcaaattccaatttaaaataaatttgttaaatgctccacacactgctctagaaagccacattactaacagttgaaaatggcaatctctaacaatttgttgaaccgctatatagacatttggttacgcttgagttggcgtgaataatctctaaatgttcttgaactactactgaaccaatgatatctaactgttcacaagctataaagtattacatttcatattgggacaattaaaaagaatgcaaaagttacgaaccggtaagatttgcttgtcgtcgtttgtcatgctcagctggttgatcttgacatcaccatgccagaggggagaaacaagagcaccgagcgaggacatcttgacccatgcaatgtcatagtcatctcaccataccttcctagatctagaatcatagagcttggagtgcatctaagattaccatctcaccatacctttccagatctaggatcctaaagcttcgagcttggaacgggtagatatagcatgcaccgagcttggagcggctagagccattgttttcttgatcacacaagagcaatgaggagaggaggcctcaagccatgctctgttgttgccatcatagtggccctccaaagatgtcaccatcatcgtacgtaccatgttcgatccggtagcccaagctagaagctctagatcgacatggcattttaagctcgccaaccgcatcgaagcaaggaaagggtaatggtggactctgtgtatctcgctgaacaaggggagaagaggcaatagtgcatgactagcttggattagttttttttttttcggggaagagctgggaattactattgctcaaccgacagactagcttggattagttgacatcaccaaaggaggtagcagctaggatggcaaaggattgaaggccagcgtgaacttgggtctggcaactagacaaggagtggcggatgaggggcaaatgatgcaaaatatggcaaagctaggagtggaagatagatgtgcctcgatccggagcccaaggaacgggtctatgggaggatagaggcgaaatgtggtaatataggtggagtggttggagtgggagcacgttgatcttacctaatatgttgttcttgatatgaatccatgacaaatatgatagggttaattggatccatgctattataacgttgccacttttgagaaatgtcactactattcgttaaattagaaacatgtcattatgaatcagctgattttggaaccatgcttctctctgcaccccaagcctcttttgttgacttgaatagacatagttgcccctggttgaatcataggtcgatggcgatggcaaggtggggaagacgacggtgaccacgatgaggagatctggcgaaagcaaggtggggaaggcggtagtggcgaggtcgacggagacggcaaggtggggaagtcgacggcgatggcagcgagatctggtgaaggcaagttggggaaggcggcggcagtgaggtcgacggcgacgacaaggtgggaaagatgatgacgaccacggagaggacggtagctcaggaagacgacgacaacgtgactacggtgagggctggagcttgggaaggtgacgatgacttctcggggccctagattcgccggcgagcaggctggatctagccagcggcgcggtgccgatatgggagaaaagctacggagctacaccggagaagcccgctgccaagctcgcgcttgccgctgccgtcgccgtctccaccttgccaccgccattcctgaccttaccgttgcgccgagctcacgcctgctgcagacgttcctgacctcaccatcgccggatctgctggcgagcttgcgctgctgcttcacgccccgtcgccaacgacctcgtcaccggcgttgctcgtagctccgccatcgtcaccatcgccgcactctctggtagggatagggatataatatgatgcaggggcattttagtcaatacgaatatacggaacaacaaatacggtcaacaaaggggcttggggtgtagagtgtggcatggttccaataatcatcatataggtttatgcaccaagaccaagaataatttaaatcgcatcaatcaaaacaccatgcaaatattctcccacaatgcatgcatcaattaaagcaccatgcctagcatgcacacattctcccatgctacatgaattgtattccgataaaattcgtgttcatgcagttatacgatgatcaatttgagaaattttgaatttcattataagatgatcaatttgggaaggagggagtaggctctacttgaaatggtgttcttgtgcgctatgtggaaattacttagttcgattgtcattatcatgaatagattattttgctatagaaatatggaaaaatcatagtgcaacattataatttccatatgctacctcttcattagagaaatataattgagatttgaaggtagaagggggaaaatgccataaaatccttaggttcatgaatagttctggtcgttctcaaatttgtcatctggtcatgcaaacaaacattatacctaggttatgacaaaaaaagttcaggcatgaacatactcttgttatggaacaaaaaatagtcactcacattggcatatacacaagctctggctcttggactacgtatttacatgctcaggccgtggccaaataaccagttgcagtagatatgccagattttgagtaaaaaaaaagaagcaaagatacattcaccgatcaaggcttgtgtacattatatggatacacaaaatatgagctgcttctgaaacaggatctgacaagttccacggttatttccttacgcatagcctcccgaacattttctgaaacaaacgcacaactgaactctgatcattatacaacatcatgttagatcgtaaagggcctttccaactctaaaataggtccatccctttctacaatcaacatgaaactattcatcaatctccatcttcacatatttatttctcaaccgttcaccaccccttcaccatactccaacggtgccttgggtgtatggctccgcaggccgcagacacctatagtccattaggatttgacactagtatctatcaggttaaagatattgaactagctaggctcttataccaattataaaattgtaaagagcatatcctacacattagtattaattcttataacgagatttagtacatattcactaaatcaatattattctcccttgcagatgatgaccgaccttagtacatacatggtgagtgagaactaagcaaatatatgctaatctttaacggttctttgtgttaaaccattatagatcaaactagcaagatcaacgtgctctagctccaaccgctcctatattacgacaccccacctcttttctcccaccccacaggtttctgaggtgacttttctcttcctcagttgaggtcctagctagatctaccatatctcccactatttacctctgccccttttcccctttcccctttctagatctaggctcacacaggacgctcatccatcaccatccccttcgctccctcctttggtatcctgaataacttcaaaccagttaggcattgagagacagagagtccactggcaccccctccatggtacggtgatgcatggtaaatccttggatgggccaatatgatggcgacatcagagatcggattgaggcctcatcctctgcttcttgctctggtgtagactggaaaacaaagactttcagatctgaccactccatgctcggtgcttgctggatctagccactacaagctctagggtcctagatctagcaaggtatggcaggacgacaatatcagtgcacgaatcaagaagtccttgctcaacgcccttagtcgtggctccaacatggtgatatgacgagatgaactagctaggcatcacaaacaacaataagcaaatcataccggtgcgtattttcttttttgcatttttttaattatcccaatatataatataatcattcatagtctgtgaaaagagaaaattgattcagtagtagttaaaaacaattagagattatacatcccaatcgttaaccaaatatttataatggttcaagaaattgttagaggctatcattttcaaatattagtaatgtggttttccctttatgcgtggcaacattaaaatgtttatttttaattggaatttgatttttatttttgatagcatatgaatttacatacatgtggtgtttgaacgtgataggtaaatctatatatgtatgtgtatgtgactgtgtatatgcatgcaaagaatatgaccgaattacccttctaaaaattgtagtaatgacttgataaaggcaagtagtaattattatcgattgtagccaaacatatgtaggaaccagatagacaaagatggggtaaagataaatttagcaacaatgaaagaaatataattaacagccaaaatatacatatctcatagcactatctcattgatccattattcatcgctgctagtttgagcacaactaggaaatcaagaggaaactcagaaaggaaaaaagaggaaagaaatgagcaccaggccagaggagaggctgacgcggcaaccatttcaaaccatcatacctgctttgtttccctcctaattttggctaggtcagaggttgccatttgaggcaggtagtgagaacgcgtccgtttgctctcaactccttgtaacggctcgccggcgaccagccgaccaccggctacaaatacaggcctcagctagcccaaatttggcactccaccctcctgagctattgcaacctagaagcctaccacacagcgcaagaagctaagctagctaagaagacgacgtcgatcatggccgggcagatgttcaccgtccgcgacgtgctgtacatgtacaccgatgcccgcaccgcctacgaccgcttcgtcggcatcggcagcaacccggagcaagcgcggaacgcggtggcgctgctggtgtggctggaccagtgcaacgtccggccatccagcacctgcccgggctgagccccaccgccgtcagcctcgtcgccgcggaggccaactcggtgctggactgcctccgcaggccggagcccgtggtgccggccatcccgctcatctccgcgctctgccaggacggcgacgtggacccgcgcttcttcgcgttccaccaggacctggtggtgcgcggcgtcgccgacatcctcgacggcgtcggctcgctcatcttcgatgaccacctcaacaagatgctgcgccgctaccagaccggcctggtcggcaacccaccggagctgatggcgacctacagctgcctccccgtggccgtgccggaggactgccgctccatgttcatcaccttctccaggggggcgcccattgaccgtgaggagatcttcgactacttcaggcagtgagtcttcaatccctatagctcatccagctcccatagcaaagcaagcaccatggatgcatgcattgacattggcaactacatatgtacacatgcaggaagtggggtgactgtgtggtgcgcgtcctgatggagaagactgcaggaggctcacagccgatgtacgggcggatcatcttccggagcgaagcgtttgtgcagctggtgctcaatggcgagcgccttgtcaaggtcaccatccgtcaccgccagatctggctccgcaagtacgttccaaggccggctgccaccgagaaccagaattaaaacatcgatcccgtccatcatcggtcattgccgtccatccatcaatcaagggcatgaataagctagctagtagcttccgtggtgccaacctcaatatttggccaatcttgcattttacacaaggctaatccttcactaaattacatctcagtcaagtctgacatacaccatgtattagcatacttttatcaatgcatggatttttgcatacataggggaacattctgacccatctcttttgtcatacacaagcatactttgttcacatatgtgttttatgctacattaggaaatccatctcaagatacatattgctaaatatgtgatccagattcgtatatatgtgtcatatcccgtactagtttgttttttataggacggagggagtaaatgatatgtctctagactggcgtagcgtatccatttgttttgctgcaagagcaatacagttgtttaggtattgggttctaagccgcacataggctggctcttgaactcctgttagaactttattggcaaatttcaggaggagagcagtgcgctgttggttctaaatctgaaatacccgacctccctgttgatcttgtgaaatggcagtatggtaagctacaattcaatgtcctccctaaatcttgatttcgccattccatagaaaggatcgtctaaggttgttgattgcctctatagactttttggccatttgcagcaagtcataaagtatgtcagaatggctgagagtgctgagtttagttaccattatcaatatatctccttctgaaaatagactcggtatccaacccaactaatctctaatcgatcaatccttgaaatgattggcatcaacatcatgtgtgttatcttggttgttgatggtggtaatcccaggtagttgcagggtaaagagctgagaagacattgtagaacttgagatataccaaggaagctagcctcttcctaggtcatataaattggaacaactgtactcttgtggtaatttacttttaatcccgagaagctggtgaaagactcaagtatctgttgtagaattaatcatggcttgctttgcatctctatcagtgtgttatcggcatattgtagagtgggtggagctccttctattcgtagtgggtggggaagtacgtcttctattctcataaggttattgaatcattttttttttaaaaaaacaactgccataagaatgaaaagtatagatggtgataacgagttaccttgacgactgaatgtgttgacccgttgtccccattcattaaaattattgtctttccagtacatatacatacaggcgctttcatgcattcacatccgtatgcgtatccatatccgtcggatttctaaagactcataccataacgtcgtttcgaatggattcgaagcggatattatctgatccgttttcacagttagattcagtagttgttcaagaacaattaggattagtcatccgaatcaaaaccaaatgttagaaattgttagtatcattattttcatctgttagtaatgtggttttctctagtctagtagtgtgtggagcatttaatggctttattttttaattttcatatgtatttacatacatgtaatgcagttttaacggctgccctgctagctagatctatatatagatatgtatgtgactgtgtatctatggatggaaaaaaatatgaacgaattaaccttctaaatttaagtcctgccatgacttgataaaggcaagtagtaattattaaatcaatagtagctagccaaatatacaaatgaattaactgatcacaggcaaagatagaataaagatatatttagcaacgatattgaatgaaatataatattaaccaccaaaatatacatatgataatatctcactgattcatttctacatcgctgcttgtttgggcacaactaataaagaggaaactcatcttaaagagaaagagaagggagaaaggcaaaaaacggaaagaaacgggatcaggccagaggagcaagaatcacacactagatgccgacgcatggcaaccatttgaaaccatcgatcaaacctgttcctccttattttggctaggccagagggttccatgcgaggcgggtagtgagaacacgtctgtttgctcaacgtactactccttgcaaccgctcgccggcgaccaccggctacaaatacaggcctcagctagccccattcagcactccttcatcctgaactatagctacttagcagcctaccacacagcacaagaagctagctatatatatctagctcttggagcttccggaaggcgacgctgatcatggccggccagatgttcaccgtccgcgacgtgctgtacatataccacgacggctacaactgcctcctggtggccgtgctggaggttccagaggggcgcctgacggaacggagggggggaggggtaaaaagaaatttttttattacccccatatatggtgcccaggtccagcaggccaccgtatgctcccaattcagttcggctggcccatctatatcccgtgtatgtacacaaacaattggagacgcaaccgcaggagccgcagctgctcggcgacgtttcagcttcgcatcgcagaagtccatccgtgactccgccgcactggtggcaccgcggcattgccatgtgccgactacaggtgctgcatgctggcatcatcggccggcggccgcggacttgatggaggacaacatcaacaccgacaacatggctgactgctctcatgttcctgttcctcctccaaatcaaaccaatgtaagcaggccctatttccctaatccatatcaaaccaatggaagatggatttttaagagattgtttggtactttatattgagagagagattgcaacgaaggtgacgacagatttgattatggacgatttcaatacagtgaagactcgtgccgtgaagtttaaatgaacatgtaagtatattgcctacttttgcaaactattcgcttttatgtattgctaatgcatgaaaaaaaaagagaaattgccaattttttgaactgtcaaaagccggctggcccccctttgattttctgtccagctccgccactggtgcctatccaccacgaggagatctttgactacttcagacagtgaatcttcaattctatagttcagctagcactattagaaaaaacattttcgcagatgttgggggattttttttttccaggtggatatgatcctcggagctaaatggccacctcggaaaatgtaaaccggggtagagctaacctttcgcctacgaagatcaatttttccagactgaccacttaagaggtctgcctgaaaaaaatataatttttgcaggcagaaccttatgtggtccgcctaaaaaatcatgccaccaaaaaatatctaagtttcatccttatcctctcctccaccactcatttcccttccactcctctctctctctctctctaatttgttcaccaccagcagcagaaatctgccgccggctcagctcctcgccgcctcagccattggctgcgatggctcccctcctcgccgcctccaccgctggacaacttgtaattaaaaaaagaatcacgcatgacatgagaaaattaatactctctccgggctgataatacttgtcgtttcagacaagggtgagatcaaactttagaatcttttattatgaaacatttttaaaatattcgtctttcaaatatggtgattacatgcatagattagtcttaaaatgtactttaaaaaatcatatatttgtacttttatacatattataatgaaaaataatggtcaaacttgttttttgaagaccgtgctcttgtccaaaatgaaaagtgttatcaacccggagggagtaactaaataggctttgctggaaatgctgttcttatgtgctctgtggaaattacttaatttgattgcccttatcatggatagattattctacaatagaaatatggaaaaaatcatagtgccacattaaaattttcgtatgctaccttcttattagagatagataactgagatttgaaggtagaagggaaaatgccattaaatccatatataggttcatgaatagtactggtcatgcaaacatacattatacccaggttatggcaaaaaacttcaggcatgaacatgttcatgttatggtccaaaatatagtaaaacacctgtcatacataagctctttcttggactatattcgttcatgtatttacatgctcaggccgtggccaaataaccagttgcagtagacatgccagattttgattaagagaaaaaagaagcagcaaggatacattcactgatcaaggcatatgtacattatttgaatacacacaacatgagctgcttctgaaacaggatgtgtgataagttccacagttaattatttccttacgcatagccacccgagtattttctgaaaccacataccactgaactctattcattacattaacattatgtatgatcataaagagcctttcccattctacaaccaacgtgaaactattcagcaatctcccctttcacatatgacatccctcagtcattcttcacaccttcaccgtacaccgacgatccctcgaatgcatggccctataggcacccatggttcatcataccttcatactttaatgtccattgggccaactatgttaaactagtcagactctcataccaatttagaattataaagggcttaccctagaaaaaaaaattgaaaatatacattgtttttgaagtttttgtgactatatacatgtttttagaagaattgtaaaaatatgcgcgtcccgcgcaatggaaacggtggactgactatttagcgcaacatcaaaacgcgggaccgatgactgacactatcccatagtacccatcgatcctgcaggccagttgcgcggcactgcgcgctcccatagagaggttgtgcgccactggccaaatacatgctgccatgcatgcatacgtcatgcaactgtccagcgtgagctgctgctggtcacgcgatgccggctgcgagatcgacgtgatctcgcacacccctagcgcggggtttatccggccaccagtgttagacttctcagtccttaatactattggatttagctatcattgtattgttgggcttgattgtgtggtcttggcctagccagcccaaac

SEQ ID NO: 52126 - DNA, 1943 bp, Oryza sativa
tcgcaaaatttgatggagataacccaaaactgtggaaaactaatagtgagaatactttagcatgtatcaagtgccctatgaaacttggtcctcgtttgctaccctgcatttcattggtaatgcagccctatggttgcagacatatgaggaattgcattgtgtagagaactggtctgaactctctgtggcagtccatagcaagtttgggaaggataggtaccagcaacatctagaggaattagaaaatcataaccaaatgggaggtgtggaggagtatcatagtaagtttgaagagctcatgcataaagtgttggtttacaacaagggtatgataaaacatttttttgtaactaagtttgtgggagggcttaagactgaaattaaagcaactatcaagctgcacaagcctcgttcaattgatgccgcgttttctctggctaaaacacaggaagagcttcttggagaactgggcttcttgaaggcattctcaaagcaatcattcagagaaggatacaaaagtttcaacaaggctccatttcaaggcaagggtatactgggagcaagccctgaagagaataagaagattgaagaaaagcccaagtgggaagagaggtttgattcactcaaggcagctagaagagccagaggtgaatgctttaaatgtggagagaaatttggcccaaggcacaagtgtccaaaatctgtgcaactttaggtgctggaggaacttttggaagtattttaaaatcaagaagaagagtctacaatggtggaagaagatgaaagcagtgaagaagagttggtcttatctgaatgtgctcccactggtgcaatgggtaaaagaactattagactacacgggctcatatagaatcaggagttactcattctagttgactcagggagttctagcagtttcctagctgagcatctggttgaggagttgaaattggctatctaggatattgcttccactaaagtgacaatagctgataggaggcagttgtcttgtacaaggatggttccaaatgctgaatggtggtgtcaagggcagagtttctcaagtgacctgaaggtgctgagtttgggaagctatgacacgattctgggaatggactagttagagagattcagcccaatgtggattgattggaaaaggaaaagaatgaggtttcagtacctggttgttaacaatggaattttgcgtcagattcggagaagaaggaagaagatcgaaacgaatttggtgttgaatcgagttgaatctggagttggactgcgcatcggttaaatattgtatcggttgataaccggacagaagcttgacttggccgatatggcaggcagccgatacggtataacttgggctcgacatgggcctagatcaagataaccgtcattgccaatcagaaatagagcttatgcaagacaattgtatctattaattaggttatgtcggtttgttagagatttcgtaagagaccgtcgtagatggtcttgtttgtatttcatctttagaaaggtttgagtcgtgcctataatagactatgtctgtactcggggtataaatatgaaccccctagcattgtaatatgagagacaatccaatacaatttcagcgcattgccacccttttcatttttactttctgacgagttcgcttcacaagaggtaacatgtctcgatggcttgtgctatcggggctattatgtcgctttagatattttaatccttttatcatggtcatctgctatcatatgtcttagctaatctagtcttagtatctagatttacctctatcggctggttctcgttttagggttcttgccagtatcagctaaatcttcctactacattagattggttaaggcatctaccatcctgaaaagtgattgttacttgattgtttagactctaggtttctttatctactttgtgatgct

SEQ ID NO: 52127 - DNA, 3811 bp, Oryza sativa
agtgtaggttgatatcagggaagcaattaactggtttagccaaagcaggatcaatgtctcagctagtgcagttgtgtgcaatttctggaagttcagatgattgtgaaaaagtgccactcctagtttaggagctgatacaagaatttcagtcaatcttccaagagccaaaaaaattacctccacatagagattttgatcatgggataccactggttcctaatgcaagacctgtcactaccaaaccttacaggtatgcacatgctcaaaaggatgagatagaaaaacaggtgaaaacaatgctgcaatagggaattatacaaccaagtttcagcccctttgcctctactgtgttgctagtgaaggaaaaagatggaacttgaaggttttgtgttcattacagagctctcaacaacatcaatgtcaagaacaagtatccaatgccagttgtgaatgagttgttggatgagctgtcaggatcaaagtggtttacaaagttggatttgaggtctgggtatcatcaaattcgactgatagagaatgatgagtataaaactgcattcagaactcaccaagggttgtatgaattcaaggttatgccatttgggctaactaatgcctcagccacctttcaacagctgatgaacagattttttgctgatatgattaagaagtttgtaaggcagtgttgtctaggttgcagcagcatcagcttttgattaaaatcattaagtattcttttgccttgcaacatttggagtaccagggacacattattggagtggacagtgttgccacagatccagcaaaaattaaagcagtacaggagtggtcagtgctaaagaccctgaaacaactgagaggatttctggaactggccggcgattacagaagattcatacaacagtatggagtgttagcaaagacactgatacatctacttaagaaggatgtggccttcaagtggtcaggcatagaacaacaagcttttgatctgatcaagcaaagattagtgcaagctcctatcctgtctatgcttgatttctctaagggattcattgtggaaactgatgcaagtagagaaggaattgagacagtcctgatgcaagggggacatcctctagctttcatgtgcaaggctcttagcccaagatcacaagccatgtcaatttatcagaaggaatgtatggctatgttactggctgttgagaaatggaaacaatatttgcaacatgccccatttgttatctatacagaccacaaaagtctcattcacctagatgagtagagattgaccaccaacatgcagcataaagcattcattataaattgatgggattgcagtacgaaatcaggtataagaaaggggaagacaatagtgtagcagatgctttatctagaaaagaagagactgaagtacttcaggccatccctatcgcaaaaaagaagtgcttcaggccatcttagtaagccagcctaggtggttggaagtggtgatagaaagttatcatgaggatgctaacactcaacagttacggcagaaacttacccttcagcctgcaggattgtacaattttactcttgttgatggagtaatcaggtttaaagggaaattttggcttggaaaccatcaagaagctaaacaagttgttctactgtctttacatagcagtggtgttggaggtcactctggtatacatgcaacttacaaaagagttaagaatctttttgcttggccaggtcagaaataggatgtcattacttttgttcagacatgccctgtttgttagcaggccaaagcagaacattgcaaaactcctaggctgctccaacctctcccagtgcctctgcatgcttggcatacaatcagtatggactttgtggagggattgcccaagtcagatggctatgatacagtgctagcggtggtagataaatttaccaaatttgctaagttcattcccctgactcaccccttcacagccttgttagtagcaaaggctttcattcataatatctatgatgtctttgggatgcctcaagttatcatatctaacagggaagggtcttcaccagtgcactttggcaagagttgtttcgtttggcagatgttaagttgaatatgagctcctcatatcatccacaaactgatgggtaaactgagaggctgaatcaatgtctagaagcatatttgaggtgtacagttcatgcttgtcctcacaaatgggctgattggttggcacaagcccagcattggtacaatacatctttccactgtgctcttggcaaatccccatatgaggcactgtttgccaggcaaccaaatcagtttggcttggttgatatgaggtactgtgccagatgttcagatttggttacagaatagagcacacctcaatgagatactccaccaacaacttcttagaggtcagcaacaaatgaaggcacaagctgataaacattgatctgagtggaaattgaagtgggtgacatgatgtatcttaaactccaaccctatgttcagatgacaatggctcgacgatcctgtcagaagttgagctttcgcttctttggtccctataaggcgttagctcatgttggagcagtggcatatcatctagaactgccagaagggagtttgatccacctagtcgtgcatgcatccctgttgaaaaaagctctgaagcctaacacaccagaaagcgcagatcttccccttaactgctttgatgattctacagttgtgcagcccgaagccatccttcgccgacagttgatcaagcgtggcaaggcagttgtacattatgagtggtgcaatatggactggtcttcctgctactctggcgacatgggagaacctacgacagctgaaacaagaagctatcaaaccaactacctatctcctcttcctcctctgcttgctctgtttcttcctcttgcaactctaaaatctcgttgattcaaatccctcaaatccctgtgcgattcgtcaggaacccagagttcgtaacaactagtctcgtgcctccacgcagcacgaaacaaccagtcgtgcgtcttcatatcgcggtactcatatattttcaccattctttcaaaaaaatgtatataatcgcaaaaacttcaaaaacaaggtatattttcaaattttacacattaattcatataacgagatttagtacatacaactaaattttattcactacgtcaatattactctccttccatggtggctaagcacaaagcaacatatgctaatctttaacggttcttaatattatcattgaaccattagagatcaaactcgaatggtcatatttgagaacggttaaaaatgtgaatccgatgtttaatacttcctgataaaaaaaacattatttattatttgtagtttaggttccttgtggtagaactaacctaccctggttcaagtctagacacgcctactcgcatttatggttaattattctttcagtggtaggcgatgtagccgtcggtagcgaggcgtccatattggtgacttcgtcaatctcaaggtatgccgaccaagttttctggaggtgctcataaggtaggatgtgcatgtgtacgttcatagaggtgagtatacgtgttttatgagtgcctgcgtttgtactatgtttctcaaagaaaaaagaagagagaacaatttacagattaggcaggatcaaccactctgcctctattctcccaccccacgggcttcctatgtgacttttttcttctcacatgaggtcctagctagctatgccatctcttgccctatttgcctctcatctgccccccccccttt

SEQ ID NO: 52128 - DNA, 4849 bp, Oryza sativa
tatgatggcgacaggaagatgaagccttttagatctggtcactccaagctcagtgcctactgaatttggccactcgaacttagtgcctgctgaatctggccactccaagctcttgggtcattgatctggcaaggcaaggcgaaataatatcgatagtgcatggctcaagaagttctatctcaatgcccttgccctacgctccaacaaggtgatatgacgagatcaactagttggccatggcaaacaacaagcaaaatcgcaaaatcttataaaggcgtattttttcttgcatttttttgaattatcacaatatgtaatgtaataatgcaatagttcatagtttttgagatcattgattccatagtagtttaagaacaattagagattagccatcccaatcgttaacccaatgtttatagtggttcaagaaactgttagactatcattttcaattattagtgtgtggtcatatttaacagctttatttttaattggaatttgattgattgaacaatttggtgatgggtcatagcatatgaatttacatatatgtggtgtttgaatgtgtgccgtgctagctaaatctgtatatgtatgcgtatgtgactctgtatatgcatgcaaaaaatatgactgaattatccttctaattgaaatccttccatgacttgataatggcaacttggcaatctaccctatagttcaacaaatactttcactcattctttcattctttcattcatcgctcaacggtctagattatccctgtgaaatccaatgctccagattcaccctccccacaaacgagtgcccccttcccaccccaaccgcgcccaaaccgtgatcgctcctccccagccctaatctctctcttctccctctcacgccgtcacgcgccgccagctatcttcaccatcacaccgcctcgccacgattgacgtcgccgctgaccccagcttcccgtagaacgctaaaccctaacctctcctctctccccgccgctcgaggtcgcgcgctcatcgctgctgctcgtcacccggagtgagcgatgcggtcaccggagatgagcacaaccgctggggcaccacgctttctcgatcggaggccagcacgatggaggaggttgcgggagagacgctgtcacacgctgttgatccggttccttgctactagatcaggatgcagtcccatttttttcgtaatctgcatgtaatcctagggttggaggaaaggcactgtggagaggtgaaagtggagacggggtgccggcatgccgatgcagacgaggggccaagaataggtgaatagctctgttctattgctagctagctttttttttaattactatgacaaattgatcaatctccctgttggatttttattaattctgatggaggaatggcgttttgttttgattaacttgtgccgtttgatttgcaggattactttgctagatttagcaattgtataatattcaaaacagaggctttcactatcactaattagagagcagaaacagaaagaatatagagtcagagttggtgtaccctgcaagtctgatgattggattgtgcatgaaccgcaatttgcatttcatgctactatggcattatgctaagtgaatcttgctgaattactttattcaggcacaagtaatttgtgtcggataatcaattctaagtagtgtctatgtgaataccatttgaacaaggagctgtgtgggtttttaggattcaattctaatgaagccaaagaaaatatcttgaagatatttttcaggttattgttgtcttttgtgtccttcagagatagggattttgtactaatttagtcactatcttgatatacctgtgctgctgctacccataatactaaagtctgcctagataatgattttcaaactgcattgcatgaccagaaatattatcagttaggattagattgttctcaaggttttaatgattgtcacatggatagttctttctactactttcactatgtaggtgcatatctatgggagtaatatatgttccatgtgtgtctgcatcaactaaaatacctgatggatgtacatgttcattaggaaattagagctgcgacaaataaatttcatgatttttgttcccaccatcatagtaaatttcatgtgctatagaggaatagcaagctaacacacgttcttgagattctttaaacaatcaattatttacttgttggtaggcatctacagttagatttgtggttccgtgaatatattcatcacctgaagtaatcaacagatttgagcactttgtgtatgcaagtagttgaagaatttcaccatgttctgcttgatgtgaacattatgctagagttcctgtagatcctggcatcacagtcccttaggtttggtaaattcaaatttaccatgttactacaacatgtacgataatttacaggaatatgaaatttttagaccaaatatattacaacaatatatataccattgtttggtttttcaggttttgagacatttgaacttattttgctaaaatatgtatcttttagcatatgattgtttaattcacattactaaatatcgccgtagcgttagtacgggcatattactactaagtaatggttagcaatactttgcgaccatatagatgaaactttctaaaataatttataaaacgggcaaaaaaattgaaatctgaacgaaatatggcttatttaattctttctgcaaaattcatcccaagttgcggaaataaaaacattttggggtacaaatagaacagaaatatctggaatatttaaaaaatacaattaaaattgaactaacattgactgaatttaaacaactttttctattttggggggaaaagatatcctaagggagatcggaagacctgatttcataaatttcattatgaaattctgaaccctggccaactaggcgtccattcaagccagttgagcagcagacattgaacagtagaagcacaaactaaactaggtgacacactgctttgtaatatataaatatatttggctatatacacagcgtcttcaatattcttaacaaatggcagaagcataatccataatattgctaaccataatccataaactgctccttttacatttagaaactttaaaaatacccataatttggatcacacaaacctgactgttgagaaattgcttttttgatagaaagccccaccccgatatagcatagttccaattttccctagtatgggtaatttggaaccatgccattataattttgtaaagtttgagatatgccatcggtatctcaatgatatgtaggacccacatgagtcaatgacatgtgggtcaggatggcatatcttgcatgtattttttaaggggcatcttctatgcataagaactctttcgatacagaactaaaacactatatacaattgagttaaacacatcctattatgtacactatactgctttctacaaaaagctagcctctttggtctctggtcaagaaaaaaacaacctatcacaaacttacagaaaatggaattcctctgcttacttgaggaagaaataaaactcgtcctgtctggttagaaggtgattgtggatggaaattctgctgcagttctgcctcgatatcttggacctcaccaaaaggggtgggaatggtatgatgctttgtggggaacaggaggcggcatcccaagtgtggaaaggaaggagtgggagatagtacatcaggagagaaagagatagacctggttgcaaatgcaagtgatggaagttctatgaaggccgctgaatatattttgcgtatatgaatgatcaaacagcctatatggccagaatgaaagatcgggaagtctttgtgtttaagatgacgtcgtagattattttgctgggaaaccctctggtttaacatataagaagatagatcagatatgttgtcagttgctatgcatcctcaggaataacaaaattgcaatttatccaaaatggggaaagaatataagctttcttgtagctgaaactagagaggcatggcaatgaagttagttcaagcatggggtcacttacaaattcaagtatcagaagtttgttcctcgtcaactgaaatcatgacacggcatcccctccccctagctggctcatgatcatcaacagagagctgaggcatgcaaatcaagcgaagctctaccaaatcatccagctggtgaagtacatttgagatgctcctcagcatggtacacttgagagtcaaaacagcgagaaacgccatggatccctgctgcaaattccactcctccaaaccaatatccataagtaccaaactgcgtaatgcaaggaatccctcggaagaacatgttattctctttcctgtgtatgatgagttaacaatttcaagcacttcaagacgtggaagtctctccagaattggcattggatcatcatttagtatattgggacaagatatcttgagctgcaatagaaagtttgggaatagattatgatgtggaagcacatcattcagaacgtgacgctctttaaaacatccagacaattctaaaccatcaactttggattctaaggcatctacccttatatctaaattgtattcttcatgttcttgggtctctttttccttcacgcgtttagtagaggctatccctaagcaccaggaaacatgttggctcattttttgcagagacctgattgttcttttccacgtcagagcatcacactgcattatggaaaatacataaagagtctgcaagcttcgtttcgttctaatctcctgggctttccaatgcagtacttggtagacatgaacatgctttagtgctgcgatgct

SEQ ID NO: 52129 - DNA, 28128 bp, Oryza sativa
agattcagaactgattttcccacttcattatcaaagtaaccatgaaatgctacacggtaacacctctgttcatctgcataataagtctccacatctgtgccgcttgagcaaactttcaagaaaccttccttcctggcttgtccaattccccactcacgcaacacatcatgaacttttattttctttatccacccaatgtttttacttctttcttcaatttggatcatacatctctgtgccagctcttctacatatctgtaggcaacttcttcttgtgtatatcctcttatatttgggacaaatccctcagcaatccacatctttttaagaacatgaactgtgatagggtagtcctcgggaaaggatgcagtataaaggaagcaagctttaaggttatttgacatattgtgataacttagagctaatatacgtccaacatcgccctcctttttcatgatttcccagtctacactagcaaccattttctcccatgtatgaatattgtggtttcgtgaaaggaagcaacctaaaaccactagagcaagtggcaagccattgcatttcttggagagttttttccccaccacctcaagttctgtgaattgcacatcatgtggaaatgccttcttctggaaaagttcccagctcttgtcttcgtctaataggtcaggggtatgaatttgcactttagttttaggatgttgtccaacttccatatcacgggtagtcagaattattctacttccatttcctttgtcaggaaatactgatttgatcttgtcccaggtatctgttgtccagatgtcatccaaaacaataaggtagcgctcttccttcagaaaatcaaaaataagttttgaaacctctgtctcaccatagaaatttaaatgcatgctctttcgctcgcttatcttcccagtgccccttatctgtcgcacgagatctcttaatacttcaagggcagaatattttggagaaatggatacccaaccatatttgtgaaaataaccttcagttatgactgaactataagctagttttgcaagtgtggacttcccagcccctgcctgaccaacaatcgatataacagttagattcatgttattttggtcaagcaagtaactcttaatttgtgcaatttcatgatcgaatccaactatatccattccttgatccaaacccggcggcacaagcctttgtgcatagaaatcctcatcctccctaaaaatgggctgtgcttccgttgaagtgctagaattaactgcgttgtatctgttgtaccgctcaaaaatctcactaatttcctttcttataacttgtatgtttttgccaccctcacggaggtcaatggaatcaccaaagatgtgagtatattttgatacagaagtctttctcctcctaaaaatgaaatgagcattgtcaataacctcttccacccggtatgccacgtcttgaatattactggccagatttttcatcatgctgtttccttccaaacatttggcatccacaacatttaagaagcattgcatctggctcagttctgctttcatggatgatacttgtcgaggaacatcacttaaaaaggtagcttcttggatgacaaggtcaccaagcctctgcaaaactgaggaaactactgatgctgtcatgcttagttagctgaatgaatccaccatgaatttagatggagaaagttgcatagccagtaaatatcatcctgttctgtccttattgtttaatagtacttgatgagatccccttatgttattgacatccattaatgagagggcaatagatatcttccctagggcaaagtcaaataacaatctcagttaaatctatggagagaattttagaaagaagttgctgctctgctcaatggagataaataactttccagcagaattttttttttcttcgaatgtgggcatggaaaatcatgaaaaagacaaacagcgtggcgaagagtggtggtacaaagtaagagaaaagcctacggaatccagatatggtcaagcagaaaaggaacacagaaaatatccccttcagtattattgacgaaatttatactatacacccttcatcaatagttgaatcttgctggattacttcttttctcgttcagaccaggtcgttaacaaccattattaccctctagattcaagaaaatttagagcataatcctaccaagaaaatagttgctgaaacttaaacatcgaaacagcacatcattggtagagtgaagaaactgaatctttaaaatagagagcagaaattaccatatccatggttgagcgagaggggattgcggctggggaagagacattggaccgatttggagagaggaactgaaaagccccaaattgacttcgttctggagctgggctacagtcgtcgactttcaagcatcagtacaggaaggataaaaagtgccgaacatggagacagataagcagtagtggtggggctacgaacatattccttttccttctggacgctaccactcatatgttccaaaattacaaatttgtcctttgtatttgttgcaattttcatgtaagaaatccaacgaggctctgtttttttttattggccttgtttggatcctcagagctattaaatagccctgtagaatcttactatttaggagtattaaacgtagattaccgacaaaaccgattccataaccctaggctattttgcaagacaaatctaatgatgtatattaatccatgattagcgactgattactgtagcatcactgtagcaaatcatggattaatatacctcgttagattcgtctcgtaaaatagcctatgggttttgtcattaatctacgtttaatacttctaaatagcaagattccggagggctatttaatagccctccggatccaaacagagccattgatcatgtcgacggaactctaacttctcaatttaacttactttacactttctatcactttctattttcttggtgtcctaagaaaaccctacatctttctgggtatatcataatacaagtggattttctttttccttttttggcaacgctacccctgtaaactcagcatagccatgctgcatttgtgcatgttggtatatacaccatcatccatgtcagagtactgtattgcaaaacacatctattatctatctattataatactacaagtccattaaatttcctacaaacacttctaagctgccacttggcgctctaataaattagagaaatcaaagaaattctaaggaaaaagcatatattctaacactttgcatgctaccaacaatcgtgaaatattatagaacaatttaatatgttgattatgctaccatacatttattccatcctaaaatataaacatatttagaaaagtgctaagtcaaacattttaactttaattatttatagtgaaaataaataaaagatcaatcatataaaaatgatattaaatacaatgtcactcttctatctagaacaatttattttttataaatataaatattattagtcaaagtagtatcctaaagaccgttccaaaataaaacaaacgtatatttttaggacagaatgtggagtgatctataaacatacgtatctaacaaatagatttaaaaataagcaaagacgctaaagaataattttgaaaaagtgtaatacattcggtttttaatggatggcgtcgttgaattttgtacgcacatttgaccatttagttatatttaaaaggtaataataattatttattttgtttttttagaataattatttattttgtcgtggcttagtttatcattaaaaaacatgcctgcacgaatgcgcaggctactttcttgattataatggggaaacaagttaactaatccaacccaccgactaggatccaccaagcactacagacaacttacgttaagtatggattgatgatttggcaaggcccctttttttttttgctctggttcataaaagctgagagtttgaatttgaaccttagaaaattgtgacttagcaaaattatctttctgtcattggctcccctactaaatcatctctcaattttgacttaaaaatactgttgctgttgcaattggtttcagtatgacgtaaattttatgattcattttgaaaatgaagagaataacatgaatttgtctttgctaaaaaacttttcctctatttcaaatttcttttgttttcgttgccttatactacgtatgccctggcaatctggtatcatgcattgatctaccaagccagcagcctgccagtgccaggttcgtatgaggaccctaagtaaagccctatgccccaatgggtgttttgaaaaagaacactattgttttgttcgttggtgcatttgatctatttcgtttcgctgatccaatgctttgccaaatattaccttgacattcttaacttgttatggaaacatttatgacaactcagaaacttcttacaatttcaaacattacgatcctttgtactcaactaatttaacttttgcatgctttcagtaggtcgtgttaagaactgtaagaagctcttgtaagaatctgatatcattttgttaatgaaatgggagaggaatccctctctttctcgaaaaaaaataaatttttcactagcagattttcgcgataatagttatacattagttttgacggaattagcaacatgttggcgaagacgatctatgattctcgaatactgtgatgaagtccctagttaaacggataggtgtattattttgtcttgcaaagctgtaagaagttatcatcactttctacaaagtctatttgtattttcttgtgtgtcaggcgcaaaataaatttactagttctctcaacgattatcccagtattgcctctctagcatggtattgttgtagcattacctatgaaaaatgtagtacagcatcagtagggtcattgttcaccggcgttagaaagttaccaattcagcgcctattggattgaattctggccttctaacttggctacaatggatcgattttctatgcaccaatagtgccaattcagaaccatgggttatgtttatacctggccaaaatgttgttggcgttcttctaaagtatgaaaggtataatccccaacagagcttatatatatatgtcatgacagatggtgctctgcaatgggtaatcattggatagaccatttgtcatccaatgatccaaacaccgatgttcggtgggggtgaggatcgtctaccataacgtcactaccatcatagtaactagtatgcgggttccaacttcctattgctccacacgtcagtgcctgtaatggtagtgctattatagcagaggatgtgaacccagtgcaaagatattattaaagtttaattttgttatctcgtccttctttagcatcgcaggaaatgtggctacttgaagaaatttgtcttcgaagaaataattgggctgtttggttctgaaattctgaaccactcatggtatgaagaatcaagaaaattcacatgatattcctggttttcttgtaggatgtgtagatagatgtagatactatctaccttcaacttgtgaatttattgttgttttcatcaaacacataggtgatttttgttgctagagcacaaacaagactaatattttattgaacaaatagaactccctctagtcacaaatatgtccttttattttattttttttgaacttttgaaactttgactatgacaatgttataattttttttatttggattgaggtaaaaaaaacagacatcacaaagagaaaacaactaaacttttgttgaaaatttctatgttctttctcaaacacgaagcatcatttgtggcttataaattccacttacaagatttatttgagagttctgtttgcagcactgttgcactttcctccccttccgctctcaaaccttatgtgcaccaggtaaaaccgtagccaaaaccatctccattttcaccaggcgtccagtggatctctcaaaatccaccatgggtgaagcagccatggacaagatcccacataatggggtactcagtactcccaagtgcttgagtgtcgactggtagcttaagactgatccagctggtagcatgtggtcaatctgaccaggagcctcatggtcagacctgaggaggctgactctaaatctaactactcgctccatttgaggttataagatgttttaactactatttaagtttgactaagtttatatacaaatataataatatttatattatcaaattagtttcattaaatcaataattaaatatattttcataataaatttattttaggtcaaaaatattattattttttcttcaatttagtcaaacttgaagcagtttaactttgaccaaagtcaaaacatcttataacctgaaacagaggtagtatttatcaacctgcattgagtagcaaaagagaagaactaagtatagctgattagtttgtaattaactaactcctaacgaactaattatgtcatcatgccaccttttttatagcaggacaagccctccaattcattaacgaagtaatgcattcaaaaggtcctgagtaaaacaaaaactaaacagacaaattgttctgctagaaccatgcatcaacatcagttcagtacgctagctacatatacttcgataagagcatggaacaaatgcaattaacacacacttctatattgatccaactaaaatttgtgtgcttccaagaccttcaagaccgcctgtaaccattcctgcacacatgattaaccaccaccatccacgctgtcaagtgtcaaaagcttcttgttctcctttcttcaaaatagaccataaacctaaccagtaaggcaataacagacatttaatatcaccttgcagatggactgataacttaattatttcagaaacacaaacagatctataccgtccccgcaaaaaaaaaaaaaaaaaagatctataccgaatcttcaacagtgcagaaaattgctgaagaaccagttcaaactagatcattccaacaaggctgtgtttagttcagcgcaaagtttggattttgattgaaattggagatgatgtgactgaaaagttgtgtgtgtataacaggttgatgtgatggaaaatgactgaagtttggatccaaactttggatctaaacacagcccaagtgagatgctattccagggataatgggtaagttaaaaggccatgtcactatgttagagtgctacatagcgaacaattgcttcattactaccacaaaattgaacaataacagccttgtatgtgttgtccaaactgagaaactaccagtcatgcaagtatgcaactaccaaaaaaaattcatctcccaacagatttcctatccctactgaagatgaagtctgatgtctgagagttcaaactaacagtcatgcaacaattgttctccattctgataccaagaattttataaaattgtattaaataacaatcattcgaaaaataaaaaatatcaagttaaatgggcttaaattagtgatcagaaagcgttcaaacactttattcacaaaggatacacggcaatgtactaaacaagaaaaatgtagcccaatgtacagggaaaagagaactgatcatggtggcttcaccgtagtgctagtcactgcaaaaatcaactgttgaaaattgactttccctgaatatatatactagtaggtattctagtgtcacataatttacagtgcactaggcaatttgtgttcatgggtgcattacccttgaattaataaaatgtgtgtagtaaacacggtaagaaaaaagattgcaaagcaacattttaactttgtgcgtctatttaaagaacgtttaactttgtgtagaattctactagactactaatccgaatttgtacaactttgataccacgatacggaaagtagcaaagctcagcactagaaacaaacattgttaacacaaaaacatcaaaattaaagcaactagatcgagaattacagcaagattaaatgggagaacatgttctaccttggacattgacaattactgtcttgttgatcaatcagcaagagccggcaatggcggatgcagcgccatcctgtagggaagtgccggcccagagtagaacctcctgtgaggcagatcgatgaacatcatggtctcgaggcttagcgcgaacacccatccagagccgtagtgcttgaggaagacgaagccctcgccggcgtccatgatcctcgtcgggtagccatcggcgtccgcgaagaacagcggcgcgccgtgggcgcgcactattagtgtgaacacaaatgtgatctttcagctaaaccaaagtcagcaagaaagatttttttttagggcaatcgctacagcgatcgccccttcaagaacatccccgatcggggggattaccgccttaaccctagtgccggttccccctatgtgcagtggctataaatagagatcaatacctaagagttaaaccctaagaaaaatttctctagctacccgatcaagcaagccactgaaacacagggaagaaccgagacacaatcctctctgtgcttccaaacgagaggaaaagaaagaagaacaaacaacagagaaatgggaactccgggagatcaaggtatgattcaatcccattccaatttgtagttccattttgtgccaaaccgatccaaagaatatccaacaatggtatcagagcaccgggttggcctcaaattggaactcaataagtgttcatgttcaaattgttctttatgttcaagcccaaacccctctgtcaagttgagttaagcccaaatcatgcaatcccaaagcataagaagtagaattaggccttctagggtttcggcttgaagaaattagaagaaggggaagcaaaagttcatggaaatctcagacaaatccccaagaaccgaaaccctagctacagtaaagacctcaaaatttccccaaatcatgaaaccctaaccctaaaatcatggagaaaaggagtgcggcgggcttacctaagggcatggtggccggcggcgacctccgtgtcgccaccgacgcaataagaggcgagcgcgcgcccgaggacttggtccccgagcggcctcgcgacccgccgtgccggcccggctcctcctcctcgccgacgccgcctcgctgaggtagccgtcgccgccccgtctcgccgtcgccgccgcggatcttcctcgcgcgtgcgactggcgggtgcattagggcaccgtcgagcaacgctcgacagggatgcgcgccagctatggcggcacgcagccccgacgagcaaggctcggcggcgccatcactactcccgccgtgcgccgtttcgccgtcgtcgtcgtctcgctcacagtcgccgcgggtgtgagagaaagaggggaggagaaaatgggggctagggtttcgcggggggcagtcgcgcgccggttttgtcccgcgcgggagcgatctcggccgtccgatcagatggacggctcagatcggctcgctcccgacgcgggatgacgaggccacgcgggaggcggcaaacgccagcccaggcccaggtttttgggcctggagcccaggcgggaggcggctcggccgtaacaggccaggctgaatgcggcctgcctcagggaagaaggcccagataaaaaaaaattgttatgggctgcatagtaacgggctgcatagtaatgggcctaattaaaaagattgggctgagataatattacaattaaattttccttttttgatgaattatgattatgattatgatatttgtgtttaaacattgaagatatttattatgttttagttaatgataataagaataataagtgattttgttatgtgataaaattctctttcatttatttatttattttatgatcatattatatttattagttaaaattattattgttattgttgttttatgcattatgaagtttatttccgctacaaataaatattacaattaagtgtgacaaataattgtcattctggccaaagctgattgacttttatttgatcacaaaattttattaattcaattcaaatctggccaaagctgttttgattgaattaataaaaggagtttaaacaaattaataaagtgtggtttgtatttattattctggccaaagctgattaataaatacttattcacaaaattttattgttcatttccttctctggccaaagctgttttggatttgatcaataaaagaagatacttatttagctgttgattctctcttatgcagcatcttatgcctcacaaatttccggaataatgggaaatattgaacaacttaatggaagtaattatgcttcatggaaagaaaagctggaaattactctagctatgttggatattgattatgccctccataatgatcctccagttgaacctagaccggaaaatgagaattatgagaccctaaaaaggatatatgatgaagtaaaggcaaaatgggatatttcaaaccgtaaatgccttatgattatcaaaagctccattattgacgcaataagagtagcagttccagatactcagacagctagagaatatcttgctaaaattgaggagcagtttaaaggctcttctaaggtttatgccaccactcttattaaaagattggttaatgaaagatatgatttttctggaaatctgagggaacatattatgaaaaaatgtcatatggcttctaagcttaaatcaatggaaatggaaatctctgaaggttttcttgtccatttcattatgtcatctctgcctcaggagttttctccatttacaatcaattataatgcaatgaagatcaagtggggcattgatgaattaatagccatgtgtgtacaagaagaggaaaggcttaaggcagaaagagttgatcatgcaaatctatttaaacactctgagaagaaaaagtataagaaatttaagaaggagtatttgaagcctaagcctattcagtttaaagaaaaagggcaatcttcgagtcaatcccagcagaataaatctggaggaaatccctatacagaagaaaaggaaaaagaaaaggatgggtgctacttttgtggaaagagtggacaccgccaaaaagactgtattgggtttatgagatggctcagtaagaaaggtactgatgttatttcttttgttgatgaatccctgaatattgattatgccaccaattcttggtggattgactcaggagcgacaattcatgttgcaaattccttgcagggattcgctatgaggaggaccctaagaagaggggaaagaagaattagagttgctaatggagttgaaactgaagttgaggctattggagacttcactctcacacttcatactggcttcaaacttcagctacatgatgttctttatgtaccctctatgaaaagaaacttagtttcagtttcacgtttagataacggtggttactattgtacttttggaaacaatagatgtataattatgcatgataataaagaggttggtctcgccgttggacgggaacaactttatcaaatctctgtgtgcgatgccacctataatgtggactcctcctcaaatgcaaatatcagtaccaaacgaaaacataacgataataagactttttcgaaattatggcactatcgtttgggccatatttcgagggggagaattgagcgtctcattaaagaaaacatcctttatcctttggacttctcagatgcagatgttgttcactgcattgattgcatcaaaggaaaatattccaagcaaatcaagaaaggtgcaaatcgaagtatgggagttttggaaatcatccacacagacatctgtggtccatttaatgaaaagtcagtggatggattcgattcattcataacattcaccaacgattactctcgttatggatatatctatccaatcaaagaaagatctgaggcattagacaaatttaaaattttcaaagtagaagttgagaatcaacatgatcgaaagatcaaaattgtaaggtctgaccgtggtggtgaatactacggtagacatactacttatggtcaaattcctggaccttttgcgaggttcttacaggaaagtggcattaaggcctagtactcagcaccgggcgaaccccagcaaaatggagtagctgaaaggcgtaatcgcactcttatggatatggtacgaagtatgttaagtcactccactctgccggtaaagttatggatggaagctcttaaaacagctacacacattcttaacagggttcccagtaaatcagtccctaagacaccttttgaattatggactgggaagaaaccaaccctaaattattttcttgtgtggggttgtcctgctgaagcacgagttttcaatccaaatatgggaaaattagacctcaaaacaatcagttgtcattttatcggttatcctgataagtcaaaggcatatagattctactgcccaaattagtttacaaagttcattgagacaagacacgctgtgttcttggaaaatgacataatcaaggggagtatgacacccagagaagttgttctggaagagaagcggaattatgttccaatgcctataattgaagaacccgttttctcaacacatactcatgttgcaccttcaatagaaagaaataatgatgcaacacctgctgaagctcctgcaactacttctagtagtgtatcaaatggtgagaataatgaggatgctcagcagccccagattgtgatagatgagcaaaataacgagcccgtcagaagatcacaacgagttagaaagtcagcgattccaagtgactatgtcatttacatgaatgaagaggtgaatgaacctatgattgaagaggtgaatgagcctatactagataatgatcccatctcatttaaagaagcaatgaagagtgaacattcgtctgaatggctaaaagctatgaaagacgaaatgaaatccatgagtacaaataaggtctgggacttagtagaaattcccaaaggagccaaaacagttggctgcaaatgggtctataagactaaacgtgaccccaagggaaatatcgaaaggttcaaagcagggcttgtagcaaaaggatttacacaaagagaagggattgattataatgaaacattttctccagtgtctactaaggattcattcagaattattatggcactagttgctcattatgatttggaattacaccaaatggatgttaagacggcattcctgaacggtgatctgtatgaagatgtatacatggcacaaccagaaggttttgttatgaaaagaaaagaacatatgggatgtcatctaaagaaatcaatttatggactaaagcaagcatcaaggcagtggtatctaaagtttgaccaaatcataagacaatttggttttaaagcaaataaaaaggatgactgtgtatacgctaagtttaaagagagtaagttcatcttcctaatattatatgttgatgacatactcttagccagtaatgacagaaatatgctactggaaacaaagaaattctggcctctaagtttgaaatgaaagatctcggtgaagccacttatgtgttgggtatagagatttaccgagacagatcaaatggtgttttggggttatctcagaaagcatatatagaaaaggtactgaagaagtataatatgcataattgttcagcctcgcctgctcctataatgaagggtgataagtatggaaagttccaatgtcctaagaatgagtatgaagctgcgcagatgaagtcgataccatatgcttcagctatcagaagcataatgtatgcacaagtgtgcactcgccctgatttagcttttgttaccgggatgcttggcagatatcaatctaatccaggtctagaacactggaaattagctaagaagaccttgcgttatctacaaggcactaaagacctcatgctcacatatagaaagtctgaaaaccttgaagttgttggttattcggactctgatcttgcagggtgtgttgatgataagaaatccacatcaggttatatattcacccttgcaaagggagctgtatcgtggaaaagctccaaacaaagagttactgcatcgtcgacaatgcaggctgagtatgtggcatgttatgaagctactggacaggcaatatggctgaaaaactttatcccgggattaagagtggtcgacagcatatcaaaaccactcaaattatactgcgataacaaaccagcagtatactatacgagtagcaacaaatcaagtgcttctgccaagtacattgatatcaagtaccatgttgtgaaagaaatgatccaggatcagacaataagcgttgagtatatgaacactaagttgatgttagcggatccacttacaaaaggcctaccacccattgtatttaaagaacatgttgccggcatgggtttggtagaaaagcctttgatcctggaataaataggaacctatatggcactgactccccataaaactaaggcggactcattttgaaattaaataggaaccatagtcacttggttcagtggtgcttaattgactactgtaatctagtgtcttgatgtactgttttattgaaaagtgagtccataagtttgtataagcctaatgtaataagttcaaagagctcgtaagattaaagaagtttgttttaaagtataatagtatgctatagtcactggattctgtgatgttttatattggtcactgtaatcttttgtcttggtatactattttattgagaaataaacttataagtttagcctcacgatcaagggggagaatgttagtgtgaacacaaatgtgatctatcggctaaaccaaagtcggcaagaaagatttttttagggcaatcgctacagtgatcgccccttcaagaacatccccgatcggggggattaccgccttaaccctagtgccggttccccctatgtgcagtggctataaatagagatcaatacctaagagttaaaccctaagaaaaatttctctagctacccgatcaagcaagccactgaaacacagggaagaaccgagacacaatcctctctgtgcttccaaacgagaggaaaagaaagaagaacaaacaacagagaaatgggaactccgggagatcaaggtatgattcaatcccattccaatttgtagttccattttgtgccaaaccgatccaaagaatatccaacacgcaccagatccagccgcgactcctgcacctaccggcctctactgctcctgctcttgtcaagatgccagaagtcgagcgccgccgccgcgaacgccacgacgcggagctcgccgtcgtcggatctcatgacgcacatgttcccgcggtagcgcgtccacatggcgcgcggcagtttgatgttggagaactgcttggtgcgggcgtcgagcgccaggaggtatgggttgtcgtcgtcgtcgtcgtcgtcgtcgttgatcagccagtagacgctcccgttggtgtgcatgtcgtcgctgaatgcgccgagcatgggcatgatggcggtgccggcgtcggagtaggggtgcacggtccacgcgccggagcgcgacgagaagacgcagaggcgcggcccaggcatgaagtaggtgacgacgatgatctcgaagcagaggacgccgccggcaccgccgtcgttgtcgtcgtcgatgcgcagcgcggcgccgaggtacgcgctctccgcgtcgagctggtagaagcgggcgtcgcgcacgaggacggagcggccggacacggggttggcgacgacgaagttgcgcgggatgctcatgcggtcgttgaaggtggagcagaggaggaggaggccgtcgcgggtgtcggcgagcgcccagcggtcgacgtcggggagggaggcgagggagaagtggccgcagcggctgatggcgccttcgaattccctcggcacggggtggaaggtcgggaggaaggcggggtcgaccacctcgccgacgagctcgccaccgaccttcctcgagacggcgaagccgttgttgcagacgaagaagccgaggagcgggggcgcgtggcgatggagccggcggaacaagcggaggaaggtcggggacgacgcgacacggcgccagcggcggcagacggtggcggcgcgcgcgagggcggccgcggaggggaggcggagaaggatcacggcgaggaggcggtcgtcgagctccgccgtggcgtccatggcgggaggcgaccgcgctttcctcttcccgttcccggccattttctactcaaacgcaatgcgcggttgggttttgggatttgggatttgggaagatggcgatggtttcgggcggcgagatgggagggagagattgatcgtgggggatatgcacgatttcccgttacgaggatatgcacgatctccttttcacagggttggggttggtgccttttttttttttaaattacacagtacaacacaaatactcacaacgcacgcgcactcacccctatgaacacacatacgtaaaccctacccctatgagcatcttcgaagactgggccgataaattctggagagattgacgaagtcaccataggcgcctcgctgtcgacgggtacgtcgcctaccactgaaagcacaggggttggtgtcattttgaaaatgtactcaccctcaaaaattgggatttaaaatacagaaactaaaaataaaaacctttaaaaactttgcgaaaacatgctgaacctccaaacaatattcaactataaaactgggttatttggagttttacctaatgcttaattacagtttaattgagaggcattgattgtgaattgtatattatcgtttaaagaaatattttgcaattcaaaagcaaatctgtcttcacactctaaggctgtgtttagatccaaagtttggatccaaatttcagtccttttccatcacatcaacctgtcatatacacacaacttttcagtcacatcatctctaatttcaaccaaaatccaaactttgcgctgaactaaacacagcctaagagcagtacaataacacactataaaccagctataaacatattttaagaagataaaagaggaaagagaagagcagcgggctagagatttgtagctagctgtagcacaaactccaagacgcagtgtgtatgataggtgagaccacgtattaatagtgtagtatataactattatatgaattaactattaaattgactatatatgatttttggagctagtagttgactatgctattaaacttgctctaaccattttccttcctagcgtgactttttcctttcaggactaccaatatatcattcggaactttttttgttgatttttttttcaggcagagctgataatactctccctagacaatattattgatgttttagatttcatactaaatcaccaactaattttatagagaaaattctttgtatgcccttaaaattttagccgatcccttatatctcttgatgtttttgttttatcttgtaactaaaggaacaagtcatatttttttaaaaaaagaatatataaagaacaatccctattaattttgtcaaaagaaaggggcaccatctctcggactaattgagctgattaattaaatgtttcattatgcctattaattttaagatcaggacaagccctccattaattaaagaaaagaattcaagcatttaaaaggccctgagtaaaatctaaatatatgaaagcaacaagctttctgaaaggaggatgagccatatcatctacaatgtatggaccgttggatgaactggtaaatgaaaatcacagttggatcatcatgctcatctatgacagtggaaacacattggaccaatccggatgcttccagactaaagacctcaaaaagcagagaactcatgtggttagtctatttaacactaccgttaaaaaaagtctttttaacactatatatatgtttgcttaattaatgtcctgactaaataaaggaaaaaatatgatgtcttaccgtaaatttgtattgaatttatatgcaagtttatatctataatgtatactacttttgattgcttggtattggagcaacacacaacaactaagtagcatacactatgtaccattttattttaaaacagtccctacaaacgcacaccttacacttaggagcacttagtgttattattgtctccgttctaaaatataggtgttttaacattcaaaatttatcataaactatagctatttctacatctactctctcatcttaaccaacatagtcatatcctatttaatttcttcgtctactttgtaatgtcaatcaattacaacattcctccatttacatctcttgctactgcgtcattcccgaaataagtatttctacgacaaattttatatacaaatataaagcatttctaggacactaatatttcaatgcatatctaacatttttagccaatcaggtgttcggaaagagccaatcggagtagttcaaaatttgatagtaagtaaccgaaagagatcattcctccttaatcttactctttactaaacaaactagaaatacttatatataggaattaatggagtatatttgagaacaaagattagggtacttacgaaaccggtaccttcaattaatatcaggatcaatatctcaatgtctaattatataggtaggttatactaacgctcaaagtcacgcaaagcgcgactaagcatttttttttctgctagcaccattcatcaagagttcagtgcactaccagtctaccacactacttgacccaacgaaggattgtgtgcttcaagactgcttccagccatttccaatcacattcttagtcaacaccatccatgctgtcgagtatcaaaggcttcttgttctcctctcttctgaaaagtagacaataaacctacaaaataacagacaataaaaatcactggaaaacacaagagatcgaatcttgaagagtccagcaaattgctgaataaccaattaaaagctaaatcattccagcaggtgatgtgctatcgcagagatactcggtatgttaccatttcaacgaatcacaatgctccatatgtagtgaacaaatatttcattacaaccacaaaattgacactacgcgacagtgatgaaactgttaagtatagtagtatgtcaagggtattagagtactttcccctctcttgtgttccccctctcttgtgtacatatatgtcatttagggccaaatcaatacaagattgaaatcccctaatctctctcttaccttgagatggtatcagagccttactgctaatcctacccaccaagttcccatcggcggcacgccggcggcggtcgccgccggcgagccattgtctcgtactaccgtcgtcttcgtcaagttgttggtagcatcgttgttcgtcgtcccgtcctcaagcctgtcaagcagcagtcaggagcatcgtccttcctcatccacacgcatcagtgcacgccgccggcggcaaccccgtccaagctgtcagccatgtcgtccccgctgcggctcgtcgtcaatcgcgaagccgtcctcaccagccgtcgtcctcgctgcccgtcgcagcgctcgtcaacggcatctgtcactgccgctcgtcgcggcgtgcatctcctcaccagctccacacctcgctgcctgtcgtaaccccttgcgtggcgccggtcctctccgccaatcaggccctgtcacccgtttgtagcagagcaagcagctgccgctgccggcagatccttcagtcttggctattgcctgtaaactgcacaagtccatatgctgcacacaaggtgctcgacaaaatgcttcaaagagttgctcccagcttgtggtcatgcttttgcctttccaatttggtgctttactgaaagtattcgtggtctctcattaccatctcctgtccatcttcatcagctacttctctctgctaccaaattggatagaattaatcagttaatatgcaattccttggcagccacaattatgtcttttgctagcatatcaatgtcctctacaaattgatttcctttgtttcctatgatcctatctagtttatccattaaagccttgctgcatatctattagtatcattgtgtcatttactagttgccattcaatccatccaagtccattgcatattcttcaatccgtccaattgatctccagcttcatatcagctctccgtcggaattggtctatcacttcaccagctccacatcggagctggtctgtcatatcaccatctccccatcggagttgacatcatcatcactcaatgaaggactgaagaacaatttgtgaaggtcctttatcagatctatgaaggtccgaagaacagtttgtgaagggccttccatcatcgtcaacgtctctgaatcaatgaagagccgaagaacgagtcgtgaaggcttcaaggtaccgagggccgaagaacagtttgtgaaggctccgaggtccacttcattgaagaggagatggatctttttcttcttcatcgtcatcatccaagaattggcacactttgacgacatcatcaagactttggagataggctaatatttagtttgtgtcctagtgtttagtttacccttcaaatgcaatgttattgcatacacattgcatttgagtgggggtgttaagtgtagtagtatgtcaagggtattagagtactttcccctctcttgtgttcccctctcttgtgtacatatatgtcatttagggccaaatcaatacaagattgaaatcccctaattctctcttaccttgagagaaactttgtccaaacagaagggacgcacaaaagattcttgaatataataaaccctgattatcaatcatgacaaccttgtatttccaacaaaacctgtgatatatattattaacattatcataatccccagcataattttagacaattcctgaaagtaaatatttggtctcagccacttggctagtgaacaaataatctaatattcaaccatccctactgaagatgaagtctgagagttaaaagggaactgaaaaatgttttcaaggcggatagttcaaagtaccagacagccaagagtagttcaccaaaattatgataccaacagctcttgaaattatgctaaaaccagttatcaaaaactaaaaaagaaaagttgaataggcttaactagtgttcataaaacgttaaacacttaattattacaaaaggatactctgttactaaacaagcaaataggagcccgttgaacagataaaagagaactgatcatggcgtcaatgtaaaatcaagtgttgtgaattaacttttcctgcatatatatggtatctgcattaggcattttttgttcgtgggtgcatgactaaaaaattaactatgcagaaaatacagaaagaaaagaaattgaaatgcaacagatctttcccagtcccagatagaagagtaccaaccaaagaagcgaaagcatttacgatgtacaacgatccctgttaagcatccaaggttgaatggttaaagcgcccaactcataattggtaaatttgcgagcaaatgggattagagaactcagtagtcctagctgtaaacgatggatactaggtgttgtgcgactcaacccgtgcagtgctgtagctaacacattaagtatcccgctttcttcaagatttggcccgaactgttcggcagattcccatgcgttacgtgtgccaataagagtttcccgacactaaccataaaatagaaatacactactccaacaaatacaactacggaactagataatcctttctaaatgttctataaacttggatattagggagtggtaatttcatcgctcgaatttttctttttattttattaatagtcttagattttgcattttttatgagcctcgttttgagggagattgaaatgcaatatttcaacgttgtgtatctatttaacagaaacttttaactttgtgtaaaactttgtgggaaaataaatcagaatttgtataatcttactaccacagtacgaaatacagaaaaactaagcaatgtaagtaacagcgttaacacaaaaatacctacagaatttcagcaaggttaaattacatgaaaggttcttctaccttgacattggtgaatgatgattgctgtctagttgatcaacccgcaagaggccggcaatggcggcttcagcaccagcctgtagggaagagccggcccaaagtagtacctcctgtgaggcagcctgaacaacaccatggcctgaacgtcgagagcaaacacccattcagagccatagtgtttgaggaagacgaagccctcgccggcgtccatgatcctcgcgacgtcgtcatcggcgtccacacagagctccatcacaccgtcgacgtgcgccagctccacccgcgactcccgcacccaccgccccctgctgctcctgctcttgtcgaggtgccagaattcgagccgcgccgctgcggccgcgaacgccacgacgcggagctcgccgtcgtcagacctgatgacgcgcatgttcccgtcgtagcgcgtccgcatgctgcttagcagtttgatgatggagaactgtttggtgcgggcgtcgagcgccaggaggtacgcgccgccgtcgccgccgtcgtcgatcagccagtagacgctcccgttggcgtgcatgtcgccgctgaaggcgctgagcattggcaacatggggatgtaggcgtgcacggtccactggccggagcgcgacgagaagacgtacagacgcggctcccacatgttgtagcaggtcacgaggatgatctcgaactcgaagctgcagacgacgccgccgccgtcgctgtcgtcggtgcgcagagcggcgccgagatacgcgctgttggtgaccggggcgacgtgcaagaggacagagcggccggacacggggtcgcagatggcgaagttgtccgggatgtccatgcggtcggcgaacttggtgcagaggaggaggaggccatcgtgggtgtccgcaagcgcccagtgctcgtcgtaagggagggagtcgagggagaagtcgatgcagcggttaacggcgccgaggaatcccctcggcgtgagcctcgggaggaaggttgggtcgaccacctcgccgacgagctcgctgtcggcaatcgacctcgagacggcgaacccattgttgcagacgaagaagccgaggagagggggcgggtggtggagctggcggaagaggcggaggaatgtcggcgacgacgcgacacggcgccagcggcggcagacggtcgcggcgcgcgcgagggcggccggggacgggaggcggagcaggatgtgggcgaggaggcggtagtccagcgccgccgccgtggcgtccgcggcgggaggcgcccgcgctttcctcttcccgcccatctcttcgctgcgcgcggcgcggttcggtttggaaggtggcgatggtttcggcctttcgggggaaaggtgaagcgggcgacgtgaatacgtgatgggattggggagtggatgaggacgtgtggcgtactggcgtgacacgtatgaacgtggcgggagaaaaggggtagcgacggttgtttcgcgccacttctcttgtggagttggcgccattttcgaatcttttatatgagtttggtttaaaatcagttttaaggtaaaaaaaaacttttaagactaatataatataactacaaattagattgtactatgaattgcgtgtaactaataaaaacatttgtggcccaatggtaacatgcacctcctctagtcctttgaaacgaggtctatgttggaatacctactaaccagtacaagcttgcgtgtttttccacctgcatagcacaaatcttatggaaatgcttcggattagacgtttggcataacatgaaaaatcaaatagacaaactactatatatctccgtgtgcactttacacatccatacatgctataatgatcttcaaaataactttttctcttgaactacttatccaatctatgatatgatcacaccattatatttgttataattaaatctttactataagatatcacatcgatatattctgatgaaagaaaaatatatgatgaaagaaaaatatatgtttcaatccgttaaaatttaatgtttcagatgtggtagcaatatgtttcaacgcgtgttttcattatgtttcattaaaaaaattaaatattttaataactgaaatttttatttcaccatgtataactcaatgtttcaccaatgaccgaaaaaatatgggatgcttatgtccctactctcttctaacattctagtggctttcttcccacactatgcatgcatgcatgtatttagtgatcttaaaaatatcttctcttctaaactactcatccgatgaacgatttgatcacaccgttgaatttgttataattaaatctttacaaaaatatatcacatgattatattctgataaaagaaaaacatatgtttcaaacaatgaaaacttaatgtttcatacgtgatagcaataagtttcaccgtgtgttcttattgtgtttcacaaaatttctctatgtttcagaggttgatttttttttcaccatgtataacttaatgttgcaccaacggtcaactgaaacatttgaccgtccatttttttctgtaacatcggacgtccgatttgtagctctctcccaaagcttaaagcacaatggaaccataaaaggccccataagcccccaagcaaaccacgggaattgctaaggacattcacagtacggttcgctcattagagtagccctagccctagatgccacataagcactacacatttaggccatataccccaacacccatgttgtgtttgcaaccccatgttcccaacccttctccctcgttttacgcgcgtacacttttcaagctactaaatggtacgttttttacaaaaagtttctatacgaaagttgcttaaaaaaatcaaattaatctatttttttaaaaaaatagctaatacttaattaatcacgcgctaatggaccgttccgttttccgtgcgggagggattagttcctacccgttgaatctgaacaaagcctagtgaaggtcacacctagttaatttttttcggacccacatgttagcccctcccactctctctctcaacccccttccttttctcacctaaacgaataaatgggttgtgattatttatccatcaacacatatgtacaaattaacgcacgttcatcttttctattatcaagaaaaaacataaaaagcaatggttatacacggtcacggtcagtcggtcccgtagttaaactatgcctacacagaccgcatacgaacaaagtcgatcaatagctagcaagctacggaagataggtaataagatgcctgatccatctcatatccaacgaagttcgtccatgacctacagtcgatgtcatcagccaccttctcaagctccttggttgcaatgttgagcacataagcaccaggagtgctgctccctttggcgtcgattgtgaagaagagcaagccactcctctcgcaaaaccacctcaggttcatggcgtcagagcgatgcactctcaactcatgcaacctgacgcgccatgtacagacgctcacctgttcgcgcgtacaaccgccattgctgccgaaagcaaggtggtagcagcttgacactccggcggagccgtcgaaataccttgaggtgacgatgaagctcagcttgccgtccgggctgatgccgagcagatggtcgtgcggcggcgcctttggaacggccggcggcatcggcatctcttcgggctccggcgtgtcggcgcgcacggcgaatgccgtgtgcgccaggggccagtaggccacgccgccatggacgacgctctgcctgaggttgtggagcgtgtagctgctcatcttgggacctgatgatcgtctagcctccgcgctccagcggccggtgtccgacgagtaggagcggagcgcggtgtacgttcgccggttgtagacgacgacgacgcggaagaaggttggcgacgacggcggcgggtcgtcgaggtcgtcggcggtgagcaaggcgcacgcgtacgctcccggcttgtcgtcgccatggagaggcgggagcgtggcgacgtcccccgtcatggggttccagacacagagcttgagcccgtcggcgtgcccctcgcgccggagctcgaggacgacgcggccgttgcgggacgtgaccgggcgggagtactcgccgtcctccacgaacgggctcaaggatgggccgaggagacgagcgccggcagccgtcgggacaaagcggcaagtctgccctgccgccgcggagcgcttccgcttgccggcggccgcctcctggtagaagaagccgagggccaagcgtggtaaaaccggctgcggcagcggcagcgaacggcagaggaggacggccgcgtcggttatgacacggctccaccgccggcacgtggcggcgcagcggactaggtcggcggcgtcagggaagcgggtgaagacgttggcgagcacgctgtccggaacgtccgagaacgcgccgccgttgccgtctctgtcgtcgttcctggcgcgtctgttcgtccggcctcgccgtcgccgtcgcgacagccagcctttgtggtacggcgcgagacgggcggcgcccgcgccgcgtggtgcgcctcggcgtcgcggcggcatccaggctgcgatgggttggtgcgcgattggatggacgcggtgatgctttggcgccgcgttatttatggccgcggaacgcgcgcctcccgttggcaactcggaagtcggagaagacctccgattccgacgatgtctcgtctgacggctatgccatatgttctcaataaataccaaccgtcagatcatcggagcgccgacgcatcgccatccatctgatcattaatccctaaatcctgtttgattgtgaaccttttcctccgacgttaaaaacgaagcagttattagcacatagtcccttcggttctattttaactgatttgttaaattttgttgtcgatttttttttagatttggggataattttgtgaataacttggatgattttgtgatgggcttgtgaattatggatgatttgttgcgcatgattttgtggatgatttgtacatgattagagagcatacctgcatgtaggatgtaactacacagctagtacaaaccagctaccactccatctataagacgcatcatccacctatagttcaaatacaattttctcttaaactactcatccgatatacgatccgattacactgttgtgttagtaacaattaaatatttacaacaagatatcacatgattatattttgatgaaaaatcacaaattacttttatgatatgtctaaattacttttagatttcactaagttacttcttagatatataaaagtaaattcagtaaaacctaaaagtaatttacatatattatagaagtaacttagaacaaaacgaaggtaactttagcatgtcatttgaagtaaatccgttgtaaagataaaaacatgactctatctagaaattaaattaatcagcacaaattatgaaattaactaaaaaaataataaaagtaatcatctcagagcattatgaatgtataggaagtattttaatcaaatctaaaaataacttatatatatatatatatatatatatgggactccatggtgcccgggctccaaggtataaaacacacaaattctctcaaatttttaaaaattttcaaattgtgagtatatacctaggtataagaatttgattcatacaaatacctaacaacaaaacaactcaaactcaactttatttcacaattcattattgcatacctaacgaattatatgtttggatgttatatacctagagccaaaatctaacaaaaaaaaagttcaaactcagttcaaacttgtttgaacttgttagtaaaagttaatgttcatatctaaacatttaaaaaaatttcatactcattcaaattaggtatatactcaatttgaattcttggagcccacactctatggagcccccaattgatttacatatatatatatatatatatatatatatatatatatatatatatatatatatatatatatat

SEQ ID NO: 52130 - DNA, 730 bp, Oryza sativa
agataatcctttctaaatgttctataaacttggatattagggagtggtaatttcatcgctcgaatttttctttttattttattaatagtcttagattttgcattttttatgagcctcgttttgagggagattgaaatgcaatatttcaacgttgtgtatctatttaacagaaacttttaactttgtgtaaaactttgtgggaaaataaatcagaatttgtataatcttactaccacagtacgaaatacagaaaaactaagcaatgtaagtaacagcgttaacacaaaaatacctacagaatttcagcaaggttaaattacatgaaaggttcttctaccttgacattggtgaatgatgattgctgtctagttgatcaacccgcaagaggccggcaatggcggcttcagcaccagcctgtagggaagagccggcccaaagtagtacctcctgtgaggcagcctgaacaacaccatggcctgaacgtcgagagcaaacacccattcagagccatagtgtttgagaaagtcgaagccctcgccggcgtccatgatcctcgcgacgtcgtcatcggcgtccacacagagctccatcacaccgtcgacttcatgcctgggccgcgcctctgcgtcttctcgtcgcgctccggcgcgtggaccgtgcacccctactccgacgccggcaccgccatcatgcccatgctcggcgcattcagcgacgacatgcacaccaa

SEQ ID NO: 52131 - DNA, 11033 bp, Oryza sativa
actgctaaaggacaccacaaaaataatgtaattggttgtaggacaccggaagcattattttataatatttaagaaaagcgtggagaaaaaaggataaatttgcccctgccggctctttctccacctagccacggcgcagggaggccggtgcaagcgcaggtgcgcactgacatggggaggcggcggtggcgagtggcgatgaggaggaaaaggttggcggctcgagaagtcgggaggggggcgaagatggagcttcgatgctcaccaggaacaatggagtcgcggatgggatgccaatgggaacggcgaagctggcggaggggccccgccggtgctcagggaggtcccgatcgacgcctagcagcggcgtcgcttgggatggagcggcgcgacggtagtggggagagcatggcatccgagcggcgagggaaagggggatcctgggtgctgtttataagtcgttggggggagaggaggagccaatggcgttggttcgccggcagccaaacggcgaccaattaattcgcacaacggcagtgattcacgggagtttatggggaaaacaaagaggacgggatggggagcaaccccctcccaattaattcagcgaaacggccggcagcgggggtgaattggcaccttctcctcctccaccaaatctgccaccggagtggcttcttcctctccccgacccagacaaccgcaaccaaccggtgacgtgatcatcaggctcgccgatgctcccattttgtcccctacccaacccccaaacccatcccctttgctactcaataattggcttctagttgtttttaaaattttacaactacagctttttaaatctgaatgaaaaactgaactatttgaatgagcttaaacttccccaaacggattccgaagagtggaacggaaattaagcaagcatgtagctgtgtgtgtatgacgtgaaacgagccttttcggcacgagctaccaaagttgcagttgacgtccccctttaccagttaccacacaggaatatatgcagattaaggttggtgatgtgatgcatgctcagctcacacgacacatatcggcatgtgcatggttgttgtgttgtgttggggttgggtgtatataaagctaggtgcagatagttacgctcactaagtcagtcactcatcactgatcatgtcactctggatagcaacgtatcctctgctgatttttattccctggaaaaaagctctacaactactgtactgatgatcatgtcatatgggccagtaaaacagttcagtgaatcattatcatatatcctctcagtgtcagtgcagatcatggatgcaaactgtttagtgctcgcttttcataagtgccgtagccaaaaattagaaagactaggattaagatatggcataatgcttccttttttcaaaaatcggtcaaaagataatatattggacgccgtagggttgtcatgtacaacgctgtcatgtagcctgcagccagttcacttgctgtagcaataaactgtaacgtggctgtgaaacaacgttgtataagacagccgaacatgccgattgttttctttataaaatttatgtggtgatttaatataattttaaaaatataaacaatcgtacgatttaaaaaatataaacagccgaacagccgggatgttttattccattatctaaaaaaatatataatttaagtaagattttagagacagccgtacgtagggttcaagctctagctattttagcctatctccgccactatttttcatgcttcacttcatctattctatttaaaatgttagtagtggtggtgtctatttccataccacgtacaccactattcgataattctttcccaattttattattggcttcccccacacttcaaaaccatgtattacttattcaataagaaaaatataaacaagtgcttattaattgatttgataagctagaaactatagtgatgaataattaatatgaatatgaattatacacattgtatttgatttatatagtggacacggacatcataagcccacatggtaatgttgttggtggtggtgggtttacgtatatttaaaatggtataaagatattacaatttgttactactactaagtcagtgaattaaattaattttctgcacactagagagggggctgaacctgtcgactcatcgatcggccggtagccagcaaccgattctgttgaacaactagcgtaactatacgagcgtgcgtgcacatggccgtcacgtcggtcgagtcgagcagtacacattgctgctgctggggcccgcgtgtcatccaaagcatggacaaacgaatggggctgaaatcaaagccaacgatggctgacgctgcgtacgcatggacggattaaaaaaaaactttataaaaagtggtggtcgtcatgtcatatttgcagctcttgcaaaagacccaaattttgttagggccattacgtgtcgcatcaaaaagcccatgatgattcaaatcgatttcatatctcttgtgttcttggaaattggtagggtttggagaagaaaaggacttgagagttgagactcgtgacttcttgatgagcacccttgctcccctagggtcgtctagttagttgcaaagttcacatcgaggaactgttcaacatagtactctagttatattgatttgcacagactcatcttaggaattgcttaattcagctcagatttttctaaacgggtacttcctccgctttagtggtggcttagaattttttttaaaaaaaagcgtgggcaaattctactgtggctaaccctcactcagatgcagatccaccgtccgatgactctgaagagttgtctatgctcattagatggatgtgctatagaatttaattattttctcaatgaaccataaaaaaaacttttataacaaaaacttggtaggttaggattcatctaggctttaaaatctttctagttcggtcactagcatcattcgatgccaatgacataacatgcttgtgttctcgtcgtgcgccagccaggccaggccgccaaggcgactgccacggtggtcacccgagccttcgcttcaccaagtactgttggtatttcttacgaccacagatacattctgtggagattatgggtaccccatacctacatggcatagttatccgactggctataggggataacttatatctatggaatatgtaacagatcatgacttgggtattacgtttccttgtatattatggaacggcctaaagtcctggtttgataagattgtaaagtagatttaggaaaccgataccgtattggttaagatttctatcttgtaaccctgccccccaacctatataaggagggcagggagcccctctaggggcatgagacaacctgatcgtcagatcaatacacactcggcggattcaaatccccaaacaggagtagggtattacctctcattgagagggcctgaacctgtctaaatcctttgtctccgcatccatccacttttaggtctcgtgcgctacccccttttattattgccgaaatcatgtttcgacagttggcgcgccaggtagggggtgcgtcgaattacctgtcgaaaagtgcgatggaatcaacttcagaagaaaccccgagatcaatctcatcaatttcgatggctcaaatcttcaatcgggtctaccgttccaatttaatctctattagattaatttttaatcattgtttgatttcctgatattttgacgaatttcatatactggatgagatcgaaacacggccatcatcgtcgcctacttgggtgcccttgccgtgtccgagtgctcctctcttcctttccttgcagatggacgtgttgcaggagcggcacaggccgccaggattcgattcctgtttgcatgtatgatggttgatgggctccgccggctacctccgatgatggcatcatgccgaaagaacatcgagttagctgttagttgccggggcttatacatgttgcatggcacgtcgccggctatcactcatgatccagcctcactgctcgacttgagtttttcgtttcaatttgttatcaatatatattagattgatttctaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccaccggcctgcctccgtcgccgccgactggtgtcctcgcctatacggttggttggtcacaccaccgttcatgggcgtctacgacttcaccgccggcctgcctccgtcgccgccgactggtgtcctcgcctatacggttggttggtcacaccaccgttcatgggcgtctacgacttcaccgccggcctgcctccgtcgccgccgactggtgcctccgcctacacggctggcctattatgccgccgctgttgggcgtctacgacttcaccgccggcctgcctccgtcgccgccgagtggtgcctccgcctacacggctggcctattatgccgccgttgttggatgtctacgtcctcaccgttggctcaccttcgttgccgtcgactggtgtttccgcttacacggctggcctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcgtcctatgctttccgtttggtttgccaatggatggttgcctttgggccgattcctagcacccgggggctcgttggatggaccgagtaacgcaaggtgctaagtattattcggaataaatcaaaagcatagagatgagataaatttatttgctgctcttaataattgcaaaagtacccgagtagtaaattctgatccgtgaaactttgtcccattaatgacgaactcatgtcactcatatgcatgtttgggaagtgcctaggccgactcccggtgcttgatggttatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagtactcttgtctttggccgtgatcctctcaacaaaagggcagggtcttcgtcgccaaaaattctatctggatctggtttatcgttctaaattttcttatataaattagaattaattcacagatcactaattattatttgatctattattttatacatgtaccgccggccgccttcgtcgctgccgattggtttcatcgcctccacggttggtgtgcgccgctgccgttgctaatggagatatggtcttcaccgccggcctgcctccgtcgccgccgattggtgtcttcgcctatatggttggttggtcacaccaccgttgttgggcgtctacgtcttcaccgccggcatgcctccgttgccgccgagtggtgcctccgcctacacggctggcctattatgctgccgctgttgggcgtccacgacttcaccgccggcctgcctccgtcgccgccgactggtgtcatcacctatacggttggtcggtcacaccaccgttcatgggcgtccatgtcttcaccgccggcatgcctccgttgccgccgagtggtgcctccgcctacacggctggcctattatgccgccgctgttgggcgtccacgacttcaccgccggcctgcctccgtcgccgctgactggtgtcctcgcctatacggtcggttggtcacaccaccgttgatgggcatcgtcatctacaccgccggcctgcctccgtcgccgccgactggtgtccccgcctatacggtcggttggtcacaccaccgttcatgggcgtccacgtctttaccgaccggctggccttcgccgactggtgttttcgcctgcacggctggcctattatgccgtcgttgttggatgtctacatcttcaccgttggatcaccttcgttgccatcgactggtgtttccacttacacagctagcctattatgccaccgttagtgggcatcttcactttcaccaacaaccaccttcgtgcccaccgactaatatcttcattagtattaataaacaactttattcccacattaaccacttctaccatcaccaaagggaatattacaaagcgtaagtcatcatttattttattctttatagaaatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcgtcctatgctttccgtttggtttgccaatggatagttgcctttaggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattaacaagagaagaaatacgtatttataaactgcttgattttttctcgagtattatatttacatcagatactactcatcctatatgtttgttctgcaggatccaaatccaaatatgcataaaagggattcatggctttaagcttatctcttacgctccaggaatggatcagtcagaacatcaccaccggctcgccgtcgtcgccgccgactggagtcttcgcctatacggttgattggtcacaccaccgttgttgggcgtctacgtctttaccgaccggccgcttcgtccaccgccgactggtgtcttcgcctatacggttggttggtcacaccaccgttgttgggcgtctacgtcttcaccgaccggcttgccttcgtcgccgccgactggtgtctccgcctgcacggctggcctattatgccaccattgttgggcgtctacgtcttcaccgaccggccgcctcgtccgccgccgactggtgtttccgcctgcacggctggcctattatgccgccgttgttgggcgtctacgtcttcaccgaccggcttgccttcgtcgccgccgactggtgtctccgcctgcacggctggcctattatgccaccgttgttgggcgtctacgtcttcaccgaccggccgcctcgtccgccgccgactggtgtttccgcctgcacggctggcctattatgccaccgttgttgggcgtctacgtcttcaccgaccggccgcctcgtcgccgccgactggtgtttccgcctgcacggctggcctattatgccaccgttgttgggcgtctacgtcttcaccgaccggccgcctcgtccgccgccgactggtgtttccgcctgcacggctggcctattatgccgccgttgttgggcgtctacgtcttcaccgaccggcttgcctcgtccgccgctgactggtgtttccgcctgcacggctggcctttatgccgccgttgttgggcgtctacgtcttcaccgaccggcctgccttcgccgctgccgactggtgtttccgcctgcacggctggcctttatgctgccgttgttgggcgtctacgtcttcaccgaccggccgcctcgtcggccgccgactggtgtttccgcctgcacggctggcctattacgccaccgttgttgggcgtctacgtcttcaccgaccggccgcctcgtccgccgccgattggtgtcttcgcctatacggttggttggtcacaccaccgttgttgggcgtctacgtcttcaccgaccggcttgccttcgtcgcagccgactggtgtctccgcctgcacggctggcctattatgccaccgttgttgggcgtctacgtcttcaccgaccggccgcctcgtccgccgccgactggtgtttccgcttgcacggctggcctattatgctgccgttgttgggcgtctacgtcttcaccgaccggcttgccgcagtcgacgctgactggtgtcactgcctgcacggctggcctgttataacgccaactgatgctaccttcttcacggctggctacatcgctgtcactactaataggcatcagtatcttcaacacaagctgcctacgtttgccatggctgccgactggttccttcacttccatggctgcatgattctgccagtgttgattggccttatcttcttcaccgccggtcgtctcgtctactgctgactagtgccctcacctctacgtctggtttatacagctaccactactgatggacatcatcatcttctgtcgccgactgattatgccgtcgccgactggtgcttttatcttcacaactgcgcgtcttcactaccggtttgcttctgttgccgccaacttgtgttcacttcattacggcaatacaactttgtcatcatggtggagcgacttcatctttattatcttcggcaccggcaaactctattgttgctacttcgcaagttttactacttcaccaaccacgacgtctttgtgaacctcgacatctcggcatgcaatgccatgttattttactacaacaagtggctctccaatattcaggatttctacttggacatcttcaacacatatcttcaatcaagcaatgactattcgacgacaagaagctacagttctcgactctatgttcagttgtttcccaactaatcaaagagtcgggggctacacaaatacaaggctcaaaatttgacaaattttatgtcaagctgaagaaatcaattcatcaaccaacgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcacgtctacgtcttcatcgtcggtttgcttttgtcaccaccgactgttctttcgttgttgttgggcgcctacatcttcactgctagctgacctgactgttgccgactggtttcttcgcctccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttttatgctcaaagactggaccaattattattccccgtaagggctatcaaccgaatacttgcgccagtcgggattcaattattatatatattttggagtatctcataagggataatcactcagatcagaagctattcatatgagctacacctggtctatatcacccggaagatttattactcgagagcatgttacatgcgtcatcctttaaagggtgtcgaaggcatattttttggtctaggcctaatatgtctgcaacccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccaatactttggaaatttctttattcacaacatacaagcttctttatagctgttttgctatgtgaattttcaatgatgtaaccaactttaggttacactcatcatattttacaaagcagtcggtatatcactcggatcatgt

SEQ ID NO: 52132 - DNA, 4005 bp, Oryza sativa
aaaaaacctggcgaaaaaaaaccgggtggaaaaaaaacaaatctgtccgacaaaaaaaaaggaaaaaaaaaggaaaaaataccgaaacgaatccgactacatcgacgcggtaaaaagagtttaaaaaaataaaaagaaaactgtcctattccaaagaaaaatgaattatatatatcgtggtaaaaaaatcgaccgggcgaaaaaagaaaaaaatagtccgatccgaaaaaaacaggagaaaaaaaatgggcgaaaaaaaaatttgtccgataaaagaaaaggaaaaagctgaaaagaatctgactccatcgacgcggtaaaataaggcgaaaaaaaactttccgaataagaaaaaggaataagatgtgacgcggtaaaaaaaaaagaaattacataaagataaacccccaagaggacccccggggaaaaaaatttataaaatacgagataaagttcgaaaaaaacggggagaaaaaaaaatctgtcctatccaaaaaaagccaaaaaggggaaaaatcaaaatgaatccaactccgtcgacgtggtgaaaacagggcgaaaaaattccaaagtaaagggagaaaaaaaatcaaaacgaattcgacttcgtcgacgcggtaaaaaaagggcgaaaaaaatccaaagcaaaaggaattatatgtgacgcggtaaaaaaaatcgatcgggcgaaataaaccgggcaaaaaaaaatctgtccgatccaaaaaaagggaaaaaatcaaaacgattccgactccgttgacgcgataaaaaagggcgaaaaaattgtctgtttctaaagaaaaaggaattatacgtgatgcggtaaaaaaaatcgaatcctattatatctagaaaggtttgacactatgtgaaagtggtgaaaaaaacccttcgtaaagaatgcacgagaaaaaaaattaaaaggacggaaaaaagcgcggaggaaaaaagtcaaatttatattcgtcgttttttagtccatttatatatcttctttatctctaatctaatctaatctaactataaaaagagaagtttctacagtatattaaaaaaggaaaaaatgcgcgagaaaataaaaacggtttaaaaaaacacgtgagggaaaaatgtcagaaaaaagcacaaaagaaaacgcgcttgaaaataaagtttcgtagttctaattttctgattgttatcgatatggttatgcatgaaaaacgtatattatcattacgttttttcacccgttgcaacgcacgggcatatttgctagtataatataaaaagcacgagttcatccccggtcctgtaatccatcggatccacagtcgcgtgggacccacgctttgcacggcggcccggcccaaagaaaacgcgcacgtcgcgcacgaaagaaaggaacgctgaaaaaacgctaacctccgccatccccacgccgcgccgcccgcctgacctcagccacgcacacgctgccctccccacgccgccgcgccgcccgccgtccccatgccaccgcgctgcccgccgtctaccgccaccgccccgcgcgcgcacctgccggagccgctcgctctaccccaccacttcctcacacgcggccgtcgccgcctcggatctgtgtgtcgccgctgtctactccccagccccgcgactactccgccgtccacggttcgtcgctgtcgcccgtcgtccgtggccacatagccgtgtgatcccccatccctatatccccgtcgcgccgcctcgccatatccagatcaccacgacgattcctccagaacgaagagctgctctcctttctcggctcctccgttgggatcgagaagctattcggacaacctccactccaaccaagcaccgccagagaggacagagctggggctgaggtggggagaagaggagccagccgccggtcggcccgtccgtcgctgcccccgtgctcccacctcctgctttcacgccgactgccactgctcttccggactggcagagcccaagcagtaggaggcaccgatgaaggtgatgaggacttgagatgaggcagtatgcaggcttgcaggtttggacctcttccctccgatgctatttcagtttgctgcggaaacccatgtttaattgaagatcctttccgttcagagatgcaaattaggcgttaatttcttcaggtcccttcttgcagcaggaattgctcaaatcaggtttgtctcgattcctattattacctactcttgtactcttgttcatatcttgtgactgaacagatgatcgattacttcagtaaattttgtgttacataactgattgaatgaaggttgtatgtatatagtggaacatgggttgttccaagatgaacaactgggttactcgctcagaatattatcaactgagattctcaccaaaccactgtacttaacatggagaagcaaaatattttaatgctggcctgaattaacaagctttacattaatctcttccagttattgtgttgttgcaacctatgctgataagtaatgtccctgtgcaccttgattcctttattacattggattattttattgcaatgtttacaacttaagggatccaatctgcattgtgccttgcacacatgtcacaaattagtaggttacatcttcctttaattttgatatgaatatagatgtcccttttcaaaagatgataaaaaactgtatggtcaaaattgatttaagcgatggatgtatttgttttaatttgctgtgagctaattaatactatgaatttcttatagctcaagttctggaagtttacaaaattaccagtcaatgtaaggttgtctcggtttagtgtctaaccttggccgttgcaatgtgtgtaaacaatatactactattaccattcaaggttatctgaacgtgaatatggaatgtacctgaagtcagtatgtggacatacctttgtcatgtttctcaagtcagtgtatgaacccttgcaagcactgcttttccccgtatttttatttctttaaaatatatatattgtaaaaacgtgccttgcacgtgcactattactagttataagaaaaacacagagtccatatagaaatacaattaataaataatagaaaatcggaattaaaaataaggaatattataagaaaagcatagagtccatataggaatttagaatgaactaaaattcggaataaaaataataaaattaaaattagagtttaaagtccatatagaaatacaatttacaaataactaaaattcaaaataaaaaaatatggcaagaagagtaatacagtttagaagtaactgaaattcgaaataaaaaataaagaatattgaaagatgagtttagagtccacatagaaatacaattagaaataatgaaaattcagaattagaaataaataatattggaagaagagcttagagtctatatataaatacaatttacaaataatgaaaattcagaactaaaaaaataaggaatgttggaagacgagtctgcaagccatataggaatataatttagaaataactaaaatttgatattaaaaataattaataagtatcacatataaataaaatacagtatgaatattacacattggtaatttggtaaagttagtacaaaatttaaaactatgttgtcattttaatatattttaataataagttgagaaaaaatatatatgctattatacgatagaagatataatgatgctagccgcgcaatctgcgcgggcaaccatgctagttccattatataaaaataagtaagcagctctttctttccttcttatttatttttcaatcttacatgaatagctacagttacgcaacatcaggttacttctgattattatgttgcaacactggaactgctactacacaatattgtcagattacctgaaattacagcgctttctgaaggttccacgcacactatatttatagatggatttttcatcttcaggtaccttcctacacctgccagtgtgccccctgttccagcggcggttacaaagat

SEQ ID NO: 52133 - DNA, 9879 bp, Oryza sativa
  unsure (1)..(9879): unsure at all n locations
gaaattacagcgctttctgaaggttccacgcacactatatttatagatggatttttcatcttcaggtaccttcctacacctgacagtgtgccccctgttccagcggcggttacaaagatatcaactttgccggctgtatccttccagatctcaggtcctgacattttcagaaaatgaacatgtgtatcatataaagcaaagttatggacagtagatgataaaacattgttgtgaggctgtgtttagttcacactgaagtttggaagtttgattgaaagttttctatcacgatgtgatagaaaagttgtgtgtgtatgaaaggtttgatgtgatggaaagttggaagtttggaaaaaaactttgcatatcactgaagtgtggatttccagaattatttaccagtccatttgaagtgtgcatctgggttcgctgggttaattgattggttaaaacagtgataatttggcatgaccttggtgagctcttccactttgtccatcatacccttgaatccacctgcaggatctgcagcaaaagaaaacatgcattacttaataacttgtcagaggacacttaatatgcaagagagagagtagtagtaactgatttaacataattatgtaaccaataacacaataacataagcacaagaaattcacaaaatttagtccataacagaaaatatgttttgtaccaaaaaactaaatgagaaatttaaatgcttgctgaatttcatctgagatcctggttgtcacctgttaatatcacttcagcacccaaaaacctcagtagcatctgcttgtcaagtgaatatccagcaggcataacagcaatgaacctgtagcctctctgaatagcaaccaataccaaaccggtaccaagattaccaccagttggttcaatcagcgtcgtaacaccaggtgtaatcaagcctttctcctctgcatcttcaaccatactgcacacaaaaaaattgcaaatttcagttaaggttaaccacatggcttgcatattcttcatcacataactgagtatatggtaagatgctaggaatggagcgaagcatagcagatttcctgtggaaaaaagggcatatataactgaagaaataatgcgatgtatgaatctgtgcttactcacccgagagcagttctgtccttgaccgagaaaaggggttggtatgcttccatctttccaaccaaacgagcttggatgccttctttcttggcgatgttcttcatctcaatcagtggcgtccagcctatcagctgtcaataataaagattaaccacaaacatgtaagtccctaatcatattagctccccaaaaatcctcaccgtgatctttcctcaccaaatgcatagctcaatgaagctctcaacaagaacactaacacacagtaagcaaacaagagtgttaatatgtgatccaaattttagtatataacttattcggtttataactatttaagtaggacttttagtcttttctgaatattcttttatttcctttatatatctctttgccgtacaggaagggtgtgacgttgttattcttctgcgtttgcaaccaactcctcgactgaccattactatgacatacctgagcgacattggaggcgatggcctcctcccccacggcggagagccgcagcagagaagggatccccgtcctcccctcttccacctccaccgccgcagccgccatcgccattgtttccactaactaagaattgatccatgcacatgttcatcttatataatccattgcgtcaaaatttttatataatccatcgcctcctaacagtttgcaaggcaaaacaaatcgaaccgaatcaaatccaccacgactgcacccgcgatttaattaatttcctcaatgtgcttctgcttcagcacgtggagaataaataaaataaaacgatttcagggtaggatgatcaggtagttgtccatggaaaatgtcaccggacatgtactagttttgaaatcacatctatcctgaaccaaataaaacgagaaggcaatcttctgtataatgggattatacagttataatttagatagaacacattcttctggaatcctggaatttgatctgcaaagatgcagcaacaagaaaagtacatttttcaacctacacgaacagcagcagaaatacagcttcagatatggctagactgatccttctgattattatgtcgacaactgttcccacatagaaaattagaggatttcctgaaaagttccacgcacattattatatttatagatggaattttcatattcaggtaccttgctacgccttcttttttcccttgagagaacgtgttttttctttccttaaagggatgtatcctcgtttattgcatatcatccgcataattatattttctaaaaaattgatagcatatatcaatatgtgatacaccactctacaaacatgtaggtgtatttcaacctatacaagttgaaacaaaaacaacaaaatgaattctaactaatacgtgcaccatcaacaattatacttattgtttttatttcaacttgtagagaaaggcccggggtcttcgcggctagcaacgcaagctgcgagctagctggtccgggttcgagcctcaccccctccttaattcaaaatcaatctagtccttcctagattggtcccatttttttttatttcaacttgtgtaggtcatagacaaccactttgccggcatattaggatatacaataaatttacaacacatgcacaaaggagcacatcacattatgctgaaattcttgctcttcctcaacaaagaagcaacaagaaaaatgtatagtgtgctctgaactatgaagcatatcttaagtaacaatatggaggaaaagtggaaaacacatgtgtacagtgcctgaaaaggagagcagctccaagacatcatcagaaggtcatattatcacattcctctctaacaggtgcaaagagatcagagttcatgtatctttcaccgccgctcgggaacattgtcacaatcattttccccttgttctcctctctgtctgcaatctgcttgagatccattaaattgggtagacagaaacacaattagagcagggtttatgtatacctagctaagatgagctgtttaccttgatgcaagcagctacatttgcaccagaagatatgccaacaagcaatccttcctccttcgccagcctcctcgccattgccatggattcctctgtgtttactgtcactacttcatcgatgacagatttgtccaaaatttcaggtatgaaacctgccccagtgccttgaatcttgtgtggccctggtgaaccacctgaatagaatcaagcagaaatattgtttaggcacattgaacaagaagttgaaagagaaggggaattttgagcagtatgtcatcaattacactttacagaagagcatgctaagatacctcatttgtatggtcactcaaaatttcaaacatatggcaggtaacaatatatatatatttttttacatttctacttagggtcctgatgaactacataatggcgaactgaattttctcaatctccatagataaacacctctttgataatagacctgtaaaaatgctcttgcacacaaatgttctactttagaaacttcagtaagcatcaactcttcctttcgttcttcttaactctcttgtctacactagcactcagaagaaaaatgcaccttgagaaagcttacactgacaatctgattattctacctcgaactactatttagagatattacaggggtacctgaaattacagggctttctgaaggttccacgcacacaatatttatagatggatttttcatcttcagatacctccctacacctgtcaatgtgccacctgaaccaacagaggccacaaacacatccactttgccggctgtgtctttccatatttcaggtcctgaagatttcacaaaataaacatgatgtatgatccctaggtacatctttccaaggcagaatgactggcagtagataatgaaagatagctgtaatttgtaaaacatggaaaattggaaatgtggatttttcctgaatacttaccagtccacataaagtgtgcctctggatttgctgggtttgttacttgattgagacaatgagaatttggtatgctcttcatgagctcttccaccttgtccatcataccattaaacccaattgcaggatctgcagcaaaataagaacaaacggtacttaacacttgtcgagtgtcgacggcacttgttcataagataaagaacactcattagttcagcataatattctttcaaaaaaaaatacttcagcataataattatgtaaatatgaaatgaacaaaatcatcccattcaactgaaaatattagttagggaaaatatttacttgaggcatttaagtgcttattggttttttaaccatttgtagaaactgggatccaggttctcacctgtcaatatcaattcagcacccaaaaacctcagtagcatctgcttgtcaagcgaatatttagcaggcatgacagcaataaacctgtagcctttctgaacagcaaccagcaccaaaccgataccgagattaccactcgttggctcaatcagcgtggtaacaccaggtgtgatcaaccctttctcctctgcatcttcaatcattctgcagaagaaacatggaaattgcaaatgccaaggcaattttgaaactctttaacactttttatagatgcttctcacataaacacaattttgtaaatatttgatctgactaaaaaatgtaaacaactgaagaaacaagtgcactatatcaatcagaaaactatgacgatgttttgcatgaacgcacctgagggcactcctgtccttgacagagcagagtggctggtatgcttccatcttcccaaccaatcgagcctgtacgccttcgttcttcgcgatgttcttcatctcaacaagcggtgtccatccaatcagctgagagcaaagagatagaaaccacaagacgtaaattattgctagatgcacaatccagattctgaatacaagaacgagaaaaatagcaccataataccaatcaagaaaaatgtccaaacaccacactggctgactggcttactactcaattaaggggaaacttgatccactaaacagcaactatcaagattttttgcaagataccgaatacaacaaactgaacctgtaatgaaaagcaacaaaatccactggttctcatcagttttgttttgttttgttttgggagaaaagaaatctgctcacctgagtgatgttagaggcgatgttctcctccctggaggagagcagagacgggatgcctttcctcccctgctcctgctcctcctcgcccggtgcagccatgtctggtccctcctctccgttcttgatttcttcccccatctcaacccagctgctgcagaaagcggcatttatcttgtggaattcggtgatatcttcttccgtcgccttcttcgccagcgccggccgtacgagctcagttaacgcctgatggagagagagagagtctctctccgctggtctgtgactccctgcgtgtgtgtggatggaatggattggaaagagatcgcctttttctgtgcggtttgtagttctgtcactggattatagcgtatgtgagtgacacgactataaactatatggccttatttagataaaataaaattttgatgaaaaacgttgcaatcaaatatttggacatatgtataggacattaaatgtggaaaaataaactaattgcaaagtttgcatgtaaattacgagacgaatcttttgagcctaattacgctaggatttgacaatgtggtgctagagtaaacatttactaatgatgaagtaattaggcttaataaattcgtctcgcagtttataagcggaatctgtaatttatttgttattagtctacgtttaatacttcaaatgtgtgttcgtatacttaaaaactttacacccaaagagctaaacacaccctataaagttgaggaaatgtttagttcccaaaaattttgcccaaaaacgtcacatcgaatctttggacacatgtatgaagcattaaatatagataaaaaaaactaattgtacagttcgcattgaaatcgcgagacgaatcttttgagcctaattagtccatgattagccataagtgctacagtaacccacgcgtgctaatgaaagattaattaggcttaataaattcgtcccgtgcgtggtttttaggcgagttatgaaattagttttttcattcatgtccgaaaaccccttccgatatccggtcaaacgttcgatgtgacacctaaaaattttcttttcgcaaactaaacacacccttagagggttaaagttaagggtgaatagtacactgactttggggagtttccactttccagccatctgattctcagatataagaaataactacaaaatcattgtattgcatgcctttgtctttacaccccaagttaaggtccttcacagtgctcctacatggaggagttacctactgcgccagctcggattcacgcgtacatggcgccgagacccacaccttcgcccggccgctcgcgccctaactgggagacgcgttttctcggtgcaaggagggtgcgtggcgaaggaaactcgcactatgaaagtcattgcttcgattcggcgcgaccttgcctcctcctctttctccacattcaccgccaagggaggagaagagagaccaatccacctcggcctccttgaccctcgccgctccggatccacgccaccgcctcggcctcctcaaccaccgcagcaccgctgctccgaatccgaccagatcgagacggacaaggaggagaggagagtcgctacccggcggcatcgtcatcgtctccgtcctctcgccggcgaagggaggaggggagagccgacggagggaggagaggagggcggcaacgacggagggaggaggggagctccctccgctgacgctgccggcgcggagatccccgagccgtgcagcagcagcagtaactccattgacttgggcgcaggcgcgggggcggggagaggtcggcgccataggggtcgggggaacggttggcgacgtcgacgacgacggcggcggggccgaccagagcgggcaccgccctcgctggctgcttcttccgcatagggagccggcgccagcggagggaggaggggagagctcgtagtcctcccgccgtcggctccagatccaagctgccgctgccgtcctctcaccgccgcttcttcattaggcctcgaagacaccgccgctatgtggccccgaggagatccggggtcgcagccatgtcgccgccatcatcgaatcgtccttgtcatcgattggatgtgaaaggggaaagtggggcgtgaaagtgggaaagggtaaaggggaaagtgggagagagaaggccggtgaaagttgggggtggttggattgggttcccgtgaaagtatttgtactgtgggagtagtggattcgatgtgtatttgtcctacgtggcgtataaggttactcaaatgaggtgcttgcactgctactgccctagagggttcgtttccagatagaatcaagaccgatacccttccggttttgtatataaatatggcatggctggtagctccatggatggagaagacgatcttgagattcaatgaaattttccggtgaaatccacaactacgctaaactccagggctcaatgcccccgcgtcagatgtataaaatctgttgttccacgtccaaattagaggggatcttttgctgatttgtaaatttaaacacgctgacgacgattctgcagagaatggcagttttgaaccacagacggatgcttgtggacagtgaacagccgattttggttaaatctcgaacagaaaatctagataacgacatcccgtaggaacgggatgacttaaaaggtctatgttatttccatcaaaacgattgtacacgcatacggcacgactcctaaaaatgaagatgaagatgaagattaagtgtttcacgtaaaacgaggtggtaataacgtgtgattaattgagttttaattattacaaacttgaaaaatggattaatatgatattttagaacaactttcatacagaattttttttacacgaaacacaccgtttagcagtttgaaaaacgtgccacgaaaaatccaaaatttcatccactgctagtagtggaaacgaacgtggcagggttatacaccaccacttatccacgctcgtgtgtccttcctccagcacaaggactccagatacactggttgggcacttggaccttgtgaatcacttcgggcatgcacctttgtaggcttgacttgcatcttctatataccatggtcatctcagtgacttgtttttaatttttcgttttatcctttttcttgctttgttttttttcttgagtgagacactttgagatttagtatgagtcatgtaaattacattggcactttttttttgcttgtccaacaaatggctagaaggctggacagtaagaaagaagcccatgttatgcttaaacttgatatttcgatggcttttgattcggtcgactgatcctttcttcttgaagttttgtgccatttgggttttgggagacgatggtgtaatttgctttgccttttgctgtcaacctcctccacaagagttttggtcaatggagagcccggcaaggaaattgctcattgtagaggcctccggcaaggtgaccccttgtctgctatgctttttatcttggttatggacgtgctgaattcagttgcagtgcatgcggatcatggaaatctactggaacctcttgctgtcccgcagacagcacaccgggtttctctgtatgcggatgatgtggtcatgttcttgcgtcctacaagcggggacctatctcttatcaagcagattttggagttttttggtcaaatttttggtctaaggaccaatatgacaaagagctcatgcactcctattcactgcttggaagatgatctggaagtgataaataatgagttgttttgtgaagtaaacaatttcccttgttcttatctcggacttccacttacaatccgaaaaccaagacagatttgttgccctctgtggacaaagtggcagataatttaccgagttggaaagcctctttaatgaacaaggcaggtcggcttataacagttagggtggtcctctcggctattcctatttatgcaatgatggcgttggatcttcctaagtgggtggtcaaggctatagataaaaagtgccacggcttcctatggaagggaagagaaatactaatggaggaaattgcttgatatcttgggatcgtgtgtcagcctttgtcctatggaggccttggtatcccttntaanaacncctttttggaaaactatggaggctttggtatcattaaccttgaaaagatggaatgggcactaggcatgagatggtgatggcttcaaaaaactgattttgccaggccttgggccggtttgtctattcatgtgcctcagaatgtccattctcttttcaatgtggctatcaaaattgtggttggaaatggagaaaataccatgttttggagtgataggtggctgcaaggtaaaacagtagcagagctggcccctaatctctttgccttgatctccaagatgggtggctgacatagtggcgcgggctttggaaaacaaaagatgggtggctgacatacatgggggactatctgttcaggtcctttatgagcacttgaccatttggtctttggttgatgaggtggttctgctacaagatgtacaagaccagcatgtttggtgatggcatgtacacttgtaaatc

SEQ ID NO: 52134 - DNA, 1510 bp, Oryza sativa
tgctctttttttttctttttccctcttttctttctcttttctcttttaactctaattatttgtggggcgttacatacatccatactcaaagattcgacgtccccgccaaactcattctatacctaggcttcaaatttaaccaggaacttcccctattagtagcacgtatatacatacaattttcggtgcacatacgtcatgtcatacgaccacttagggatcatcctgtatgcctgcgtacatgttcaaatatacgtatagctgcaagggtcggctctaataccatctgtgacacccagggcgcgaaaacggtattgagtccatctcatccagttggaccacacctacaatatcaactctcttgcgttttcgtccccgctttcacgcaaaaaatctggattggagttaatagccctcaggcatctccaccttataagctgctgctccttagctattatactcggcgctatagtgttttcaggctgctacaatgtcacgagctgctactactgctgggctgcttgctgctgtgggctggactactagctagctttgctctcttttctttttatctctttcctttttgttttctctttttcccctaattatttgtggggtgttagcccctcacctcattggctaattttttgggtgggagaaaccctttgaaatccaaaaaaaaaacatcaagccacaacccaggacaaacatcaaggctgtggcataggtcgccaccaacctggcccaactagttcatagtatgtctatttcccttatctacccgggttgttgcttgtgcatagaaagaaatacaacattcagacaaaaaagaaagaaaaaaagaaacacctcgctaatatctcctatcactggcatgccacttgctaagttcaccatcaagcttgtggtcgccggatcgagtggcatcacctaatgaacaaatgaagaatggcagtcatgaggggaattcgtcagcaacgagtagggaggtgacggttggcagagatgcagccaatggtgtggcaggagggaagcgttggcccagtgcatcgatccatgttcccttgtccctccccagcgttgccgccatctcttggtgttggcgccaatgcggtcgtgggtttgtgccgctagcactagcggcctagcccgcttataggttccaaccgtcccacttcaacaaatcgtggccgccctttgctaggactcttcctcgcttcctcatcgtcggcccatcgccctaggctccagcaccactcgtagaagcaccacggtagcaccagctgccggagtccatcgctactcatccacatccccacatgaccaactccaacatcatcatgacgctagcttcctggttgcttcgccaagcgtcatggtcgccatctcaccatctgcatcacttggctcgcgggctaaatgagttggctcgagacaggagatgagccatgccaggtttttagctcattaagaaaatgagctgagctgaaccagctcgttatcctaatga

SEQ ID NO: 52135 - DNA, 818 bp, Oryza sativa
tccagattctgaatgtcgaggccgccgcactactttggtttatccacagtcctacatccatgcgtaccaccaatccaccatacgtccccttccccttacatctagacatctagtgatgccaatcgggtgtttaccctcttgcattttcgtactaattaacgaggcttccatggctaaatattattgggtcaaacaggccaagacccagtgcatcctcgaatgcatgttggactcaagacgagcattcatggaggaagtctaatggcgatacgtaagaaaggtaaaaaagaggtaagggtttgttaggttcaaagctaaattttggcctaacaaaattttggtagtactaaaaccttgcaattgttggcgctaccaagtaaaagcaacaagttttcctacacaagaatacggcacatcatcaaaaacgtattgaccgtcggataaaaagtttgaataaacaatggccattagataaaaaagtatatgcatttaaagaaaaacacaaatgagctaaatatatgaaaatttctggaggtttatagtgccacctcttaaactcatgaacaaagaaagagaggggcaattacgatgaaaaaacaggagccttctagtgattcatcatgcctagattcattttcctaagtggtatcaaattctcacatactatgttgtttttctttacggagggagtgtactctagtataatttagctaaatctataattggttagacaatttatacttactagataaatgaacttacgtcaaaaccttcttaaaagctaactaaactaataaattatatatagaagttttttt

SEQ ID NO: 52136 - DNA, 3821 bp, Oryza sativa
  unsure (1)..(3821): unsure at all n locations
acgtaagaggcccatcggcaggcagttactgtgggcgaatacgtctcgtttcgtttttattttcggtataaaatggtagactacgaacgtctcgtgcatattgttcgtgcggcccatacggcaagtatatgttttcctatgagtaaaaagtttatctttctcttaaactttttttaaagataaggatataaatcctagcatttgcttcaaattaactatagctaattattctaaaattcactcaataaagagcacaaaccattctcttaaagaagagcacatactatcctctcaacaaatagcacggaagaataggatacgatgcacaaactaatgacctttaatatgaaataggaatccaacattgttgaaacctatttataaatctccatccatagttgacaaaaaaaaaagtataactgttcattctaaattacgatatgatgtataagatcactgtcatcatcacatatttgtagttgtgcctaaaaccaaaatcagaacattgctatgaaaaggatctgcattttttatttagataaggatttgtccaacaccatattatttctacaaagttatagagtccaacatatagcaaatgccccataaatttgttagttttttcatcaattcctacaagccaattctccaatatctctcttaaacttgtgttgtctaatttttgtccctcaacttcgaaactagatgacggcaacaataaacttacaaaactagacaaaatatgttcctaattggtttttttttaaaaaaagttcctaattggtattgagaatgattttgtggtgtagcgatcatatcactacctaggtgaaaccctgtgcattgcagcgggagtttactatgataacaataagtaaaaaacaatgtgtaagataacgtaaacaacataagtttacataagttgatatgatttaaatttaaatagtatatagaatgatgattcaaatttaaaagtaagatgatgtggctttatgagagaacaagagaaggaagataatttatgcatatatccaagggctaaaacaattgatgtggtatggcttaatgagagaaaagagaaataatatttaaccaagtgaggataaactatatagatatatagaatattaaaaaaatgatggagagatatattgaaatattatgtaaattatgtggaatgatttaacatgcttacattttatatctctaaaatttaataaactataaagttatagataatatagagtgcttgcataatacttaaatgtaataattgttagtgaatgatgatatggcatctttgcatgttaggcttttatagagttatagataatacagcatgcttgcatgatgtttaaatgtaataattgttagtggataatgatgtggcatctttgcatgttaagcttttataaaattatagataatatagcatatgcttgcctatgttacccagtaacccagatacggcgatacggggatacgcgtatatatatattaatatatatatatatatatattaaaaaatacaaaaaaaattgaagagtaaactagacaattagcagagcagagcatgccaacaccaagcgaccaaccatcagattccattatgggctctatcttcaattgagtcaaaggaattaaacccactctcagacaatgaaaaatctgcaaactgttgtttgatccttcttaagtcatcctcagagaaataccttctaaaacatttatttctcatttctaaaatctctgcatccatatgagagccttggctagttggaacatcctccgaccaagtttcacaataatacctacacattgtaaaaaaaaaatcaagctgctagcaactattccaagatatggaaaaaaaccaaaatgaattagaactttattggggtttagtgagtgtgccaagcaatgcaggggagtactattttttgcccatcgagagtgtaagatctcattcacatgaaagaaaaaggaagaatgctcatcgagttctttcccttcacgatagagctgcgcctggcagagccgacagcggacggcagaggcccggcgctacggctgcagacggcggaggcgcagcccggctacggtggacggcggcggcgccggtgccgacgcgacgagccggcgacggcggaagcgcggcgctgtggccgcggatggcggaggcgtggcccggcgacagtggacggcggtggcgccgacgcggcaagccggcgacggcggaagcgcggcgtggcggccgcggacgacggaggcgcggcccggcgacggtggacgacggtggcgctgacgcggcgagccggcgacgacgcagccacgcaggagagagcgagcagaatcagggcttggggaggcggcgctggtggtgtggactgtggaatttggttcgctcgatgcaggctggggatttgatcgatggatttaggttttgaacatatcagagatgtatcgggaatttttttatttatttgaaaatcaagaaaagagaggatatgtacgggatacgtatcggggcgtatccgatacgtatccgtatccggcctcgtatccgatacggatacgaggcctgaaaggagtatccaggtaacgtagatgcttgcatgatgcttaaatataataattgttaaagggttatgatgtggcatctttgcatgttaagttttaggaattagtgcgttacaactttatagtaagaaaggattccatggagtcacatcatcatccagctagtcccacatatagtactacttcttccatggttctgttctactcaacatcacatcctgctttacacgaaaagtttagcaagatatgtgtcagtttaaaaagttggggccatgacaccctaaacacatttatggtaattttgattggtacaatagtgaattttatgctaaggcgaactttaattaggtaagtttaatgcttgtgaattaattaagtcacacatatgtcaacaaaataaaattatgaacaagtataaccacctccattttatacacaactacttaaaaatactctgaggggttattttgtctagttcagaaaattggggacaaaaaataacctgctttttaggttagaataagaagtagatattgagcaaaanttaagggctagaaatgtagaatgcccaaatttatttagattagttcaacagtggtaagaacaccatgtcaacaagaataatggaagtataagggatgagtatcaactaatttgagaaagttgagagatgggttttatccagattggtggttaaaacacaaaaacaaaaccaagtgattttttccttctataccttttttctcgaatacataggagaactgcatattatttcataaaaatggaaaaaaaagtacaaaactcaaaaataaacaaaaggatagaaagacaatgaacttgctagcaaacaaaatgacctagaccacttgccagcaaagcctaaacaagttcaaggacccctaacttaaaagttatttcacctcggccctagggctggatgaaaaactcatggtttgtttgctcgagccatcttgagctggcttgcgagtagctcatgagctgagggtgcttttagttgatggtcaaggttggatacaataatggcgatccatatttgagggatatggtgatccatattttgtttagttgagtggatacaaccatctagtttttgtatggttagatgaatgagggtgaatagaatgaaaacaataactattaagtaacaatgacatatgttagttatcgttaaccttaccccaaactatactaattggccataaaatagactaattatatcttat

SEQ ID NO: 52137 - DNA, 1350 bp, Oryza sativa
aggggtatacctcttccaattttatggaactataggtgggacatgttcctaggttttttggaaggataatccaaaactctacggaactatagatggaacatgtttctaggttgttcggaatgataatccagaacggtataccctactagaggaatatgttcctatatttgttggaacaatagcatggaacgtggaaccctagtcaagaatattgttccaatcattttttttaacaagtaacttaactcaagtttatagcaaagtgtaatagaagttctcagaataaattattacaatgaaaaagtatataaaccaatatgctctagcagtggatgaaaggagaaagatcacaaattgagcttcatatatataaaattatagatgtgggtggttgctggcggcaagcatcatgatccacaacatcaccatgaaggtcttttctgcggtagcactcatatgatctttccatgttcatgtaaacacataacaatatatatgaacattattaccaaggtatgaaaaacaaataaataaacaatcagttaacttatgatttctgtgcatttccaaccacttagattgtggagtcttcgggatctatatccaacttggcgttaggccctcctttatagctttgagtatatcttgatagaagaggtaagtttgagtggattgacacaagcttatccgcgtttgtggcatttagattgtttctctttgcactatggatgtactgataagtggcccaaatcctctcagcggatgaaccactaataggttgcaagagaaccattttggcaacctctgtcaattctgatgtctcggatccatagctgctctaccactcaactagttccatcgtttctgcatccacctacacagattctagtgcaaaaaatcccttcttcataataaagtcattgagttgctcgcgaaggactttttcctcatctttattatctactattctctcaaatgcttttagcacacctgtcatggcctcaacatcttgattcggtgctctccttattgtgccaccgggagcaggtttttgaagataatcttgatcataaaaccttgggcaaacagcataagccaaacagtgaagttgaacactcatctttttccaacgttcaatgactatgttctctacctctggaagaaacttttgtatggattgtcatctttcattatgatatcctttatctctccaaccatacaatccattctctatagatctcacccatttttggacgttccccatcattgaaccttaatacttcatatatgtgctctgtgatagtaaaaatattctcaactttaacccaaaagtcctcaccactgatttct

SEQ ID NO: 52138 - DNA, 10602 bp, Oryza sativa
  unsure (1)..(10602): unsure at all n locations
atgccttatattatgttcacctaagtttctcactagcatataagtggctttgaggatatgctatcaccaaatactatgagagtccatctgtctaaccaaccatgtggccaatgactaatatccataattgatgagaaaaaaatactttctttctaggaaaaaatccaaatactcccttaaactttggatggaagtccgtctagcaccctaaactttaaaaccggatatatctaaccccctaaactttgtaaaatcattcatttttttcttgacataaattactgccaggtattagcccaacaatatagcttttataaaaattggaaaatatttacatcttacaaggagaagcaggaacccacaaaataattacatagtttgtaaccaatcaaaaactaattgcttgagaggctccttcattctacacatatgtagaagaagttctttcctgaactgaactttccatccatgaaaagtcagaggaacattctgaaaaatcatgccatttctttgtttccaaatgtaccaggcagctataaagaagatctccagaaagcccttcataccaaagcgatttcttgctagaacaaccatctggaagaaatttaaattgagaaaccaatggaaacccaaaagctgccaacatcggaggctataaggacaagcaaagaagatgtgcagttttgtttctcttaaatccccatagcaaagaacacatgtgagatcatcattctccttagcacagtgcctgcgatccaacatgtcccttgtattaaatctatctaaagagaggagccaagcaaacactttgattttgatcacacactttgtcttccagatccaaacaagcagccttgagggttgtaggcatgagtaattcattttgtataatctttgagctgaatacttatcaatattccaaatataactccaatgatcaccaaacccctcatttaaatgaacactgtcaagatcagatttcaacactaaaaattccccataagcttcagtattaaaaggaagcatgaaagcatcttctaaaggccttgagcaagccatgccaacatattcctctttgttataagctgccaaaaaaagattaggaaacttatatcatttaagttccccattccacaggtccctccaaaagagcacataggttcctgtttgcactgtgcactgaacaatccctctgaaaacatcagcaagatagacaatatctttccaccaaaatgaacctttgttggcaattgagtggggaggctttgaggtgtaataagatttccatatgagatccacccaaggaagatcaacatttctgtagaacttgtctaagtgtttcaacaaaagagcaatgttctgtgttcttagatttatcacccctaggccacccttgtcctttggcctacacactagctcccaggaagctagagattttctggtggaagttgggtcatttcctctccacaaacaatcctttcttgttgtatcaatggccttaatgatagttaaaggcaatttaagagaacacatatagcatgtggggactgcaaaaagaacatagttgataggtgtcagcctaccaccctggggtaagaatgctgagctagctgttagccttctctccactctgtccactaaaggagcaaagtcaatcttcatgacaacaagggggcctctcaagggtagtaagatcaacacgtggaactctaagattaccacccaagtgaacaatgtggccttgtcggaggaaacggtgagggttggggttgacattagccatctccggcggtgaagaagagctctgtagattggaaacttgaggaagaacagctttggtaggtgaagagataatgggagaaactcttgcagtagtattaggaacctttttagctctccaaacaaaattactccgattatacagattattcggaatagataaatcttctttcttttgggcctttaaagggcatggcagaaacgagccaagtgactaagaagacagcaagcctgatagcacaaaggcccaggacagttagctttcaaatggcccacccccaaacaccggccacaattcaaatcagaatttaaacccagcgcggaattaccccctaaggtggttttggatggtggtttttcatattttaaaaccttaaacgaacaactttaaataactaatataacatatttgcatatcatcagttgtaagtcatcaatctatacatatcaccgtactattattatgttggtacttgtttgtaagtgagagctaacaactggtaaaaagaaagatttaagtggagattttaatatatatgtccaatgtgtatgtcaagtgatcaaactcatccaatttgtatacgaatgagataaaaaccactatagagggtaatatgaacggttttgcaaagtttatgggggttggatgtccggttttaaagtttagggtgctaggcggacatctatctaaagtttagggggatatttagactttttccttctttctatatgtagagtatgttttcttcttgtggggatcttgcattgctaaaatagaaacatctttttcactcttttcttgtttttctaaagagtaaattgcacattaggtaacctattttttacatcttctgcagattaagctaggattcaacctagacttttatcttacttagctttgccaatggtttcactttggtctatgtccctctcctcatggctatgctgctcctcttcattctatcttctccatagaaccaattggccaaacacgatggccacggaagattttttctttgtagaggccgaatctcgaatgcacgagacactgccacactagtgatcaatcctcgacccagccatcgccgtcagcctgcccacacgacacaagggtcgtagcattgctcgtcaccacatggatatcatgtttggactcgaagccactcgttttgctagattgcacttcatacgagacgccgtcatgctcgagcagctctaggatgcagataaaggtgagattgggcttcctatcgaagatcctatatcatttctagcctttcctccccttcagattgactgatcgagccactcaagttggggatgatcattgtcatctgctgttcatcccctatgagcataatactttcttcttttactagctccttccaaatctagccgaaggtgaacagtgtttgaacgtaagtgccattccgagtggcacggccacacgagccgtgcttgagctgggcggcaatggctcatctcaacaatgaagaaaaatgggagaggagagatgaagaagaaatctggtttaatgtgagatcaaagagaaaagattgatacacgctaatacaaatatggaaaacttgtaaaaaggagtggtccatagtgcatttcactctttttctaaatttgcagatgactctaaccaaagaagatgagaacttgaagagttattgctgcgggctaaattattattttctttatgtaccctcctgtgtcaaatggtcgatgggggatgctgattacatgctactatgtgttgccaaatttattttcttgcaatgacagcttgtcatcatattattagtattatctgcatcacctgttagtttacttgcttggtcaaaagctggaagtgcttcagcattatcaaatttagaccgcatgcctttccatgtgagctaagcgactatataatattttgaaaagtaaattgcggtaatggaaatagtttgacaaattggagcgatctagagcctcctactgcaacaacttgactcaaggcgtactttgttcaaataggtcggtcgtaacacattttttttgtttttacattagcaagccacactactatgttatcgatttttgtggactaggccccctataggttgtagacagaccataaatgtcccgcatgcaaaaattgctccccattgtattggttcaaggctacctgcgaaaatgcattattgcaggcagccacttaaagaggcctgcctgcaaaaatagatttattttcacaggcagacctctttagcgactacatgcaataatgcaatttcgcaggcgagtctcttaaatacccgattcaagtctaatttccccctccctatcaacatcttcaatttttttcaagccaccttctctgtctcaccttctcgcatcctcatccttatcttctcacctccggctggcggtgatgggctttttcaggaatggcgccggcggcgactacggcaagagtgacgacgacacactcacaatggtggagggaggcggtggcggtcaatccgtcaccgctgtcctcaggagggacggatccgacgccctagggaaaggaattagtgacgacaactgcaggcggcgagggtggtgccgtacttggccccatgaggggcgcgatgacggacagcggatccagcgccgccgacctcgggaggggcggatccgcctccccggccccagtcctcgttgactactacggcgacaacgtcgacagtagcggactatggtgagcaccacgatggcggtggtgccggccacggcaacgttagggtttcaatcggcggcatgctagggtttcggcggatttggtgttttggaatttttatttttttcgctgaaatttttttcgcgtgcggtcggtattggtgaccgcatgcaaaaatgcggttgtgctgaccacacgggtagactccaggatgcggaccgtctagccgcttgtgaaaatcgattctgactgcctgcgaaaatcgattttgtagtagtgccatatgtcttaagatcatgtcactaggctgctaagagcccatatgactttgaaaaaagaaaaatttttgtttgcctcgcatcaataatcaaaagggagctaagaaagtaagaaaatatgaacctcaatttgaaaaagaattcaattgcaaaatgatcgaaagaattcttgatagaaagttgctagacaaaatatcagacatgagaaaagcagttttagcataagaacacaaggtttgtactaattaacaaacaaatcaacagaaccaaggaaataccttagataatagaaaccatgcaacttctgaaacttaagtttatatgaagatgcaaatggcgctggcagcgatagtccgagctaacatacatatacacatacaggggcggatccaggccttggacagctatggctcaaaccctaggcctgagatccattcatataaatttcagaaaagtgtatgaatttgtagagaatttgggtaagaaaatagagttgaaccctataggtgtggctccattcatataaacttctagcaggctccaccactgtatacatagttacatacatacaagagaatttctcgaaacaaacttgaattggtttaatcaaaactttcctggtttcatgtccgaccttagaaaaggaatgccaagaataaccagtaggatcctgacatgtgtgacgaactcgccaccagtgctgagatgcttggcatggaactgagccccacagtttggtccaaggtagcacagcatctcaatccacaccatggagatgagctcccaacgctgagctccgttgcttatcttgagaaggtgatcggtgatcacacggccacgactaaagcatggctcagtcaccccgggtgactgccgcacataccgcaagagtgtcttctcatcatggacggtggaagctcgaatgatgcgcttcagcaggcggcgtgccttaccaagccgaaaatgcccattggtgccactcatcacgtcacgcttcacgacgaggtacattacatatctcgacagctccatgctcggaaccctgcacggggagcgatcatccttgtcggcgaaccagcacatctccgtcgcgatgtgccaaacaatgacggtcattggaaaatacaagacggtatcgatgatgccatcggttagtatcccttgagcaatgtcatcttggattctcccctcctgcagccaccactgcaaccacatgccactgtacttgctggaatcccagtcccagtagtcacttacactacgggtggtggcaacctcagtcaatttgtccaatacgagctttttcagttcaggagagaccgtcttactcatgtcgatgtcaggcatgatacccgtcttcctcactacccatccgcatattatgctgccacgttcttcttggatgcatgcgtcgatcaggttatactgcggtatcttctccgaccagaggggtttgctccatggattaacaaatctgacaaggctgaaaacacagccaaacaagccacctgtttggtgtaactgcaaccaatatgatgagatgagcttgaagatggaggatatgtccagggtgacagcaccaactagcagtacataggacaccattgcatcttctcttctgtagttgaatggcccctttagatcggtccctacaaacaaccttagggctaccgaggttgagcaaaacgtaatcagccgggcgattacgctgtagacaaggccaaggcggaactgaagcgccccatacttagtgtacatgtagtcatagatcagtgagagttggatctcaaccagcttataagccatctccacctgtgtgtcgggatctgaactacgaagcttctcgacggttctctcaatgatagtgtcttctttagacgaccataccaggaaaggggtcatgtcagtcagaaaacctaggcatatccgaaggccctcgccggcagccatcaccaggccctggtaagcttcatcagcttctcttattcttccatcacggacatctagatcctgcacttccttccccgggaaaatattatgcagctctcggaaataggacttggcatcgatgataacatcatcttgtacatccatcacatgatctgccacagaatcacctcctggctccatcgccctgctagctgccatgagaaccaatattctctcgacatacttgattgttccagagatgaacatcagcaccaatggcgccaagagctgcttgtccgggtgccatgacttgaccatgatgtagatcgctagggccacttgggtgacgagaccgaggaggtgacgcttccacagcattgcatcctcaatggagaaggcagagatcgtctcctggctaccaaggtgcagcagcaggagaggcgtccagaggagcacgagctgatgatggtgtggatcgccaacgtagagcgccagacgccctagtgtgaaggtcgcaatgtagtcggctgacaagtaggccagccagagaagaaagcttagaacacgggaggtgttagccttgcgagtgcttgagaacaagtggaggaagacttgcaagctgaagctcgctagtaccaggcactggatctcccactcgttccagagttgcagggcacgtgccagtgagctgatcaaagggccaaagatctacattagtttctttgtttagaaactgtacaactgcattaatagaaattccaaatattttcgtgcaattttttttgtctctctaagtatctttatgtccattgaagtatggatcagtctttttatgttccaatctattcaagcagttgttgacaactccaaaaatattctagggcataaggtgtgacacctacccatcatactccctccgtctcaaattatagagcgccttttttttaagaaaaatcaaactcggtagcttttgactaataatcatactagctatatgtatacttagtattatgcatgttatatcactagattcatattttgaagtactttcatatgatgctataatttcatatttgttgggatcatagaatgaaataaaatactagtcaaagtatgttattgaagaccgtgtaaaaaaatatagtccttataatttgggacagagggagtaacacttgtttagtttagttagattttgatcttaaagacttatgcccgttcaaatcttctgaatatgaagattaaaagcgggcacgcaaaagagaaagtcattaacgtgtgattaattgagttttatttattagaaacgtgaaaaatggatatatttgatactttaaaggaactttcatataaaacgttttcattttgtggtttgaaaagcatactaacgaaaaccgaggtaaaatctttatctttacgagaaaaaaagtgctcctcactagtatattttctaatttctaattttacgttcacaataatatatgtctttatagatggagggagtaacaatgtactagtactaagaaagatggaatatcacctcatgccgctcatgactgcaaccagagcgctgctacaacttgtcagccgctattgcggtctctgcgagaggaacgaccaggaggagctagccggtaggaccagtagaatgttgctgtctttgcttctcagctgtagttatcaggacgtacatttaattcacaattcacctgcgaatttttttttaaaaaaaaatcgactaacctccaacgtcgtccatggtcgaaattatgcaaagactccgaggcagattacagcaagaatggaggattagggaattggagaatgcgagattatacccagaggaatgggattagctaggatgaaagattagtgccaattgatggatcttccgattacatataccagtgctactgcgtagtagcatcttccttccctcctgctcacgccttaacaacctccgatccttttgtccggctcacgccatactacaaagctaatcaaaaaggtcattctggatcagagaactctattactgccaccaaagtacgccataagtacactcaagcttgattctctggaaaatcagttccttctgacagactgtcaccaggtactgtgcttatactcttgggctgcaggaccgtgatcgatcaatatcttgtcaacgaatgcctggtactctctccatcccaaaataaaccaacatcctaatcctaatataaaccaacatcgtacggcatgtgacacatcctagtatggtgaatctggtactaggatgtgtcacatccagtacgaccgtacgagaggttggtttattttgagacggagagagtagatatgcaacattcgtcctgataagggcatgttcaacggttgagcttgatttgagctcttaattagtacgcatcatcaaacagctatccacaaatatgttaacaactcaaaacacacacttatctattccctaattaactttttttactactatgcaggactatatggccatcatcttttcgcttatgtttatacttatcgactaaaatttgaattttcaaccttaaatgtagagctgattttaaggttttttcatcgaagtttatttttcagcctttgcttttagatcattaaggacacgtatataaaagttttattcacaaattacttttcgtttgtaaatatgtcgtttcgcttattccacgaataagccaaacgatggctctgtgtatgtttctctcgcatttcgtgccaagagtcaatgttttggcatacgatcgactcttgtctcttccctccctctatttggagaagtagagggattagttaaatataaaaaggcgaagaacagtgagccatgctccattcagtcatatttctttgttaatctacagaatcaggaaaatcgaatacagtttgcaggtatgaggtttgcatatctgtttcaacatcctccaaactctaaatagatcaaccatgagaagttaaacatagcactacacagagagagagagagagagactcctagatgatacagaatacaaattaatttccataactcgaaaaattatctatagatataactaaaattttgcagtgaaaattttctactgccagagtaatcattcgtaccttctaagacgtatcagacaggaggaaagcagctttagcataaggaacacaagatttgaacttacaacaaacaacaaatcaacagaaccaagtaaatactttagataatagaaaatcaggcattttctgaaacttaggtttatgcaaagatacatacgactggaacaaacagcccaagctaacataaatacatagtgacacacatacaaaggggttttctcgaaacaaagctgcaggcgcaatcattagtttctttctcagaatttccctggtttcatgtcagacctgagaaaaggaatgccaagaacaaccagtaggatcctgacatgcgtgacaaactcaccaccagtgctcaaatgcttggcatggaactgagccccgcaattgggtccaagatagcacaacatctcgatccacagcatggagattagctcccagcgcagagctctgttgcttattttgagaaggtgctcagagattgcccggccacgaccgaagcatggttcggtcacctggccggttgcctgtcgtgcatacttcaggagccccctctcatcactgataccccgtccttcaaggatgcgcttcacctggcggcgtgccttgccaagctcaaagtgtccattgctgccactcatcacatcccgtttggcaacgaggtacatgacataccttgacagctccatgctcggngccctgcatggcgaatagtcatcctcgtcggcgaaccagcacatcttcgtcgcgatgtgccaaacaatgactgtcattgga

SEQ ID NO: 52139 - DNA, 3880 bp, Oryza sativa
cccggtcccagtaatcacttacactccgggtgcttgctacctcgaacagtttgtccagtaccaatttcttcagttcaggagagactgtattactcatattgatgtcagacacaatgcctgtcctcctcatcacccaaccgcatattatgccaccacgttcttcttggatgcatgcatcaatcaagttatactgcgctatcttctctgaccacagtggtttgctccctgcatgaacacacttggcaagactgaaagaacagccaaacaagccacctctccggtgtaactgcagccaatatgacgagataagcatgaagatggaggatatgtccagtgtgattgcaccggctagcagaacgtaggacaccatgacatcttctctgctgtagttgaatggccccttgagattggcacccacaaacaagcctagggctgccaaagttgagaaaaatgtaatgagccgctcgattccgctgctgacaaggccaaggcggaactgaagtgccccatacttggtgtataagtaatcatagataagtgagagctggatctccaccagtttataagccatctgcacttgtgtttcaggatttgaagtacggagcttcttaatggcactatcaattatagtgtctgtgttagaccataccaggaaaggggtcatgtctgtcagaaaatcaaggcataaccggaagcccttgccagcagccatcaccagaccctcatagccatcgtcatctgttcttcttcctccattgtgaccttcaatgtccagcacattcttcccagggaaaatactatgcaactcatcaaaataggatttagcgtctaagataacatcgtcttgtacccccagcacatgatctgccatggaatcgctccctggcgacattgagctgctggcagtcataagtgcccatgttctctccgcatacttgattgttccagaaatgaacataagcaccaagggccccaaaagttgcttgtccggacgccatgactttgctacgatataaattgccagggccacctgggagacgaggccaaggaggtgacgcttccacagcattgcatcctcaatggagaaggccgaaattgtctcttggctaccaagatgcagcagcaggagcggcgtccaaaagagcacacgctgatggcgtggatcatcaacgtggagcgtcaggcgacccagcgtgaatgttgcaacgtagtcggctaacaagtatgccagcaaagcagcgagcttaataaccgggaggtgttacccttgcgaatgctagagaagaagtgaaggaacacttgcaagctaaagctcgcaagcacaaggcactggatctcccactcattccagaactgctgggcattcgccactaaactggatcaaaggaccaaaaatcccatgttagttgtcaatcaaactactccctcatttcctaaatgtttgatgccgttgacttttttaaacatgtttgatcgtttgtcttattcaaaaaaatttgtgaaatgtgtaaaactatatgtataaataaaaatatttaacaataaatcaaatgataggaaaaaaattaataattacttaaattttttgaataagatgaatggtcaaatattttttaaaaagtcaacggtgtcaaacattttgggatggagggagtagttatcaagccatgcaactacctggagaataattccaaaaacgttttatgaaaaatttgaatgcatttttacagtttgaacttcatatcagtttttagatgttcctgttgagattcccccctccccccaccccccaaaaaaaaaaaatccctgctaagattgaaccataaaatcttccctcttagagattactgagtttcctcacacaaactgtttcaacaaacacaccaaaacataagcttttaacacccacatattcgtgtgtgatatttatgcgatacaatgccttctacacaagagtccatacaagtctattgatagcaggggtaacgggttaacacttattaacactatcggtatcgtaaaaaatttcggcggtcacccgaaatttcaaaattctacagaagtttcgaacaaaatttacaaacgcattttggaatcggaagaaatttctgcagcagtcctgcgacttcattgagcagcaaagggggaaggtacctggaatcctacagccggatcgggaagagccgcagccgcgagaggggttggcgagtcgcgagcgccgccgcggccatacgccgggaggagtgggctgccgctgccgcccgtgcagtgcagggaagctcgggcgaaccatcgaggggatttttttttttttagaactcctttcgaggggattgaccgattgaaatgggatgttaggaagaacagagtttttctccttttttttattaagaccaatttgaccgaaattttcacctggatgtgactgactaccaggcccactgatatatgcaaagataaaaattctctgattaactttatattctaattatccctcgatggctcgaaggctatttaaaatatatgattggaacaaatgtagaaatttggcaaatcatatgagaggaacaaatgtagaattttgacataaatgtgacaaaatttagggttaggaatttgatgagagataaaggcttgtatgagttttttttaatcaggttgaacgtcatatttggttcccttcaaaactcatatggattaaggtattcctttgtattccacctttattaaaaaaaacatttaaaaaagaaatctggtaggactaaaatctaaaaattctgaccccaaagtatgaaacaggtgatgattttgtaggtggttttggtcacttggactacagtgagaataataacacgacaatgaatttggcttgtcctttggttggaggaattgtgtcctattatagggaaaaaaatatagtcatttaaaacaaaagattgattcttacaaattccattgtctataggttttttggaagagaataaacatgaggttactacgtttttccttgtatatcattcatatgataatttataacttacctattttttaagttcttaatagaaatctattaacttattaaaggaatagaaaaatgagcctccacgttcgttctcacggcttagaaattcccacattaatcggagaaaaagaaaaacatagtccatatagaaatacaatttaaaaatagtggaaattcggaagtaaaaaaataagaaatattggaagaggagactagagtccatatagaaatacaatttagaaatagttgaaattcggaattaaaaataagcaatattggaagaggagactggagtccatatagaaatacaatttataaataactgaaattcggaattaaaaaataaagaatattaaaagaagatcatagagtccatatagaaatacaattaataaataatagaaattcagaattaaaaataaggaatattagaagtagagtatagagtccatataaaaatacaattaagaaataatagaaatttggattaaaaataaggaatattaaaagtagagtatagagtccatataggaatttaaaactaactaaaatttgaattaaacataataaaattaaaagtagagtttagagtccgtataaaaatataatttacaaataactaaaattcagaatttaaacaaaacgtgagaagaacagtctaaagtcaatataggaatacaatttagaagtaactgaaatttgaaattaaaacttaaaaatattaaaagatgagtttagagtccacatagaaatacaattagaagtaatacaaatttcaaaattagaaataaataatattagaagaagagactagagtctatatggaaatacaatttacagataacgaaaattcagaat

SEQ ID NO: 52140 - DNA, 3418 bp, Oryza sativa
aaaaagaacaagtaagatgctctcggaaccaaagcacatcaatgtcaacatgtaattcctggggttcattgattagagagaaacaaagatgctagattggtttcagtaaaatacatcaacgagttgctcccgcaagcaataccactctatgtgttatttgaaccaatttctgcaaattaggaggtagaatacttgattatgattaaggggattaagtagaacaatctgatattggtggtgtttaaatcccctgaagatgaagatgaagataaacataaatattaagtgtttcacgtaaaacgaggtggtaataacgggtgattaattgattttaaattattacaaacttgaaaaatggattaatcttataatttagaataattttcatatagaaagtttccgcacgaaacgcaccgtttagcagttcgaaaagcgtgccacttctatccaaaagtttatccagttttggttggagaaaagaacaaggcaaacccagattagaaaacatttttttttcaaggaacatctcattttagctggtccctaataaaacacatgttaaagagttaaagtaatagagattttcctatccaaaattaatctcgatatgtaatatgagggggagctatccgatctttttcaaaatatcatatggtaaaatgttttagctgaccgcaagtgcaatattaagttatatatagtgaaacaaaacaatcagcctctgagacattcaaaaattttgtgaaacacggtaattcacatgttgaaacatattgctttcacgtatgaaaaattaagttatcactgtttgaaacatatgttttctttatcagaatataatcatgtgatatcttgttgtaaagatttgattattaggaattcaacggtgtaatcgaatcattgatcggataagtagtttaggagaaaatttattttaaagatcactaaatacataaatacatacatgtatgcatccatggaatacagagagagccactagaatggcatgagagagtagatgcatgaacatctgatactttgtcggatggcatgagagagtagatgcatgaacatctgatactttgtcggttactagtgaaacattaaacaaaaaattcagttattaaaatattttttaaaacacacataaaacatatcgctaccatgtctaaaacgttgcattttaacggtttgaaacatatgttttttctttctttggaatataataacttgatatcttgttgcaaagatttaattataataaatataatgatgtgatcggagcatagattgaaaaattagtttagaagaaaaatattttgaaaattattatatgcatgcatggatgggtatccacatgcataggtggagtggataggaagctacaaaggctgttaatccggagttttggcccgtgcgtggacggcagatgcaaagtattttctgtaatatgagtcaattaggaatggtgagataactaattcttcttgaccaagagctgttcgatgaaattaattagctaataatttgctgggtcaatatattcttcttcatccaaaaggaaataattttaggcatatgacagattatgaccgtgagagctagcaattgcaatttatgtaagaaaacatattttccatatcccattttgtatggatataatatatcagtaatatggataaatcatatatgtggcaggcatctagtacactacgaaagctgcaaaagatctgtttgaagagcttttagcccgctagtggcctgcagattccgctagaatctcaaactctctcaaacagatccatctattgtccataaaaaggtaacgatggtcacagcaatgcatcatctacttccattgtaaattttgcgagctactctttgaacttcttaatattaaaaaagatcaaaactaaatgaatagcaataaaaaatagatttaaatacattttcgtttatccgtagcaaagcacagccatttagcaactatgctaagaatatatagtcatgtaatcaagaaaataaactaaaagacaaaagctaagaaatatagctttttctgtttctcaaattttggctaatagtcagctgcttctccaaatcttgcttcataaatagaactaaaaccacattaaaaataagaaataatgctacaagaccaaaccaaacccaaccaaagcaacattaaggcagggtgctagatacaacctaccaacgaaagctacattgcagggtgctacatacaagctgcagaaggatggttacttaccccatggctgatggctcaatggccgcaaactacagaatctttccgtttctctggtaggggagagaggttagaggaggagctccatggccgccagccgggggatctgggatcgctgtgtgtaagggtaagtcgtcgtgcaagtcgcgatgcctgtcttcatgtgcatttaattaacctcaaaccccacgggccagggggaaaaacaaagacgtcaaggcctcatcagtcatcagtcgcgattaatatgttttcaaggacaaaagcatttttgcaagtggccaaaagcaatttttgtaagcggaggagaggaccgccaacaaaccaacgaccgtgaaaatcatccatttttgcaggcggggcaatggcccgcctgcgaaaatccaataaaaaaaatcgccttgctgccactgccctcccgcggcctccctccggccggatctgggaggggagtggaggggaggggagccgcccacgtcgttgccgccgccgacgccctcccctgtccaccctccgaccggatctgggagaggaggtacttgtcacgcccagaaattcccgaatggaatcccaagcagaatgtgcattaaaatccccgtccaggaccagccggggtacacaaacgacaatgttgacatacagatccacgtcttacaaacatcataaagtcttacataaatgcagcggaaaacaaagaaactgaagctaagccttgactaagctgcagcgggaacaccaccccacaggcatcctcgacggcacggacgaagcctactcctcagagaaaccttcatctgacccgaactcgaactctggaggttgggaaaagtagagcaaggctgagtactacccactgtactcagcaagtcatactggaatggagggtatgatgcatggattcaacaagggatagctaaacaggttcatttgcataaatactggcatttataaacaagaatttgaatgcgaaaacagttgtaataatttagcagtattaatcatccactgttcaacgctacaccacgttgcaacaggcccaaccatccacctatgctatacaaattaagggattatactaaggtgagactaatcacggtgaatctggttgaccgcccataaccgcgagcacggctattcgaatagttttactct

SEQ ID NO: 52141 - DNA, 23090 bp, Oryza sativa
  unsure (1)..(23090): unsure at all n locations
ggcgcacgcgcggacgtggccgacgtggcccgggagaggcggagacgagggcgcggcggcggtttcggcgcggcggcgcgagcgaagatcggcgggagggaggaaaacgggccgacaggtgggccccacctgtcggcgaccccgagaggagggaggcgggcggccggctattgggctgggcctcggcctgcggccggcccagcaaggaggaggggggggagaaaaaggaaatgggccgacggcccatttcgcaaaaaggaggaaaaagaggggaaaaagaaaaagaaaaagaaaaaggaatttccctggaattaaaattgcacttgctccattttaattggttaaaattatttctagagctctgaaaattccactaaaaatcctgttaatgaatttcgacatgtagaactcaagaaaaattccacatgtcaaatccgattattaattgcattattttcttagggttttctcctgatttcaccaacatttttttagggtcatttataaaattaaaatttggctagggaggaaaacttcggggtgtgacaaacctacccccctttaaacggaatcttgggcccgagattcgaagaagctggtgaagaggtgcgactgggcggctttcaactcatcttccctttcccaggttgcttcctcttcggatgatgactccattgaactcggcaaaacctggtgaccttgtttctggtcctcctttcgctggtatcaagtatgcgaaccggcttctccacataggtcaggtcctcctggatatcgatgtgttccgaatcagcctgttcctcaggtacccttaagcacttctttaattgggatacgtggaacacgtcatggatgccgatcatgttggacggaagttctagctggtaggcaacttctccccttcgttccaaaattttgtatggtcccacgaagcgtggtgccaacttgcctttcgtctgaaaacggtgtactccccggagcggagtgacacgaagatacacgtaatctcctgcctcaaaggtgagctcccttcgacggttatccgcgtagctcttctgtcgagactgggcaatcctcaacctttccctgatgattctgactttctcttctgcttctgctaatacttctgttccgaacagttgacgctcgcctgtctgatcccagaagagaggtgtgcggcacttccggccgtataaagcttcaaacggtgccatctgtagactggcctggtagctgttgttgtacgagaattccgcatatggcaagcttttgtcccaagctccaccaaaatcaagagcgcatgctctcaacatatcttccaagatttgatttactcgctcggtttgaccgtcagtttgcggatgataggccgtgctgaaatttaaacgggtccccaattcttcctgcaacttctgccagaattttgaggtgaactgactccctcggtcagatactatcttcctgggtaccccatgcaaacacatgatccttgcgaggtacaactctgccaatctctttcccgtataggtggtatgtactggtatgaagtgagccaccttggtgagtcgatccacgactacccagattgaatcatgtcccgatgatgtccggggcagtcccgttataaaatccattccaatctcttcccatttccattccgggatttgaagaggttggagtagacctgctggtctttggtgctctgccttcactcgttggcaaacatcgcagagtgcgacgaactcagctatttctctcctcatgctgacccaccaaaacttttctttgagatcttgatacattttggtgctgccggggtgaatggagtactgggtctgatgagcctcggtgagtatcagatccttcaattccttgtcgtcaggtacacacaatctttctcccatccagattgtgccatgctcatcctcaaggaaatcccgagcctttccgactctcatgttctttttcagctctgctatttccgggtcatttacttgagcggctctaacttgatccacgagcgtcggccgtgcctccagagcggctacgaacccgtgttcaacaattcctatgttgagatgttcaaactcctgccgcaattcctcacacatgccctcggtgcatagggcagtgcagtaacttttccggcttaaagcgtctgccaccacattggctttacccgggtggtagtgaatactcatgtcatagtctttgattagctccaaccatcttcgttgtcgaaggtttaggtccggttgggtgaagatgtatttcagactcttatggtccgtatatacttcgcagcggttgccaatcagatagtgcctccagatcttcaaagcatgaaccactgctgccaattccaagtcatgagttggataatttccttcgtgtggacgcaactgccgcgaggcatatgcaaccactctgccctcttgcattaggacacatccaagtccgtgacgggatgcatcgcaatagacttggaagtctttcatctggtcgggcagaatcaaaaccggtgcggatactaatttcttcttgagctcctcaaaactcttatcgcactcagctgtccatttaaacttctcatctttcttaagcaactgagtcatgggtcgggcgattctggagaagttttcgatgaatcggcggtaataaccggccaatcctagaaaacttcgaatctgcgacacggtcttcggtggggtccacttggtaactgactccacgttcgatgggtcgactgccacaccctgggctgtaatgacatgacccagaaatttaacttccgtcaaccagaagtcacacttgctgaacttggcgtatagttggtgctccttcaacttctcgagtaccagacggagatgttgttcatgttcttcctcggactttgaatagatcaaaatgtcgtcgatgaacaccacaacaaacttgtccagaaattccatgaacactttgttcatcagattcatgaagaatgcgggtgcgttggtaagtccgaaggacataaccgtgcactcatatagcccgtaccgcgtggtgaaggccgtcttcgggatatcctcttcccggattctcaactggtggtagcctgagcgcaggtctatcttagaaaacactttagcccctttcagttgatcaaataaatcgtcgatccgcggcaaaggatatttattcttgattgtgacctcgttaagtgcgcgataatcgacgcacatcctcttcgtcttatcttttttctccacaaaaatgaccggagcgccccaaggcgaagtgcttggtcgtatgtaccctttctgcagctgttcatcaacttgcttcttgacctccgctaattcgttggccgccattctgtacggtctcttatagattggagcggttcccggtgccaagtcaatccggaattcaatctctctcttgggtggcatggtagtgaggtcttcggggaacacttccggatactcgcagactatgggtatatcatccaattttctcgagttcttctctacggtgtccactgggatttctgtctcaatctgattcaacgagacccctttccttggcgagactagggatttgtacaccacggtttctcccttctcgttggttaaggtgactgtgcgattcgcacaatcgatgactcccttaaacttagtcagccaatccatcccgaggatgacatctaggcctttggagtcgagaaggatgaggttggctagaaatggtgatctttggatttctattgttatagaagggctgaattgaaccgaagtggagctattccctggggtatgaacccgcatcggtgtgctaagttcttctcttattaacccatgcatcccgacaaatttctttgagatgaacgaatgcgttgcaccagaatcaaaaagtactgttgcagggattgagttaacaggaaacgtacccagtacgacctctggtgctgcttgtgcctcctccgcagatgcgtggttgacacgagcctggataaaccttggcccggcacgcctgggcttcgggcatttgtccgcgaagtgaccaagctcgccacagttgaagcaggaccctggttttgctccagtctccttcttggcttgcgtgggctggcctgactgtgccggggccattggtgggcgtggagctgcaccgcggttgggctgacctccatggtggttctgactgccactggtgccctggtggaagttgctagggttgaacgggcggtgctgacggacgatcatggtggtaggtccaccctgctgtccgggagtgaaacgcggcctctggtgacttccctgatgtgccctgaactgagcggccttcctcttcctgtccatcttgttgcgttggtcctcttgacgaattgccttgtcgactagcctctcaaagtcggcgtagtccccagatatcagttggttggtcagttcgtcatccaggcccgccatgaacttctcctgcttctcggcgtcggtgcggacatcctctggtgcatatcgcgcgaggcgattgaactcgtggaggtactctgtcaccgtcctgttgccctgatggagtgcgcgaaattccctcttcttttgtgccacgaccccatctggcacctgtgccttcctgaagctacggcagaactctgcccaggtgacttccgtacccggtgggcgggtggccatgtggttgtcccaccaagctgacgcaggaccctgaagctggtgtgtggcgaaagcgaccttctcctgatcattgcactgcaggagattcagcttcttctctattgcatggagccagtcgtttgcctccatagggttggtggtgctagagaaggtgggtggcctgactcgtaggaactcaggcaacttggactgagggggagggggaccaaactgctggtgctgctgttcagcgtactgcatcatcctctggtgcatctgctggtgctgttgctgcatctgctgcatcatggctgccatcatctgagtctgatgcgccataacttgggcaagtgtcggattctcgggaagtggtggcggaccgttgccgggatcgccgttggggtgcataccatcaacgcgttcttcaccgttgctgccctcgcctgtcgtgcggttgccagtcctggtgttgaccatctggagggaagagcagacggggaaaagaagaaaaacagatactcaggaactaaactttattacaaaggaattaaaactgtaattgttctgatctgaattaaaaacacttaaaagagcaagcaaatatccttattaagacagtcatatcataggcacatgacatcgaccgtcgactgaccccaaacaagcaacctaaacacacaaactaacaagcagaaactagacagtcgctgaactaaggggaaacgagcctaatgctcggaacggctcctgcggtcggtggagtcgaaagcgtcctcctgttcatcaccaggtccctctgaacgactcctggagcctggcaggtacgtctcgctgctgcccgtctgcgagccactggagctgcgatcgcggctgccactgggggtagcaggcaaccaacccccgatgccactggctggacctctgacggctgacgctggggcgaaggagagaacgaacgcgggagctggagctggagctgcaggaactggagctgcaggagctgcgggcggaactggaggtgctgcgggagctgctgctggaggtgggttcctgggcgcgagctggatgcgcacgggtgccttcgtagtcttgcggggcgtagtgcggatccggactcctcctggcgctgggagacccttaagctgagcgttctccttcttcagacgcgctatctcgtccttcaaagcgacgatcctcatgagcttcccatcattcaaggccttagtcgccttgtgcagatccgagtgcatcctgtccagacccctcatcaccgcgcacatgtgaccgaaggtggtgtcgttctcgccagctgtcggacggaaggagctgacgccatcaccgtgggctcgactggggtggtagcggtacgccgtgtcgtggaagatgtagttgtggcgctcccgtagtctggccatcatcaggtaggctgcctcctgacaggcatgatctgctgtgcctcctgacgcctcgaccgccatgttagcgaggcaagtccccacgtaaccatggacctccaagcggacacggtgaggaagctcgccactgagcggtgggatggtcgtgtactccggcgcgtcggggtagcccaccaccaatgtcatgcgtgccaactctgccacgaaatcgatcatgccttctccgcggtggttgggtgggtgaccggccatctagagaagacaaaggagtaggatcaatgcatgctcaaatccaaatttaaataaagcaataaaagactcaaataagggaaatcaaataagagcaaaattttatgcatagatcattttacatgagagcgaataaataagacagactcacatgacgatgaaataatgagaaattagatacataataataataacgaacaaagcataaatacctggcaacccaagttcctgagctaggacctaatgcatttcacccctcaaacctcaactgactgacgaataaatcccaataattttactaaaaccctagactgactcgttttgaaaaatctcacttaaacgagcgaccaagatttttcccttgaaccacaagaacagatcccaattttcccggaacaaatccaattgcaaagagcatatgcaatgaaaaggattcagagggctcttaggtttttccatttggcttgtcctacggtcaaagtcggctctgataccaacttgtcacgcccagaaattcccgaatggaatcccaagcagaatgtgcattaaaatccccgtccaggaccagccgggtacacaaacgacaatgttgacatacagatccacgtcttacaaacatcataaagtcttacataaatgcagcggaaaacaaagaaactgaagctaagccttgactaagctgcagcgggaacaccaccccacaggcatcctcgacggcacggacgaagcctactcctcagagaaaccttcatctgacccgaactcgaactctggaggttgggaaaagtagagcaaggctgagtactacccactgtactcagcaagtcatactggaatggagggtatgatgcatggattcaacaagggatagctaaacaggttcatttgcataaatactggcatttataaacaagaatttgaatgcgaaaacagttgtaataatttagcagtattaatcatccactgttcaacgctacaccacgttgcaacaggcccaaccatccacctatgctatacaaattaaaggattatactaaggtgagactaatcacggtgaatctggttgaccgcccataaccgcgagcacggctattcgaatagttttactctgaccagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtgattcattttatttaaccaacaccggagcggtggtattaaaccaacattatcacctatagtctaggttttaaatgagattccccaatgtgtgctagttgaactaagcatggctaagcaaaccctagtcctaactctaatcaggttataacccaagctaacaaaggagcatgatatccaaaagcatggctataacaataggtaaccatcccatagtaatattataaaacaatgcaatatttgaaaggaaacaatagagcatttgcaatataggatcaacatgttcaagtgacaagcatgacttgccttgctctgctgctggagggacctcggcgactatctcgaagtacaccggagcgtcggcgggatcggaatctagcgacatacaaagcaaacattgcaaacaggctataagactactgaaacagagaacaaaaccatttttaatggattctacacatttttcttgatttactgagacttgaatgggattaaacggagctcggatgaattagttatgaattttagaagattcactgtgtttattactataaaagaaatccttaaatgaattattgcgcaatatcaaccagggctgacgtcagcgcggggcggcgcggcgccgacatgcggggcccaccggtcagcgacacgggggagagagaggaggggcggcgacgccacgtggcggccgatccgacggcccggatcgccctcgggccgatcggacggacggcggcggcggcagccctcgggctcgggtcggcgtcaaaaccgaccggccgacccggggctagcgacggcggcgcgcgcgcgtcgcggcgccggcgacggcatccggcggtggaggcgacgcggaggcggcggcagcggacggcggcaacgacccaaagcgacggcgagcgcgggcggcggcgacgcacggggaaacggggagggagaggagaggagatgcctcaccgagggtggccggcgcgcgggaagacgatggcggacggcgacggcgaaccacgggagaacggcggcggctagcggacgagctccggcgtgccctaaggacgaaaaagagagggattagagagagggagatagaccacggcgaccggaatccatggccgaaggcggcggcaaaggcggcgctcacccgtgcgcgtggggagagggctccggcgacgaacctcgacggaggaggggcggacgaggtggatctcggccgcgcgaagctaacggcggcgacggcgcgggacggcggcgagcctagcggcggctagcggcggccggagtagcaaaagcggcggcggcgggtggttgcacggcgcggaggcgatggagagctcgggagagtgcggcgaaatggggaaaaagagagagaggagaacggcgatgcttaaaaagggggagagggagccggacgtggccgggagcggcgggattcgccggccgacgtgggggagtggggaggagagagaggcgggattcgattttcgaatcccggccatctcgggcgcgggcgcgaacgggagggagagggggaaaggcgcggacgactcggcgcacgcgcggacgtggccgacgtggcccgggagaggcggagacgagggcgcggcggcggtttcggcgcggcggcgcgagcgagatcggcgggaggagggagacgggaccgacaggtgggccccacctgtcggcgaccccgagaggagggaggcgggcggccggctattgggctgggcctcggcctgcggccggcccagcaaggaggaggggggggagaaaaaggaaatgggccgacggcccatttcgcaaaaaggaggaaaaagaggggaaaaagaaaaagaaaaagaaaaaggaatttccctggaattaaaattgcacttgctccattttaattggttaaaattatttctagagctctgaaaattccactaaaaatcctgttaatgaatttcgacatgtagaactcaagaaaaattccacatgtcaaatccgattattaattgcattattttcttagggttttctcctgatttcaccaacattttcttagggtcatttataaaattaaaatttggctagggaggaaaacttcggggtgtgacagccggggagccgtcgccggaggggagccgtccacgtcaccgccgccgctgctgccctcccccggcctccctccagccggatctgggaggggaggccgggaaccacgtcnccgccaccgccgtcgacctcccccggcctccctgcagtcggatctgggacgggatgccgaggagccgccgccgagtccgcgcgccgacgccgccgctatcgccggtggagggagggaggggaggggagggggagctgagaagccagtggagggagagagagagagttgagaagataagtgtggggaaatgagttgtggggaggggttggaggagtagataagtattaaagtttttttatttttttgggtaggtacgatttttgcaggcggaccacataaggtgcgcctgcgaaaatagattttcgcaggctccgcttaggtggaccgcctacgaaaatcgccgcttaagtggtccgagcgaacttcaccccgatttatatttttgtaggcggtcatttaactccaagggtcatgtccgcttgcgaaaaaaagaccccatgtcgggaaaaatgctttttctagtagtgcgtgactattttatcgatcatggatatcctccttcactctctccctattctaagtatagggtaaaagatacaataaaagatacaatagagcatattgtaatttagctcaacttggtgtgtgttggaatgaaggatgagaagtccttttatagcttgagaatgacggttgaggccattaattccagtataaccgccattggaacgtcagttacaaccatcattggcttgggcctaggccagcggagctaggccggggtcggtcgacccccggtaggcctccccaggcaggcctccctggcccagtcctaccatttggaccacatttaatggatcctcagcccagtggcatgatggttgggcccattttctggtatttcaaagagtttgtgggcctaagactgttgacgaccaaatttggtaagatgtgaaccaggttcgacattgggatcgaggcagattcgataaaaatatcgattcaaagagcagagtatgcatcgcctgcgaaggcatcagctggagtatgcatcagctgagatggatcggacaaaagacagccgatacagccgatggaggtgatgcagccgattccgatgaagatggtttcaaagctgtttccaaaatcgttcaaagtgcttcatgaggatttccacgatggagataaagctctcggataaggcaactgtatctattaattaggatatttcatgtaatttccttatagatatgtttgggcaaaagtctgccgcaaagacttatggtatcttagagtttgttaggatatttcatgaggttttccggcaaggacatattttgtatctcaggtataaatatgacccgaacccatgtaatcaattaacaatcgttcaatacaatctcagcacatcgccacccttttactttcgtttatttcgacgagttcttgctttcgggttgagctgcatagattcgatcttcaactagaggtaaaacttgttatggcggcttgcgttctcggggttaatgcttccatctttatgatactttcaccctgtttacgtaattcgtcaagttatgatatacatgttgcaatttctgttagttatactatatataacttgttatcggctggttcttattgttaggaagcaatcggtagagttatattttgttattaatctagattgcatcgtgtatctaccatctcttgtaggttttcatcatcctgcctagatctcatacttatctttatgcttaatgctgcatcggttaggttcgatctattaagtaatatttataattgtgatatctggcttgttttatgatcatcgagagagatagtatcggggtctcagccgatcttacctaatttagctttatgttttatatgcttaattgatatgctaagtctgccctttatattaagatcttatcgcaataaagtatattaggcttctgtttgatatattctatctgttttaatatattaacatagagtggtatcggagtactggccgatacatgctagatctatctgatcggctatgctataagcgtttataatctttatgttaatgtatattcaatctaagtgatttatattgtctcggcatggcgaccgatctatcccaatgtgacatctcggactagggcttaataggattaatagaatactcatatcaacaagttgcaacttcttttccggaagccgatctctaaagaactccaaggttaagcgtgcttggcctgaagcaatttagggatgggtgaccgattcttcccgagtcctcatgagtgaggacaaagtgtgcagaaaagacttgtgttggtctgtgaggcagtctatgacctatgaaagctgccagatataagcgggctcggcctgtgagaggcgggacgttacacccaatcacttggtttaaatatacgtcgacagaaggattatatagcattaatatcaataactgccgatcaattcacatatgacatcggctcgagaataaatgatatgtcatcggcggctggccgattggctatcgtttatgaatttaaccacggtttcttttgtctttctttcttgttgattgcaggatcaaattaactggcacgctcatgaatctaaaagcaagattttggacctgcactgaagttaagcagatcttccaggccagtgtgtgtttttcacatcaacaaagactcaataggtgaaattctcctcctcttttatgtgtatttcatatcaactttggtagtttgccacctgcatacaaatatacaccaacactcgtgaaaattgttaaaattaaaccctaccactatgttggatgttttatattttcagatttctgcagatattggtgacgtaaaattggtatagccgccaacagccgtgtcctgaacatcaaggccgttgtgcccatcaacctggacatcaactctgggaactacaccaagtggcgcaggcttctcctcgtcaccctcagcaagtacgccctcgccgaccatgtcctcaccgacatctactggtcagatcgctctggctgaatgcgcatggattgtgttgtcctctcttggttgtacggcacgatctccaccgacttgctggagttcgtcatgatgcacataaccacggctcgactcatatggcgtagcctcgaacatcagttcatcagcaaccgcgaaactggcaccctcaacctcaatgtcgagttctacaacttctatcaaagcgatttatccattactaactattgtcgtcgtctcaaagttgttgatgagaaaacacggcgacctgagagttctgcttagttccagtgcaggtccaaatcttgctcttgggttcagggtgtgacagttggtttgatcctgcaaccaacaagaataaacaataaaatcacgttagaatatgataaccgatcggttggagggccaataacatttcgcaatgacctagccgatgcaatctggtcgaattggttgtgtataggataaataaagtaagcaagcctaaaacatgttacatcggttgtagatgcaatcaatcatgtaatccataattcaatctttctctaaaatataaacaaacagtataggtcgaacctaatcaagacagtatggattgctcataacttagatcagatgaattaaagattacatgtgtttatatcataaccaatgatacaatatttaggttaagaaagctaacatatcggctattgctccgatacaaccttatgcaagaatattgatctaagtaaatataccaaacaagcacccatcccccaatatgatgatttggccaagattaaatacaacattgatatatttaaataaggtgatatacttatataaggggcggatataacatgaaaagcaggattaaagatattaaacaaagcaaaatagttatatcaggtaagatcggttgaaaccccaattctatctattggcaatcaagaagcaggttagttttaataactttaaacacgacttagaagatcaaactcaattaatgcaacactcagtatggaaagaaacataaattctaaacaataaaacttttgactgattttcaaggtggtggataccttggctaatctaaactgacaaaacgatttagtcaataccggcaaaaccctagaaaaggcctggccgataggagtaaatcgtcatcaaattagattaactaagatatatgataactagcaattgcaaacgttagattaagacgtctaaaacaacatattaaatcgccgatgcaaacctctatgacaagccatacctctcgccagaagatcaaagccaatgccccaactcgaagcaagaactcatcgaaaaagttgaaaacgaaataggtggcgatacgctgagagttattgaattgttgtggtttttcttacaagatcccatcatatatttatgcccatggtacaaaacttgtctatataggatatgactcaaattttacaaaataaacacaccggcctattgtggactctaacatagatttctaaaatataaaaaggaaaaattgactcttatcttaattaataaatacaattgtcttcttcggactctattttgaatccttaatccaacctcgacatgaactcaaaacctgtctgtattggctaaccgaatccgaatccgactccatatcggccgatacagactccagccgatgcgctgtgccgttttggaaaccgctttatcctcttcaaatccgcttcggatttatatgccctacaatttttgtgcttcctatatatgaaagaaaactgattcgcccatgtgagcaggtgtgtgcagcttgggacgacataacggaaatgacacagggcatccacggcgccaccccgaaataacaacggatttaatttttagattgtaatggcatgtacaaagctagagtctaatatgggctctctatattaattaatgtcaatagagactatcctcctataatagtagagaaaataagatttttaaaccattaatacactaaatatttttttattatacttctttccttttctataccctcatgcaacaaactttccgttaataaatgagagttgaatctgagccgttgtcatgcgtagcaacgatgtttctcattccttccctctctttcttccacgtcactaaatttacttgcataacaacgaaatgtcaccaaatttacttgcataacaacgaagagagcccgttattagacaccattgcatatgccctaatgtagtcagcaggtggttgatgacagtacaagcggtagtaatctgtatgcctattccatcttggaacggggcagtttcttgtactcataggaattgagctgattcttgcaaaggtcacatttttttttcacgagctcgaaccaataatttcctccaaattttgtaggaatttaactgacaaatgatataaattctgcaggtaaatttcttgaaaattccttcattccaaacagtttcagattcccatgttcaaaatggtacttaaacttgtatatataagtgagatttttttttagataaaaataacacacacaaaatgtacaatgctacaagcaagtctagtaaagcaccggaagcgagtctagtagctggtgcgtgcgttgcatctcttcgtctccgttgttctcctgttccattcaacctcgtctgcaacaaacctctgctacaaggaagagagggtcctctaacttatttatttctaactttgagtcactaatatgtgagcccgctgggtaaaagactaagttcaaagagaaataagttaaagaggtctttcttcaaaagaaataagttaagagggactacttgcagctgggacgcatccaatgcaaaaggttctcaaggagagccaaacatccaacttggaagcaagcagtagaaatgataacagtagttaaaaatactaaccgcaaagaatggcaatttctttgtttgtggatcaacagaaataaaatcgtggaaaatcatactacacagtttgcagatttggggtttgcaatgtgtggccaaagcaaacaatcattcagttttaacatccacaacatttcaaaatcaaccatgaaaagctaaacaaaacattacagagatagaggtaggcaacattgaattaaattactttccatactagaaataaaaatatatatagctagaacaaaattctcgcagtgccttcacacctttcaagacgtactaagaaagaaagaaaatactcttttctagctagaccataacgggtttcttcaggaaaaatgtataccagctttgttgaagagcgacaggaggtacaagaagtcaacctggctgagcttcgatgctctcttctctgcaaaatctccttgctgtaatatccccataatcttttctttgaaacatgcacggctctctactaccatatcggcatcatccatttccatctcatcatcatcatcattctcgtagctgctttccatgttcatgtcatcgaccatacttgatagcaatgcaacatcatctggtgacatcttctcctcacctttttctgcatctgaggtgagctgtagagactgcattgtcttgtagttcttctctaacaattcaaggacacgcttctgcttaaagatggcacccaatgtcttgttcttccggttgaaacaaagcctcacaagtccatcccactctttgaagctgacaggaggtaggggctttctgggctcgatacgaacaaccgatgaatcaaccttgggtggaggcctgaagttgttccgtccaaccttcaggagatgtgacacacgtgacaagagctgcacattcacagagagacggcagtagagactatctccaggctgtgctacaagtctcatggcaaattcacgttgaaacataatcaccgcacacctaaagattgggcggtgtgacagaagcttgaatgtgaggggagatgaaatttgatatgggatgtttgccacacagatatcaaagtatggaagatcacatttaaggacatctccttggataacctacagaatgattgaccaggaaatgacatcttgttaggaaattattttttgtattagtgaaattgcaaagaataggggaaacaaaaatgtagtgacaaatacagttaaatggactggatatgccccactgttgttttcttgctacatttgccttccaaaactgttaagcctaactgattatagtcattgctgcaatcaaatactgtcattaatgtatagccaccatagcctcaagtgtcaacaaagtccagtcttcatatcacaccaacactccctcatttatgatacaaactacttacactggaagataaataccgcaatgtactaaggcacatgcaaactccattgcactggaagagagagtattgtgctccatatatcatgtaaaataaaatgaccccaccgtaatacggcattcggcaaattccatcccaccccttctgtgattgttctttgtccattcatgttggatgaagtgcgtatacgcatatcactgttgaaaatttttatttgtggtgatgataacatgattttttttattggaaaatagcatcagtcattaaacagtggtatgtgatacaaaggctaacgtgctgagtttctgacaggtcaaagatgtcaccagtatcgggctaagaaacccacgtccatgggcagcgggaaaggggtaaacctcgcagtactgtagcatcagttaagagttagggacaagattttacatttagtcttactcagggattaagtcatacaatctatacaaggatgcgagtgtatctatttttcattaggctgagtttctgacaggtcaaagatgtcatcagtatcaggctaagaagccaacgcccatgggcaaattaaatacctggtgggaaaggggtgaacagtgccctcgtattactgtagcatcagttagagtcagggacaaagattacatttagtcttactcagggatcaagtcgtacaatctataaaaggatgggagtttatctattttcgttaggcagtgaatcagaattaatttaatccctccctcaatgttcttcacccccaacctaagtgcctttttggtcgcaagctgccatggccgcccaactatcctccggcagtgtttacccatcatggatttggaccatgacaggagatgcatcaacagaaacattgtgcatgttagcctcacatttgatttccaaggttcaagctttatcatcttactatggataattatttattaaaacatccaaaactaaaccatcctaaaaaagtaagatcactactttgatgattattactagctaaatggtcatgacttaagtcttaactacagatatcatgcgatcatgcatattttgatattgtccaaaacaaaatggttgttacttttccatcaaacttgtctttcatttttttcacagttacaaggagcatttgatagtgtttgcagactctactaacaaaatcagctcatacacttacatatatacatggcaatatggtcatcttgaaccttttggtatgaaattggaattattctatagtgaaataagagaagatcatatgaaagggaccgtttctatattgaagaatagaacggacattcataaaaatgcactgtagaacatgtgagttggcagattcacaaccaccaccagcactactctcttttaaaggagtaaatgtatcaatgtttgctgattattcttaggtattttgtttagttctattacctttcctcttaacaagaaatggtatgtctacacagggaatgtagccaggaggatggctgggaggcatccgctgctaaggatggcatttagactttgtggagaagaacattgggagggattagattaattcttcttcatttcttaatctaaatgacaatacagtacatccttatatagacggagggaaggacccagtttaatcctatacaactatccaacagactagaactgataaccggctgagctatggtactgtgtacgaggtgaggatagcgttctctcgaccggtcctgggttacccttgggctgacctgttggcccaatgccatgacagaatacagattgaaaaagggcactaccattgttggtctgtccaaacaataccattatataaacagtaaaagaaccaaacacttgcttagttctttaaatgtattgtacaaacacaacaacagtactgccactttgcagtgttggagcatagacaattccatcgtctagttgtacagttctacagtagatgcttgaccaaggtttctttgttttctattcatgttattcctttactcctttaaaagaaagtagtggtggtgctgattgtgaatttcccatcccaccgcctaatgactgacatttttatgatccccttcccccaaccacacgaaaaaacaacacccaaaaaaaatatgaaaagaaatcccttttacaccctcaaaactaaccctactgccagcacattcagtttattcttaaccaaattctttgccaatctagagatcttcaagattcccactgcaatcaattcaaccagatacacaccacaagagcctacattttttctgtcaaaatttcctaggctatgggaactttggccccaagttgtacatgagggggagctgctaacaatgtctatgggggcctgctttttgagacgactgtatactcagtcttggcacattatatttcctagaatcttgaaaagtatccatataaacagaacatcaatgaagcatgcaaaatacaggcagccccacaacacatgggacacacctactcttccagcacttaccaattcagatcattgaaaaggcatcctctcacactgaagcaaataccatgcagcattttaacaatccaaatcctaaaactctaacccgttaccaaaaacaagaaccaaatactgtaaggtacaatgcgtaaagaaactcagcagaggaaacttcactaatagatctacactctaagcacaaacattacaccactctgaattccccagcatcctcagaaattcaatctttttcaatctgaataatacaaacgagtgaattgtgcattgggccacgtacttttacccatgttgcagcttggactagggctcaatcttttcaatttggacaggtaactaaacaaaagtttcgaattggactagtttttttctccatctctcctctccctttcttccatgttgagatgaagatgcttctgttcaacaccatgaaatctctctaggttgcttgagttctatcctgatcctcatttgtattcaagcttggtcagcccctgtgtcgaccggccagaggtcgagtttgagcactgctctcaccctgagaaaggatctggaaactggaaggatgtagaaacaaaaaagcattattcttatacaggaagagtactatcctacgaagcaacggtgctcatccatgactccagcattacgaattggatgggaataagagcaaggtgacatatatacgacagctgtggttatgagaaatgctgcgactctagcatggatttgcatctagagagcctgctagcgaggagtaaattggaccttgctgaccgctcatgccttcggctctatgtagaaggaatcaccggtgactggtgcctttggctctatggagaagaaagaacgaagaggggcagatcaaccggaacagatcgatggacatggtccaaagtgaaaccatttgcataggacaagcagtccaatgtgaaaatattgtttccaccctggtccaagttgcaacattggtaaaagtaggtagcccaatgttgtaatttactctaaattacagtgcaacccaccaccgaatcccctgaatcgctgtcaccgaaccagactacaagcaaattcaagatgcctaagcatccgtattattattaacaggaagtagcactagtccttgcaaagttaacataatccaatcgttccatcaatcacacaaaactggagagaaaaaataaaatgaagagaggagaccatgagaattttaccttgaggcgtgaggcgagagggtcgccctggaagcggcggttgagctcaagaaccatgcgggggtcgagctcgacggcgacgacggccttgacgccggcctggaggaggcgcttggtgaggttacccgtgccggggccgatctcgaggacggtgtcggtgggcttgaggccggccttctcgacgatggagtccaccagcgccgggttccgcaggatgtgctgccccttggacttctcgaacgggatccctccctgcagccgcgcgcccccgcccccgccgccgccgccgccgcctgctcctccgccgtgccgcttcttctggatcttcccgcccgccatggtgatgggctcgcgcgtcccaacgccgccgccgccgccggaggaggaattgggagagggcggaggcggggagagagaagtggcggctagggtttgggaagaatggaagggaggggtcttagctttcgccttccttctggggctaacgagattacgccacgtgtagatgcacggatcttgaagcaactctcgtgtccgccccgacccagcactcagcactcccgggctcccggccggtatatggagggagtattaaatacagagtaatagattatttatttaattatagtaataaattaaatattttaaaaataaacttactaaatggacgtgactacacagctagtggtctaaactagctaccactctatctataagagacaccatctacatatacttcaaatacaattttctcttaaactattcattcaatctacgatccgattacaccgttatattcgtaacaattaaatctttacatcaaaatctcacatgattatattttgatgaaaaatcacaaattacttttatgatatgtctaaattacttttagatttcactaagttacttcttagacatacaaaagtaaattcagtaaagcctaaaagtaatttccatatatataagaagtactttataccaaaaataaagtaactttaattaatgtcttttttcattgaacagattatcataaatctccccaggagtatgtaccccatcttctctattggataatccattagcgtagttcaaaatgatttgtgctgaaaaataagtttttttttatttgtagcgtgcatgcccagtttttcggtggtttcaaattttagaatcatcaacgacactccaatcaacacgcagtacgtttttcccttagcgggatgcatatgctgtcttttacgtggaagtatgtactgttttttagttggcaacagtatatactgttttttaggaagcagtatatatactctttgcagtgatcagcagtacataccttttgttttgttgtagcagtatatacttttttttagtagtagtatatacttattttttgttagtagtagtatatacttatttttaggtagcagtggtatgaactgtttttttaggatatggtatatacttcatcccaggttggagtagtatatactgctttctttaagaatcctgtatatacgtagatctctgcttggatccggcatctttcacaaattatatgctgtgattttagaagcatgtactgatgtctttcagaaattgtatggtgtgattttagaagcatgtactgatttaattatttcagaaattgtatgctgtgatactacatacttattgcacagtagcatgatgtgttttagtagtacttatattccgcatacagatcagaactaagactgggaggagattttaaagaacaaaatagttgttttacaatacccgatttagaataaattgaatcatattatgttcacaatagaatttgcaatccaggcagtatatggattcacatgatacatttagccattctgaaaaagaaataaatgaatctacaatatacccaattctcgaactgcacaagctgctttggacagaattttaattaatactggcaaatcggcaattcatatactgtcgggcgttggccaccatcgatccttggtatatgtcacgcatctgtatggagcaaagttagttaggggcttcatatatatcattaggattaccagaggaataaaaattgaatagaaacatg

SEQ ID NO: 52142 - DNA, 1627 bp, Oryza sativa
ggggggggggggggggggggggggggggggggtgggggggggggggggggggcgggggggggggggggggggggggggggggggcgggggggggggggggaggggggggggggggggggggagggggggggggggggaggggggggggggggaggggggggaggggggggggggggggaggggggggggggggggggggggagggggggaggggggggggggggtggggggggggcggggcgcgggcggggggggaggcaggaggggcgggtgggagggggggggagggggggggggggggggggggagggggggggggggggggaggggtaggggggggggggggaggagaggggggggggggggtgggggaggggggggagaggggtgggggggggggggaggaatataatcatgtgtagatcttgggggtaaagggttgagtgtgaggaacataacggtgtaatcgaattatagatcggataagtaatttaagagaaaatttcataacaagaaaaaaaatatgcataacctaatagaaaaactacttgcatgcatgtatgtaacgctactagtacttctcacataattatccgcgtcgctcgttaaatctaaattgagatgcctctcgaaatagattttgcgttactaaatactctcttcgaattttaatacaggacattcttgacttctaggtatataagtttaaccattcatcgtattcaaaataataatttattttgttaatttaagcatgacttaatttgcatctttacagaaagaactgaataatattaagaaacttaggaaacgtatatatattctttaaaacgtgaaacaaataaattgtttcgataattcgatcaataaagtgaaaataacaagggccggagtagacgcttggcttctctgggcttcaaccatgtttggttgaagggactaaattttagtttatgttacatcggatgtttaaacactaattagaaatattaaacatagactaatggcaaaatccatttcataaccctgtactaattcgcaagacgaatctattgagcctaactaatctatgatagcctatgtgatgctacagtaaacatatgctaattatggattaattaggcttaaaaaatttatctcgcgaattagctctcatttatgcaattagttttattattaatatatgtttaatacttctaattagtgtctaaacatccgatgtaataaagactaacatttagtctctgatccaaacaccgccttatccaaacaccgccttagctttcatggcctatcacttaaccctttggtggaggacggtgagttttccgaatgctctcgtctgatagtgtctagtgacaaccgagtttcaatggattaagttataggtaaaatttaaattttaaacttaattttaaattaatctatgcgctttttcattcttttctattacattgcaaaaagcaaaagtataatagctttatctaaaattatttttcctcatttatttttctttacagcttatcacgtggaggcgtgtagctaatcaatatgcttgggtcatcctcaatatctggcgcgaggggcttaccaacgaactgaacctatgtcatcctattgttcgctg

SEQ ID NO: 52143 - DNA, 2495 bp, Oryza sativa
agaaatacaatttttgaattttaaacgcaacaaaaaacctcaaaaaaatattttgaattttactagccatcctatacatggttacacatcactacctataaattcacaatttttcacacaatataacttgtatgctacaagtgagattcgaactcaagacctcaacctccatatagagctcccttaccaactcacctactcaacacatattgactactaacccaatgttattattttgtctatgcttgtctgaatcatttaacatatatttaacaccctaaatgacttcaaatgaaaatattatcaactaaatagttatagatctcatcgtgttttataacttttacatagaaaatatcttcatccgatgttgtttgaagaattcaaaatttcatttttcaaaatatatctcactttataacatgtaaattttgtgaaatgaaaatattttcaattataatgtgtgtagatctgattgagttgtatgactttgatacggggcatgtatccatccatgtcatttgaaaaaaaaactcaaaattttgtttttaaaagtagatctgatcacttgtaatgcatgttcggggatgtaaacgatctctaatagaaatgttgttagttataaagttgtggatatcattgagagctacaacttttatataggacatgtttcaatccgaggttttttgcaaaatttaaaaatttgaattttcactcatcactgacgggtcataactaccacccgtcagagataacgttatctgtgacgtgtgttagttaaagacccgtcagagatgagtggtctcttttgtgatggttcataatactacacccgtcacagatgacttcacatctgtgacgggtcctccctggtagccatatattgaagaggatattttttcggcccgtcagagatgactcatctttgacgagttgcgttggcccgtcacagatgacccgtcactgaagcccggatctgtagtagtgcttaatcgtagattattttgtggtgtttacactttttaatcagtaaagataaggacatgcatataaaaggtttacctatatttttttattaagaaaaaaaatgtaaaaatttaaaaccataaataaaacgaaggcaacaatactgctctcactcccttcatctcaacaccataaacactagagattaaaaaccctagcattttccagtttcaccaaagatcatgaattgagaaaattctagttctttaccataagacaaacccatgtataatgtacgaagaaaaaaagacttaatgtgatagacacatataagagatttcaaaaaacacccattcaagaactcatcttttacaccggttagaaatccccattaatcccggttataacaaccctgacatctttagtaccggttgaaagtatactaagttaaaaaaatgtggaatgcaagattcaaaaaaaatgtggaatgcaggattcaaactcaagatctcctcagccctcatacgtgtcaccatcccaagtgcatccgacttgaatagagatgttgtcttttttaactaaccctagagacgtctttagtaccggttggtaataccaacggtaactaaaaatgtttctagggacttgaacttttagaaccagtaataaagatgtatttttagtactggttgttaacactaaccgggactaaaaatgtttttagtgacttagacttttagaaccagtactaaaacatctttagtaccggttcttaatctagccaaaatatttatgattttgggtaccacgacgaaacatttgcttatgagaagacattggcagagcactcatcttttataccggttggaaatcaccattaatcccgggtataacaaccatgacatctatataataccggctgaaagcataccaagtcaaaaaaaaaatatgtgaaatgtgggattcgaactcaagatctcttacctcatccctcaagcgcattatcatcccaccttctacatacgtttgacttgaacagagatactttctttttgaactagcccgggagacatctttagtactggttggtaataccaaccaggatttaaaaatatttctagggacttggaccggtactaaagatgtatttttaggactggttagtgttactaaaagtgtttctagggacttggatagtgtttctagggacttggattttcagaaccggtactaaagcatctttagtaccggttcttaatctagctaagatatttgtgatttaggtaccacgatgaaagatcggttctccagtagtgagagactgtcagaatctctactaatagaaagataatgcacgcattagatcttaaccaagaatgcacatactatgtcaagaaataaaatgatcaccagagaaccagaattgatagtactatagagttatataaaacataagcttgcattaaagttcctttgatttaattatcatataaaacttgtataagactgtaggaaattattttaatcgc

SEQ ID NO: 52144 - DNA, 6272 bp, Oryza sativa
caaatcttttttagggcagataagcaagcaaattctgacattccttttttccgtatttttatcttactgatctttactgaaattatctttgctcaactaaatactgtgttctaattcatatattaatgtctcaagaagtaatgaagataaagtttgcagtatgtggggtagcactgtagcaggacaatgtaaatgcattatgcattatcaacatttgatttttaatttcctgtgttactagaaaacttaaaagataacagctattggaaatctgccactttattatctgttatctagctataatgtctttaccgttctgtttgtgaaaacagtacaaatctattttcaccaagcaatctgtggcataagtaatttgttgttgtttcaggtttatcatggcaccattttgcccaagccacaagtgccagaagatttatgatgagttctctcgtgtctaaaaatgacaagatatctttccttatgttgctactacattagtctcataaacctaacaaggttgtgagatgtattactcctgaagaaatttattgatgcagcgtcagaaacagcatacagttgaaagtgacattttgttttcttatagtctgatcttcaataactgcagaataatatgagatcgcagatgaatctgatctttgatgtcttatcttaaccacagtagccaaaagatattctcttcttcaggaacctgttattttggcattctgaggtgataaggggtgataagagtttccctactagcaatgctgctggtttggtggtaatatctacacgagaagactgattatgaagtgagacaggttgatttgcatgcagttgtttctggtgttaacgcacataactgatggctgcaaagttttaccatctgttattcaagtgacatttatggaagtattgcgagccacagtgactccgtgatcaaaaaggtggggttgagtaccatggtttgcaattacggacctgttagaaactaagaaaattgtaattataagtagacacaaatgacgtgcttcaacttttgatattggttacaaatgtgacctgctcaaatttggggaaccattccatcctcccaatcatcaggtgagagaaattgattagtggagattgaacgtattcaagttttattactttctagtagctctctgactggctccctgtttgtgaggttatattaagttaagctactgcttttagtttttgttcgttcttcaccttaccactgcaatcttctgcttggtcagggttttatgctgaaagaactgaagaggtggtatttccagtgtgggggaggaacagttttgctagtagtgctttaagaaactggggatgatactgtagtatggccgtgcattttctggaagttcatcaatattttgaagaggtgatatattggagcactgcagtccgagaaatgatttttacggcctcggtcttttctcaggctttcagcctcccaggcaattgaatttattgaaccattagtcataaactaatactaacacacatagcacattcttaagaaatagatagaccttggtgttcgcatagactattgtattgcacagttttgtttccttaattattgattcattttccctaataagtgaaaaccgtattctttttcaccaatacaatgatgctaattcttttttttcccctgtgtaacatggattactgatcctccccaatacaatgatggctaatgcttatttcttttttacttccctctttgtaacatggattactgatcctactaaaactaacagtgacaaatagagtactattttcactgttttgttctctcttacatgatggctcatcatgtactctgcatcatcaggtagcataattttttacagataatatcattctcacatactgttctgctgatacgatatcattgatagcacttactacttcgcagtcacaactgtaacaatgtttatcttttccttgtacaaaagatccaaatgttgcaacaagtattttttgcaggtatctgcgcttgtctaggcgccccggggggggcccccgggggggaacccggttggggggacagacactttcttacggaacacgggaccggtgagcttgacgccgcgcctgaagctgagcaccatcccgaactggagctccggcggcgactccatccgcggcgaccggcggaacacgaagcggcggtagaggtgcgccatggccagcttcacctcctgcagcgcgaaccgccgccccgggcacgcgcgcgggcccagcccgaacggcacgtgcgcgtacgagtgccgccgccgctcctcctcgccgccggcgtcgaacctctccggccggaactcgccggcgtcccggaactgcgcctcgtcgcgcgacaggacccccggcgccagccacacccacgtcccctgatcagtttatatagtactagtgcggtttgggtttttcaagtttaacggtgaggttacagaggagatttataacgtgttggttaattgcctacctttgggagtgtgtagcctccgacctctacttgctccgacgtctccctcgcgatgagcggcgacaccgtgtagaacctcatcgcctcctttatcacctgcactttttgaagagaaattaggagaacaaatgtgtatttatgttggaaattgacaattcatcgtgaaacttgtaagttaatatcgctaatttatcactgaactttaaaaacaaaacaaatgtggggggtttatgatgaacactgagagttgcatcatgaaactagtaggttaaattagctactccctctgtttcatattataagtcgctttaacctttttaaaattattttaaatttcttgaaagtttgaccaaggttataaaaaatagaacatattttcatagtttctttattttgtgttgaaaatattattatatttttctatacattagttatatataaagaagtttgaaaaaaaaatagaaacgcacttataatatgtgactaagatagtaatcaacaaagtaatttagataatttaccgttaattagcgattaatacgacttataatataaaacaaatgtagtaattaagaaagtaattaaaagaatttacagttcgttagtgattaattacctggtcgaggtaggggaacttgtgctccaggtcgtctgccgtcgggaccgcgtcgggcgggccgaagcggtcgacctcgtcgagcagcttggcctcgacgcccgggtggccggcgacgaggtacacggcggaggagagcgtgaacgccgtggtggcggagccggcgaggaggtgctcgtaggtgagcgcgccgacgtagtccggcgtgagcagcgcccgcatcctgtcgctgccgccgtcgcgggcgttgagcacggcggacaggaagtcccgccgcgcccgcctcgcctcgccgccggcgcgctcccgcctcgccacgaccgcccccacgcgcgcccgcagccgctcgttggcgcgcgcggtccgccagtccgccgtcgccgggacgcggctcagcagccgccgcgcgggcccctgcagcgccggcgcgacgaggccgagcacgatggagagcgaccccgagaggtccatcttgagggaggtggtggagtggacgtgctccctgatgaactccgccgcctcgccgccgtcggcgtcggcgtcgtcggagcgcggtgctgccgccgcggcggccgtcaggccgaagtcgacgccgaacgccgcctggccgatgacgtcggtggcgagcttgagtgacaggtcggagaagtcgacgtcgcgttgctccgccgccgctatggcgtccgcggcgcgcgcgacgcagctgtgcatggtggggatgaggccggcgaggtgcgacggctggtacagcgagatgatcgtgttcctcatcgccgaccacctcgcgtccctgcaacgcaagcgttctcgcattacactatgatgacgcagtaatgttagaatttaattcttttttaaaaaaaatcgcacccatttcccatttggaacgcgcaaaattttcaagaatcactatgtaattgaaacgtttcctacaaaaattacacggaatccctgcgtctgaaacaaagcatatgctacaaaacactcacgcgtgcaaaattagtagtactgccatactatagtgttttgttgacatttttgcctttgaatggagatcttcgaagctccacacattgatttgcaccaattccaaaccatgatcaaacagtggatgatcactacttatctcttgaaacgctttgaattggaaaaagtgattatgaaatggatttgagctccatcggttggcctagtaagccaaagcaaaaaccaaaaattgaattttcgagcttgattttgaaattggttttatgatattttcaacgtaatttctttttagcgttgaattttaagtctatacgaataaatatataaaagtttcacctacagattaatttttaattttttttgttatgaccttgtgaagaagaggcccttctggtggagaggggagccggcgataggcgccggcaagctccggtttgcgatgctcttaaactgcctgatcccgacctccttgcacagctccgcctccgccacaatcaccagcggctgcctccccaaatgaaacctacaatccaatccattacaaaaaaaaaaaaaccatctccttcccaaacagatcaaatcaaagcaaataagcccagaaatttggaagccaattattagattctttttttttttgtccaatttttgttctgaatttgtgttacctgaagatgggcccgtatttcttggcgaggacggcgaacacgtcggggccatgggcggcgagcagcggcaggtggccgacgacggggagggcggccggccccggcacccgccggacgccccaccacggcgcgtagaagtagacgaccaccaccacgacgccggcgagccaggaccacggcagcagcagccatggctgatccctcgcagccgccgccgccgccgccactagagcctccattgatctgatctgagcttttgatcactcgtatgtgattcttgcaagatcactctccgatcgagtcacagccgattaattggttcttctttatatgagtgattgccactgcagattgcagttggccatccatagtgctgtgatgttgctgggaatttttttatgcaagagattgaattttagtgctgtgtcaaagaaatggggaacttggagatgatggattggacggccattgtcgcccacattctcctccaagtggggaagaacaatgccccggaattcttttcaataaacaagttgggaaggggggaaaaacactttgcaagaattttaaacaaggacggatagctgtggcatccaactgtacattcccccacgattttgtaaagggtatggtcgagttttttaagcccttcaaatttgctcaaaccaagcctttggattcaaggatttttggaggaaaagtagaggcattgaatccaagagaataattcctattagagatcatatttggtttgtaggattgcttcaaaggaatttcataggataggaaaaaaaatactccatattttggaggatttttagcatgatgtttaagctcatattttcaaattcctttgagagttccaatgcaacttgtgtatttttctctcccttcactctctaacaaaatcataatataatcttaattttcgtcggagctatgcaaacatcttttttgagcaattcccatgattttatttcttgtaggattcaacaagtactgataatctattcctaggagtacttctttttttctttcctgtgttttcaaaatcatgcgttccaaataagcccttctagtcgcgggatgaaattaggcaaaatccgtttggtaacatcgaaaaattgtccaaaagcttggttttaagttcagggctcggctgggccttgacaaacttacaaacagaaaattaggcccaatgggccttaacatccgaacttggaataagatcaccttgactccctcaactgaccaccgaatctaaatcgtatccctcaaccgcagtaccagaaatcttgactccccaaacttacaaaaccggtgcaatttgactccctgggtggttttaggaggcggttttgctgacgtggcgcctacgtggcaatattgaccgagtcttcgttccacgtggcgatgacgtggcacctacgtggcggtagaattaaaaaatacgcgtgggacccattagtcattcacacaaaaagaaatg

SEQ ID NO: 52145 - DNA, 1004 bp, Oryza sativa
cccccgtgcgctatcgtcgtcgccgccgccacgacgcctcagcgcatggccgcctcccccgcgagtccctctactgggccgcctcctcgtcgccatcgtcgtcgaccccccactccctccgcacctactgcctcctcgtccacctcctctcccgcaccgccggatgccgccgccgctcctctcgctgtccccgcacgccaccggccgaaggggaagaaggggagagaaagagagagaagggagagagggaggaggaagaaggactgacatgtgggccccacatgtcagtgggcccacatttctttttgtgtgaatgactaatgggtcccacgcatattttttatttctaccgccacgtaggtgccacgtggaacgaagactcggtcaatattgccacgtaggcgccacgtaggtgccatgtggaacgaagactcggtcaatattgccacgtaggcgccacgtcagcaaaaccgcctcccaaaaccgcccagggagtcaaattgcaccggttttgtaagtttggggagtcaagatttctggtattacggttgagggatacgatttagattcggtggtcagttgagggagtcaaagtgatcttattcctccgaacttaacagctcaagcttaattctgggccaaattcaccagccttgctctggtgcccggcagcccggcccaacaatggaatccgaccgatgattctggtcgctcgctgcttcgcttgctcgcgggcctcgcggccacatccatcaaaccacgggaaagatccggccgcgcgctccttttctagcgcacgttagaagcttccaaagaaaaaaaaatcccacgcctccaaacgcccaaaatgcatctcccctcgccttcctctagtaccttccagaatgttccgtttccctcctataaattacaaaatcccaccttcttctcccgccaaaagcacgccgatggactactcgacggtgaagcacgaggaggtggaggtggtggtgctggatggagag

SEQ ID NO: 52146 - DNA, 9825 bp, Oryza sativa
cgggctcgacgacgccgcgtgctgtgaactgcggcggcggcggcggcgagggggaggtggagaggctgaggagggacaaggaggcgctggcgagggagctggcgcggctgcggcggcagcagcaggaggcccgcgcgcagctgctcgacatggagcgccgggtgcggggcaccgagcggcggcaggagcagtgcacggagttcctcgcgcgggcgctcaggagccccgacgtcctcgacaacatcgcgcgccgccacgccgcggcggtcgaacgaaagaagcggcggatgctcgccgccgccgcggacgacgacggcctcaccttcgaggcgctggcgctggccgcggcggccgacaccagccatagcacgggcggcgcggtgaccacggacatgatatggtacgagctgctcggcgaggagcaggcggagatcgacatcgaggtggaccagcttgtcgcctccgcctccgccgccgccgacacggcatcggaggcggagccatgggaggagatgggagaggaggaggtgcaggagctggtgcagcagatcgattgcttggcctcgccgagttcttgatgcatggcttgcattaggtagtagtaagctagccatgagcttcctctatattgttgtgtggcgtgttagtattagtagctgctttgctggtatgtgattgttagtatttatgtttgggaatggcttggtttgatataattcggattctgcgtttgttcttgcaggatccagtgatggcttaattaggagtataatggaaggaatgcaggaagtggatggatgtggtagctaatctgcttcatggattgatgtataaggttatgtatcaacacttcaccagtggtaattcatactacatattattcatcttcattgatgtgctacaatgaatctcttggaatttaatacattgaatatcttggaattgagtacttgtttaaagataaatcattttttgtctgataagcttgttttttttcttctatagaggaatgcaatggatgattgattattcatctctaggaaacacctggtgataacgaacaatggcgctcatgcagccttttcataagacttgtctgtttcatcttcaaagggccacagcaggcacacagtccatttcactgaagatcgacagccaagaagttgtctctcatgaacaggatccaacatcagtatcgctcagatttgttattctactattcaatgttctagcttatttcatggaacagtttcttatcttgattcttgattacgacaggtttgctatcgatgagcaaaagtggtgctctcagcatgaggctgcactgtccagatacaaaagtcccagcacctattgccatccacttcactgataaagcacgacgcaaaactcaagcttccaagggaacagggacaaatgtgtttaagtcatcaactaaacaacatggttacaactgttgtctgacaaaagcttaactgtatttgttacaagagagagacatatggccactacttgtcagcactaatgttacaccttcaggagaaaggtacagaagctatcttggcattgttatcagtcgtcatcgtcgtcgtcatcgaactcgtcctcctcttcctcgctcagctcttccataggctcatcctcttcgttaactataaaaccactgagtgtttcatcttcctcatcatcttcgtccccctcatctttttcatccccactattcttatttttatctttagtctcagttttttccttgcgaggtttctttggttcttttgatcttgtaacatactttgatctcttcacactagaacctcttgataatgaatctttatcgtcctcactctcacctatccaatcttcgtcttcacgctgcccctcattcttcttgttagcgcctttaccctttaatttgccttcctcatcatcttcatcatcggagcccttccttacttcctccagaaaccaattccaatcctttgggggacgaattcttcctttaggatagttgtcaaattcgtggcccattgataagaacccgaattctgcagccaaacaattactgtatcattcaacagggtggaagtattttcgatattacgaaaaacgccaaacgaaattatttatatgtccttcgattttgcaggaatcatcacaacttaattcttcagataaaaaaaggagtagagtataaccgaaatcagtagcactctttggtattttctatgaaaccaaacaggtcttgacatatactagcaatttagcaatgtgacattcttggttttgtacatctacatgaacatacctagatatccccacaaaaaccaacaaccattttgtatcctttttccttttgaatttacccttttgtacttcgcatcaacaaacacgagttaaactacacattagaaaagcctcgaagatgatgcaatggaaaggaaactagtcactgcaatgtagcttgaagatgactactagtatctaatcaactcatttctacagcattgtcagaaacaaaatttaactcttgtttgggttttttttttcttttttctctgaagatgaagatgaacagaacaaaggtcaaagctcacctcgaaccgggtcgatgcttgatagatcgaaattcaaatcctccgcttcggcatcggaatccccactgcacgccgcctccgcctccgccttcgactccgccgccgccttctagttggcggtgacctccatggcctcctccgcggttcgcctttccttctccttccgttccttcgtgcgcctctcccgcctcgccacggggtccagaacctccgcctccacatccccatccccatccccgcccttgctccttgtcctccgcaccgcccagaccgacaacggcgacctcagcgacagcgcaagcccgtccccgtcgcggagctccccggcctcaccgcaccggaacaccctgctcccgccgccgccgccgcccaccgagcgcacgaccacggggttcctccccacgacctagaaggcgaccctgggctcctcctcctcatccccgccgccacctaggaggcggagggccacgtggcggcgcgagacggtgcggtcggaggcggcggcgccgcggccgagcaccgcctcgggggagtcgccggagagggacaccggtggcgcggtgctcctcctcccgccgccgcctgctgcttcgagttcgagctccatggatgctaagctggcgacggcgaggtcgcccgagaggagagggacgcgtctctcaggggttggcaaatggtataggtgtccaaacgggcggcacggcccggcccggcacgggcacgggtccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccacgggcctccagtgcacagtgttttttttaaaaaaaaaagcaaaggaaatgtataaggaaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattattttgaaataatttgaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggcatcgttaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgcactgtccgcgcctgacgggccgccggcgtgccgtgccgtgccgtgccgcgggccgtgccgtgccggcccgctacagtagccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccatttggccacctctagcaaatggcaagcggcggcagcgagtgctgtgctgtgcttatgtgggccgtgactacgtgaatttgggccgggccgattttagtattcgaggcccacagtctgtccattacgtttcacgcttatgggtttctcattttcttttttttttctcccaacctataatactaaatcgcttttgctattttgcagtcgcctgcaaaattttaatccatcagtcgatcgcatcgaccgtcgattatgtgtcttgattttgtgcgcgccatcatctttcccttgctaataagcccaaagtccgcagcccacagcccacagcctacagcccacagcccacaaatagctctggagaaatccgtccgcacccgtgactcatctagaaagcgcttctgcttctcgacttcccctctcgagtagatagcgtttgtgtttttctcgagcagggggagacggagtcctgcgagcggaaggtgccggagattcttccaaggcaggaggtggaaggggaggcgagcgggggaggtgggctgtgcaccgcgagcggccgcggacggcgccggggaaggcaccgcgagtgtgccgtcgaaggcgagcgcgcttgagttgaggcacttcaggttttttcatctctcttttttgttcaaatctcacgccgcgacggcctgatcccctcagctccagattttctatcatgtggattttgtgagttgtttagggctggattggctaccatttcaagggaggggggggggggttcccgcgtagtttttttttcattccttgatgctttggagtttactgggtatatgtttttgacttgattttgcccaatgtcgagtaaagcatcctggatctgaaaccacatgatgtgtgtgctttgaagttttgttcggtgtagttggggaaaatttttttagggtttttactgcacatcgcgtatgatatagtcggcaggaggtgggctgcacctctgcctggttctaaaccttgccactaattattttctccctaacttcattttctcactaattattttcttttgatgtaaatcatttccccatctgtgaagaataactggatatatatagcccataaatttgcgaataaacatgcttactattgggtcattctcattatggagtactcatcagtcagaccatccgagctggatttagaggaataacatgcttacttcagttttttgctcccaacttgaaacataatgtatagagaaataggttttgtcattttctttagaaatagttataagcagttctgtcattggagacagagatagttgtcaatagttaattttgtctgaactctagctgcaattttgtagcagtttgttttgtagctgcaaggtacagtttctcatattcagatatgtgtactttgttaaaacctgacatagcagaggtacaagattcagaggtcaatatatttgtgtgccaattcatattatttctgttaatctagttcatatgcaggggcaagattaaatgcctcatatcagtcaaatgtaagtacaattttgtttagttttttttctcaaatacctcgagtaatatcaactcctttcagctttcttttttgccaaatccacacgccagtgcctctcctgagactagaggaaaaattaattcagcacaacagattatattttttgtcatttaatacctgaacacccagtttcctgaaactagctgtgaacctaaacaagactatatatctgagtagtaaagttaacaccaagctatggctagaggaggtcaaatagatattagcttaaatcattttactgaatttttttttcttcatgaaacatatgacctctgccgtggcattttagagaggggtttagggatttgctagcaatttgagctcaacaactaaccaatattttcattaaatccctacaaatgctcttacctttttgtccctcagcattgtcagatccatttttgtgcatagagggtttgagttaatcagtccattttagtggtcactctatacagggagatttttttgtgcttgtatacagaaaaagctatcttttgtttttgtgtgctgtgtattttttttaacagtagttgtgctcaactgtgacatactaagccacttttgcttccattccatcagtgatcaatctgagataagcctccctgaaaatgaactccaggctctgctcctatcaattatgtttaatctttttgagattaccagcagagcattgagagaggagagtaatcttttttgaaattatgtttttttgagattatctatgctagttgcactccctgactattgtagtagccattttgatttttcgtgcaagtcgtgtaataagtttgtgcaactaatgttttttgagcaaatttttccgtttactttgataaatagcgtttgtgttttaggaaaacatgcatacaactggggacttttttttggtagacaacttgttttcttagtaattatgtccaacttttcatttgtttttgttttttgcaacccatactactttttatgttgtatctttttttttctcatcaacacacgacagcaagcgtgcctctctttttttcatgtactgtgtttttcccgcttgaaccatctacataccagcagcattgtccaaatagcaaaatcaactaatactatacatttcgcgcaagttatgttataaatatatgcattttcaattattaaattgtgcaactaattcttttttagctgactactatacgatttttttcctaattttggttataaacaagcataacttcagactgattgtatgctcagatgtagtagctcactacgatttttgttttcagggagcgttggattctaccgggggggggggggtggagcttgctgcagggcaagaagagtatatttccttctgctaagattttgatttgctggtgagcttggacatgtgggtggttgaataatgtcatatccatccagtttgatgaacta

SEQ ID NO: 52147 - DNA, 1221 bp, Oryza sativa
gagttttttcattcaactttgtagggttgtttattcatgtgttaccaacatatatgcgattatttttgagattttcttagtacttctgtaaaaaagttttcaattttacaattaagatgtggttttcaccgtatactagctaaatgtttatgcatcgctacatatagataaaaggagaatttcataatattgcctaaaataagcaataatatattttccatgaaatgtataagctaccaacctttttctgtagggaatacccaatttaatttaattttatattgcctattcacttagatttagttgttatgtaatattaaggagttcaaggggctaatatgtaaaatctataatgaaagtaggtgagatgtagaatccctgccattatcattagtcatatatactttcccacgtatatgcatgtgtcaaaaaataaaagatgtattctatgtttgccctgcacatgtagatgtattttatttatctatattttatctttattcagctgataggatggacaccactgatagaaatgaagaagattaatgctagcagaagggctgcgggagttcgtttggtcgggaagatggaaacataccaacctctttgttcagtcaaagacaggactgcccttgggtttgtgaatatatccaacacttttagattaaactatcaggaaattgcatattaatatttcagtatctatatatttaacaaagatacattctactccattgatctatttcattgggtcacttaatggactaaactatttttggctcatcttacccttaaatttttaaaaatggttcagtttattgcttaacagtattttttttcaagtcatgttctaagacgactcttttttaaacaatggatgacaccattatcaaagttaaaaaaatatcattttatatgattgcttacttgaacttaattttgttgtgtaaatcaatcttagttgtttcccatatgtaaataatgataaaatatttaaaaatgttgagagataagttgttatacatctatttaattctatcaattttagtgcagaaatatgacagataacaaaaagaaaaatatcacgatgagtaaactgaattgttttcaatagatcatgatataaagtgacctgtaaaatagaataaggggttaagtgctccagcaaaacatatagttcggaagagttaagtaagacttttttatcacctttaaccaaag

SEQ ID NO: 52148 - DNA, 3480 bp, Oryza sativa
  unsure (1)..(3480): unsure at all n locations
atgagtagcctatgtgatgctacagtaaacattctctaattatagattaattaggcttaaaaaatttgtctagcgaattaggtttcatttttgtaattagttttgtaagtagtctatatttaatactctaaattagtgtctaaatacatggactaaagttaagtccctggatccaaacaccacctaagtcagagaacagtagcacatcgatctgctgtccaccaagtatttctgaaatagctcagagattgtaacaaatacttttggcctctcatctatctcaaataaaaataaaaacttttaactaaaacttgtaggtctcatcaagagctgtaacatgcatataaaatttgtcttcatgcactactgcaagaacaaccataggtgtcaattgagaactggcaataggtgttggtttcccagtcagcaccaatttatcggcacctatgcaagagattatagatgccggttttagaactgacacatgtaaagattataggtgcatgttcttaactataataagcggcacctatgaggtacacgcgggacaaaaaagaaggctcgatttgagccgatgcatcgaggttctcctgttgccccaaatccaaatctcacatctcacaatcctcaaatcaccaaatcaaacaagaaggattcctgtacgaacaacaattaagataaaataaagaattgacgccgaaaaggacaccagagtcgttcctagccgctcagccgaccgccgccttgccttgctcttccctcccctgtcccttggctgcatgcactactgcactcgtactctatagatttctcgtttggcgacgagtggtaatgggcacggcggcggcaacagcaacagcagcaggtgaagacaatgacgaggccaaggagacgtactgcagaagtaggtaggaggaggcggatgcggtgggtgggagtggggcggcagggagcagttgaagaagatccatcggcccccaacctccacgtcggctagatctagtggcccacacctccacaccggcggccatagaggagaagtggaggggttttgtagtagcgatgtaacttcgtatgaaggagtgatgattttttttatgaaatagtattgctcccatttctatatgaaggttctcttaagaaactgcaattaaaaaacaaattttgtactccttttcttaagagaacaaccagcaagaatcgtttttcattggcacttttcttaaaaaacaatgattttcacaagtcctttcttatgaataacatctcaaagtagtgacagttattgaggggtgaaagggtaaaacaacaccttagaaatgtttatatttgtgtctatttgtaggaatgtatgcatttctaaacggatggggtagacaccatgtttgataaaccctgagctccactcgagacactcacggctatgattggcctgatctttcggtgaattgaagataactacgatttgggagaaatgttgacgacctgactacacccatacgagacgttgttgtgttgtgcctaaacgattaatacacctctccgtgggttgttgatcttgccggtgcagatcaaccttatccccacaagcaaatcaaagaaacgaccaagaccaagataaatcaatctaaatggcaaatataaattgaatacaaatgaaaagttggggttccgtaatgagcaaaccggtgatctaaccaatcacggattacacgacaaagtagcggagctaaactttaatctaaacaaaacccaagaaaccctgaagggacctatctatttaaggaggtgggaggacgaccaaggggtctttagggtcgtgctccgcctggttggggcgcaccccacatgagtcccacttgggcctggtcccagatgaagttacaagcccatagacccattcttggtgatgcaatacattgtttctgtgattgtggatgactgggatgaaatttggtgatgaggccagatctgttggaaagagaattccaagatgtttctatcaaatactcatagacccaaaatggagcacgtatgtacacttggcagccgtttaaaatcaacacggtagcaggtggctgaattagaatctaaaacttggtcaaatgatcttgatatgagcaacggttgtattaatagtttgcatggtcacatcaatgttatacgacaccttgttgaaataatatacaatttctctagaaaatatatatgtagtgtaaactacatatatagtagaaacagctgaaaacagccgttagatcgtaaaatagatgtatgagatttggaataaaagttttacttttgatgtcgtcgacaaatctcatatatccatttttttatctaacggtactttctaagtctcctctgtatgtgatttgcacggtacattttcactagctgctcgggctagtacagtgcatctttaagtaccatataagaaatttgtatgcgtggacttcggatgtttgttgtacattcagaccctttttttctatatttgctctgcagtatgatagaagatgctgaaaagaggggctcgatttcacccggagatacactaatcgaggcaacaagtggtaaccttgggattggtttggccgctgttgctattcagaaaggttacaaatttattgctgtaatccctaatagctatccacctgataagcagaagttaataaagtatttgggcgccgaagtaagaataactggtaagtgttaaatacgtacatatacatgcttgcagtatgacgatcactacggctggttggtacctttctgcctgtgccttagctacatcaaaacttttctagatcatattattatcttttactagataaatacatgggctttgttatggatagatatgaattatacatgacctagcattatttggaacaattgattgtaaggtttttagaacaattcatccctatagatgtctttgcatgatgaactgtattttaaagatgaaataatgttgaaccaatatatatgactatttgtaatataaaaggagtagttagtaaaacaaattaaatagagtttgtgaagatggtagattaaccaccaccaccattacattctttttagaataatatagatatagataatggtggtgtgatcctttcgaggttgctccatttcttaaaaacaacaacaacaactacctctagccacaaataaatgatattttagagagtaatttagtcaccaagacattgttttaattgttaattactagtataaaatctataaaaaatatagcaaagtcataatattttagaactactaaagacaaatntaatcaatgcaacaggacctgcttaggaggtctttacctatcacaggtatttacacctaattaatcccatgtttataaagattttggggagtttaaaaagcatggcacgtaaatgttgacattggatcaacaagggtgtttacaaatctctataaatatgttagtttaaacctagccat

SEQ ID NO: 52149 - DNA, 3340 bp, Oryza sativa
  unsure (1)..(3340): unsure at all n locations
taatattttgtaattagaaatctgatctatataaacattaaattgttcacttatttaagcatcccaccttgtatgactacatcaaatacagtccacacacacctcaacaaacaatataagattcaagcaagtaaaacaagtagaaaaacaacataagattctaaagcaaacacctcaacaaacatacagttatcaactgtaggactcttgcaacaacttaatcaagttgatgttcaaatcggcagaatctgtgggattgatgggtacagtaccatcatcaccacctctcctcgcggatcgtttgttgtaagcagacactgatactactacaaaatggcaaaacaccaatccttagtgtctaacggttttataagtcaatttttgagatttagctttgaagccataatccattatcagtggcttgcactaatctcttatgattcatgaacaaggatagttggagattaatgaggatgtgaatggtcaaatatatatatataatacacatcccatactagacaatatagttggccatgtgggccgcccggcacggcacggcccaggcccggccgtgcctgggccgaggcttgtcgggccgacacggcccgaccgacgcaccgggccgtgccgtgccagcccacgtgccgcactcacggcccaggcacggcccaacacgcctcgggccgtgccgggccggcccgaaggcacgatgggccgtcgtgcttttcctcacaataagtctaaatttcctccctcctattgggctgtgacatatgtacagctacaaaaagtctattttacctccctcttctttgggctggggtatataaatagctaaaataagtctatttaaggtccctattctttagacagttacatttatatgtctatttttagtccccatactttatgtaccgggcctggcctgccggcccatcgtgccgggccggcccgaccatgccgggccagcccagcgtgccggtggggaggcccaggcacggcccgacggtcgggccgggccagcacgggcccgacccaagtcgggccgtgccgtgcttgggccgggccaaaaaggcgtgccgtgggccgggccttcgggcctcgggccttatggccaactatactagacaagaaagatcggtctctcagatcgatggtatagctacgtagtcttgcgcaaagatctagacatgaccatttaaagcacctaacaaatagcttgatcttaatgacgaatcattacccattgattttaccctctattctcaccaagtttaatagtagagttaactatgagcttatagctcatattaaagttaacatgtataatagataagctataagtttatcaatatctttttcttttctctctgtctctcacctatgcatttaatgtttcatcttgaagtatgtgaatagcttgctcttgcatgagagcttttaaattctttctcctccacataaccttatagttggcttatagtgtattaaacttgctctaaggttgtatcaattaaccgataagatagctcttacaaacatttggatattttctttgtaggagtacgaaaagcttaaaacatttcttacatataccagctaaagttgagcatgtttttggttgcattgatcgtatggacttctcttttcaattttatgcagaaggtccatataggaatatggagaaaaaggtggaggaacttaaaaaaagtataaaaaattcttataatcttgatcagatggtcaatgaagcaaacgtagaggcacattataagtggacaggtattcccttcgaaaacctactccttttattcacagtacgttgtagttgtggttttttgcttagtttttctaattaattgtgtattgtaaggcttagtcccatttctcctaaaataagacaccttcttcttataaaaaatacgtcggcaacgactggcctaaaaaaatttatgattggattataaaaatattacaacacanattcgatagtaataagatatatatataccaccaacaacaaaacaccggcaaactgatggttatatctctcttttggaaacaggacctgaaatttggaaagatacagcaggcaaagtggatatttttgtgacgtctgtcggttcagggggcacattagcaggagtaggaaagtacctaaaggagaaaaaccaatctataaggatagtcgccgtggaacctgcggaaagccccgtactgtcaggtaattctatgtacgcatagataacatatttttttctctcccctttctagtaatatataaataaatggcatttaccctaatacaaaatcaccacaactaagtagcagtttaatttggctctgtttaggtggcaaagccagcaagcacaggatcagggcataggggtgggttttgaaacagaaattttgaaggcacataaacctattattacctatgaagtgaagacaatatatagtgaggatgccataacaaaagcgaggatgctggccagggaggaggggttgcttgttggtatttctgctggcgcaaatatagctgtttgcttggaggtaaatgctcccgatcaactctgttctttttcacttgtcttttattatgtcggcatggtctccaatatgtgaagttacttctctatatgtgtgaagttacttctcttttntttactatatggtctccaatgtgtgaagtacttctctacatgttcattgaagtaaatgctcccgatcaactctgttcctttttacttctcttttattacatataccagctaaagtttgcaccaacgatgatgtttcttatttcccctaatgaaggatgctcccaatcaacgttacactcctaattttacttaccaatacataccttatattatttgtaataatatgatcaacactcccctgttctaaattatttgtcgttttagttttgtactaaatcatgtgttccaaagtttagcaattagtttctaaaaattcatatagttgaacaacatgtgagctatatactagtatgaaagtatttcttatggtaagttcaaaaatatgaatattatgatgataaactatataaattctagaaaataaaagtcaaagttagaaatatttgacttcatacaaagctaagacaataaataacttgaaacagatatggagtaaataaaactgttcatgtggaccatgcgtccatgcctatctatgtactacttgtggatcgatcttatgaatattcgtggatgacacagcttgcggcgaaagaggagaacaaggggaagatgatcgtcaccatgctcccaagcggcgccgacagatacctaagctccgatctcttcaagtactg

SEQ ID NO: 52150 - DNA, 1140 bp, Oryza sativa
tatagctagtagtttggccgtactatcactagataaaactataatattctcaaggagaaaatttctaacgaagcaacattaattcctctcgtcaactatacgttaccgtttctctcaccatctttgtcgctgcatcatgcatcgatcaactattctgtgctgaattaattaaccaaggtgacagaagcactgctcttctagctactactactactatatatactgcattgggctagctagggttcttgccatcagagtacagcctataattagctaatactagctacaagatgcattccactacgataacatccactagaacgtactactacaggttccaaccaaatgatcaaagtccgggtcgatttgcactgcagtgctatgctacgacgacgcccacgatacgatcatgtactaacatgccctacgctattatggggagatctcaagcattcccgttttcgtcattcacattaggtagagctcctgcccttgttttgagcaagcgatcaaaaggtaaagatgggcgagttatggcaacagatcaggaagaagatggggcaacagaggaagaagatgcaaggaaaggcatcccgtttctgctttcgtcccaagaagagaacatcgcctcagacatcctgcaggttgatctatatatagccccttctaggccctccccgctcgtattccatttaattaggcctttttctctaagaaatactcctagattttaggtgtgtttagttcacgctaaaattagaagtttgattgaaattaaaacgatgtgatggaaaagttggaagtttgtgtgtatatataggaaagttttgatgtgatggaaaaaataaaagtttgaagaaaaagttgggaactaaaccaggcctttaaaagaatttcacgtgaattgaactgattcctaaatatatcctacaaaattcttgcgcttcaaacaagcctttttttggggtgccttaggccctgtatagatgggactaaaacttttaaatccctatcacatcggatgtctggacactaattataaatattaaacgtagattattaaggtggtgtttggatccagggacttaactttagtccctgtatttagacattatttagagtattaaatatagactattt

SEQ ID NO: 52151 - DNA, 3389 bp, Oryza sativa
taattatagattaattaggcttaaaaaatttgtctcgcgaattagctttcatttatgtaattagttttgtaagtagtttatatttaacactctaaattagtgtctaaatacagggactaaagttaagtccctgatccaaacaccaccttagtactgtcagtattgcttgtggcgtacgtctctgctgggggaaaatcgttaataggaaatggaagttgaggggtggtaaaggttgttgtctattgtttgggtagtgagcgtgaaattatgttttagcagggattaggaattaataaagtttaatatatagtagcaaactcacctttttaatacatgggtagatacaaataaatggaaggaaattctcctgctaagaataacgaactccttataattcttatctctactaataccaagcaagggatgtggagaaaaataaaactccctcacaaccaatccctaccaaactcctaatccacttctcgtgccaaacaagctaaccgttggacaaatgtcctagctagtaaggccagtcacaatgggtgtttcatttgagtgtcatgcgcatttaatacagtgacaagtcagcaaaagagcaatatttgcatgaaatgggtaggagagagagtaaactcgtttcaccatggtgacacgagatagcgccgtttcccaggtcgctgaaacggggtgaaacagcattgagagttcatcgtttcacctccgggatcccgtgcgagcgctgctcttcgccatcttcgcgcgcatcgccggattcttcccgcgcgagtcccccatcttcccgcgcagcacctccatgttcccgcccccaaagcactggctcgaagctttttccccaatctcacctgcaaccctagcgccagactcagtccccatcgccccgtccgtcccataccctagcgcaagaaccacgagcggagattgcggagctggatccacaagtaggtggtgaatcctgtccatctgccgccgtccgccgtccagcagccatggatccacaaggaggtggtggatcccgtctgagcgccgccggcagaggagggaataagcgtgggggcaagcagctgggcctgaagaggtcgtcggcgcctgctccatcaccggcaacagctcagccaccgctgcctgcaagttcccctcctgaagctccatcgccggcaacagttcagccgcctactccatcgtcaagtcctgctgttgctgcccccagttcatcccctgctgtaccgatgtcaaccatgcccccatggccaccgcaaggagcaggatggggctctgtaccccccaattttgcttttctgcaaggaaaccaacaaggcccaagttcatggtattttctccttgtcacagattattcactgtacactatgatacatgatatgactctcttcttcatgcattagtaattagttcctgtttatgctcaatgaaatttgttagaatcagtatgtcagtacattggtaatttgatatatgcctgagtaatgaatagaaaaaatgtagtattcagtatggattgcagtaatactttgttagtgaaaattcagtattcagtatgcagtatggattgcggcttgtataacagaaattgaaagcaaaagattcagtttgcaatctggacagtgtactgtacaacatgtaattcacatacgtaaagcttgttaaatatctccttgtcagtacattggtaacaaatgctttgagtgtaaatgccaagggtatcatcctaacattggtatatatttttagccttctgtatggaatgcagacatggtcttctttgcaaccacagcaacagcttgccctacactctgtgctgtcgtcatagctaaccaaataacctgttagtactgatatatatggtcttctttgcaaccacagcaacagcttgccctacatggtcttctgtatgcttgactaaacttgttacttgacatatatgcttgactgaacttgttgcttgactgaattattccttacacatactgtagtacttgcttgactgaactatgtcaggatcttattaaaaaaaatctatgtcagcactgctactatgtcaggatcatcagtatgatgcttaagtaacctgttagtatgtcagtacttactatgtcaggatcatcttctggaacttactatgtttgattttcttatgctgccatcggtttcaattggatttgcttcttatgttttcaggttgtatcctacagaaggcttcgtaaattttctccaacagaactgtctgccgcagccacaagaaggtgaaaattttcaccttgttggtcagactaccaacacaatgtctactccaccaccaacaccccaagctgcagctaacaatacagtccaaattgatattcatgaagatgcaatcaatgatgcaagtgctaaaaagagaagtttgagatattggactcatgatgaggaagagagattggctagtgcttggttgaatgcttctaaagatcccattcatgggaatgaaaagaaaggtgatacgttttggaaagaggttactgatgagttcaacagaaaagggaatgggaagcgtacaagggaaataaatcaattgaaggttcattggtcacgcctcaaatcatcgattggagaattcaatgattactggactaaggtaactcaaatgaatacaagcggatatgacgatgacatgctggagaaggaggcacaacagatgtatgcaaatacatttggaaagccttttgcacttgtgcattggtggaagatactgagaaaagagcccaagtggtgtgcaatgattgagaaggacaaaaacaaggctgaagtggttgatattccagatgaacaaaagcgtcccattggtagagaagcagcacaagccgagcgcaatggaaaacgcaagaaggacagtatgtcagaaggaattgtcatcctaggggacaatattgaaaaaattatcaaagtgacgcaagatcggaagctggagcgtgagaaggtcactgaagcacagattcacatttcaaacgtaaatttgaaggcagcagaacagcaaaaagaagcaaagatgtttgaggtatacaattccctgctcactcaagatacaagtaacatgtctgaagaacagaaggctcgccgagacaaggcattacaaaagctggaggaaaagttatttgctgactaaggttagatatctaatctaatctgagctgcactattatttataataattaaagaatgctgcaatatttagttatattgtctgtatatctgtgctgcactatgcagtcagctgcatatcacgaatttgtcaaatctgagctgcatatctgtgaatggtgcaatatttagttatattaattacccagtgtgaatgatgtattgctgtcagtttc

SEQ ID NO: 52152 - DNA, 2118 bp, Oryza sativa
tgtgtgtgtctgcgttcgtgtgagcgagcgagcggagctaatgaatgttgtttgtttcttgttatatcaagaggtggggctcttttgcaggtccggccgtcgtggaaagcggaattccaactctcttcttcctttcagccttatttcatcgggaaatttaaatatttgtcactgttaggtttgccaattatccaaatatccctcttacatttgcccttattttttcccctctaaagtggtggctttttaactatttgccacgtttgcccatgtagcatgccaacgtggcaacccggtataaagatcaacgtgggacccacttgttagtctcataactcccctttcctctcttcatccggtgtggccaaccctaccaacagccaaagcgccgccccacctaggtcgcacccccacgattaactccaccccttctcgtctcttcctttggtggtaactgccatcactgccgacgacgacgacgacgccgacaccaaattcccaaaccctagcttcaccctcggccttgccgccgcaagccgccatggcggagaccatcgacgacaaggtcatctacttccaggcggtcaccggcatctccgaccacagcctctgcaccgagatcctcgctgcccacgactgggacctccagctcgtcgtctcctccatcaccgccaacccctcctcccttgacccggcccccatcgccgagggaggcggatttggtcacgccacacccgtctccgcctccgccttcgcagcagcagcccaggattgcgtggaaactgatgacgcttccattctatgtggtctctggtggggttgggctcatcgtcagttcgatctgtctcgttgcctgggttgccgaagccatagctggggaagcacggcgacgccaagcgcatcttcttctctagcgacagcaccattggaggagtgggcagcactcggctataagcggggttggccgcacggaggaacaaaggaaggggggcctgtgagactcacaggtgggtcccacattgatttttacactggggtgccacattggcatgccgcatgaataaaagtggcacacagttaagccaccatcttagaggggcaaaaaaaaataaaggcaaatctaagaggggcaaatagttaaatttccctatttcaaccatcagtgttcgtgtcttgtactgattgttgggttgaaaatatttattgattaattttatgtctcaagataatttaatttatacatataatcaagctataatatgtggcaataatccactcaatgttctaaatcatacgggttactaagcaagggctaattagactgctactagttattttggttaagatattgttgtttctatgtgattcgataatgtgtgttacctttttttcaattcattcataaagctaaaaaatagttaaaacaaaagaaaaaagaatattttagcatggtcttatttttaattagaaagcttcccccctgagcggttgaaagagaagagtgaagtggagaggccagatacaacggtagctaggtgtaattgaggcacaatgagaagattggcaaagccacagccatagctggtacaagaagcagatgaaaggtggtgatggccagccaagaaacactgaagagggttaaatgacatttctttaaagtgtgggtcggatttaggtggaaggcatcgggaggaaagtggtgcaaggacgtgttgtgatcagagaagaccccattagagacaagctagcaaaggaggaggcccggatgtgctcccttcgttttatattttaagttgctttgattttttttatattcttttttgttttacagggtttataaaaaggatagcaatatttcctatacaaaacaaacatattatcaaaatatgttcaatgttatatttaataaaattaatttggtgttatagatgctgctaaatttctctaaagacttagtcaaacctaaagaaattagggtaaaaaaaaaaggcaaagcaacttataatataattcagagggagtattcaagttagttcagtcttttggggtgtacaattcaggatttggaatccatttagagtaggtttaatagttagctataagggaactataaatata

SEQ ID NO: 52153 - DNA, 2306 bp, Oryza sativa
agtagttcatcacaaatataatataaaaatatattcaatagtggatttaatgaaactaatttggtgttgtagatgtgtgctacattttttctacaaacttggtcaaaactgaagtgagacttatgacaaacccaaaatgtcttgtgataaggaacggagagaatagtgtgctaacacaatagcctttaacatgaaaggtagctgaaaattgatcttacttgattccccattttttatcaagctcatgtttcattgcttttgtaacacagaaggcaccatcagccatccgtccaaaatgcttctcgaacctagaacggaaagaacacaccactgtattaacacaagcgatcagtatgctatatctagcagataaacaaacaggacaaggaattaccagaagtagattttaactatgatatggcttctgccatgagacaacccgagcagtgtatatccaaagttatgccaatccacaatagacttagcacctcttagcccgctagccagttttacagcagccaatgttggaacagagggtggattctgtcagacagaagatgagatgatcaaataaaagaaatcagttccattccaattgtacgacacgatcagtcacgtatgaggttttctaattaacaaataaattataagtatcatacagaaggatctataggttatataaatctatcagttaatacggcctacaaaacgatgagactttgactaagtacaggctgcacatatcttagctgaaatgttgaattgaaaatggtgtcatgcagcatgacttgctaactaagctgggaaatactttgctaacaccatggttttactacaatgattgatgaatgatgaatcataaaagaattccacactactgaaagtgatagtgattgtagaaaaatacatattgtccatgtaattctgaaccatgcatgcaaaactgcaaataaagaagctcaatgcaattttgtgataactgacctgaacaatgaagacatcagggcgaggaatcttgaaacaaaggtaccaaatcaatatgataaactggatggcggctttaagtagcattgacagggcaccagatatctttgatattcctgttaactgcactgatttctagaaggtacaatttgtaagtactgatagtaggcaaaattagagaacagccaacagcataatgctttcgcacaatcagtaccatttcgtggatgtgaatcaatggattttctctcaataatagatgtgggtcacttcctgctcatttacccaaagcagaacataggtcaaatttcaacaacagaaggtcgaaagctgttggaaattcagcctgtctgtgtgccctatgtggtatagttaggtataaataacttcgagttacaatgctggagtaaaatccaaaagtacaatggaactttgaaaagagcaatacctccatttgcaacaatgtccacttccataccaccctgtcaagaaaaataaagaacgactaataaactaaaacatagacatatgctggcacatagagttggctgtttcacaacataaagcatgttccaatttcccaatttttttgccacttgaaggaaaaatgcttagtaaatgcaaggcaattttcttctattcacttcaaagtctgtcttatctaacaggattaatatttgcacgtgcaatcacactttcagggataaaaaagcacatttttaagggagcaaaaaactgacggcattaatcaaagcgaaactatgtcagctcacactttcaggggggcaaatgaccaccactacgttagttcatcggtgcactggcacaactgagacgtaccacatctccttcctttccttgttattaccatgctatataacctaggaccaaaggcttctctagagtagagtatagatggccaaaaggcccgaggcccgacggcccggcccatggcacgatattttggcctggcccaagcacggcacggcccgacggaggtcgggcccgtgccggcccagcccgaccactgggccgtgcctgggcccctccaccggcacgttggcccggcacggcacggccgggccggcccggcacgatgggccggcagctaggcccgatacacaaaaaaaaataggggagtaaaaatagacattatatgccatgaacgaaagaatagggatctaaaatagactttttttatctatacatatgtcagccaaagaggagggacagaaaatagacttattttagctatacatatgtcagcccaaagagaagggacggaaaatagactattttagctatacatatgaaatagccca

SEQ ID NO: 52154 - DNA, 1614 bp, Oryza sativa
aatttgtttgcaaatttcgcacaaatacaacagtgatcttttttctctaaaaattgtcaacagcacaagaacgtacagatgaaatatatcttagcaatcttatactcacaaattaatttgtaattttgcctactttttcaacgcagctggagattcatttgtttgtaccaaccaataccttgcaggggtttgggggttttggcagaatcttgtcacgcccggaaattcacaagtaatttccaaacttatttgtgcataaaatcctcgtccaggaatcagccgaggtacacaaactgacaatttaatatacagattcatcaaagaaactaaaacgataaatacttacttatgaggcacttagtcctcatcatgaagaaaactgcagcggaaaataaaatctagcgaagctccggctccactcccacaggcagctcaactggggtataagccaaacgtcttctccttctggggtataagctcaactgggccgactgggccggggagggagagagaaagagaggttttgggccggctttcggcccaaagccaaaagaaggatttaaaaacatttttcaatttaaattatttcttaaatgcaattctatttattaaaaatacttccttagctcaaataaatcccagaaaaatctaggaattatagaattaagcaaagtatttaataaaattttatctagcccaattttatattgagatttaacaaattaaaattagatcttctcttttaggcttttaaaatcatttctaataattccttttaaacaacaatttataatttaaggatttttaaacaagaaaagctcttaacaattataattgatcaaataattactgaactgttctttgtatcatttaggaattgagctctgaaaaatccgagaaaatttcagagagttgacttaatcatggagaatttaataaaaattaaatccatccatgctttagatttaagaaattttatttcccacatttcacttcacttgtaattaaagaacatttcatataaactctattattgatttattagaaaatttttaaatcctgaaacgcaaatcaggatgtgacaaatcggttctgaatattcgcagcttacaagtacccaaggggactagtcccaaccaaacctttctatagcgagcaatcacgaactctcttccttgagaagcctgctttcccaaccagatgaatgtgttcagctagcaacatgatgcgggctatggccgaccaccatgcagaataatttcacatatatcatgcgttagcacaatcggttaggaacatacatgaatttcactgtctaaagtcaagtcaggttgttaggttgttcttgcattgatatggaagagcaaaatcgagtggaagaggggcgaatttgtagggtttgggggaaataccgtaccaaataagcccttcaaaaatctagaaccataaacatacatatctatcatacatgctaacatgcagtatcaatcttggtattcaggtagggctagttcttggtgaatcaaagacaaggaaatcaaatcaagggtacattatatattatatgacttgcacctattgttggttgttgctaggatgaagtacataagtttt

SEQ ID NO: 52155 - DNA, 7442 bp, Oryza sativa
  unsure (1)..(7442): unsure at all n locations
tacacaaactgacaatttaatatacagattcatcaaagtaactaaaacgataaatacttacttatgaggcacttagtcctcatcatgaagaaaactgcagcggaaaataaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcacaaggataccaaaggatggcataatattggctcatttgcaaaagcagcatttagcaaaacatttaagagaagtaaaacagttgagntaaaattttanaattccaanggaaaaaattttttttttttaaaaaaatttttcccaaaaaaaaaaccccaaaactgaacagcacacccatgctgcccaggcccaaccattctgaacaaccatacccggctgaacagatctaactccaaaccgggaagctaaccaaatattaccagttattaccatcaatacttattgtgagaggtgtgggactaatcacgaaaaacattgctcaactcgcccataaccgcgggcacggctattcgaatagttttactccggccagaggtgtaccactgtacccacaagacacagtctcaacatcatgtctaccatgcgtcgtgatactggaaagtacccgaatagaggctgtgacaataccctctgcataacacaactcaccacagtgcaccattcctggatcataatcacccccttataaaacaaggcatggactccccagcgacccccgtgggcttatctccgccacttctcagtctggtgctccgcaatgaaccatgttatacaaaaggtaaagccgttgcccacgctggcttgtggttggcacggttaatgtttcacaataatagctcgcgaaccggtccttaattgtcatgagcacgactctcaaaaccatgtgctcacaacccaccattatcaagttttagttggcaggtaattaattaaccaatcacgattgaccatcgtgaactatcattaagccatcattaaataatgagtcataagttatcccaatagtgtactaatgtttctaagcatggctaagcaatcatatctaatatctagctgaaccaatatataaagctcaactagtcaagttataataacccaaggtatcaagaaataaagtaatcaatgcaaacaggccataacaaaagaataggttaattccacccaatgacattcgaaaataaatgcacagttgaaataaatagagaatttaaatataggatcaacatgctcaaaggaattgtgtttgggatctgtgtgacttgccttgcaataatcggtcttcaattaatcttcttgaatacttccggcgcactcgcgaaccttcgcaacgacggaaacgacaagctaacacgcaaaacgaagaaaaagactaataaaaaccaaataaacaatacataaaaagtaaacaaacatgtatattataattttagatgaattatgagacttgaacggcctcattctgatttcatatgaatttattatgaattttacaagattaaatctatttaaagcccatttaaaaagaattaaataaatttaattcaatttatggacaattttattatgtagatctttattttatacaacttttgcaacttgaaccacattaaactgagttaagatgaattagttatgaatttttaaagattaaatcggattaaaacacttatatggattttaattgaattatgacgcaataatgaattatttttgaaaaggaaaagaaggattattgcgtcagcggctagggtttgcggtggaccgggtgcacggcggcggctcacggaaacgaacggccgagatcaaccctatccaaaacggacggccgagatcgatcgggtccacggcggctcacgggagagggcgacgatgacgtcagcgatgacggcagcgatgacgtcagcaccggcggcgactcgggcggctcgggcgcgcatgctcgccggcgaacgacggcgcggcgacgcgaacggagggcaccaacgggtagagggcgacgcggcgaactcaccggtgaccaaaggaacggcggaagggcaacggacggcgccggcgacgaggaagaagcggcggcaaccttcgggtcgacggcggcaacggcgctccggcggtcttcggcggtggcgaaacggtagacggggacggcgacgaccttgcgaacccgacggcggtcttcccgagcgacggcgacgactggagcaacggcgaaggacgactggagcgacggcggcgacggcggcacgaagcggcacggcgctagggcgctacggacgacgagaggcgaaggcgaaggtggcgacgggtagaggagagctcggggtgcttatataggggcaaggaggcggcggcggaggcccacggcgaccggcgacggcgaaggaaaactagggttcggaggagagaagaatccgattcgatctcgattccatcgagtttccaaaccgaattaggcgatgattccaaaagagaaaaggaagaggagatctcaaggatcatttgccctcaaacgattcggccggagaaggaaagacgcggccgaatttggaaggagacggcggcggcttgcgttagggtttcgggcggcggcggcggcgcgaggaggacgacgggtctgacaggtgggccccacctgtcagcgacagagagagagaggagagcagcggctcggcggactgggccgactgggccggggagggagagagaaagagaggttttgggccggctttcggcccaaagccaaaagaaggatttaaaaacatttttcaatttaaattatttcttaaatgcaattctatttattaaaaatacttccttagctcaaataaatcccagaaaaatttaggaattatagaattaagcaaagtatttaataaaattttatctagcccaattttatattgagatttaacaaattaaaattagatcttctcttttaggcttttaaaatcatttctaataattccttttaaacaacaatttataatttaaggatttttaaacaagaaaagctcttaacaattataattgatcaaataattactgaactgttctttgtatcatttaggaattgagctctgaaaaatccgagaaaatttcagagagttgacttaatcatggagaatttaataaaaattaaatccatccatgctttagatttaagaaattttatttcccacattttacttcacttgtaaattaaagaacatttaatataaattctattattaatttattaaataatttttaaatcctgaaacgcaaatcaggatgtgacaaatcggtactgtatattcgcagcttaacaagtacccaaggggactagtcccaaccaaacctttctatagcgagcaatcacgaactctcttccttgagaagcctgctttcccaaccagatgaatgtgttcagctagcaacatgatgcgggctatggccgaccaccatgcagaataatttcacatatatcatgcgttagcacaatcggttaggaacatacatgaatttcactgtctaaagtcaagtcaggttgttaggttgttcttgcattgatatggaagagcaaaatcgagtggaagaggggcgaatttgtagggtttgggggaaataccgtaccaaataagcccttcaaaaatctagaaccataaacatacatatctatcatacatgctaacatgcagtatcaatcttggtattcaggtagggctagttcttggtgaatcaaagacaaggaaatcaaatcaagggtacattatatattatatgacttgcacctattgttggttgttgctaggatgaagtacataagttttaaacatcatactaatataatttgttggataaagatagaggaggccacgttaattggtgactgctgtcaaaaggaactgaccatatattgtctcattgggccatagtatcaatgcattaacattttcttcctaatcttttgaccggataggtacaattatgcagatcaaaatgcttgtggaaaaatcaatttgtgacttctgttctgtcctattcacatacttctccttattggtaagaaaaggttcaacattttattacttgaggtttgtagtatttattacttaattaacagctagctcaaatcaagtttatcaacgattaacatactattcagttccaaccatcctatgtgaacaaccatgaaatgtttaggaacagatgaaaacttctcaaggggagctccaaccaatcattttttagggatatctccaatcaatcataatcatagatgtataaccagatgagatatacaataaggagcaaaagacactaaatctgtgagaagcttaccatgctgtgcatctatggtattttttttaaccatcatactaatctaatttgttggataaagatagaagaggccacattaactggtgactgcttaaatagctagctacatcaaactcgacaaacagcaccatcagttctaatcaagacagaacagcaccataacgacatattaatcatgacactgatatggttcaaacctaagccagattaatcaagacactgcatcaaactcgacaaacagcatcatcataatcccaaaaaggcttattccaacgagaaccatcggtcctctagaccctgattaaatagctagctacatcaaaattgcgcaccatgttcaaggccttgttcttgacggtggatgaggaggagcccttgcagttggagacagggacagaccaagaacccaaggaacaagaaccaaaccctaggtaggacagggagaagagaggggaaggaagagagactcaccggtgagaaggtggccagcggaggggacggtcgccggaggggagaacgccgccaccgccgccgcactcgcctcatgcgccgtctcgtgcactttgaggcccagaatgagggggaaaggccggggtaggcctggatccaatccttgccgggcttaaccgaacgcaatttttttggtgggccggggtttaatccaagccgggctgatccaccggtattgggccgcaacccagcccgaccccacccaaaacgaacaaggcccattgtaaacgggctgggattctatccaggcctaagcacgtggacagaccggaattgaggccaattcaggaaagaataagttcatctgaggtcccttaagtttacaccgaatccgattttcatccttgaaccccaaaaccagatgcaaccggtctctaaactgtcaaaaccggtgcaaacgaaatccctcggcggtttggaacaatcaatagtagtaaaataagcattcatatgaataattagacggcaagtgaattaaacataccagttatctccattcatcacacgacaaacaagttcgtcgtgccttaacatcattgataacccgatgtctgactggcggtaccgaaacactctaaatctaaataacaaaaaataacactcaaaattggataactacaaatctaaaaggtaatctttagtcactaattagtcaattaaaatctaaaaagctaaactttacgaaaaacatgacctcactgttctagttataatcctgaaactactttaacaaagtatagaaaataaatacatttagagcatttacagaaaattatctaaaactttgatgttgagtaaaaactctaagtcggtatctattggttgtggatttaaaaagaagaaacgttgtgccagtttgaacctggttagcagcactatcctaaaccgcttatctgatttatatgaaactagagccgttctataaagatagcgacgatactgcaaacgtcgcttcgatcatgacacctaatttatattagattaataccaaaattctaattaatggtgtgtttagttcataccaaaattgaaagtttggttgaaattggaacagagtgttcgaaaagttgaaagtttgcgtgtgtaggaaagttttgatgtgatggaaaagttggaagttcgaagaaaaagtttaactatatcctattgatcggagaatggtaatccaacagactaaaattatttaaccgccacgatttcaaattaacggacaccaattgctgtatttcgcatagctcaaagaactctatgtatctactgtctcagatcgtttgtccataggatggttcaaaaattgaattttcacgccacccgtttaaccggttctgattaaatcttagggcatcacaatccattacgaattgggaatagccaactccggagaataaaaaaagaacgataattagaaactacatggatttctctgcaaatacatcatgcggcatagccccttttttagaaaaaaaaataaagaagaagaaatatccagtgtggattttggatatctggatatcctctttggcacggtttcgaatccaaaatctatctggatattcctaactccacaactccatggatttagatctatgattattttgataacatttgaataaatcattttgttcccaatttagataaaattttaaattttaaaccagtataatttcacatacaaactttaaatctaacatactttcgatattcggagctgtgccaagcagtaccttaatttgatttagcattagctctagcttggaattttttactctaaaaaaacccacgcaaattttgaatttgaccccagaaaccacccacaggctacagtacaatggcaattcaaaatactccaattaattaagtaaaatagtttaggaacaaaaccgcttgaaaccctacttatactccccttccatggtttggttctctccgccttgtcactgccgaaggtggtcaaacgatgctactatccctcctccctgagtaaataatttcatcatccagctttatattcagtgggaatccaacttgtaaaaatctaaagaagttttaaaggttctagttaattttctagaatgtgaagaacaactggattgatttagagagcttttaattttcggagaagccgcggcagttagaaactccttcaaacattcccttaatttgatttggcatttaactcaagcggtaagcctgtaacatttcccctgtacggaatttttactctactaaaaaaatctcaggtaaaatttgaatttcaccaaaattgacgaaattccaccaaaaatccaaaaccacctacaggctatactggaagtctgcaaattttaacactccaataaagtagtaaaacagtttgggaacccacaaaacccctcaaaaccctaccactacactcccccccttccatccatggcctgattccctccgcctcgccgccgccggaggcggtcaaacgatgctactacccctccccccgcgccgacgtctcctcctcctcatctacc

SEQ ID NO: 52156 - DNA, 2081 bp, Oryza sativa
gctgccgccccaatctcccaccgcatccgcctcatccgctccctccagtccgtccccgccgaccgcctcctctcccacccgctcccctccaccgcccacgcctgcctcgccgcccacctcctcgcccgcgaccgcctctacgcccactcccgccgcgtcctctcccgcctcgtcgccctccgccggccccacctcgccgcctccctcgtcgacctcctccaccgcgccgcgctcgcgctgggcccccgccgcagcgcgctcgcctccgtggtcgacacgctcctctccgtcctcgccgacagggggctcctcgacgacgccgtccgcgccgtcgcccgcgtccgggagctccgggtgccgcccaacacccgcacctgcaaccacatcctcctccgcctcgcccgcgaccgcagcggccgcctcgtccggcggctcttcgagcagctgcccgcgcccaacgtgttcacgttcaacatcgtgatcgatttcctctgcaaggaaggggagctcgcggaggcgaggtcgctgttctcgaggatgaaggagatgggctgcttgccagatgttgtaacattcaattctttgattgatgggtatgggaaatgcggggagctggatgaggtggagcagctggtggaagagatgaggaggtcggggtgtaaagccgatgttgtgacatacaacgcgttgatcaattgcttttgcaaattcgggaggatggagacggcgtacggttactttgctgcgatgaagagggagggggtgatggcaaatgtagtgacttttagcacctttgtcgatgcgttctgcaaggagggtttggtgcgagaggcgatgaagctgtttgcgcagatgagggtgaggggtatggcgcttaatgagttcacgtatacgtgtttgattgatgggacatgcaaggcagggaggcttgacgatgctattgtgttgctcgatgaaatggtgcgccaaggggtgcccttgaatgtggtaacatacactgtgttggttgatggcctatgcaaagaaaggaaggttgcggaagcagaggatgttttgaggatgatggagaaggctggtgtcagagccaacgaattgctttacactacactaattcatgggcacttcatgaataagaacagtgagaaagcacttggtttgctaagtgagatgaagaataaaggattggaacttgatatttcactctatggtgccctcattcaggggctttgtaatgtgcacaaattggatgaggctaagagtttgttaactaaaatggacgagtctggtctggaacccaattatatcatatatacaactatgatggatgcttgttttaaatctggaaaggtgccagaagccattgccatgctgcagaagattctagattctgggttccagcctaatgtaataacctattgtgcattgattgatggattgtgtaaagcaggatcgatcgatgaggcaatctcccatttcaacaaaatgagggacttaggactagatcctaatgtacaggcttacactgctttggttgatggtttatgcaagaatggttgtttgaacgaggctgtgcagttgtttaatgaaatggttcacaaaggtatgtctctggacaaagttgtgtacacagctcttctcgatgggtacctaaaacagggaaacctccatgatgcctttgccctcaaggctaagatgattgatagcggtttgcagcttgatctcttttgctacacttgttttatatcgggtttctgtaatctaaacatgatgccagaagctagagaagttttttcagagatgattggacatggtattgctcctgatagggcagtttacaactgtctgataagcaaataccagaaattagggaacttggaggaggcaataagtcttcaggatgaaatggaaagagttttaccctcttgtacagacagtgataccgcaactgatggtaaaacctgagctcatgtagtgttaccatctcaggagttggaactgtataggcatcagtaccactatgctgaaatttttttgatgcagcatagaaacatatgccactgattcagtacacttctcctgat

SEQ ID NO: 52157 - DNA, 4127 bp, Oryza sativa
ctggggcaaccaatgtgtgttctcttatactaccatgatgtcatgaacaggcaacaagcccaaacaaatagatagccctgctgagaacatgtaccataaaacagatcatcagaagcaaattaactcgccgcaaggtaacaagcatcatcgctccgtttcaccatcgcctgttgatcatcttgccaagcttaactcgccacaatgcagagtgtacattactactggtgtcccagtgttgtagctgaacatcataagcacacagttctcctgacatgtgtggactctgtatacttttcattctgcatgtcagcaatgctgtttagatataatgtcgagctagatgtaaatgaatgtaccaccctgaaaatacaacttgcgttggaagttcgaatgagcggaaggctcacctagagagagaatatgggtacatgtatagaacaaacagcaaaacctggtatttaacctgttataatgtcagatgcccagccataattgtgtattaacgttgctggaaagaagaataaagcaacatcgttctgttctgatctcaagcatttgttttgtgtttgggtgattcacatgatatttgtctttttgttatttctgaactaagttgagtttgaacttgagatttggtgagaacgtatttcatatggatatctatctctagtattttttttcatgaatttacaaaaacttttaggtatgatttttacgagtttttaacacttagctcgttttcactggataatggcttgagttacatttacacatgaatgtactaccatgtttaatacaatttgcgttggaattcagttcgagacagaatgggtacagatatagaaccgacagctaaacctggtatttaaccgattatggtgtcagatgccataattgtgtgctaacgtttctggaaagaataataaagcatctctcacttctgatctgaagcaatgttgttgtatattctgatcacttttatgcaacgatgtataattctctgatacttcgaaacaccatttgtgtgattataaacttgtcactgaggcagtcttcctcttcttttgtattgttttgcctggtggtatactcttaatttgcctcatgaaataaaaaagaagaaaacatgacttggattttcatggactcaaggttgggacgaaaacaaggcaaccagttcgttaaacgcaaggagggagcatcttaaaatcctggagaaagatgctaaagaaacatcatattcaaatccagaggcttaatttactacgtactgataatttgctcacatttctgtaccctctcactttcagaccaggtaggcggcatacaatgaacttgcaacagaactgaacgtacagcatttggagactaattacaccgtgagaaaaacacttattgtagcatgatcacactcacattgccatcctaccttacaacagattactgcagccgagctgcatatggaggagatcaggagaagaaaacacaaacacttatctgaatctttttcttcataaacttattttaatctcttgacaactctgatgataagtgatatctgaataataatctgatgagtagtgatcagtgatcaccaccaattcatcatcatcatcatcagcagcagcagcaggcagcagcatgagcttattaccaccagccgtccaccacgcgggtgcacttgcccttgatccaccgcatgctgctctggagcgacaccttcaccttcccctccacgccgtacacccggtagccggccaccctccgccgccgctgcatctccgccgcgtcgccgagcccgccccacaccctccccttcgacgccgacgtcgacgccgacgccgacgacgatggccaggtggccgccgccttcttcttcttgatcttgctcgccttgccgctgccggcatcgtcgtaccagagaggaggaggaggaggagcagagtacgtcgaggtgacgtagtaggcgctgtggcacctcaagtcgccggcgccggcgccggccaccgtggcggcgctcctgctcttctcggtgtaggaggctgacctctccattggtgaaatgcaaatatgcaatggtggtgtggtagctgagagtttgtttgttgcaggaactaaccaggccaactggccaagaatgcatggatgaactgaatggagggctttgctcttaaatttgtagagggagactgcttttttttttctttttcatttttgtgaattaatgggaaacagtggaggtttagaataaggtaattttaccgtcctttagatggtatcagaaaataccacattttctagcgtaaattttggtacctttagatactaaggatcttgaggtaaaaaaaaaattagtgtcaaatttagatacctcgatactttttcaagaaccgtaaaatttctcttagaggaaatgtggttttgctttggccattgggtactgacttttgaacatacaagatatagcttgtcctaattttgtactacagcatttataagatattggcatgtttgttgagtgggaaatttatgataaactgttcaaaaatttagggaaaatgcaccccacctctccagaagggcatgcggttgtttcttcctcccatcacagatgcttgttgatttggacatacattttcggttaatttttcaaacttggagtattattttttaaaatttttattttggattcatggagataatattcacagatttgtcgtaaaagtactaaaatgggtagtttttctacctttaaaaattttacaaaaaaataaattattgaacaaagtaatattttgagattatatgtccaagactagaatagaagtattaatgtatacaacaagtaggaaaagccatctcattaccaacccatacatggcttgtttggtttataaccaaacttgaccaagtaaaagaaaaaggccaaaatataagtatttatagtaaaatgttggaatggccaattaattgccccggcccgaatagccccaaatgaaggcatagctattttttgtttataacttttgacaatagccagttctcttcattgcccattttttttggcaaggttaaaaatggaaatgaactaaacaaacccaatctggtcagtccctgcacggctgtttcaagtccgctactctgttgcctacatcttgggctagtaacaaccgtgccttaattcctggcttgaccggtaatgctacaagcctaaacaaatctactacagatatgttaatccccccatcccaaaatataaagaaattaaagagatgtgatacattctaatattactaatctttaatgttaggacgtttcacggtcctccaaaatctcttatattttgggacaaatgaagtatatcttatactaaatttactattaaatttgtagtattaaaatatatcatattttatactcacttcgtattttaatgtatgacgccgttgactttttaattaatgtttgaccattcgtcttattaaaagattttatgcaaatatacaaatatttatgtcatgcttaaaaaatatttgatgataaattaagtcacaataaaataaatgttaattacatatttttttaaataagatgaataatcaaacgttgataaaaaaataacgtcatacattaaaatatgatatggaggtgatattatatttgtttattttagaatagaggaagacaagctgagaaagagcaagcaaatatgctgcatgttgaagcatccgatcatttaagatactcctacttttcgtggtcgcatgaatgcctgctttttagggacgaaagcaactttgcgttttggtctttcctctcgacagtgacactggcgcgaaaatgttgggtatgcatactcgaaggactgtcggcaccgtcgcaccgatcaaaatcccgtcaggaaacttcgattattgtactaggtcttgtcttgtactcccaccaacttctaaatataaaatgttctaggttatttaagcaaacattaggattatgaacgatggattaaattttgaattgattaggtaccctgtatatcttattggctgaaaatacatgagtttgtgtgcaacatcgatttatgtgtgatggattcgctacgctagaaatacttatgttgtataaat

SEQ ID NO: 52158 - DNA, 3647 bp, Oryza sativa
taatcatgttttatcatccaacaacaatgaaaatacgaattataaaaaaatttcatataagacggacaggcaaagttggacacgggaaacccatggtttgcctttttttaggacggagggagtacgcatgaatcttaacgtactcttaactattaaaaaaagtgactaaggctgtgtttagatcctggggtgaaaagatttggcgtgtcacatcggatatacggacacacatttgaagtattaaacatagactaataacaaaacaaattacagattgaatttattaagcctaattaatccgtcattagcaatatttactgtagcactacattgtcaaatcatggagcaattaggcttgaaagatttgtctcgcaatttacaagcaatttgtgtaattagttatttttttcgtttatatttaatactccatacatgtgtccaaacattcaatgtgatagggtgaaaaatttcaccaggggatctaaacagaccctaaaatttaagggtttttagttgcttgaaaactagacagcccaggtaacaacatgatgtttggtttgtcgaaccaggttgtgatgggccatcggtccagcctcgttccggatgaggtgaggtgatccactagttttgctcaaacgatgcaatcactatagctaggaaggatgactcgaagacggttaatacgagatgtcaggatgcaaacacaagtcagcaccagagacgaggcatcccatacaaatcatgagattgtatgatcaagcaatttactcttaacgagtggtttctaaatacaaaccaactcgataggattaaaataagagtgtaagtgggtcaacccacgaacccatttatagattaaatacgacaggttttagagaaatgggaaccaaggtccctatcacctgctgcatgaggtgcccatggacacattatcacgatactgtaactcatgtcgctatcaaccaaattcaagggactattgagatacatctaaagaggaacgctccaagagctccaggcgcaacctcttgtgggttgtgctcggggtgcatctgccataagcccccaaagcacagcccctcatgggttgtgcttggagtacaccttcaatttgcccctgagtacggccccccgcgggttgtactcggggcacatctacagccggcagccaagtacgacccctcatgggatgtgctcggggtacatctgcctccgcgctcgaccgccgagtgcctagaggagcatatatgcatggaccctacgaagcctcgcattgaatgcgaggcggtgtataccaacccggcgtgcgactgggataacacgtgataacacaacacgcgccaaccctgtgaaaagcctttatcacccctatgcggaaaggtgtgggctgtcaggtggcacggttgactgccataccacgtgtcgggcccacagtcatccagcactctcttccagccactggcgtggcctgacgaccaggctcactcgtcaagaagcaacaagaccaaacacatctaacccctgtcctggggcccatttgtaagaaacaggtcattgtatatccccttgcaactagaggtggaccaaggccactgaaaaaggggttgaactcctgagtagagccgatcttagaacatcttcatcatctccacaacgtccacactccacaccagagaaatcagctccctagaattagaacaaaggtataccaacatcttggaaacattccaacaaagaactcaaccaagaatataggagtagggtattacacctacgtgcgatccaaacttatttaaagttttaaaaccatcgcctctctagtttgtcgtcctcgtttcatccgcccgacaccatcgcctcatttccgcacacctattccctggccgagtctctaaagagggtgtgagtcctccctgctagaggagctcaggctccaacagtaggttatccacttatttaatttatgagtggggttcaccggttatcccacttacacctctagttaatagccattataagcccgaagacatggagcacgtcgccgttgcggtcatcggcagcagtgtggcagccaagcatgaccttggagttccagtagccgggccgccggggcaggggacccttgacctcccatgatcgtccttggcatgcatctggggactggaggtgggtccaacactcgccgacctttcggtgtcggtgttggttgtcaggaattccctccgctctcacatagtgaatcacaaaccaactgaaggttttttttttttttcagaatgggtacaggaaactggagaaaggttcagagagcagaggaaacagagttcggttctgcgtacagcttgttcaacaatttcgtttttcaccattatttatcccatccacaatctggagtctgttgcatgtaaacactagatctgcacattacgtcaatcatacaacgggaatcaagatgaggcactaaaactggaaaaaaaaaaacgctaacttaaacttgagcactaccgctagagtccgcctgaaccggtcatctctgaacatgcagcctatcaaacagaagactaacgccatgtttctttcagcttgggattattataatccagattattgggagtaaactgaaagaaacagacaacttattgaagtagcttattataatctggagcccagcttattataatctgataagctcatttaggtgagcttttttcagattattgggtgaaaaattacccaccatgccaccccactctctctttagacatgcaaacccaataatctaggctctaataatataggaaagaaacagctacccgcttattctagtacagattataacaatctagcttatagtaatctgactcaataatctagattataataatcccaagctgaaagaaacagggcctaaccaaaacatcaaaaataaaatttgcgcacaagattactgaagataagctatcaaattcaccccttgatcttggtgcgcctgaacctatatcagcccttcttcctcatctcctgagagcaggtacaatagcatgttataagtcagctacaaacatattttaaggagataaataaggagagagaagagcagcggctacagatttatagtcagctgtagcacggactccaagacgcagtatatgtatgacaggtgggaccaggtattaataatgtattatgtaactattgtatgaataagctattagatttatgaattggagctagtagttggctatactattaaacttgctcagaaaacgaactttgcccaatggctttgtcagaatgtcagtaagctcgtcctctgaacagatgtgctcaacacactccccgatgaaatggtagcgagtatttttgtgttctacatctatcatgaagcactgaattcttacaaagatcttacagagtagttataaattttcagaacatcacaactaggatcttcaggcatcagctctcccacagcaacctactgagccaaattccttgataagctgcagtgatggcagcaatgtattagcctcacatgaaaataatgccaccaccttctgtttctgttctccaacatgaacaaaacacctgccgtgctcttactgtcgcttgcatctccagccatattacagtcactgaaaccccag

SEQ ID NO: 52159 - DNA, 1616 bp, Oryza sativa
tattacccgttcaaaatttcgtaaggttgaaaaatgacaataaaataaccatacacttggttgtttctaaatcccctgctcacattacatacatgcattgatgtgatccaacagggatgtgattatgggtctttgcgcgtaatagtggttgtgtcttacttctccgttccacaatacttgtctttatagcattaaaaaattgttttaaaatagttgtcactttgaagtactacttgtcacatcaatcactttcaattcaaatctctccattctatccccagccaccattccacatccaattatactttattaattaagaggtattatggtctttttttttcaaatctcagtatatgctaaacaatttagaatgacatgtattttatgacagaggtagtatatattaagatagagagagagtatatatcccaaatgaaattttctttttaaacctttctttcttaagaaaagctttatcctaggactcgcttcatcccaaaacatattaacctactacatcagttcaaaagtataacatcttttaacattcaggatttgtcccaaaatataataacttctctaccaatattttattaccaaccaatcaaaactcttcacccatttacttttgctatctacatccacttctcaaccaatgacaacctctcactatttaattctacatactttcttaataaccgtgtctaactctaaaactacttatattctgggacggagacaatagtattgaatgatacatattaggttgtgtttagttccacatcaaaattagaagtttgaagaaattggaacgatgtgacggaaaaattagaagtttaaagaaaaaaagttggaatctaaacagggccttactatgaatctagatatgaggccaatccaaaattgtacaaatatgtctcattcgattctgggttgctatattctgagatggagctagtggtatatactacctccattctaacatacagcaacttagaatggatcttatactcagggtatcaaatctcattatgtttaacatatagtcgtggcatatgtttaattctatcttaagttactgctctctcaattttaaaatataaggattttggttgaatgagacacttatattttggaacgaagggagtatatggccctgttcgagaacccaacagattgttgataaagttttggatttttatggcacgcttttcaaactgctaaatgatacgtttcgtgcgacaaattttctatatgaaagctgctctaaaataccagattaatcaattttaaagtttgtaataattaaaactcaatcaatcataagttattatcacatcgttcatctccatcttttatcttccgtagattcaaacagaacctacgttagaagtaagatataagaaaactaaaataattggagctactaataaatcctgtcgtagcctttggccgtgtggctcgattgagccagacagcgcgaccgcccacgggaacgggacggcctggtcgggtcgccccggccgcctctccctccctccgatctcgcaaagccccggtgagtgacgacggcgcaaggaaggagggaggacgcctggcgcccctcccgggcccac

SEQ ID NO: 52160 - DNA, 3751 bp, Oryza sativa
ggcgaacccgacgacgccctccgcctgcgggcccgcgccgccgccgccgccggtgacgctcccgctccgcagcagcagcaggagcagaggcatcaggagcagcagcagcagctgctctggtaccgcgcgtcggcgcccgcccaccgccgcgtcagggagagccccctcagctccgacgccatcttccgccaggtaaagcacacgattcctcctcctctccttccccccgctgatctccatcgatcgatgcggcggcgttcgtggaagctccaccaaaaataaaagagttggaattactgtgccctctgctagttcatcaacccatgatttttgttctactaataagaaaaaataataattagttttcaaattgttattagccgtttccttgtcggttagcatctcgcctgccgcctgccgtgctcagatgtgaagttcagcctgccgcggtgctcccgaatcgtggctagattttcgattcacgtctgtgtgtgcttgggacgggcacaatttgtttcgtggtgatatatgctgctgcggattcgggttgccatcgttgctcgttttggggatcatggggggaaccagcggccgggcgccggacgcatgcgttgcacaatttcgcggtggccggcagtgcagagacgacagcgatgtccgaggataaactgttgctgttagcatttacgagtagcagggtttggcctttggcgtgtcagagtgaaacagtgaatgaccaaacaatgaatgggtcacttggcacgcaaggcttgtacacattaaaagacttggtactcgggttggttgtacagactacagactatgagttattgttgggaatgttacttcagatacagagcttccattgaaggccagcaaaatcttgaatttatgcgatgttggacatgtggctcccctgttcagagtggtccatataactgtgtgtagtgtggccttgtggccttgtcttctccagttcggggcatgccttgcttgtgcatgaggtccatataactgtgtgtgttgtcggctgctgttttttagttggatagcccctttccaccaggcattaaggcatgctacttggcaccgatatgattctttacatttgctactctaggatgtcagtgtgctgcaatgttggcacagtattggggcaacattatttaatgaaatttccttgtaagattggtggtgggaactgggaaatgatctgagccgaacactaggtccatacccgttgatctggttttacgcaaaactttgtatgcatgcttgcataaatctgaagatttgagttttaagactggcattccttttaatttagatatattcttgcaaatcaaatcatttttttcttttacctgacaaaacaacattacataacttaacccatgataaaacatttattaggatattagtaaattggatgtcaacttttattactctttcttatagctgacagctaatcttttttgttttttgttttttttgtagagccatgcaggccttctgaacctatgcattgttgtgctggttgctgtgaacagcagacttattattgagaatttaatgaaggttcattatcatttcttgctctctttattttccccagggagtagtagcatttacttattatatgcttttctcgacatgcctcttgtctattatagttctgatttaactcattctcattatctgtatttgccgctgcagtatggcctactaattagagctggattttggtttagtggaacatcgctggcagattggcctcttctcatgtgctggtagatatctactgacctaattctaatttgagatttgataaacagttgtacacctcctaaaacaatagatctgcaaattacagtctcactttaccaactttcccgcttgctgcacttatggttgagaagttggctcaaagaaaacttattagtaaacatgtaagtttgttttactttgttagtagttctttatatttttattgtcttttcattcaaggctccttcactattgatgtatcgtgtatgtaagttcatgccaaaagaattgcctgttgatttactgtttcaagtgccagtagacagttcatgattttggtacacctcttgcaggtggttattcttctccatatcgttattacaacatctgtccttgtctatccagttgttgtgattctaaagtaagcatatttcttttgactttgcagtttgtttgaatgcatctacttttgacattcgttgatctcttatatttgatggtatgggatacactcattttttgtcgtattcagagatatgctgtatttatgtggtatgagtgcaaaattaattcaggtttttcagtttcaaactttttaagagtaattttcactaatgtatatttgttacttaaaagatgactcatgcaactcttatctttggttatgtttgatgttatacgatatatctagtccacaaaatgttagttttcagtttgagtaaaacaatcagagtcatatggataatttgattccgtcttggaatcttaaagcccatttctttttaatagtcatcaactattaaataaaagtaaatcttattagttccaaattcttagaactaacctgagagatatcagcgcagtcctaccaccctgaagttgcatgtatgtggcaatgttgtgcaaatcgcatttcataatcttagattcagattaagtcatccttatttgtcaaacagaggcagttgagggcagaagtaacaagtacatgtcgcctttttgttgattgtaaagagattagatagttcttatatacttatctattttggcttcatgcattgatataccaagaaatgttgtttatgaagatattgttcttgcataaatctggattcttagttcatttacatttcaatctttcaggtgtgattcggcagtattatctggatttgtgttgatgtttcttgcaagcattatttggttgaagcttgtttcttttgctcatacaaattatgatataagaatgctgtccaaaagtattgaaaaggtaaagcataggtatatgcttgtatgtttcatttttcatggtttctgttcaaatcgttgattccgaacatagagaataatgcaaagcaatttccaaagcagtgtagattttacggatgtcagcaatggactgctagccagtagacttttgttgtattccttctacaaagactagttcaagctgtacttcctgtttaaacttgtttctagcgttcatccctgacaatatttgaattgcttgtgtagtgcaaattttatagcttagagctcttcactcacttctatcattgtggctatgattatttaataataccatattttattcttatacaatagggcgtgacacatgacatttctatagatccggagaacattaaatggccaacctttaaaaggctatcctacttcatgttggccccaacactttgttaccaggtactgttctttgccttagacctttggttcttactttctaaattctaactttgcatgatccattctttttgtcacatatatttacatttaactaaaaataaacttttccttatttcattcttgttcactatgcagccaagttatccccgaactacatatattagaaaaggttgggtggtccgacaactgataaaatgccttgtttttacaggcttgatgggttttataattgagcaagtgagcctctttacatgatttctcatggtatttcatttacatagct

SEQ ID NO: 52161 - DNA, 1840 bp, Oryza sativa
aaccgaggttaagcatgcttggcctggagcattttgggatgggtgaccgactgggaaatacttcccgggtgacgttacaaaccaaggttaagcgtgcttggtctggagcattttgggatgggtgaccgaccgggaaatacttcccgggtgctggcctatgagggcagtctctgacctattaaagctgccagatgtaagtgggccccggcctggtagaggtgggacgttacaatggatctggagacctcgacggcggcccgtggctaaatcgggcgaccttgatgtagatcaacgccgtcaacggagggcttcgatgaggctattgcgagagtgaggaggatgcagcgggaggtatgaggggagctaggaggccgaggctcaacaatgagggggttggggagttcttgtccttgctgggcacttcagatctgaaggcgacatggaggaagctgcagccggcaatggcatggaccaggcgatagatggccgttcccttctccggcccctccttctcattgcccgtggttgtccacctcactccgagcaatggaggcaattgctgagaccctagcgagctccgtgcggcatggtagtcccctcttcttcccttgccatgcttgtagtctatccccaactccatctgcgctttcttccattaccgccacttgccgattaaagcttcgggccggacgggtggggggccggggggaagggttggagaccacgcgagggcgtgggggcacaacgcgccaatgcacttgcgaaccatatcctccgcacgtgagaggcttcgtataacatggcttgatgaagtgtgtgcatcctctggagggtatgctccccctagtagaggcgtgacagaggcagatgtgacgctacgacaccgtcatggtgagttggttccactcgtcatgtcggtgcattgttcatgccataaggtcgtcttgtatcacaaggttccctctagtagaggcatcacagaggcagatgtgacgttgcgacaccgacgtggtgagttagatccattcgtcatgtcggtgcattgttcatgccatatggtcgtcttgtaccacaaagtgggcctagtttttatataatagcacttgctgtagtgtacagatggtaaaggagtatgttggatcccactaaataaaaaatatctctccttaattaccccttcccttctgtgcactttttctttcaacccccttcactatctcttcttcttctctcatagtagcacaatggcgactatctagtgacgacggtggcattggtggggctctaacgggtggacaccgggaagcggtgacactggctggtgaatatggagacgatgccatcttgcagattcgacgacggcggtagctcgcgtgaatggatccacaatgatgcttgtggtggtgctcgcaaatggctctagtagcactagcgggcgactgtggcggttctagccggcagatccaaaggtggctgcgacgctcgagggcgcgtacggattcggcagtagcaactgcagtggcactcaagggcacgcttgatttatttgattttttttaaaaaaaatcatgtagaaaatattttattttcaagaagacacaatgttgaacagctcggaaagcatgttcacataagacgatgaagttgcaaaattctaactcactaccgaacaggccctaatagtacactactatggctatttcattaaaatttcccgtggaattcttcccttacaaacgaggccattccttcagaaaggtggaggtaaagatatattggtcgtttctgcagacagaaaatagcatatttgtccaaattgacacgatactagctagattca

SEQ ID NO: 52162 - DNA, 1119 bp, Oryza sativa
gcaggccgtgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgcagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttc

SEQ ID NO: 52163 - DNA, 1775 bp, Oryza sativa
caagcttgcaagcagttcaattacttcagtcgtcatgaacttctctgaaggaaagaaggtttctttgtgcagcaacttatgtaactcaggcacacgaggatcataaagtctgaaggaaaatataagttatttctatgtaccaaaatctagatagtaaagggaagcagaaaaatataaaaatgaaatccatggtattcatggacgtaacaagctcattattgatgaaaataaaaagaaattgcagattacatccaatatagaattatacaaaacttcctacatcaaataggttccagttatttgtttccattatgaaggtttacttctacatgggatgctgtttcatcaaatatcaaaggaaaagctgatgtacagattagacaaagcatttgccaaatgaacattagtcctagtgcacatagcagatgatgcagcacacaataaaatcaagaggtctactaaacaaaatacacttctacatatgtgtgtgcgctcgcgcgcaagagagagagagagagagagacctggagggatgtacccatgcaccactcgctgccatgacgaaaggggtttgatgtcatgcagctctcacagaagtatcattttctgcaatagtttcacatcacggagaattgctgaaacaacagctggttgtgatagaaactcggatattcgaggaagcacgtggttcttgtaaaattcagccttttgaggttccctaatagcaaagtatgataccaaaattgacttctcctttgccgattctgttcttataaaactttcattcaacagatcctcatgaacaccttcaggtttaagccattttctaggacttgtcaggctaacaagctctctagatttataggattcaaatataaaaagattcctgattgtattcatatagaaagaagtcatgtaatttcctgaaaaccactttaactgaaaaataaaactgcatagctcatgtgtttctgccagtgaaatacccatgaacaattccttgatatcctgaaaattagaagcaacagactgcacagcattcaaaacaccaactgcagtggcttcctgaacaaaatttgccagctgcggatgttctatctgcagatcagatctcagaaagaaacatcccagtttctgaagcaacgagtacatattttcactccacccatcatctattattacatttgaagcattgccaagttgcataagcttgccatctaccagtggtaatataggccattttgcaaaaattgaaagatcttcacatgaatgtcgcaagaaattccagagtgacaccatccattccacacttggctgaccttgatgtccaggagaccaaaataactgcttagcatgctgccattcaggtggcaagatcctaggcaacaactcaaggagaaaattgcatgtgaataagtaaatgtttgaccgtgcagaacaagctatgtcatataacttcttcaaaatggcatccggtaaagagttatcaacaacaagatgtggtatagagtccttcagaagctcaaattccatttgtgaagaaaagaatactctttcaccctccccccggttggtaaatgttgtgaatgatccatttgccaaaggaagaagagctaacccttgcaatttatcaggaaaggaaggatctcccatgtcactcaagcagtactccagaacaagtattgcttcttctctatttctgaagcaacgcttccgtcggatcaacaaattcctcagcagatgaggattcaagagatgaactgaagtatatgcgt

SEQ ID NO: 52164 - DNA, 2104 bp, Oryza sativa
gccttgttgacacccaatgtccccctcgtgcttttgtatacagaacatgaagtccaagttctgcgatagatacataaagcttcctcaccatggaagaccatggctccacacctacagcagtaggccaaaatgagagaaacagatcggagggaccaagctcttgtgcaatggctgcaagcaggtgaccataagcaggagcagcaacatattcaagcagtgcaagattccattctgatcgaactcttcctccctcagccatgatatatcctatccagatataccttcgatttgaagattgttcaaaactagcattcacatgcactggcatgctagaggtgattggaaaacgaagaaagcacaaggctcgaccctaaaaagatttgctgttcttagaggatccaagagacagttgcttgagaaccaaatcattaaagttgactttaacttcaccagacagttcttttgtattggcgacagtcacagaatgcagataagcagcaacagatgcccagggaacaaagaagtgggacttactaccagaggcaggtgacaactttctagcatggcccccacctatactctctgttaagatccatgaatgcaccaagcaagcagcagggctttgctcaaagatagagaccttttgagaactccaaggtaaatcactatctttagtcttattcaacttattgaaaaattgattcctatccattcctgatggttgatttccatttataaatgcaagcatcgtattaagcgcatgaggttctttggccatctcataactattatgcttcgagacacgatgtacaagtttcatctcctggctgtcactctccttgacatacagagttatattctttacgttgcggagaaaaagtaaagcctcagatacaacttcagagaaggaagagaaaagcatttccacatcttggggtgtatattgttctcgctttatttggcttctagaagcagcagcctcgttcctaagagggaagcggaagagtgtgcctggaaatggctgttgcaagttgcaaccaaagtgtaagaatggggtgaattgatcagggaactgttctaagatcctccttcctacaaattttatccttagacctggatgagatggagatattcctggcagataagaggcatgcggatcaaacataacaatattctcaccagaaacaaacccaggaatgtctgtgaagtgatatacacaattgaagccaagaccaaacctgcctattgcaaaaggtttctcaagtttgctgtcttgaccaattcgtgagatggcataaagatcctggggactaaaaattgagtcattgaagcagtagagagcaggcccctgccattcagccatttcaggtgatagaatagatgaagtaccataatgggtcttatccagtaaaaacacaacctcagaagccttagcatcttctgcattctgtaccaactcaaacagaatccctggtccatctgcatacatctcaacgatgtgcttaagtcgtgtagtcaaatcttcatgctgtccaaaagcctcagcaacccctgacaaactcaaattcattgagtccgaactctcagcaagcaagagacggcggagagagcggacacctagcctttccgccacatcattagaaatgttgccatggacaaaattgtgaacatacttcttcgaattgaaagcaatgcttggtgcattcccagtgatgtcctcatcaaaatcaagaagccaaggggcatcattaaatacaagttcagaagacagacagagcctagctgaagaatcaggaagatatatttgtgtttggtggtcctgaaaccgaaactcagctagatgctgcacaaccaagacagctgttctaagttcctcagcttgtagtgaagtcgaagctttccttgtggccattctggtcaaaatactagcataatctacagggtcaagttgctcctttatgccaagctctaagaacaggtccttgaatactgctaaatcaattggaatcacgcgaatgtaaggtgccacatgaaggtgtccagttaaaactacttcatcagtttttgcaaatccatcccccacccatatccatctacagccttc

SEQ ID NO: 52165 - DNA, 1080 bp, Oryza sativa
tgtttgcaactcatctaacctattcagaacgtacctctggtagaagtttgattttggcatgcgctcaataccataatatctcattattatatcttcatcacttggggatatgcagaagacaaagtcatcattcagtaattgctctgcaacaccaagaggttggcagatactttcttgaagtggataaatccgagaaaccataagaactgggagaccctccatcaaataccctaaaaatgggtaactttttgcatagatttatgctcatatcagaaaggtggggtcctaagtaccattttgcatcaagaacaaactgatatagttcatttttttcagcaggagtgatgcgctgaaacaaagcttgcaaatcaacaccctccaatgaggcaaccccaaagattgaatggagtactccagatgcatcaccatcatacacataattagacaaatgctggcacgtactcaaatactttgtgtctagtatcttgcaacctaatttggtcaggagttccttcatcaaattagacagtgagcctgtattaattaattttgagactgtagatgctctataaaggtgccctgaggtagaaggtaatataggccaatcactaaacaaatcaaggtcatatgaacaatccccaatgtattgccagaaaagtttaaaccaggctgctgtaggagatgatccacccgattctggatcccagggaacttggtttcggcatttccatccaggaggaaatagccagggaaagaactgaagaaatattcggccttcaataagtgaaatgttaacctgagaactactggctatctgatacaacttgtctagtattacagggggaatgcttcggtcaattattctatcgctaacagcagaaagaagctcatactctatgctatcacagacataatattgattctcctgtgaaataccagaaaaaatcccaaactgtttatttgctaatggaatcaatgggaggccattcatgcatttgccgatattaccactgtccagatcagcaaggcaatattccaataatattagcttctgagatttttctaatgtaccaagatttt

SEQ ID NO: 52166 - DNA, 3214 bp, Oryza sativa
tggccataaagaataatatgatattttggagtccaaaactgtacgcaactgtagcagcagttctctgaacaaaggagcaacaacatcttctaacaataacatattccagggggagcgaagcttaccacccctgtccatatcagctccataccaaatgtcacgtcggttggatgatacttcaaagtaaccattcacatgcacagataatcctgtctttactggcaaaggaagaaaacagaatgcgcggccttgtctgagaataacttcctgcaaattcagtgattactaattaccatagagtaaccacagcaaatgctaaggtgtaaaaaacacactgaaatgatgcaccacgttctgaagaacgtctgatatagcatgaagtccattacataacataaatcaaacacacattttttaagtcaaaggtattataatcaattaagttatgcagtgtacaaagtttgttcaaccagaaaaaaaaatcacatcaataaccatggtcatattgttaatgattattttaaaaatattcagcatcagataacaataggcaacgccctactgttgctaaaaaattggtgataatagccataataaagagaactgcaaaacgaactagatattacctcaggtcccacgttggagatgcaagcagcaacagaagcccaaggtagtaggtgaagatcataatccttggcagcagttgttgcaaaaataccaattttacttaatgcagatgccattccctgtacaataaaataggtatagctcttcttctcaaacttctcacccaaaaatgactttgatacaaaatccattgaaaaggaatctatctttttctcagaggactcagcagcagtgccagaaaacctgacaagggcttgtcgatgccagcgcaaattgtcatgctgtgaccctatggagcaagagtacactatctttggttcactcataccagattcccatacatacatttcaagtgacagcacatttttaaggaaaagtaaattatatacagcttcttcgtaaagttgagcaaacagagataagatatcatcttctgtgtacacttgtctcgataaccgactaagagatgcttgctcagcagtccttaaaggaaagcgaaacaaagttccctgaaatggtgctttcatgtcacaaccaaatgcacaatagggtgaaagctggtcgttgtatagtgtaattgctgaagaactgacaaaatctatacgttttccaggatttgcagctgacacattcggaagataagcaccctggggatcaacaggacaatgtacttgccactcacaaatgatggcaagtcagtcaagtggtacaccgagttaaaaccaaccctgcggaaacagaaatcgtgagttatcgctcacagcaaaactaaataaataaataaaatcatgcgctattacagggtgaacattaaacagtgaaacataaccagttaagaacaaaggtaagtatctgttgaatcattagtggcatgtctgacaattccagggtgcttgttcaaaataaacttaggagcctagacattgatatattcactacccaaacccatcaatacctaaaacattataacggggatgacatcagaacacaatagcatagatcaggaactaaataagcgggacaccacggcgacattgatatattctataccaaacccatcattaatacctaaaacattataactgggatggcatcagaacaacaaataagcgggacgtcgcagcgacattgatatattcactacccaaaaccatggatacctaaaacattataacggggaaggcatcagaacacaatagcattgatcaggaacaaataagcgggtcgtcacgccgattttactaccaatgaagcttagcattgcaaattacagctcgaacaagcttgagagagagaaggggggcgcacccgaagcggccggtcttccagacctgggacaccttcctgctgtccccgatgcgggagatactggcgaagtcctcgtcggtgaagacggcgtcgttgtaggcgagcaacgccgggccctgccattgcgcgagggcgggcgcgagcagcgagcctgcgccgtgcgcgcggcggtcgaggcagaggcggacgcgggacgcccccgcgtcgtcggcgttctggatgagctcccgcagcgcggtggtgccctccgggtagttggcgagcacctcgcggatgcgccgcgtgaggtccacccgctgcccgaagtcctcgagcagcatcccgccgggatccatgggcgaggaggcgatcgaagcgaagctaccgtgccattggaagcgcgaggaggggaggaggaggaggctagggtttgggaggggagtaggcgaggattttttgggcgagggagaaggggtgggaattcgcggatttgggcgtgagcgctcgtaattttgcctccgccctcgctgctgctgctgcggctgcgggcgttggttggagattttgactcctccgccttttcgcggaggcttcgtcgtcgactcgttcgctcgccttctccttcctcttcaagattgcgcgaaccggacgccggaagggactcccggcacctgccgctgtctctgccgtgtggggcccacgtttggtgcctcctttccataacatttttttgatttgggtgctgctctgttgggcctttaatagtgaaacggcccaatgttgagcgctaactgggcccacgattcatcgtagatatgggccgatatggggctgcccggctggtgcggcagagcagcccatttaggctgtgttcgtagctccatgttgataataactaatccctccgtaaatagggtggctcgttagagtataattaattaattattaactaaaacctcgaacaatataataatatatattttttcaagcaggtttactattcgagtatagattattgttgtttagaaagtttgtgcatgaaaaaagaagaaagcacaagttgagaaagagggaaaacaaactcagcctttcgccatagaggcctaaccaaagcaggtacagactataagctagctataaacacatattgagaagataaatgatgagagataagagcagcgagctgcagatttgtagccagttacggcacatactacaagacgtaatgtgtgtatgacatgtgggatctaatattacttatgtagtatatgtttataggaaactattatatgaatttgat

SEQ ID NO: 52167 - DNA, 6699 bp, Oryza sativa
ctatggcagacagccgtagcagcagcagtagccaaagcagtcgggtcatagcaatttttttgttaaaaaaatagttaaaacccagcctttatatgcaaagagatagatgtagctgagttgtagcaatagcagctgatggtttattttcaatttaattaagttggtccttgtatactcattttattccaatatatagttagctttagttttcaacacgagtattaagaatagatccaaaaagacttagtttccttgagtgggtgaaattatagagttatactagttgaagatataataaaacaaagagttaatatggtaagtataatttagtggggaaaatcaccttttactaataaagtttaaactctaagagttattatattttataaggtatggagtaaccatttatgtcaataatgctggtggattatttcctatttaaaaccatttcagtaattatcgtatgaatggttggttttttttatgaaaagattagctcctactctcttttgtagaaaaaaagtggttttgcatttttttttaaagtcaataaaacgtagctttggtcatttcactcttttgcgtaaatataagatactcaggagcacgcaaaacgataaaactcattagcatatgattaattaagtattaattattataaatttaaaaatggattaatttgatttttaaaaaaacaacttctaaaaaaacttttttataaaaacacactatttaaccgtttgaaaatcgtgctaacagaaaataagtaagttgaagtttcgagttgagaaaaaagaactaggccttacacaagggctaacagcctcatcttttaacccatgcttatccttataagccaaaatgtgaattttcaatcttaaatttgaagttgattgtggagttttttttatcgtagtttatttttccagtctttgcttttatatcgctaaaaaaacgtatataaaatttttatttataaattattttctgtttgtaaaaatactactttacttattccgtcaataagtggaacgatagagtactaacactattatgaaagctttgattgtaacaaacctggttacgccattttttatgtccaagacatttactattccaaaaaccgtaactatggtcaaaatcaatttatattcactgcacggatttacagacgagatgtcaggcggagtatattccattccagggtccgtttattccattccacaagtcacaagttacagcttcgtgataattgttgttttcctgggcgcgagtagatgcagcctccgctggttgttggcgcgcggacgcggcgtgaccgcgtgagtcgcggcgttttcaagcccaatgatcgctgatgcgagcaatctgaccgtcttctgagttcagatatagaatcgccacaagtggagtagacgatggctcagacatgggcgccacgcacaactagcacacgtagcacaccacaccacacagcccataggtagatgtgatgtggctgcttctgccgtttgctttgctctgcaatcctgcatgctctcccaggccggatcgcgtgccatctgcaaagccaccaactttgcctttgcctgctgctagtactagttgtactactgtgatctgaacatggagctttgcactttttcttaagaagatatcaaatcatacagctagtgacaattaacaaatcagattgtgatttgtgcaatcgatccatatcgaggtcattaggaggccagagacgctgcaatttggtgcttgtagttggagaggaaatcaggaaactgaactggcacctaacagcggcactgatacagcagcagcagcatggatactgcaggcgatgaggcgtggctgcatgttttgcgaggaccgaacgaacgatatggattgcctcgtttcaatatccatcaaaaaaaaaaaaacaagatagcaaccattccatacctgtcgctccagacaaacagtggctaccaccaaacctgtcaaaactaaaatgataatgagaagtccgcaataacttcgtcaattttaacctgtgacaacacatcaagtatttgtaaaaatagagtgtgcgtgtttgtttataggatgagtatgcttgtgctgtgagcgcttacgtttacatcgtgttttttttaaaaaaaataatcgctctgttcttttcaaatttgcagcccgtgtcttttgtacgtcaggatcacatcagtaagtgaaactgggtagtagctgatgacaaaactctctgaaccaaagttgttgggaggatttcatcaaagaatggggccaccgttttctcctcatgttgcatcacctctcttaccttgacaaaggaaacaacgtcaccgtcttaagtgtgggtaggtagaacaagataaactgcattatgcgcctaaaagaaagatacttcctccgtatctagctagattcattaacattaatatgaatgtgagaaatgctagaatgacttacattgtgaaacggagagaagcatgtttcattattgacttggttcaggtaatccgatctaaattatatgtcgtgttgatgatcaccctctctcaatttgaggcaggaatcataacccctgatctgtttacagtgctctcgatgttgccagcggtgtagttgccagcaacctgtgcatctaacaaaatggacgaacggaaatggttaagtatagaagcaagggcgatgtgaattctaaatcaaccgcgttagcgaaaagccggaaaaaacggatttgtacatcatatgtgaggttgcttaattgaatgctaccttgtttggacgattagggaggtggagttttttttttgttttaaaaaggtattcaataatttggtaatcgatttgagcagttgtagacattatcaattcgctaacaggcttagtaaaacttagatcttttttagccagctgtataagagattaatatattttctatcggttataaatattctctatttataaaagaaagtcatgacagtaactaaattctttcgtgtattcttagcactaaacgaatcgactgttccactaataaaaaaacgaaaactttgctgggctacttgtaccacatctatatattcatcatccgtacttctaatccgtacctcaccttattccaaactgaatagaccacccgagcaaccttcatcgagtaaaattattttgtaccaccgatgatataatcatgctaattagttttaaaatgcggttaggataggaatggcgcgtgatgaaggaggacaagcaggctacggagatcggtctaaagagatgcaatggtagcggaggcccagaacgagcaaggtcagcaatatcatgacaagaagaacgggtcctgaaagaagggggtgatgaaaaaaaaaagacaatgatcacgatgaagtatatgccacggtaccgccgttatcaatagtcggagatagaaacgactcatcggagccaaggaaaaggggaaggcgaaggggagtataagagagagtgtaggacacaggaagatagagtgtagtgtattactaccatcttatataaaaaaggcaaaggtacattgagacaaatgcaacccaacagaatcgccataaaaagacatctgtcgatgaagaggagccacaccattatcaccaccaaacctcaaaggctcaacaagcttgagtgcaggacaccaactcgtcgtctcatggttcatgcttgacacccaacagtgtcacatttggaagcaaaatgacgctttcagcctctgccaatcctcggactggcacctaaccaccaaaacccaacgacggagagaagaaaagagagatcaaaggcgaagggcaaatcagaaaaaaacgtgcctcgtatgagctcatatatataatttttttctccgaagaaatcccatcattttctccgggggctatttaacgggctcatctggtcctccacattctccccctcctcctcctcctcttccacctccaccctaccactctccaccacccacccgcccgtccgcctccctccgctccgctgctgcagccagccaacccagccttgctgcctcgcgggcgaacaaaaacccccagaattctccgcgtcgatctcgccccgccgcgtcccggctcgacgcgggccggcgccgtgagggtggggatcgcatgtgaagcgcattggagcggataactcgtctctatttgggggaattttttttagttttttgtttggggtttccaatcctttttcttcggcggagccgcgagcgtaggtgcgtctatctgctccgtctccggtggttgttttgattttatccgatttcgaggggggttcttgtgggcggtgtgattaggcggggtgatctcggctcgatcgatcggaacatcatctgcaggggaagcggttggcctccccccctacgccctttgaggatttttttacccttggtgtgatgagatagatgtgtgctgttttggggattttggtaggtcgatcggatcatcggatgcgctatgccagcatattcttgtcgtgtttcctgatctgagcactaagcctcaggcagtgatgagagttcggtggagctcgttagtttagtcgatcgtgctgctcaccctagagcttttcccccttttgtttaatggagaaaaactcataagcatactgtttctgttgttagcttagctgtctattgggatttcttttggagagtttagatgcagcaacaagtagagtgctaggataggctattatttatcatttgtttatctgtggctgtgatcaatatggagcatcttcaccactacctgactgtaaataagtaattgatagtgttgactaattggaaacgtcactatcaattgatagtattgtcgatttctatgtatgttctccccttcaatctgaattaaacttagtctggcccgggtaaaaaagataatgctgaccaatctgtagacccctttgaccactgtgttttaatcaatacatatacaaatacttagatctcggcactactataaatgtatggcgcggaatgaatcttacaatgtgttttttcttcaacaaacaaagcggctgaaatatttgtcggcaaatttgactagagaatcttctcgccaccgccgtgtaggcacattgtgtaactgaaatttgtttcttctgatatattcacgtgcaaagcttttgcgtttccgctaataaatttgaatgagagaatcaacggtatcagttattcgaaaacggacggaatatatttttttgtcgtcttctatgctcttttcagaaatatatatttcttaaatagcttcataccatttttagattagcttatttctaatcaaaagtacttcgactttgaccttgttatatgtttagtattgttgtaaagatataattaaagaaagtaaagccaaacattgtccaaattgcaagtaaaaatacagtgagtagtgtgttcatgacatggttgtttggcccgaactgcaaaaaattgtctttgaaacattctttttcatctacttgattagtttcccctcaatgtagcacgatatgctgcggcaacctgcaagcacctctggagatgttgatagaattgcaaacaggaagcatcgtcacatagtgcctaggcgttcaacagaaaagaagaaccctcataacatccagtttgtaagtactaacttggaaagagagatatggtgtagcgtgcattttttttggagaatttatttatcctttttttttctgttttgttattttgcaggaacgtcaagtagctgcgcttgaatacaggcaggaagaacagaggaagaggtacgctgatgtgctctaaaatcaatgtgctttgataaatcattgttttgtattatctccagtatactgaacattttctagtggttttaataattgatcagtattgatttcatgtcactattattagctgttattattactctttgttcagcatgttagttgaagaactgcattaactttcttgcctggtttgttattttcagagccaatggtggtcgtttattcttcacattgtctttatcatcccatctcgtggaaaatggagatgaacttgagacatccgcatcaccatcattgttactttttcacttcaatgatccagaggatttggcaagatgtttaacttcatcaagggcgttgctagaggactcccaacaatcagacaaagcccctgataatgatttctcagtcaacaccttcagcaacgcgagtgtggacgtgaagcgaacttcacgaaagaaaagcaaaaagaaaaacaagaggcacaaaagagtgcatggcaaaaaagtatctgaggcatctgacacacagtctatgcagagcaagggtgcttctcattgcatcgatgttgctggtggtgaatccttgaactttcatccaaccatgtggctcatgctggatctgaaatgcggtgtagaaaggagacttttccttctatggctgatggaggtgaaactttgacactgcctccaacccatgtggctgacaaattgtttggggatttgtcttctgattcttcagtgagagaagtttctgcggagagacctgatagtgaaactggtaacgatggttctttcataactctgatatcaagtacatcttgtagtgatgagatagaattgtctaggcatgcttcttattttgaatgctgtgagcaatctaacagcaataactccagatgtttgg

SEQ ID NO: 52168 - DNA, 2001 bp, Oryza sativa
agaacagaagaaagtagataatgctgtaatgagcagatctcatggcatggaaggtcaccatctacaatcccaagattcaggttctcagttccctggatgcaccacagattactggaaaacttccaggcctactgaaagtggttggaggttggctatcatggtgtatcagcttttgaagggcgctgtaacacgaaccagcaaagatctgttagttctaaattgcaattaggtgagatgatcaaggctgcaaatgatgcctgcaaagtgcaaggtgcatcagatgttcatctgatttctggtcacccccttgctgattttgagacttttatatattctgcaagtccagtcattgctaagacatcttgcatgaggaatggcaactgtttgcaggacccgcaagctggcagctcaccatatcaatatcagatatcggatgtctccttgagaaatgtgtgggaatggtatgaggaacctggatcctatggattggaagtagaaatccatagaagtctcaactctacgagatcagcttgtggtgtctcagagttctgtgcttactttttaccttctctatctgctattcaattgtttgaacagtgcaagaataacttggaccataagtttgacagtgatgatgatttcttattatcccaaccaaatggtgtgtatttaccaaaaccatctttatctgtacaagaccatggggaacccctgtttgaatattttgaatcagagcatccttcttcacgtcctccactttttgagaagtaagccttctattgttgatgttatgtatctacagactgtagtaatcatctacacttgacttaaaaaaaaaagaccgaaacaaacaaagttgtgaagagatgaaataaaataaatcagaaatcattcataaagagcttagccaggaattgttgttgttcttcttgacttttaaaatcataaagagcttagccaggaagcattgttcttcttcttgactttttagatgcttaccagtcattaatgggctgtcacatgttttttcttgatgatacttgatacattttatttttatctccttatgcatataactgctgaaataaaatgaggacgttgcaattttgttttaaaacgtttccttttcctatgcattacaatattttataggatcaaacagcttaccagtggtgaaaatctctctacttgccaaatatttggggatcccaagatgttggaaaatcttaaattgcgcgatcttcatcctgcttcctggtatgttctaatattggatatttctatccactgaattttgaatttatataccatttgttcccttattagtgctgattattttttaactcttgctaatgatattaccggactccatttccaggttttgtgttgcgtggtatcctatttgccgaattcctcaaggaaactgccgtgctgcattcctgacttaccactccctgggcaaagtagttccccaaattcactctccagacaaggctgatgaacctactcatttggtttgtccagttgttggtttctggagttacaatgacaaggtaatatttcatctctacaataatcattttttgtatcggtacggatagtataggtttgtagccacaatttattattattactaatcacattcagcacggtactaaaagttcaatgtaaaacctcatcttcatctaacaaaagctttatgagtaaactttaattcttgtttttttttcttatttgactaatcaagttgtgacctcccataggtggcttgcttatatctctagtgcacttccccttttaagcttaatttaagacagtaagatatggtgttggacaaacgtcatcttcatcccatctgtctgtgaccaagttgattgtgcataggtggacaatccactatggaaaatcattgtattagtaaaggaatataaagttttctgttattataccagatggcggaaacctttgtgtactagaaaaaacttttagttttcttgctgg

SEQ ID NO: 52169 - DNA, 9603 bp, Oryza sativa
atggtgcatcagttatgtcaagcatggtgatacccaaggccaacggggagaagtctatcaaccgtcatccagactatgaattcttcctatctcgggtctaactgaatggttgcatgatctccccggcatggaaatacatcatgttctctccattacctgtactgtatgggtcctagaaccagaagcacctccatagtcccaacattcagagtttcagactatgctctagcgcggtaccatcataccaaggctggaagttgatgagctttagctctttctagtagtagactggtagcagaacacccgaagggtttttttttttggttttttgaaagagcgactcgggccgtgggttttcgacttcagatgcttgcccctttaagtaaatcctttaagacttagagcgttgcttctgggtacctgcagatgggttcaaggcctgtagtgtatgctgttgcttgcttgaaatgggaatttttgtccatgcagatcgatcctccaggcggtttttatatgccagatagtagaagagttctgtagctaggatgggctcgtttgaatgttctcaatgttattttcgcgaggcaattttttttgccaccaggaggaatgtcggaatgtaggacagttgaatatatcccatatgtagaacaagagaaattttactgtctttgtggatacctagagagatcattttttttttattttggtttctcttaatagccaaggtattgtggatacctagagagatcaattttttaatgtagattttggtatctcttaatagccgaggtattaagagaagaggtataccaagtttcttaataaaaaaaggatacctcactgtacctgctaaagagtaaaatcactcaacaactaattaaatttccggttgttcaagttgcaatggaatcattgtagtttggaagcatcgtcaatagaatcaccatctttgtctagtttgaaagagttgccaatactcaatagcattatcatcttttttttgctcccaagtagactttgttttcgttaagaagaacatcttcttaaacttctttatcaaagaacacatcacccaccatcttcttaaactttatcaaaaagaaaaccaccaccttgaagtatgtttgctcaatcatatgcaggaccactaaacacaaggctcaaattgacgccatctgactaacaactacttcctccattcttttcttcaagaaactactccctctatcctatattagtctccaaaactaatctttgttttataatttctcatatatataataaggttgtagtaacaaaattataaccatatgaaaataaattcaaatattaatccaatgatataatttttagcaagtaaaattcaatttatattgtactaaatgatggtcaaaatgttttgaaggtggaatcttaaaatatgtggacgccttatattatgtgatggagagagtaacttctaattctgtatttgaacatagtctatatctaaatatatagtttgaaggtttttttttttttttggtgggagggggtgtagtccatgaccagtgaaagatgcatacgttacaaggattacactgcgacagaggtgagcaggcgagttggattgactggaggaaacgacaacgcttcgtcgttctgaggacgcgcatgctggatctggggcgccgggccgcagttgatgacggtgagagcggaggcgagggcggtgttgggtggcgagtttatcggagacgacgacgatgaggcctcaccattccggccgatgagcgtgttgggacggccccgctgcggaggaggtgaggggatcggaggctctgagaggcgagtttaccggagataacgacgaggccgtcccattccggcggatgcgcctgccggagcgacgccgcggcggctgggacggagagatcgccgggggaagaagaagaagagagaggaggagtggcattaactgacaccgttggatcaaaacctcatggctgcgatcgcgtaagcacagggtgacttttgcaaaagagccctcagtttgttgttagtattttctttagagtccttgctcgacatggatcgctgcgacgctgcgcatcgttagcgaccgtacgggcctgtacggaaaccgtcggatccgaatcaagcggtcaggaactcaggatcaccgcggccgagtggaaactgtccgtagatcgctatcctgatggctcgtagtcgtacatacaccgttggattcgaatctcgcggccagggtggtgcggctctacgtcagccgcgccgtctccttcgccggaaatccagagccgcgtagctccgacaccattgccacttcgctcgagagctgaaagctggcacatctagtcgtcggctgatcactcctggtggcaacaaccaaaagaagtgatcgataattttattcttggctgctgatgaattcagtaaatcggcctggccggcatggtagatcgatgccgtgccatggcggagtcgatgtgcagttacactgaataaaaccagtgtgcagttgtgcatttggtctgcttagagcaggtgcaatagcaggctataagccagctataaacacatttcgaaaaaataaaaaaagagagagaatgacagcggggctacagatttataaccagttgcagcacagacttcaaggtgtatgtgtgtatgatagatgagaccaaatattaattatgtagtatatatttataggtaactattgtatgagttggctattaagttgattatagatgatttcaagccaacagttggctataggacacaacatttttctttttcttttttgaaaatgacacattttcctaagaacatgcacggagttctgcctgtctcaggagataaaggaaaccgaaactcatacagcaggattcacaggagagcaaggaaggtacttcggttctgatgcactggagatcgagtgcagatggtgctgtgaaagctcttgaacagcaggaaggtacagagatgtttggctcagctcaccttgaatatatatgcataatatctgggttgaccttccacaaatatccagatcaatggcacaaacgtgataaaattgattggaaaatcatttgcaacacaagatcacgcagtgtaactggagtggacttcatgtcgatccaagccgacacaattggtagttgacacaatgatcatcaaattctcaaaaaaaaaaaaagacaatgatcatcagacccaggcacccagcctttcattttttttctaatcttcccttaaaactacaagcatccaatcttcaactccattaccttaaaaaaaaaactaatcttcaactattattatattaccaattaaactattacacgcttgagttgcaaccatttctgcagtttcggctccacgacgtgcatggctcaaaccccgccaaaagctcacctcgtcgtcgtcgtcgtcgtatctctcctcctcgctacgtgcgaggcacatcgcgtgcgcccacgatgccacggccgcgcgccaccgtcctccacgtcgtcgatcatggcgaccttataaaactcctccgccgtgcgggcctctccctcaatccagtattccactaccgaggtcgagcaatggcggcgacgatgaacaagacgccggcaaccaccttcctgctgataccggcggcggcgtcgctggttctcctcctcgcggcggccgcgtcggtggaggcgtcggcgttcgactacgccggcgcgttcgacaagtgcctcctgttcttcgaggcgcagcgctccggcaagctccccgacgaccgcctcgtccggtggcgcggcgactccgccctcaccgacggcttctcccagggggtaatacatacatctccgccgcctccggttcaatcaaccaaatgctcgatagtggttacagtcgttagagtagtactttaaagtcctgagtttaaatctttatagaagtaaattttagattgtgttgtccacgggacaaagttctctattgcaatggccgtgtatatccagttggatgtaaaaggcaaggccgggtaaatgctcgatcgggttgagtaatgcggcgcgaattgaatcgaaggatggatgaatttgcaggtggatttggtgggcgggtactacgactccggcgaccacgtgaagttcgggctcccgatggcgtacgcggtgacgatgctgtcgtggggggtggtcgagttcgagaaggagatggtcgacggcaacaagctccaccgcgtcctcgacgccatccgctggggcaccaactacttcgtcaaggcccacacccagcacaacgccctctgggtccaggtacgcacgcactcaaggcccatctcaccaagagcccaacacggcccactagtgccctcaagaaaaattttctggattctttgattaggtgggtgacggcgacagcgaccacctgtgctgggagcgcgccgaggacatgtcgacgccgcgcacggcgttcaagatcgacatcaacaaccccgggtcggaggtcgccggcgagaccgccgccgctctcgccgccgccgccaaggccttcaagccctacgaccgcatgtactccgacctcctcctcctccactccaagcaggtacagagacacatgtggctgtgatcttcgtccatttttccaacccaccttcctcgtttttcgcacgcatgcttttcaaactattaaacggtatgatttataaaaaaaaagtgaattacgttttgggccacatcttattacctaagtttcactttagaccacctttaaacatatatttttactttggaccgaataaatttactattgttgtaatttggattaccacgaacgattttttttcagtacaaccaacgagcttaaacacatcaactctagtatgcggccgaactcctctatatatggttcatatgtttgccgaaagggaagttatacatgatgagaaaagttgtttatgatagtacaaaccgtaacagtggtaaatttacccagtctaaattaaaaagatagctttaagggtggtccaaattgaaacttgggaaataaaagagggaccaaagtgcaatttaatcttaaaaaaatatatattaaagttattttaaaaaatcatattaatccattttttttaaaaaaataattaatagttaattaattttataataatataagctttgttttgcgggacgggaggaggggctgtcgaacgcagccagcgtatgagagcaatcagcaaatgcagcagcaacattctgatgagttattttctcttttttttgggggggcagctgttcacgttcgcggacacgttcaggggcaagtacgacgactcgctgcagagcgccaagaagttctacccgtcggcgtccggctaccaggacgagctgctgtgggcggcggcgtggctgtacgaggcgaccggcgacgagcagtacctccgctacgtgtcccagaacgcggaggcgttcggcggcaccggctgggccgtcaccgagttctcctgggacaacaagtacgccggcctccaggtcctcctctccaaggtcctcttcgagcagggcggcagcgccgccggctacgccgacacgctgaagcagtatcaggccaaggccgagttcttcctctgcgcctgcctccagaagaacaacggccacaacgtcaagatgacccctggtaatccatcccatccttgctagcttcttcttcttccaaggatggaaaactcaaatcatccttaagaaaacatctcctcatttttgcatgatcataaaaaaaattagtaggatagatcactcttaataaatatacaaattcaaattcaattaatacaaataaaaacaaaaataataaatttgacaatgaatagaacgtgtaatttaaggttaaatttgttatttttgttttgaattgtataagttgaattttaactcgcatgtttacgaaagatgtcatatattaatctatcttgacaatttttttttaaaaaaaaattgataaaattttgagtgagatgtataaaacgaggggatgtcctcccgagggacaaaaatccacttcctcgaagaattggtaatagattttgcaatgtgattgttctgaattgtgtggattggattggttatccaggtggtctcatgtacgtgagcgactggagcaacatgcagtacgtgagctcgtcggcgttcctcctcaccgtctacgccgactacctcgccgagtcgcggggaacgctcaggtgcccggacggcgaggtgaagccggcggagatcctccggttcgcgaggtcgcaggtcgactacgtcctcggcaagaaccccaaggggatgagctacatggtcggatacggcagctactacccgacgcacgtccaccaccgcggcgcgtccatcccgtccatctacgccatgaacgccaccgtcgggtgcatggaaagcttcgacaagtactacaacagcaagaacgccgaccccaacgtcctccacggcgccctcgtcggcggccccgacgccaacgacgcctacgacgacgaccgctgcaactaccagcacgccgagcccaccctcgccggcaacgcccccatgtccggcgtcttcgcccgcctcgccgcctcgcccgccgataacacgccggagtacacgccggcgccaaatgccccctcgccatcaaatggtaattaattaaccaaatcaacaatgcaatcgaacttgtaccattgagatctcctccaagtgatcgtgcgtttctttgtcaggtgggtcgccgttggagttcgtgcacacggtgacgaacacgtggaaggcaaacggcgtggactactaccggcacgtggtgacggcgaagaacacgtgcggccacgccatcacctacctgaagctgcagatcaaggagctctccggggagatctacggcgtctcccgcacgaacgccaaggacatgtacgagttcccgtcgtggatgacacggctcgacgccggcgcgcagctcaccatcgtctacatccagggcggccccgccgccaagatcgccgtcgtcgagtacaagacggcctgagaatggcacgacgacgacgactgatttctgcctttccttttttccattttagttttggtgtgtggttggctgctgcttttcagcaaacaggtggtgtgcaatctcgaagcaacgagtctgtgatgtcacctctgaccacgactgctttgagatgtggacatgcactgtttcttctgtacttggaatggcataggagatctctcagcttttcttttagctttcgtgatttctccattctttccgctgtgcacgcctgtgtgttttatatgttcaaattaagcagaaaactgtgacatgatgtttttgctattgtgcttaggtggtgtttggatccagtgacttaactttagtacttatatttagatactaatttagagtattaaatatatactacttccaaaactaattacataaatgaaagctaatttacgagataaattttttaagcataattaatctataattagagaatgtttactgtagcatcctaattatggattaattaggctcaatagattcgtctcgcaaattagttcagaattatggatgggttttattaatagtctacgtttaatatatataattagtgtccaaacattcgatgtgatagagattaagttttaagttttagtcccatctaaacagggtgctagtttgagatgaaattcaactgccaacgacttccttttctaattcttattttcttgcaaagctctttatcttctacaagaatagagaataaattgttgtaattagtcaaacaaatctgtaccttgtcttttcatcaaaaagaaaatctgcagtttgccaatgactctctgcattgctttgggtggaatatgacagattattccacactggttgtcttttcgatataatgttttttttttcagttttgtgtttaactggttcaagatggaattcagctgccaacgacagtgtttttctttgcaatttctttcgcttctagaagatatttaaggagatgaacagtttcagtttttttttgactggtcaccagagggagagctaccccacctaaattttcatttaaagagagatataatatattaagtcatactccctccgtctcaaaaaaaaataacagaggagaggatgcctctccttgtccagatttgtctcttatagtttgtctttttttgagattgagagaatatacatttgaacgaagaggagaagatagaatttgtttctaggattctgctacgatcctgtcggcacagttcaatctttatgcccagagagcaacatcctctatacacttggatgctaaacgatttagagcatgtataatagcagactattagtcagctataaacatattttagtgagataaaagataagagagaaaagcggcgggctacagatctgtagccagctacagcacgaactcctagatgaaatgtatgtatgataggtgggaccatatattaatagtatagtaagtaactgttatatgaattggctattaaatttgactatagatgaattggagctggtagtggactatactattaaacttgctcttagagcaggttcaatagtatagccaactactagctccaattcatttataactaatctaatagctcattcatacaatagttatatattgtattattaatacttggtcccacctgtcatatacacactgtgttttggaatccgtgctacagctgactataaatatatggcccgctggccttctctctttttatttattttcttaaaatatatttatagttggcttataacatgctgttgtaactgaaggagattctcctctgaaaactacatcatggtgatgattccaaagccccggagacagagcaggaatgaccagctgcagttggtctagccaatctgcaatttgcagtggtcagtcaaatatatcagcgttgctttgggtggattatgactagattatgcccacaccagccatcttttcgctccacggtagctttacagtttctagagagagaaaaaacggaaggccaagagggaaattccattgatgtcgtctgaatttcacgttcgcgagtacgcagaattgtaagaattgaaaggcggctggtgcatgtgtttcaaatagaccagaagaaattttacacctacgatggtctgaaatttctatggagtatggacgaatgttttactagtataactgatgaagatgactgtccagccaataatctgaaataaaataagatgagtcagacatatactcctacatagaaaaggcactatttttttatcaggaaaaaaaccaattgctagactagaactaccaatgaaaacgatcgacgagctagacaatcttttcttcgccgggcacgagatagacattcttgactagcctgtttgcacattgcaattgactgaccaaattagacacatgcagtagcaactagcagattagatagctgcaaggagccaaggattggtgaagaacagtgctacatactccggtgtatttcttttctctgaagataatacactggtatgttcatctcctgcacggaactctgaaagcgacac

SEQ ID NO: 52170 - DNA, 6311 bp, Oryza sativa
  unsure (1)..(6311): unsure at all n locations
ttttggaccgtacatacacatcgccagatcatggtaaggtattaatttgtcatgctgctgatctgtatcatatatccataagtcaagaacaaattaaatgaaaagtttcaagcttttgtacgttccgggtatatggaaacgggagtcttgtttttaccagttttaaaaaagtttaatactgcacatcagtagtttggaggtaccatcttctgtatcgtttgttaatctacagtgccagaaagacagaggtcctagatcatgtgatgcacatttgatgcaaatctatggggttgaagggggagtagtaaaaaaaaacatgctactgccaactactgccatctgttcatatatgatgaaaagtattttgattcgttctcttgtctcatctctgggttctccgaggtttggctgggatgctggatcgaagaaaatgaattatcttcaatctttctttttactgcggcatgaactagcatatgatgaggtatctccttcgccttataaaacactaatttagtatcgagtttaacacagtactccctccatattaaaataagtgcagttttatactattcatctccaacgtttaaccgttcattttatttaaaatttttttataattactatttttattgttattagatgataaaacataaatagtacttttaagtgtggctaaattttttaaaaaaaatcataaatttttcaaataaaacggacggttaaacgttggatacggatttctacggctgcacttattttgagacggaggtagtagtaagtttagattcacattattaatgtgttataatcgatacgtttgttttttctatctacttctgggactaaggaaggatacattccgtgtatccagattgcgcctgcaactgatcgtggccgtccccatcaaacgaagctgctgccaatttatatggataaatttctttttatttaaatggaagaccactgatttctttataaatgcaattggaaattagtactatatactgtactccatatattactactaaatccattcctccttatttgacatagttgaccagcgtaaatttcactcgctgttgccctatccttagccgttgatctcgatccaacgggcaggaatcaaggtgactgagattcggagaataagtcatctggtcaatagcaaactggttttatatcaccgcagcctcctcactcgctctttcctcgcctccactccaaccaccccgcgatagctggagtcaccggcgttcacacaggcgacagctcgtgctccggcgatcgacgcggcggccatggacaagctcggcgccaacccggccaactcgtgcgcgctcacgccgctgggcttcctggagcgcgccgccaccgtgttcggcgactgcccgtccgtcgtctaccacgacaccgtcttcacgtggtcgcagacccaccgccgctgcctccgcctcgcctccgcgctcgtctcctccctcggcatctcccgcggcgacgtcgtgagcatccatcgatcctttttccttccacggtcatttcgtcgaacaccttcctcgtgttgctaagctaagctggattgagtcaggtgtccgtgctcctgccgaacgtgccggcgatgtacgagatgcacttcgccgtgccgatgagcggcgccgtgctgaacagcatcaacacgcggctcgacgcgcgcacggtgtccgtcctgctccgccactccggctccaagctcatcttcgtcgacccggcgctgctccccgtcctccgcgacgcgctccgcctcctcccggcggggcacacggccccgcgcgtcgtcctcgtcgaggatccccatgagaaggagttccctcccgcccccgccgccgcgctgacgtacgagaggctcgtcgagaagggggacccggagttcgcgtgggtgcggccggcgagcgagtgggacccgatgatcctcaactacacctccggcaccacgtcggcgcccaagggggtggtgcactgccaccgggggatcttcctcatcaccgtcgactcgctggtcgactgggcggtgccgccgcggccgacgtacctgtggacgctccccatgttccacgccaatggctggagcttcccatgggggatggccgtggtgggcggcaccaacgtctgcctccgccgcgtcgacgccgccgaggtgttcgacacaatcgcgcgccgcggcgtcaaccacctgtgcggcgcgcccgtcgtgctcaacatgctggcgaacgcgcccgagggcgtgcggaagccgctcccggggaaggtgcggatcctcacggccggcgcgccgccgccggccgccgtgctgtaccgcacggaggcgatcggcttcgaggtcagccacgggtacgggctgacggagaccgcgggtctggtgctctcgtgcgcgtggaagggcgagtggtattaagcttccggcctccgagcgcgcgcggctcaaggcgaggcagggcgtgcgcacgccggggatggccgaggtggcgtcgtggacggcgagaccggccgcagcgtgccccgcgacgggtcgaccatgggcgagatcgtgctccgcggcggctgcatcacgctgggctacctcaacgacgaggcggcgacgaaggcggcgatccgggacaacgggtggttctacaccggcgacgtcggggtgatgcacccggacgggtacgtggagatccgggaccggtccaaggacgtgatcatcagcggcggggagaacatcagcagcgtggaggtggagtccgtgctgtacggccacccggcggtgaacgaggcggcggtggtggcgcggccggacgagttctggggggagacgccgtgcgcgtttgtcagcctcaagcagggcggcggcgcggtgacggcggcggacgtggtcgcgtggagccgggagcgcatgccgcggtacatggtcccaaagacggtgatcttccgcgacgagttaccgaagacgtccaccgggaagatccagaagtacgtgctccggaatatcgccaaggagatggggcccaccacgggcaccaacaccaaacgcaacagtaaaatgtagcggcatctagccagcagatgtggcacttgctttttagcgtcgtcgtcgtcttcttcactcggacagagtcacagagcagaaatgtctggtgcaggcagaggctgatgcattccgcattgtcatggcatggcatgtttctgtcgatatatcagcaccaccagccatggcctgtttgattgggggaagggggggggggggtgtttagatccaccgataaattttttttaaggcatgtacgaagtattaaatattagacgaaaaaaactaattacacagtttgtgtataaattgcgagacgaatcttttaaaccaaattgttccatgatttaacaatgtggtgttacagtaaatatttgctaatgatatattaattaggcttaataaattcatctcgcagtttacatgtggattatgtaatttattttgttattagactacgtttaatactttaaatatgtgtcagtatatctgatgtgacacgctaaaaattttcacccatttttgccagggtaattttttggttgccatgtgattttgcactacgtacgtgtccgtgtgacgatgtttcgtgaaattttgggcatttggtcgtcaaattccgggctcgtatctatcatcaagcggttgatttgccaaatttaaccgcgagctagtgctacgttgacgggaagacgatcaagagacgggggtgacactcgccgatagaagcggatcccgacggaaaagcccctatccctgccacgtggcactagcaaactgaacccaagtgaaactcatcagtgaccccacatgtcatcccctcgtagcggacaaccagtactactgacatgtggggcccagacgacaactcttaactccccggaaacacgcgcgccttcgccttcgcctccacacctcgcaaccgcgatcgatcgagagagagagcgagagcgagagctcaattcgcgggccatggcgaggagcggaaggaagcgtagagatcagnaggagnagncgncggtggtgtcggtggagcgggtgttcgaggggagggtggtgccggggtggaaggagcaggtgacgctgcgggcgctggcggtgagcgcgctgctgggcgccatgttcagcgtgatcgtgatgaagctgaacctgacgacggggatcatcccctcgctcaacgtctccgcggggctcctcggcttcttcctcctcacgtcgtggaccaagctcctcgacaaggccggcgtcgccagcgtccgccccttcacccgccaggagaacaccgtcgtccagacctgcgtcgtcgcctgctccggcatcgccttcagcggtacggtttccccgctgccattcttcgcactcgccgcggatcggatcgctcgctcgctgcacgattcagtgattgcgcgatgcaaattttgcgtcgaatcgaatggcgacggatcacttgtttgggccgtaaattaggcctcgatggcctcctttttggatgtatatcaaggcccacaggccacaattccatttcggtgtgtagcatgaattttgatcttaggttttttctggattctttttcttgttctgtgcttgcctttcttaaagttcaggtgtttgaatttccaaccaaaatgatgtttttagcacaccattggaaactggcctattgagcatacttcctccgtctaaaaaaagactaatgtccagattcattatattacgaaatgtcttatctaatattaggttgttttttggtgggacgaagggagtacacaacataggtgtacttctaattgccacgtaggacaaatacggtgcttagcaaaaaaaaatgattgctgcatttaaatacagaggataatgtagccaactagccatggcccatgggaaagcacctacaaagaaatgatttgattggagactcattcctcgtgttgtttcccctagcacttggtaatttgcatccttactaacaaaaaaaaacttatctttctttaagcaccttgttactataagcatacatgttccgttcttcacgtcctagacttttatcactgctctccctgttatcagtagtacatccacagagagcactgtgcactacgttctctgcttggtgtcagggtggtgatggtttcagatgctgatctatgcactggtggtacagggggttttggcagctacatattcgcgatgagcgacaggatcagcgaccagtcaggcgaggccagggacgagcacaacatcaagaaccccagcttgggctggatgattggattcctcttcattgtcagcttcctgggcctcttctcagttgtgccactcaggaaggtacttagtacatttcatcagctcagctgttacagtttctcctaaaattcagagatatatgatttctttgaaggacatagttaaattaattgaaccatgatgttaatttttctctgtcagataatgatcatcgattacaagctcatatacccgagtggcactgcaaccgcacatctcatcaacagcttccacactccccagggtgcaaagcttgccaagtacggtttttttttcagataagaaagtttgctaaagatatgtacatgtggtgaatacagagaacaaataagactcttgtctgaattctgaatcattttcctgcaggatgcaggtcaaaatgctgggcaaattcttcgtgatgagcttctcctggggcttcttccagtggttctacaccggcggcgacggttgcgggttcatgtcgttcccgacgctgggtctcgaggcctacagaaacaagtattgtctttgtttttttatacacgacgtcgttaatatttcgtataatacattatttaaaaatataagttaaagttacatttctttgatgataaaacaagtaataataaaataaacaataataatacaagtattttgaataaaagaaatagacaaatgtcatgctagcttgaaacatacagatgctcgccacactggacagtcaacaacagttaactgaattcttcagttggtttcttgctgcaggttcttcttcgatttctctgcgacgtacgtcggcgtcgggatgatctgcccttacctcgtcaacatctccgtgctcctcggaggcgtcatgtcgtggggaatcatgtggcctctcatcgagcacaagaagggtgactggtatcctgctgacctcaaacccagcagcctccgcggcatcgtcggctaccgggtagaacgagcttcttgcaaatgatcatctgttgcatgatcaatggtg

SEQ ID NO: 52171 - DNA, 7305 bp, Oryza sativa
  unsure (1)..(7305): unsure at all n locations
aagctggccatcttcacggtgggggcgtgggcggacgcgtcggacggcggcatcattccggggctggcggcgtgcggcgttatgatcgggatcgtgtcgacggcgtcggacctgacgcaggacttcaagaccgggtacatgacgctggcgtcgccgcggtccatgttcgtgagccaggtgatcggcaccgccatggggtgcgtgatcgcgccgtcggtgttctggctcttctacaaggcgttccacgacatcgggatgccggggtcggagtacccgtcgccgaacgcgctggtgtaccggaacatggccatcctcggggtgcagggcctcggctcgctgcccaagcactgcctcgacctctgcatcggcttcttcgtcgccgccatcgccgtcaacctcgccagggacctcgcggcgcccaaggtggcgaggttcctcccgctgccgatggccatggcgatccccttctacctcggcccctacttcggcatcgacatgtgcatcggcagcctcatccgcttcgtctgggaccgcctcgacggcgccagggccaaggcgttcgctccccccgtcgcgtcgggcctcatctgcggcgacggcatctggacgctgccgcagtcggtgctcgccctcgccggtgtcaagcctcccatctgcatgaaattcctctcccggaccaccaacatcaaggtcgacgcgttcatcgccaagctcccctcctcctagctaccatgcagctgatcgacgagctagccatctatctagctagctcatgaccactcactcaaccatgacaacttcatatatagctagcagtagcacatacattaatgtcgtagcctccttgtgtcttgcttccttttagaatcagatgcctttgctagtagcccgcatgcatgcatgtgacacatataaatagctactaggaaccgagcagcaatgcaagtactacattatttggactgtcaatattaccacaaccaacacagcagcaaccaaatctgatctacctgggctctcaacttttcaagtgcgtacctttctagcactacgacttatagtaggataacatgatcattttaccttttgggttgcacgcatgaaccagtacgtagtttctccctctcctcgcctttactttttgctaggtgagggcgagaatgatgaagtactcccactgtttcatattatgagtcttttgacttttttcggtcgaaaatttttaggttgaccaagtttataaaaaaattattttcgacacaaaattagttccattaaacttaatgttgaatatattttaatacaatgtttgttttgtattgaaaatgttactttattttgctacaaacttagtcaaactttttaaaaaataactaagaaaaaaaatcaaacgacttatgatatgaaactgaaaaaataattgattttatctaaatataactgtgtcgtattttgggacggaggtagcagtagcgagctagctaggtcaggttgatgtgtgtaggtaggagaatacagcgaggcgaatatctgtgggagatctggttggtcccctcggagggcaggaagggtctggatctgcacagcccagcgtgggtcaggcagggccagccagccagcccaggccggcctctccatcattgagagtcatgtgatccatataactgggaatggattctaatccctcgaggggattcgagggggataatatcccctcatatatctttttttttcaaattcgatacaaatagttataaaaaaatctgaaaaaaaattgacaatgtagagtataatgatacctactaatccaccaaaattcaagttcaaattcgatctacacatcgagaaacaaaaaagacaaatttagatataaacagtacgctactattcatatgttgaatttgtcttttttatatctcgacgtgtgagttgagtttggaattaagattttgtggagttgtatatatgtgttgtatgaatgttgttaaatttttccagaatttttcataaccgtttagatggtttttaggtaaacgagggaacatcccttcgagggattagaatagtttcccatataactctactatccaccatgctactacctcctactagctaatcactccgacataacattgcatgaattcacttgaaaatatactgcagtaatctgcattcagagatcaggtagtaggagaagggttacaagtggagatcagcctgtagtaacagctgcagaattgcatagattaacatgtaattctgatggacacactgcatgcaattccgtgtactaattaagaaattagaggggatacagtaacagtaacatcgcgtggatcagggggaatttggatggaatgggcatcacaggcagctgcaaaattcagttcgctttgcccctcgagaagcgcgaaaaattccatcctccccctgattgctgcaggggcaggcccggattgggttgttgcactgcaggtgaggtgaggcaggcacaaggcacaccaacagcagcaggaggatgcagtaattaatcgcgagacggatcatggatccatcgagtgagattttatggtttttttttcttttttgctgggagaatcacatgacttttatgtgggggttatgttagcttttggatggtagcatttggtaccatgagataccattttttctattataaatttgatacctcttggtatctaaatactataaggtaccatgagatactaatttttacactaaatttttagtacctcatagtatctactcaaggaccgtagagacggtgttttgcttttgctctctctctctctcttttcttttcgcctccttcagatctctttctgcacaagcgtgatttccacctgctcaggacagaacccccaccaccgccctggcgggtctgcctgtgcctccttcacttcacttcatttctctctctcttaatttttttactcagaaatggcagtttggaatacgataagtttaaaattttacatgaattttgtagtgttctaattaacttttttttttgccaaagtagggggaaagataaatgttgtgcagtgaactgcctnggtttaattacagtggtgaagtactaatgaggacaagcagcaaagggtaaggtaggtcgcccttctggttggttctttgcaaggagtaggctggttggggtacttgaaaagggtttgtcgtaagtgcagtatagagagagctgcatggtatgctaatttcgtgccggttttagaattggaaacccaagtgtcagtagcttccggtcgtgtggccaagtacgagctgtcggggctcggattctggcaaataacagagagatccaatgagaattgtgagtggtgaattttgaaatttaaacgcgttggttgtagtggtttcattttgaaattagggatacggatgcaaaagtagtttttgggatacatgatgaattctagatggactctgaaaacgccagtacgtttttcgctctgaattatcaaattctgaagattgcttcagtgaaataaaatctggaatttgcttcagccaaaccttctgagcgtacttctgatctgaattctctccaccggctgtcgcaccgttcagcaattccccgcagcatttgcttcatcaaacttccatgggcgtgtatgatctgaagatctttttcgctgaatccagatgctagctctctagtgtttcgtcaggcaattgtttcataagaacctgtgctgaattgaattttcataaacagtgtgttaaagaacaagtcaatgttagacaaactgttgaacccaaattctcctagagtagggaattcagtacatcagcagcaagagtaattgtaggatcgagcagaagaaacaaaacgaggaaaaccaagatccagagaaggcagacttccaagcaaggaaacctttgccgaattgcgcctgaccacacacatttaagaagggcgaaattcagaagagaagaaccatcctgttgctgaatttaaccaaagtaaatatgcagcataatgccatgggctttctcaagccacagaagtcaacaaacaccaagaattcaacaaaattctccgccgcaacggcggaattcaagtgagcaacaagtactggatggtccaagaacacccacacagagaattctcagagaattacgccccagagagccaaaaaccatccaaattcagaaccaaaaccacagaattcaacccccccagggatctgtgtggccggaattctccggatggcggaacgggaagcacacaaagacgcggcatggtttccatgggctttcttgaccatcaacaggtagagacgaccaaagacagaacggggagctcgacaattcagctttcttttcagagaattggaggccaccgaccacattcccaacatgagcacatacacccccacgagttcacagttcatgaaagcctgtggaaagcatgcccgcacatctttccccccacataacaattctcaccgtcatcacatcttcacccaccaccaccaccacccaagaacagcaaaaaaactatctagaaagagagagaggaagtacaagatgcagaggtggttgcaaggaggaagagatagagagagagagagatggatggagtgagaggggcaacggcccactgaggcggggggatataaatagcgggaggagataaccaaccgggaggatggtgtggcacgggccggtatatagtacggtgtcctgctctgctctgcacgcagcagcagcagccagccagccagccaggctgctcggctcggctcggcctcatggcgacgctgccccacgcaaacgcatcccctccttttccgtgcacctgccggcatcgcaccgggactcccggaattctcatgctctgccaccaccacccaatctcagctctcaccacacctactagttaaaaaaaaaaacaacacacacgccggctttggttgttagctcctgcttttccggtgagaattgcacgatcccggcgaacacacaaaaagattgcaggtcagtatattaagaaggtaaattacggtggacaaaagctactccaaaccgcgagaggggtcagaggacggaggagtgaagcataggtgatgacgcagtatgcagagacgcacgaactctcacctcactcaccggccaaggttattatgacgttggccatcgatcgatcgatcgacaaggcagggctaagctaggaggcctagttgccggccaccgatgcatgcacgcttggatggttggtctcactcgattcgatcggacagagacagcccctgcatctgcatctgcgtgcacgggctagctagctagagctcgatctcagctatggatccgatagatcaatcgatcaatcgccatgaattttttttccggtgacaggtggttcgatcgatggatgaatgagatcacggatatacgttgcattttgcttgcttgctgctgctgctgctgtcgctgctgctagctgcagccggagtcgtccaggacacttcacacatgctacttatcttccacacgacgcaaagattgatattgtggccttcgtgaatgaaatcggccaaatcttgttatctgcaactgcgaggcatcccatgcctgacgcacatttcccccctcatctccgtgatcgatcgatcgatgaattcttttatttcttccctcactttcttccttcctttccatgctcgatcaatcgatcagtcagaagatgtctccggccgggacaagcagatgcatcgatctcatcagatcatcgatcagtctgtggatgcagtaccaactggccgtcgcaagagctcaatgatcagctacagtttaccaatcggtgagtagcagctagtttgggactgaaacaaatcagctactcctatctagctataatacagtatattcaccagctaccaaccacgagctagcgatcgatcgaacgaacgagcagatagccagagagacgcagcaaccgaatatcatacacacattcttccaaaacagaagtcgagaaaactttcgcctccagttgtgcaaggaatttctttaaccatggcttgtcgtgcagattagtgtagcgatatgattcattgtcccttccatgtgctagcagcagctgcagctagtgatgaggcgttttttttgtttttttttttctaatccatcttccattgcttatgctatcgccatcacgtcatggccatgtgttcttctgcatatataatccactgtacatcccggctgcatgcatatgcccctgataaataaactaattgggccaattagaggcaattgccaggctaatcctgtccctgatcgagttgatgcaagggcttttgtacgcactaacacattaaggaggatctggaccacatgtactgtcagagaaatggacaagccctgtttgtgagggccccaaaaaaaaaatgaaaattcacttggtcaggtcactgtttaaacctgatctttctctcatctcagtatgaggttaatctgatggacactgcagctcacgaattcttgcagtgacatggcaagtactactctgcgtcctatgatttatgaactttttttttctttcacggctaatttggcttagcttaattagctactcagattgttgtcggatgcagtcgctatcatgagcgtatgaaaacttgcagtgtacagtgtacacagcttttggcatatgattaaccaagcatgtagggggatatcattggggttgcagaaagatgtggatgatgcatggccaccactgttgcaacaaaaggagaaaagaatgtgcagccacacgagtaaaagctactacaagtctacaacatcaatcagcacgtactgaatgaattaatccctgatctctgatgaatctttctgaatgccaggccatgtggtagatgattatgcagagcagattaaaagacaatccaattcagataccagttaattaccttcttgatgacggattagctgcaggttaattgagcacggcaagagcacggcggcaacagcttgggcagtagcaaaaaagaccgatcaataaaagcagcggcgaacggcagcagcaagaggcaaacaagactcagaaaaggacgcgggaaacaggaaggaaaaggcggggaggatgaacggacggatcggggccccagcccggttcgtactcccgataggagcaagaaagagcggcgaattcccggtacaaaagcggatttctgttggatctgaggcctgaatcggcagctgggagatcgatccatggagaattattgtttattcctttcttccgattgagattaattt

SEQ ID NO: 52172 - DNA, 1368 bp, Oryza sativa
tgagaattgttactactggttgacaattcaattcagggatagcttcctcatacttgccaatgatgtaaaacaaaagacaaaatactccctatgtttttaaatgactgatagtggacactattcccttttgaatttagccactcgtcgttttactaaatatttacaaggactaaaaggaataatatgttattgaattgtattatattctaaacataaaacatgaaacttttattcaattactctaaccatttcagagtaattactagtcaatattcaaatagtaaagctaaagttatcagttatttaaagatggaggaaggcaccgaaacccgtcatgctgtaagcgggatggagtaatctatgtgcgagcaaagctcgtaataagcttgtcgtttgcttgcacccactccaattaagcaagcagagtctctgtagtatatttgcggctgccggtgagtgccgcggcacagcaacggtggaaaagcacatggcaacatggcgatcgatcgattgattcgacgaccggccagccagccttgccttggctttggccttagccttgcactgcactgtctctcctcccaccggccggacatagcaatggccggctttttcttttgccattttacatgttgactttgcagctgctgattggtctgtgtactcttcggtgatgaatatacaatgcatcgtatgcacaaatcatgctagcttgcccctgcatgtgcagctcagagcacaaaattccatcagaagtaatcaaataatgcgccattgtttaacctcgtaagtgtgtacggaatcgtagtgccacgtagcaatgggcagcttgcgtattgtgctgttgcagaagagagcatatgtatatggcatagcagtacatctgtacatgacatgtggctgcagagaaagaaaaaaaaagaaaggaaggaagaaagagagatggatgattaattcatgggaaagatgagatgagagaggtagcctgcttgctgctgggacaacggggcatgcaaatgcaatgcaaggacaggcaattaattgataaaattgcttgcgatcgaaggaaagcatgtgaaggaattaagatctgagagacatacatacctgcagttaacttagccgcattctctctctctctctctgaatttagagtgattttgtagttaacaatatgatcaatatctctccccgatccaacgtgaaattgcacggtagatccttgtcaagtggcatccgtacatgcagtggaagctgaagcaatttcttcagatctgcagttcaggaaagcccatgatcagaccattacaacaacatcaaatcatacgagcttgaaggttacaaaaaatgcaacaagccaacaagtaa

SEQ ID NO: 52173 - DNA, 16591 bp, Oryza sativa
  unsure (1)..(16591): unsure at all n locations
gaagacaagtctgcctagccagtctccattcaaaggcggacaacgcaatcatcagtatataataatattaatataatgtactgttgctatgaaatgatgaaatcaatgcagcttggttagttgcatgtatggccagagtaaccatgtccatttgcatatatgttcagacgaaccattcaacaaactgacgcaggcagctcccataattccaaactttgatgatttcatgaaaggccatactccgtaaggaacaaaaatgaggtcaaatggttacaagggcagcagcaatattaattacgtgagctgtgtcccgttacaattgtcaggccaaaaagctcagttgaatgaattacataaaatctggacaaaaatggcaagaacacatggaacagtatatgacacgtttataagattaccgaccaatttaaggctagtttagtgtgtaaatagtacaaaagcagccgtggggttccttttcctatataccgtgttaatgtatcgacaacaaacaggtgtggtccaagcattttacaacaccgaaatcactgccagatttaatcttcacgttgatttctcctgcaacaccgaagcattagactgggatctttcacacagaacaagtactgatgatgctcacaattacggatagagcaatttatggcctcaaccatcagcacctcaagatcatccgtactctgtaggcaatgaatatattggaccacattgtatttcagcatctgctgaaattgcatccagtaaatcaatgtgagaacagttccagctcaagactaatgccgacagtataacttcccttcaaaatgaagtcctctaccagattgcgtggactattttgtgtaatgttatgttcacaactagcttcagttatgcaaactaactggctattgactgtcaatccactgttttagtgtcagcagcagaaccattatgtctgcaagaaggtccataaatgtttcttcaaatgataatatacacattctaccactgaaaacatgtaaatgaaacctctgctttagtccatgattacaatgattacaaaacatcatgaatgaattgcgtgcagtaaccaagcaggtggaataactaataacatcatctacaaccatcttacaatctgttagttggctccagtcctttttcattcaagtgagtaggctaaaattattttaaagaaaatcacgacgagaaattagtaatacctagatactaacattatgcatgattgcatgcttattcatttccttaagttgaaaaagtaaaaataaaactttgcagaaatataagtagttgaaaccagcaagatgaatcattatgaccaagccaaaggatttaagaggcaaggaaggtttagttaaggaccacattttttttactccaacaatacataatctatcgggaaggagttcataaaaaatggcttatgaaatgcatgaaccaacatatgaaatgaaagcagtgcttgaagacttgtgattatgtacctctaaagaagttttgaactcgaattgttttgtaatttgctagtgtttgagtagtctgataatactttagaaactgagtaggggcacccaaaaaattgaataaggttttgcaggcctctcttgctgtgcatgacattcagcgaacttaaatggttaaggtatgtatttccttcatatatataattaagttgctggaacaacagcacacctatattggcgttaattgatagactagcaaatgcaatatatactgtaacaagaccccttgctgacaagaagaatgcagagcttgccaaggtaccaataatctcaattagcatctttatataacccattgaacggtgagttgatgctagattttcaaaatctagtgggggccatatatgataacttgaataaatggtcataccagcagcataactacaactgatgaccacagaaataagaaaaaatacaaaagcacggtgatttgaagctcccacacagttcccaatctgcagttggacacagaaaaaggaaacaaaccaagtcaagtcaaataagtagagaggaataacggtattggaagttagttttagagttgtctgacttacaaatgggcaatgatgatccatgtctaacacacacattttgcaagatcggcagtgatgtgcccttgggggctttggtttactacagtatgtacagaaggtatagttttccaggtcatttttcccaaccatgggatagctgccccaccgcatgtctgccggtgcaccagcagatttaaaagaggccaagcaataacttgtgatggtaaatacagctagtacacctgttaatatgcagtgaaagatgccacaaaatgtgctgatcgagaaaacaactggatataccgcccagaccccaccacctgtgagacaacaagtttagtcatgtggaacagcagcacaaattgcatgaataaacaaataaacatggagagatcaagatggaaagttttatctaaagcagatgacaatagactcggacctacatatgacgaagagcatgaagaggatgagcacagtcacaaagaacctgtcccggaaattcctccaatgagaaaagcatacactgtcaggttttcgtgaagtttggttactttatgtgattgctccacaccagccacacttaaaaacaggagcataacttgcaaaaatgagacggagtccacatccccaacaagtggcctcatgatcttctggtatagatgttacacattgctctacctaaatggaaggacaattgcaattagcgcattactgtagagaatattagtccaacttaaaacaactcatcatatcattttccaatcagcaaactgtaactcacaaccttgacttgtttatcatttcagtcaagaaacttagggaatatcattcttgctactgagccaagagcacataattttattcaagagcaattctttataacagattttctcccgtgagattgtagcacagtaagcacagcttttagcagtcatatctaaatcaacaaaactgcaatcatgtattataaatgatgttcaatgtcaacacaatttactgattatgctgtgctaactgcctatctctgggttctttctgaacacaaattaaatttattttaagttgctagtacctgtttcagaagttttaccaacaaaaaagggtacattagtgattctcggagcacatagttgtaaaatatcatgtcagttaccacagataatatccgtgtttctgaattgcattacaacttaagatcatggtcatagactcgttgtctgggccgaccaacaaaattataaggctaaagccaaatcaccatccagaccaaagcgtatcaattataaggctacagcagggttactcgtcggatatcagttacttcccagagcatttggcactccaaataatccagatatcaagcatcagacgtctcctttaacaaaataacccaataattgaatgagtgataatagacaacccaagctcacaaaaggataaaccccaagctcatgatccaactggatgcgcagattacccaagaaacaaaacaaaacaaaacaaaaaaaacacctctacaatctacataacaagtagagggcgatgccccgacccattattaattatcctataggctagaaattccctcgcgtgttggcaacggagaccaaaaagatgggtgcgaaacttatgcaagaccgagagccgacggttgcaaatcaggcgcaatgatgctcccaatcatggacccaattcgacgcaagagcactagaacagcacggaacccctacaaggcgatgccgccaaagcacgcggcaaaagaaaaagggggagacgggcaaacctcgagcagcggctgctgctgctgctgctcctccatcgcggatccaccagaggagaccgggagcccgcggatcggaggagcggaggccggctttagagagcggaggcggtggttgggaaattcgcagggttctctacacttcggaatagaggcggagacggagaagaggagagaatatgtttcgataagaacaggtttaagggaagatgacttgaggttagttagttttaaacggtacaaaagaccaaacaaaaagaattgcttcatggtggaggctcttaatcccttttctcttttataaaagagtacttcatgtagtgcttaccatgtcatatcatgtaggattattcattgtaggtgcttaacttcaaaaaaaaaaagttgtaggtaaacagagaggttcatgaagctcaaaaattgctatttaatcaagcattagtgtcattcttattcctatataataataagcagcttgactattctagttgaaaaaaaatatatggtactgtttccttgagcacatgtatgatgtatatacaaaaatacgcatgatctaaccccccgttaagttctagaccgggtcaagtgcgacactggtacaaggaaaacacttaaggttatgtttagtgcacctccacgtttaaagtttcaagttaaattatagtaatttagattttatatttgtagaaacaaaatgactcattaaaatattatcaattttgtcacaacttcaggtccaaataatttgtaaaaaaaacttagggtgtatttggtagtgctactagttgacggccttgcagcagcaggtatagtcccaccacaagaaagatgctagggaagcgtcagcgctgcggttgtacaaccgcagttcagcactaccgaacaacccttagttacagagtaatgtcaaacatgacgtgctaggggacgcactcgtgacgttagtgtagcgttgcattggtaatagtgtgtgtacatctctaccatgtaatcgcaaaatacaactctggtttttttagaacaaaggtattttacatgatttttttcatataaattagttcaatttcaaagaaggcctactttggtgatatcctgtatctcggacaagggacctgttcactttgatgctaaaaaaaaccttaccaaattttggtaatgacaaaattttggcaactataccggtaggatttcttatatagttacaaaatttggtagcaaactaaatgtagccatttttttgtcaactttactaaaatttggtaaggttaaaaatgacatcaaaatgaaccggcccaaaacgtcgcgaatgataaattatctcctttttgtcgctagtctgtgtgcacttctaaagtacagagaactgttcctgttttggaccctatgctcctgctaacaagtcgtattcaggtttcaagcataggatgcttagtactgtgttattactactacgttgttattgtgtacatacagttgatacaagtgggttacatgccgcagagataagtttatatttgcagtttgcactttcagggatcacgaacatgccatttgtttgtctttttttaaaaaacaaaccacacaaaatactgcgaacatacgtttttttttattaacgaactgcacaagatagtactaggtcttatattatttatatataacagaaaaacaaacaaaacaacagcaataaaaggctataatcaggaaaaagtaacaccaccaccaccacgccgcacgcagcagataagaacacaacatcccactgcattgaaactaacatgccatttgttaaggggtcactgtcttgcaagatcagcagagagcagcgacgtgcgatttgagatttgacagtttcacaatgaaacaacagtgcagtattttctcagttacatatatcatcaaaacagaacgcataggcgagtcacactcacacctgaaacctgggaaccagaaagtggtgataactagcagggggattgagatccatttgtattttcatccaatggtccagatttgttgctacaaaacacgtgaaacagtaatttctgctacagtatacaggtgctagaaccattaatttgttatcatgtggtgctagtgcaactgcttaagttgcagttaccctagcaactgcactggatcccaatccctagcagggactacagcaatggtcctcttctttccatctactatcacacccatacttggtcagcaacttcaacattctaacgaacgaacaaattaaagaagccaattcctatctgctgctgttgccgatgttcccttctatcatcacatgtcagccgcaaggaagttgccaggtagggcaatctgccaatcagagaacagtgagttgtttcttaaaaacaagttcaactggcatcttgggtgttctcatgaatcaagaatttagggtcaggagagataattaccttctcgcctggcttgaatgctggtagacctctgtatgggcaagtaccacatcgaaatgcatcgcccaacccacactgcaattatcatttcacaggatgaaactatggattttcacagggagaggaccaaaggcaaaaaataaaacacttaattaaaaagcagtcatgctcacattgccacaagcggactgagggttattgatctgttctgatgtgagatttagcttctccaccttctcctcagcctcagcccggccacaagtacagttcttgcatgccttccttgtggctcccacctcacaatccccaactggtaaaacatacacaaaccttcaggatctacatattaaatttatagacgttgaacaaagctgaagggtgctataaaacagtaccaactggaagttctggtttcttcaagtcgtcttcagtcaacaggctgtcttcatcaatcagttcagaatcatcatcaatctgaatctttggaaaaccctttgtggctttcttgagggggaaggaaaagcccaagctccaaaaaaccttctttgccttaatctgcatgttattcaattaacactaaaaagtatgacggcccagaaacattaacacatattgtggcactagatcactcacagtaacagaatgctcgctatcctgggaacttgcagcagaagcttgcacgtcaacaaatcctcctaacagtagcttgcgctgaatagagttattgggctgatgaagagaagatcagaagatcagggagtgcaaattaagcattacaaaataaagtatattggcaaaacagtacatacatcctgatcagagggggaactctgtataagcaccatgcctccagctttaagaaccctgcttatttcagttatgaacagatcgcccaagttttccactttcttaatgacagcaagaacagaaccaactgatgcatcatcaaaaggtaacttcccacctgaaccatgccaacatggaatgttcaaaacgagcttatgacaaaccaaaatgtatactacaaggataaggtatactaaagcataacagaaatcgaaactgaacatatagcagagcaaaacagtgtgtcggttgtagggtccaaattttggaacatactccaattttggagtagtagtcatgggtgagaattgaatattgccactaatgaatctagataatcaatacaaaacatatagggagatgatctccaaaattttctcctcatgattgatgtgagaatatgaaactcttttctttccttcgtcaaccaatagcactgtctcataacctatttggtcccatatatggtgaaatgaatctatataggaattagcatatgaagcatcataaggggagtcgtcggaaactaaaggaatggtgagctccaaactgtttttcgaagaactctaccatgaatcgattgaaatcgattgaactgttgcgatttgttgagttggaactgatcctaaccagcaaagaacaaacgctcgtaacagggttaggcacagttccatattattgaatctaaacacgaaaaatcctaatcgatatcggagtctcatatgatagcaggaaaaagggaagcaaggagacgaggagaagctcaccaagcgaggcgcactgcgtgatgaccaccacctcctcccgcgagacccccgcggcggccgccagatcccccaccgcgcgaagcggcaaggccagttcgtccgtcaccgcgagcgcctccgccaccgtcgccgccatggattcaaatcgaccgcaccacctgcaaccgcgcaagcgaaaaccaaaacaaaccctcaccctcaaaactcgatcaaaggcaggaaccagatcgaaacaaccagccagaagattgaaccccgcgtacggattttatacctgatctgacgtcgagggcggtggtggagacgaagaatccgcggccccgcaagagcaatttttttttggggggggggggggggggaagcgaatttgggttttggcttttcgtacgtagaggaaggaggaggaggcggtaattagaggaggagaaatcagaaatgctcgcggtttcgtgcgtctcccgaagcttcctgattaaactaatcacgtgtcgcctttccaattctcgccggcggcggcgacgcggaggcgagacgagacgatgccgccgcgaggggactcgagatgggccgcgcgtcctccgcttcgctggcccaatacagaaagagacgcgggcttcgatgttgtctcggcccatggacaggcctgacgacgggatgggcttcgctgccgcgtgtgagttgcagctgcagagcatgtgagaggccgtcgccggcggcggcggcgagaggatggcgacgcgagggcgtgcgtgcgtgcgtgccgcccacatcacgccggcggcgtggcgttggactgatcggctggggtggggtggggggcggcggatccgtgacttggtttacgcgggcacgcgcggcgacctgcagaccccagtagtgcccatcgccattcctctgcaggcggatctcgtttacctcgtgaggtgaactcctttgctcgtttcaccttcccattcatggcggcttttggctttctcccgtacatttacttgatcattcatctttttcaaatgctcacgccattggatttttggactgaacattcttcaacatgcagggagagaaaagctgataaaaatgtggcgctccgcgcttcggttcagaaacaaccacagattgtgtacaaagttcagatacttctactagatcgtcaactctgaacaacgtaagtctttctccctctagtcaagcatccaaaaaaattagaagtaggtagtagcaattaacctctgcaattaggttctcttcactaactgaattgatggcgatgagagaaagaacggtggccgttaagtgagtacggcatttctttatcatctttggtctctcttgcactcgtgagcaacaccggcaggtgatgccgtggcgtccagggagaggagaatcaatcgcttatccgttttcagttggtgagtgggcgccaagagaacattcatctccacttcccaacacccgtattttagccatcgccaacctatggttgtctcccgaaaccctctcccgtgatccatccgcgggaataattgccgcgatatgtggatatctgttagacatatgtttcttgacacaggttgctggctgctactgttcttgattttgattgctattggttgtagattaacctgtcaagataccgaaaaaacaggtgccgcagtagcatatgtttttttaatcagttcagctgaaagataggccaaccgaaattttgagagtagcatacattgtagtagcatttctttgacgtgttaatcctgtggtttaaagttttgtaagtacaatgtgtcgaattcgcattcctcgaatgcgatgttcaaatatgtagtttttttggtccgaaacagtcaaaaccaattcagagccaggtttgtctgatcaaacacgaactgaccatactcttctactccctaggtggttaatttctacagtaccacattggatgtacttgatggtggtattaacactgcacatgttggagttgctgcgagcctgatgataaactaacacgagtggcatttcttctggcacttgtgagcgggattccttagctagtcgtactgctgctccctgctgttctcgccgtgctagattggatgcatatgcagcaatatcttatcacggtattcgtcttgaccctctgaatttctgtccataagattataatagtggactatgctgtacctacctttcaattgatttgtcccttagttaactcatgtgtttatatcagtatatcagctaacctgatattagacatcctaaacatctgaacatgaaaaactaaacgcttggcaaatcttcccacgcttacctctattagtatggccggcggacagctcagcctgaactagaagaagttgttgttttgcgtgtttgttcttcttcttgtttgaaggttcttgagctacatccattaatatgtcaccaaaaaggtagtagcaatggtccatactccatcctcctcatcttttcatatgaacactttatgttacagataatttaagcatgaaagagggctcctctccaactcccacatggaatatgataagcctgtgactgtgagcaccagtaaaactccaaagcccatttcttagggagaagacaataccaaagccttgagtggcctaagccatatcaaattgccaatatgacagccctggcataataggtttttggagcgatggagccactgcaattgcaccagctcctgacagagcacacatgcctgaacaaatgtcacgacctctctctctctctctctctctctgattagttaattgaatacattgtaagggccatgtgtcctgatgtcctctcaactctctaagcttgtttttcagcacaggattttcaacagtactatagccatagaatgtctggatagtatagggactagggagcaaaaagaaggggaaaacttttaacagtgcttgtaacagctacaagttcatctttcatcctgcaaaagttggtcgttgcctagccacagaatttttactgcactttgacaaatatgcacagcatgaactggagtaatactacaggataagggtgcatagctacagtttgttgcgtgctctgatgtcaagttggtgacatgttgccaatcaattccagccaggcgcactagcaatcttagcatccagatgctgaatcatctccttgagcagtgcaaacactcaatccatagtggccatgaacaagatctctctgttcctctgtttttttcctctctttttttctttattttcatatgagatctctctgttttagaatagaacaaggggacgtttttgtttgtttgctctcgtgcctttggaaggcaggggtgcttttttttccctttcattctttgaactgcatgcagagcccatcagcccagcattgaagagtgaagagttcagagaacctgttgcctacccagaccaaaacttgcttttgttttcttctcagggatcatgaggtgttcctccatatctctccacaggacacatgcactcaagcaatgtggtactactagtctactacactgtgagcttgtgagctgtgactgtatctgccttgaggtcccaagtaactgaactgaggcagcaaccaagcaaccaaatcttcccaattctcacttgctcctagatactattaaactccattctctgcagtgccattgcctccatttctctctctctccctccctttctctttctctctcgagccatgaatgagctctgcgacctcaaggtgcacatcaatggccatcacacgcttcttcttcatcaggtacgtgcgacctgcgtaaatctttgaaatcggttcacgtaatcaagaatcatctattcttacaagtgattggtgttgtttcatgtgcagagcgtcatgtgtgcgttctcggggaggttgaggacaatggtgacgcaggagaagaagaagaggaagacgagccgggcggagagcctgtccgtcaagctcgccgacttccccggcggcggcgaggggttcgagctcgtggccaggttctgctacaacaatggccgcgtcccgctctgcccgtccaacctcccgctcctgcactgcgccgccgtgttcttggagatgaccgaggaggtgtgcacctgcaacctcctgacccaagcagaggcattcgtggacggcctctactactggacatgggccgacgtcctcgccgccgtcaagagctgcgagccattcgccgcggcggccgacgcctccggcctcctcgagaggctcatctccgcgctgttctccaagatcaccgccaatccggagacgcccgtcgccgcgggggcagtcgggacgccgaaccgctcgtcgtcgtcgtgctcgtcgtcgccggacacgctcgggttcggccggtcgtcgtccaccaagacgcccgagtcgatgaagccgtgcttcgccagggagtggtggttcgacgacatgacgtcgctgtgcccccagaccatccaaaaggcgatgagggtgctcggctgctacggcatcgagaacaagaccctgatcctgacgcggttcttgttgcactacctccgcgccgccacgcgcaggccggctctgtgcagggaggccgccggcggactcgccggactcgccgacacggccgtgcacggcgtggcgctcgtcggcggcaccgcgttctcgtgccggggcctcttctgggtgctccggatcgtgtcgcccgtggggctgagcaaggagtgcaggcacaaactggagaggctcatggggctgatgctggaccaggccacgctcgacgacctcctcgtctccggcgacgacggtggcgtgtacgacgtgaacctggtcatgcggctggtcagggtgttcgtcggctccgaggaggaggccgacttgccgtcgcagaggatgaggaaggttggaaggctggtcgacaagtacctcggtgagatctcgccggaccatggcctgagggtgtccaagttcctcgccgtcgccgagagcctgccggactcggctcgggaatgctacgacggcgtgtacagggcattggatatctaccttgaggtaattaaagagatcaccttctatgaaatctatatttcatatttttcagcaaaaaaaaatgttattttcggtggtagtgtttggctcagtgaacaaaatatatgttaatttcgtcctaatagtaatacctgtttatgaataataggatagtactacctctgtttcaattcatgattgggaacatgattgataggctgttcaaaaagcttgatgctattgagtggctaattataggggcagtaccagtctagtcttttctcctatcttaatgaaattggccggccatcctttggccgtcccggcaaaaaaaaaagtaccagtctagtcttggattagtaggagcagtggtaaaattctttgcctgccaaggtaaagtttaccgttgtgcatgggacaagacggcattttggtcgtctagtaagcatccagattttacattttggaaaattcgacgtgaatcctgtatttctctgtacccccttagctggattttgaggtttacttgttctgctctgagcttctgacttcgtgaatgattgatcatgactgggtagaaacagacttgtaggtagtttagggcaccgggaatttcacctgacactgacagtgaataggagcattctctcacgctatgattggagccatgatgagttcctggaggtggcaataggcagttagaatgttgataaacactggcaagaactgtgataggaaggttaatagttggagagatattaggtagtagtctggtagtacgcttttgctgtacctgaaggtcaccttcgtaatggctatgatttcaacatttacatttttgtcagttctgtcttcaatacagcttctttgattggaacttctgtcatggatataccattcctccaggactctgcatatctttccaatctttctttgcaacaactttgtttcgaactgtttttttcttagccactgcataattcctgtgtgttggcctgttcttgcctggtcttttacaaaggactgaataaagtttgatagtactatcatgggacgctaatgatggacagagagatcgcctagtactttgtgttatgggtagaacaattcatttgtccaatttccataattccattgcctttaacccttttgcactgtgcagtgtgagcttttcgttcgtcagatctgaaaccttgtcacttggccaccatacattcctctgtcctaccagtcctatccactgaagtctgatcccatttcaacaaaaatgctaactttaagttgtttcaaaatcataagttgataatttcaacttactgaaactcgctatgtcttgatcacatacttacctcaggaatccatgcagcatttctgcacttgtgcatcacatttttttttctgtggactgtggtcctttgtttcttcacagttgcagagttggcaacccttggatagatacaactgcttttttctgacatagtcgttcaagctttatttgcatgcatgcagacgtaaactttaacctttttccctgtctgcgtttcacttttgatccatgacactgtcgttagcccatcacattggtgaccatttcgtcttggccaaccgatcatttttgcaactgagatctcgccaatttgtttatcagcaatgaaacctagggaggctttaacaagtgcccggtctgcccagattttgcctttatcctggcttcggtgctttctatgtgcaaatggcctttctttaatcctctcctacatgtttgtgcttcctgtttcccatcgcatccactgcctttctctcaagcgtggtaaagcgcgcgcaaaaaggaactaaacaattctttaattctctctgcgatgtacttactttgtttcacaatgtaagtcattctctgcgtgtcntgctgctccttgacactatctaatgtgattagctgcatgcatgattgggcctaattaattgtgctacaattaacagcgagtaccattgatcaaggcattagtttgctgatgaaactttgctgaattttctgcaaattaaataactaggctgcaagagagtgttgctgaatgctgatgaaacttagctgaactttgtgcaaatttgactgaagtttattctatgtctgcatgcagtctcaccgacgctgaccatcgaggagcggacgacgctatgccggtgcctcaactacgagaagctgacgctggaggcgtgcaaggacctggccaagaaccggaggatcccgccggggatcgccgtgcaggcgctagcctcgcagcagtccaagctccagatcagacccgccgccgccgtggcgaagggcaccggcggctgcaggcctgacccgtcgcagacgccgaggaagatcatcgtcagcggcagccgcgcccggagcgtggacctggacgccatggacgagaagagctgctcaagctgaacctgcagaagatgcagaatcgggtggtggagctggagagagcgtgcaaggagatgcgagggcagatgtccaagatggccaaggcggcagggcgtcgtcatcgttcggcgccgccgcctgccatcaaaccgcggtagaggcttgcctaggctgtgctaatgatggatcaagcagtaatacgtcttcttcttctttgaattcttctttttgttggtcaagatttgccaccacatcacataggggcatttaactacatagctcgccttaatttttcacctgtaaattaagttgatgatctactgcattgattgggctctcccttttgttttttcgttttgtgtcttgcgttggcggtgtgagtaagatagatgaagatgagcaagattgacaggggatgtaaatttcttttttcaccattgtccctttgctgcatgctatctttcttctgttcttttgctgtaactttaaggtgatttggtccataattacagcgcagcttttggacgtactacctactactagtaccatttggtctcagttttttttacttctgccgttcgttttgggatacgcaccaatctgcagttctctctcttcagaggtggtgtaaccgtgtaccagcaactcagcaaggaggtttcaggtacctttgcctcagccactggcaacaaggggcctgccaaataattttgattctgatccagtatgaggttctaattttgcttttgcacatgcaactatgcaaggatagttgtaccttgtgctgcaaaaagaggatgggcaacacatctcacggaaaatataattttatttatttcagacaatattatgatatgttttcttctgtccatagcgaagtaccggcattcagctagtattacacataaaaatgtaattaactcatctacactattgttaaagggaacatcaacattgcaagcttagttgctatgctaagttaaagagaattactagtttttttaggtatcaatagcataactcttgctattatccttgaaagggaagagctaatactaacgtagacaaagtgaaaaccaagttcagacatctttcatgcaaatgtaccgatctaaaagtctaaacactgctccttttgggatcagggcatggtataattccccagttcctcctcacttcatccaaatcttcatgaaaatgcttctcatagtacacagacataagatctgtgcacttaagacctgcttttgaagcccatgg

SEQ ID NO: 52174 - DNA, 7712 bp, Oryza sativa
atccggcgaccccttcccctcctgaacggatcctgtgggcggcttcactcctcctctcttggatcctgtcctctctcctccccactgtccgcggatccttcgtgggtggtattggaggttcggatccggcgatctcttcccctctcacacgattttcgttgtctttccgcccccctctcgcacggatctgcccccagcgacgacggaagggcggacccggcggcctcccctagggtgccgacggcaattggtttcaagaggtgccgatgtccatgatgagaccgtatgcgtctcatggtctccatcaccaaaaccgccgatagcgccaagaagatgtacattgctcttgagctcccccgatccccactcgttccatcaccatcactcaacggactccccgctagctgtccggccggccggagaggagggttcaagcttgcagacgaaggtggaccgaggagagcgcagccgagtggtggcactgaagatagtgggcgttttttcatgatttcaggtgcgttctcggttgattaacattttcctagctttttgattacacggttagacatgattttgtctgtgtatgtgcatgtgggggtccgagggatatggatgggtgttttttttttttgcttgttgggggtattggtgtaaacttatcagatatctaaacatagtaaatttttttctcctgtaaagcatatctgattcagtttatctaagtgcttaagtcctatggctgccatagattggggttagttttgtccttaatataggattataggactacaaactctttgatgatcctgtttgtgtgtacctgtgtatgattacttagactttgtaggagctgttctgctattttcacatgcaaactttttatccatttttcgcatctagaattattggtcaaccattattgaactcatttaaactatatggatctgaagtttttatactgaatatacctcattagttgccacacaaggtcatatcttgttacaaagtcagtgattctaaaaattaatttgagcatatcatgtctgtggagtagttcatgttcacttttcttctttcggaatttgtgttctttgtttgtgagaccaacatcttcaggattgattaagctgttatacagatattttaatcttttagacatatattgcttgaagaattgaatttgggaaaaatgtgtagtatttcagcatccttgattaggtcacacatgttttgacaaaataatatgttttgtaatcattatactcaagcgtatgtgaaaatagtaaattctggaacatgttgatcagtccgaggttgggaacatgttagttaggtaacacactgtccatctgctctatgttgtaggggaggagcggattgttgagtggattccaggcagagatggtggttaggatggagtggtgatgtcatcggaggttgtctcgaatgctgcagtccaggtgtctgaaccggtgagtttttttaagcttgatataagctttgctatgtttttctttgtcagaataattagattggacaaatggtttttttgatttgtttggtttgagtggatcaaccaagagcatatgtctaggtggagaagtgtattcattaaaaacttgtcctgttactctatattggtcgaatcttgatgcgtctcttctcggtggggctcgtggacgatagcaatgttccagaatttactactaaaattttagtagtatttcttaagtaggagggcaaattgtgtttttatgattatgttatcatgtagcttcctagtgcaagaatctagtcgataaatactatagtgaacaaaagaatggaattatttccattctgaaattctaaacatacatatacatatgctagtctgtaagtgagaaaatttgtcaggcagcttaattcctggactgaactgcttgttttccttttttttttgcccccttaaaatgcaatgatacatcttgtgactacaaatgccattattaattaccagttgatcatcttgataaatgagaccattgctgctagcttgatctccaaaatcttaggacgcccaacaaaaccggtttggtgctcaacaattcagaaaaatccaattaattcagattatattcgtatgataattgtatggtgtcgattatattagttataatgagcactaaggcaagtgttcaaattgactaagaattctactatgattttgctgtcagggttatacaatagatcatgcattcgattcccgtgttgagggatgttctcatgatactgggcagctattgttatggatttgtgtttgattatttattgaattggttacttttcatattctctgaatttagccttgaaggttaatcagctaaaaattatcatgtctggctctatggattaccagaagtatctaaactactcatttttctatgtcaattcctgtagaaatctattttccaacttcgggagtggaggagaaactgggttcatgttttcaccgccgctggtcggaaattggtaaggtttttgtcatgaaattaccaatcttaattgaattggttagttttcagtagtttgaatttagtcttgaagcttaacagctaaagtaggaaactcaacctctaaatgataaatgatactgttcatattgatatttgcaaacattcaagtactgtgaattttattacctcaaggtgttactgtgaattttccaatcaatatgacacggtggttcaaaaattgcagattaaatcaaatcattaatttcatgctactatgatatgatctcatattaattttgttacctcaatgtgttaccgtaatggagtagaactgcattagaaattcttgagttatatataaacctaatggaattgtaactgcattagaatttcttgagttatatataaacctaatggaattgtaactgcattcagggttcagtttaatgataacgtggaagtggcttgacccccgaggaagagcctcgtgatttgtatttttgtattttcttgtgtgtttctattatttctatatgtatgtcttgcctgtgattgtattcgtgtatgtgtatttttcccctgcgagagaaatctgtaaaatcgtgttagtgtgagcgctaaaaaatagcggtagaaataacagaagaaaaggaaaacggaggacttgcggtttgtggccttgtgggcttgtggtgcacctggacttgtgggttaggctttatgggcttgtcgcttggacccgggcttgcttgtgggcctgtggacagatgtggcctactgggcaatgatcacacacaaaagcgcgtacggacgaaaaatcggatctgtgtaaactgcgcgtacggacgaaaaagcgtacggacgacaaattggtgacgaaaggaaaaatccgaatcttttagttaagatttgtctaacaaatttgactccacatatatatccctcatgttattttttttgaagtcagacctatatatcattcacatagtagatagagttatatttctttgataaaaaccatttgttgttttggttttgtaaaataccacgtcgaagttatagcaaagtgatagttcaatcgaataattgtaattttccaaattattatttttataatatcgcaaagagttcaatacaaaggatggtccgctaaagatggtttatagtttatagtttaatcaacgagaggcgcggttttccacgggagaaaaatgcgagtgcaaactgaaggtttgggatgcaacattcagcaaagtcacaaataaattatccaaagtcaattccaaatacaaaaaaaaaatctaagtaagaattacacgagattgcaatgaacgagcacgtcaaaaatcactaagcataacactcgcaaagacctgacaatctacaagacgatatcaattcgatcgggcatgcacgcaggtgcatgcagctacggtgaccatcagacaccgtacacgaagaccggcagcagcatggccgcgacggcgagtccgccggcgcctagcgcggaggcggcaccgctggggtgaggcggtgtagggggagcgttcgacggcggcgcgggcgggctgaccggcggaggcgcgtcgtggccgatgaccttgatgaccatcctctgcccacgctcgcagtggccggcgacgccgctgatgaagtagaagaggccctgccggtccagccccacctccgtgtcgccgttgttggagaagaagatcgggtgctccgccttgcacttgttgtagtcgtcttccgtcactaccatcaccgagtccttcgcgtacttgaaatctgcatcaaatgcaaatcaatgtcgcgtacttgttatttttattacaaccggtagaagttgaatttaaacttaaatgtttatgatgtaatatatttcatattaatatattttgtcaaaattttttaaatttttcgatgactatttaggtggcatgcacgaaacgatgaatatcccctctagagatgaaatcactttccctgttcattgccgacagaattattcgaaatggagattgatcgatcgatcgagtgatcttacggacgctgtcgccgacgaggaaacggttcttggacgcccagtcgttgtacacgccggcgtctttggccggcgggcacggcccagccgtgttccccaccgacctcgaaggtggtggcgccggcacgccggaccgatgcgccgaggagggcgagaagcagcagcagcgcgggggagacgaggtggttcgtcgtcgtcattaccgatcgcgagatggtgcaatgcagagggcggagagcgaattaatagcaggtaaagagcgcggatggtcgagcggcaagccaggagccaggtcccaggaggaggaggcggcggcggttttggagtcttcagccagggagggaatagtggagattgcgactacgtgggccgcattggcgtagctgcaatcttgcattcttgcatgtctagtatgactcggcgattggttgcctcgtttgaccgacgtgccaatcaactgccaactgctaacttggttctcacttctcaggctctgagctgatgggcgtatcctgggcctaattgttgtagtggaagttgcggccctactagccaacggcccagtgcagaacgcagagcaaagcgaacaagaactagttttcttttttataacaggctaaatattgattacccggcttctggagaaagctaaaacaaacacattctgaagaactactactccctccatcctaaaatataagaatataaaatcagatgagataattcttagtaccataaatatggacgagctataggactaggaaatgtctcatctaatcttatattgttgtattttgagatggagcccgtacacagccgttgtatgtagacgatgcactggccagtggcagcctggcaggcagtacgatcgtatcggatccaacggtgtgagatgcaccgagccctcctcgctggcaccggatgcgtgtaaaaagatactgtagccctagtacgttcgagaatccgagcaagcacgcgactcccgtattgtagtactcctaccctatctcgcaccaaggagggacagtgtggtgacaccaaggacaaagcatggcgtccccatcgggagtagcggaagtgtatcggcaagcgccgtgctctgtcggggccgggcgggctaccgcgacagcagcggccgacctgaccttcacctgaccctgccccggcgcgaccttcttccgcttgccgcgacggcaaacctgtgtgccccgcgccgcatgtgcgtgcccgcgagatcgcttgcgtgacggctccgaccaccgcacacatgggcgatgtgtgcgcgactactgtactgtgcgtgcgcgcgcgtgggcgtgggcgggtggtgcttgacctcgatcgcctgcgcggttgagtgcgccacggcgtcctcgtcgtcatcgtcgtcgccaaggccagcgcctccttgcgcctctcggcaagccaacctcgcggctcgcgcccacgccgtggtggcccatgcgggccgcgccgctgacattttcgccgtacgtgcggccgcggttcgatcgccgttggtgccaggttgctcgttctctcacgctggttgtttgtacggctcggctaagctactccctagctatgattcccccattcatcgtaaccacatcttctaaagtattaaatgatgcgatttatacaaaatactttttatataaaagttttttttagaaaaataaatgaatctaaaatttcaagtttgtactccctccatcctataatataagagattttgagttttttttacatcttttgaccacttgtcttattcaaaaaatttgtgcaaatataaaaaacaaaaagttgtgcttaaaatactttagataataaagtaagtgacaaaaaataattctaaatttttttaaataagacgagaagtcaaacagtgcaagctaaaccttaaaatctcttatattatgggacggaaggagtaatacattaacacatccggctctatacaagggtttgtctacctagataatcaaatgttattatattttacaacaaagataatacttaattattcgtgcattaatgttttgtttcatttcgctcgccaaaaaaaaaaaatctgagccataataagctgattgtttcattaatgtgtctgtttcaactggtgaagtcggtaagagagattttcttcacaaagttcctcatggtatacatacagtatgtatgaagccgcaaaattacataggtaggtgaacagttgccacggttttcccaagtttttactggattccacatctgcaaaagggtgcgaattgcactgtgttctcatatgtggcaaccttgacacacagatagtagtaacagctggtagaaaaagcaccaaaccactgcatttggctgagacaccaccccatgttgccctgtacctgtagaactgtactacttccagaattatacttgtatttatacagtgacataccagtatggctacggacgacacacggtggaaacggctatttacacggcgtcttttcggcgggtcccaccatgatgctcccgagctccgcgttgcggaggcacagcgccgcccggaacacgccgttgacggcgtcggacagccggtccaacggcgccgtcagctcctccgtccgcctctccacctcctgcaccgccgcccgcagcgccgcctcgtcgaggtcgccgtcgccgttgtcgagcacggatttgagcttgccgacggcctcgtcgacggcgtccacctcgctgggtttggtggcgagggcggcgagctggatggacacggcgttgaaggcctcggtccacgggaattcgccggagaccagggggaaggcgatctggtggagggcgtcgccgcagaggacggcggacgcggccgccgctgcgagcgaggagacggcgtcgacggcgaggaggacggtcgcggcgccggagacgcggtcgcggggctggtcgaacgggagagaagggagcggcgggggaggcgacgccggggcccgctcgtcacggtcggcgagcgcggcgcgcgcgcggcggaccgaggaaggcagcggtggtgacgacgacgagaggaggtggagcgcgaaccgggacagcaggcgacggcggcggagccggtcgaggcgcgcggtgatcccgttgcaggcgtcgagcagcgccaccccggcgtcgaagtgcgcggcgagcgcggccgcgtc

SEQ ID NO: 52175 - DNA, 3383 bp, Oryza sativa
  unsure (1)..(3383): unsure at all n locations
acagcgtcagcgagggcaagcgcgaggagatccgcgagccgcgccaacgcagccaacggcgacgccggcagcggcagcataactcccgagcctcgcggacagcgcggggccgaaccgggcggacccgggaccaccacccgccgccccgggcaccgctttgcccggcctccgccggtgatccttcacgccgccgccgctggcgtggaaagggagaagcgcgtggtacttgtcggtgaggaacatctgggttgctaagggtgatcggatcggattcaggtgaagctcgcggcggagacgaggagcgaggatgtggcggggagaaggatataaaggtggcggtggcgtcccggggggtgtgaacggtggcgaaggtgaaggtgacgggacgtgaggcttttgtccccggcaagaatgcgtttccgggaagggggagatggcctctctctctctctcggctgtgaagatgatgggagggcggcagcgtgggcccgccgcgtaagacgcgtatcggaaacacttctgaataagaattcgccttttcactcctccacgcctctctcgtctcaattgagataacgcagtactgcagacgacatgtgtccctctcgtctctccttttggtatcgatcgagaggggaaaaagaaaattcagaatctaattagggttagctctctacttgtccattttaatactggacttaatcgagattatcggtaatccaccacatatatatacttttacttcaagtatgcgcaatccaccacatatatatacttttacttcgagtatgcgcgtggcgtcatctactttttaccttggcatgacgttttctttctgaacattgggatcgattcttttttttcccttcttgttttagcgatcttgtaattgcacaacagcacaccgtaggtacttggcagactggaatgaacacatacacgtaataatttcttctcctaccttgcgggctaaagatatacgagcagaacatactggaacgtttggctaaaccttaaagatattttttttccttatcgtaccattaagggcattaataactagactgggatcactggcttattacccccactaatagagctttcatctttatgacatttgatcttacaatctccaggcactcaagctccgtgcagggccgcgcgtttccactggtgacatcgcatcctacatcatcgtacaactacaagtgcaaggcttgcactcttctgcagttcacactggactagtaagttactgtcagatggcatatgtgccgactcgatcagctaggcttataaacaagaaaatgtacgggctaataggtaaggatggggccataatattttctctgggtacatattgatcaaagaaaaaaaaaatctcctccgatatgcaagttctactagaatgtgcttctgcgattaaagtcgtaacgaaaatttcataggaaacagttacaaaaatcatctttatgacatttgatcaaatcgattccaatgccaggcaaatgtggtttagttcctaactttttcttcaaactttcaacttttctatcacatcataacttgtctacacgtacaaactttcaacttttccgtcacatcgttacaatttcaatcaaacctttagttttgtcgtgaactaaacacacacccaaaagctgatcgaatcacaaagtagcctagcctaggttatgacgagtccagcgtgaacagcacgcccattttatcgtgattnttctntggggtgtgtgtctgtgcccataccacgtcattttctgatttttgccgagccattttactttacttaccgtggatgccacacaacaaaccgtacatcacttgcagggaagatacagatattttacccgtgcaacgaaccaccccgtctttagggtgtcgcgcacacgtgtaatgggtatgttcccatgttctgttacgcccccattctgcatgacgcaacgctacaaacagcacacttcacttctgtatcatatgcaatgcaataccgacatcatcagattagcagaagtagcaaaggccatacctcctgatacctctcctgtgtcctgatagactcgttgggggtggcaacagcaacagcaacaggtgatggcgaagaaaaatttaccatgagacggggtccagtgctacagttgccaccaccctagcttcgctttggctccacgcatccgaaacggtaggagagaaacgtgggcgcccgttttattcttcgcccattggctgttttttgaaaaccaggttcgggccatcgactttgacctgctgaaaacttgatctgcacacaacatatggataatgagcgataatggtaatttgaaaaactttataaacctgaaattaaggagccgttgacgcagacccttttgaattgacgtgtattgtaggttcagatggccgacttggccccgttgatcttgaaaagaatgatgtacaagtgggataggtacatctaaagtttggcatacataaagtataaactatagcgatctagcaagctagtgaaaattccaaagtttggcttgtataaagtataaactatagcaatctggcaagctagggaaattcctaaagtttggcatacataaagtataaactatagcaatctggcaaactagggaaactctaaagattggcatacataaagtataaactagcaaactggctagctaggaaaattgtgaattcaacgtttctggacctaaatatgaaaataaataaatgcctatttaacaccggagtatatagcaaatagaaaaaaaagaggcattttgcatgtaacatatgccttgatacttgaggagaaaaaacaatgtattactcagagtgaaagaagaagataaaatcaaaattagaactttagaagtatgaaaaaagaacctgcagatcagcacacacatttggttctcgttccactttgatgctttgatgtgcttaaaatgatctcatgagccatgactatgtggcaactcataagtcctgtctacaactgtaacatatgactgaaaaacacgggggatttagtgtgataaatgatatgagcattttcagaaaaccttgcattagtgcgtcataggcaatagaatgtctaggacaggatatggtatttatttatttgccagatcaatgttggcacacaatgaaggagtaccagatcaacaaagctatccatataaactaaaagagttctccttccacacactgtatcacacaggaagcaaatcagcttaacatcacaatcaacacagctaatatttcctggtttttcaatttttttaattaggtagagtatgctaggaatgttcttatcatcttgcatgtgccaaaccaatccaggtggtggccccacaatatcaaacttt

SEQ ID NO: 52176 - DNA, 2007 bp, Oryza sativa
caaactcgagttcccataggatgagcttgcaactgctagcaaatatacagtaaataagctgaggaaactaagttttgaaccatggtctgaatatcatgatatgttttctttagttcaacggccaaggcacccattaaaatttttgtaacactcaaaagcaccttctttgattattgagtgcacacttgagattaaaaaaagctgccgctatacaaaataactaccaaaggctaaaaccatattcaagtcccactttacaggtacacaagcaacatatgtaagagagagaagtactcaacacaagaaaggagtctatttaataaagcacaatcaaacacatgctaaaatattactacctatgttcttttttacttgtcgttttggacattgacacaatctccaatgtatatgtctcatactctcatcattactttttctagttatatatgtataaaacttattaaaaatataaccatgtgaatgtgtttttcatgacaaatctatcaatgtcattttcacatcttaacctttttttttaatttttaatgattatcatatcgagatttgaatgtgttctctaggatgtcatccttttgataacagaggtagtacctctccaatgggcacctctttcactctttgtcactaacttcagaagaagaatgtacacagaccgtaaaatgtaaatggatttcaaaagatattgaaaaagggtacataacccacagattgagttatttctcttagcatatcagtactgattgagaggaaagttgtgattaatgatatcgacaatttaagcatttgtgaggttaatgcatgaaacgtatgcttaccttgcatggcatctgtttgttaggaacccaaagggatgaaatgatgaacatgtcagcaaggtagttaattacatccaataacagaaggaaatgttttgatttttgacatgtagaagtgtggagcattgccatccactgaaatttctactcaagccatcaagccctgtcatttcccattagttgttagctttcaaacgagttcatctagaactctggaatacacagacgaaaagaaagaggtagatatgtaatatgttcaacaacttttccaaaaaaaaaaaaaatcctccatagaatatttagctaactaaattacctcattgttgaaattgtgatatgcagttagcatcttcaaaagaaataagatggtaggatctccctgaatcctgatacaaatatccgcttcactcaggctcagtttcatactgacaaacgttacggtgaaacagaaccatcaatccataaagcctttggttgactgcagcaaccgtcattagtgtgacctatcatgcaaatgaattggtcatgatagtgtaaagtaacagaaacgttgaacactggggcgaaagttccccacataggctcgtgtcgctccagccccaggggcgatgcgagcgcccccacacgcgccggccgccgccgcgccttccccctccccttcgcctcgccgccgcccgagtggcccaccggaaagccggccgggcgcaaggacggcggcggcggggcatcccggcgcccgtggcggcggaggcggccagatccggggctggggaggcgacggcggcggggcagagaaggtggcggcgacggggcggacgaggcggcggcggcgaccgggcggacgaggcggcgctggcggcggccgacggggcggaggaggcgctggcgacggtggcgacaggacgggggtggagctggcagcagggacagggcgggtccggcggcgagcgacgtcaccgaatctggcaacctcctcgctggatccggcgccccccagtccggatctgtcctctccggcgtgggaggccggatccccctccgtcgaggcggagaccgggcagcataccgacgacagggtgcaaccggggtggatgcggggaagaaaaagaaccgcggctgtgtgggcgcagcgttggcagcgggacccgcgtgagagacgctgcttgaggcc

SEQ ID NO: 52177 - DNA, 2571 bp, Oryza sativa
cggtgtgtgggtggtggtattttttcttttcctgtttacgaccatctagggttgtaatcttgtaattttttcctgctctatcaatagaatttcgcactgtctcgtgcgagtggttcaaaaaaaaaaagtaaagtaacagaaacttgaccctatccgtcttggttgatgggtttgctccaatcattataaaataaaccttgaacaggaaatcagtctacaatatatacagaatgcagtccttcgggtgaaactcaaatgtaactggcagggatatgataatatgcaagtttctgattcattcgggaactggtgaaacatcatatcatcccttttttgagatatcaccctctgggaattattaagcagtttattcaattatgaataaaatctaagagagtatgtgtaagcttaaaagctgtggttaagtgtataatttgtccatgaccaaaaaaaaaggaagaagataacattgaatagtataaataataatcagaagaagaatgagtgagttttcatcaatgttctccattagatatttcatacctttcgcattaaggggattcaagctgtatagctcaccaaaatgatgatttcctgttcatatttaagggaggtacaaagaaaataacaatattttcgggaagctaatgggtttacaaggaaaattgaaatggtgcatgcattagtgaataaaatagtcaagaacaaaatcatgatggaatcctggaagagctctgagagagcctaacaggaacaaccgcccatatgctggtagagtacatcatcattcgtatggaagaatattttactgcgctaagagtatcaggggtgtttgatatctatttctgaaatgaaactccgtatagaacaccataaagaaaatcaaacattagcagtctcaggtagatttaaaataacatacgggattcgaaagaaatgtttgaggactacagaaatctctattctggtgaatcctcctgatataactagacactgctacgtgctcaactcctgtaaaatccttgaaaaggatacataaacgctgaactatatatcatgtggttttcgaaacgatgaattcatcaaccaatacatacaaaacagtaaacagatgcacgccaaaccacacagatgaacttgaggcgtacaagaccagcaacactgagcttgagagttgaggcgcgctacaaaccaatggaatcagagccttaacaaatgggacacgaaatgccatcttccaatctccatgtcaatgtaccaaacccaaaagtctgagcggttaccgaaagctcacgagttgtcgaattcgttaccctagaaaaaaccgcacgcgcatccgtacgcaagctaagcacgagcatacacgcatagatagagaaaactcggggtgaaaggggagggggggaatccgtacattacgcgctgctgcccgatcgagagcctccttctccggctccggctccgccccggagatgccccaaactccagtagagctcacccgcacctcgcggctggagagactcgcggcgagaagcggcagcctccggcggggagctgctccccaaatcgcgcggcggccggcggcgagagatggagggagtgtgttttgcgtgtgaaaagcttctggcggaagctatacgatggttgggccttagtgcggggccgaattagtaggccggaacgggactccggcccacgtgcagcgtgcggcccgttctagtttgcctcacgcgcaccgttggaaattggacgacgtcttcaacgaaaaatcaatgacatatgatagcgaaaaagagacaatacaatatatactggtgagaagtgttatacgtacgagtaactcatacatacgactagcgactagcgtacgtcttacctcatcatcagactaatcacgtagcttggattaccttcatgtgagtccagatttttcagagctagttatgaacttgtggttgtacacttgtacgggagtcgtatgcatagttattatgtatgacagttcgagggtctatttgggaaagtttttagcagccgtagcttctcgcataatctccagctcttcaaataatgtagactgtcactcagattataagaatatgaagttataaaatcaataaaatgatctagaaaccagaagatgaaaactcggattttcggaagctggttatcaaccaacagattctcagaatcttaaactctccacacaggacctaatacacactgtacactgctaagaatgattaaggacttttctttaaagatgatggaagagcattttcccggcctccatatagaatgagtaaaactaactagacaggaatatttccattgtttcactaaactattcactattcagaattttcccatccgcccgtcagatatacatttcttgccgtgtgaaacttcctcctatttggatggactatgatgatgatgaaacatcagcattggcaaccttctgccgtagcttttgtacacgagcctgaaacagggggggttgagtgtgtcaaaatggagagttcacagtgttacaattgccgagcgtgtgatacagacacagaaaacact

SEQ ID NO: 52178 - DNA, 767 bp, Oryza sativa
cattttatcagtgcatagaatagaacgttatggtgtttcagactttctgttaggcagggggaggctccatctacattatacaagtgaatttcattgaacaccatgtgcgaacgtaagctatatgtcagagacatataaatcaatagaactatacttgctatcgcccgtcatcttttttttgagaatgcgcaaaagagctgcgcatcttttttattaagattggggagaaattgtgacatctttacaaagcaactgaaatagaaaccgaaaaagaaaggtaagaaaaggaggctaagctataatctcgtgacatcaattttgcgaccacgacagccatgatctactatgggagaagacctgctagtctccagagggcggcctcctctgctgctgccctagcaacctcctcccacgatcgctgcttctggttgaagaccctattgttcctttctttccatatggaccaagcgcctaggaccaccactgtatcgaaaccacggcggagttgctttgccactcccttcctggatgccgaccaccaagagatgaaggaattctgagaggcggggaagaggtccggacgcccaatggtattcattacaatccaccagaattgcgcggattccgggcaggaaatcaggatgtggtctattgtttcttcttgttggtcacaaagcacacacctcgccgggtggggcaatcctcggggcctccgtcgatctgcagtccaacaacgactatgagccacgagccacatgaagtaacgg

SEQ ID NO: 52179 - DNA, 1016 bp, Oryza sativa
cggcatccaaccaaggcctggtttagttcccaacttttttttcaaacttctaattttttcatcacatcaaaacttttctacacatataaactttcaactttttcgtcatatcgttccaattttaatcaaacttttaattttagcgtgaactaaacacacccaatcggtgcgtggaattttgtggtgtgtccatgcagcatttgctcgatcttggtgggcaggaggtttccctgtgacctgtgagagtctgtactagccgcggctgtccaatcaggtggagaaacgttgcgcgtctcgattgggcgccgtgatgcattcaccgaaagcaaagagcgtcgcacgtgcgcgtaccccatgctagctatagcaaagcctatgtaggccatgtttggatagctcttgttagctgtagcttatgtcaaaaatctcttactactgtcagaagttttctcaaactgttttaattatcatatatattctgagaatgtataattatacaatcagaaaataactagaagcttgagttcctagatttttcggattctcacaagatggtttctgattagctgcttttaaaaatattaagctccctaaggatagtaggacactggctattgctatccattgaagcccatccgcttcgtagcctagtttttactgcatggattggaatccttgtgggctcgcttcctcacgggatgttctaaccagatgggtgtactccttccatactcataaaggaagtcgtttaggataatgtttaagtcaaaccttgggaatataaatcatgaataactcttaaattattgagtttgaaaatgtaaaaattatatgaatagatttgtcttgaaaaatactttcataaaagtatacatatatcacttttcaataaatatttttatagaaacaagaagtcaaagttgtgtattggagaccgtgtcaatgtactaaacgacttcctttgtgagtatggagggagtatgtatagtttgtaggcaaaatttgctacaggacat

SEQ ID NO: 52180 - DNA, 4431 bp, Oryza sativa
  unsure (1)..(4431): unsure at all n locations
agtagcgacctcactgttaaaggaggaagagagaggaagagaaaaggagatgagggcaatttggtcatgccatgtaaaaagtaggccccttctcgcttagtcagcacaaaaatattaatttaatgaatgcagtgtcccctgataaataaccacattttgagagtgtctttccccaaaagtgacttcgtgcgatgtcctacagctaaaaccacaaagtcgctatgtcctgtagcaaaatttgcctagtttgtatcatgtactagtttcatgtatatattaatttattttttaaaattgtggtacaacatctttaacacacaccgataatatgaaagccagcgattgatcagtggtctcgttgaaatcctattgataacgcaacgccacggacttcaaaaaattttggcatagacatgttaattctttgacttgatccttccgtttagtgtttcttatgattcaatttttatacgtagtaaatgttttttaggattcaaattctatacacaatatatgtatttctagagtatcctatcaatcatctgtcgattaaatttctctctgtcataaatcaccctccctcctcgaaccacacctcatttaattaggaacactatagtaactttttctcagatctaatcttcactaaacaacctagaaatgtttatagatgagaagttgagaacggagtgagcaattgtttatttaatttctaatagtccttctttagccaaatgttttagaacgctgtcatagcaagatatttgcggctcacaaatcatcactttatgagaccgttatttctaacttaaagtatatattgcctagtgctttgcctttttatattggagttgcaaagattccggagaaaagttgtctttttatcacggtggctgaataaattatatgttaacacggaagcctattttgtctttttttacggtcaactataatttttctgacttggacatcatctgttctttttcttgagagtagcattttcaccattttcaaagtagcataaaaccatcatgaccggctaccactaagctgcgcctgtctacttgtcaagctctacaaaaccggtcacagtttttttatgtatatctcttctttccagaaaacttgctctcactgacaagtgggacaagccactacaccctccttctgggcccacctgtaagtgacccattcgagaatatttacgcgagggatctggtacgcctaacgataataccccaacggctacagttcccattcgtgattccacaaaagacagccagattcggagattcccctcgggaccacgtgccgaggcggcccatccggcccggtccggacgcatccgcgccgtccaaccgaattcacccccgcatccggccgtccactcgccgacggctgagatgcgtcccccgcctcgcttgatccgtttcgtaggccgacactttgcccgccaaatggcacgccaccgtaattaaccccgaactccgggggccaaatatctacaaaaacaaagggtatgggcgtgaagcctagaggtaggggggctactcgtagcctccgttttaagtacaaagactccgaaccaaaactccacgcgatttgtttagatcaaacgggttcgtaaaaaaaagttttattctcgggttcgttgggttttatctatataggcggcgagcgagaccatctcattcagttttattccgcgcgcctcctaaatcgcgcttaatacggcgcatcctgattcaaagagtggtttggattcgttggattcgaggtgaacgtacagggcgtggaattttcgaggactctctcctctcgcagaatcccgcgcgcctcttgattcggagagcggtttggatttggattcgaggcgaggaattttcgaggactttggcagcggcggcgggggctggtgagcttctgctgcggcttggagtctgcccccaccattgcgtggggaggtggaggtggaggcggtggtggcggcgggggcggcggaggacgatccttccgcggcttcggtggcaggtgagttcgccgggttgggttcggatttcgtctggatttgtgggggactcagttatgggtggtggttgcttgcggtggttgtggtggcttggtcgtgttgaggtgtggggtctccttcctggtcatctcccagggcctctcgatcggatcctcctcgggagtcgggaatgcgaagctgagtgtgacgcgtgcacgactctcgagggaggaattcccttggtgatcgtgctggagttcgtgggattcgtcgagcttttcgatcctctgctgaaaaaaaaaagtcgttctctgtcagttactcgtttcgtttcaattgggtgagatttttttcctggctcgatttgtgcaggtttgatccaaattgagcgccctgaggatttggggcgtgtttatggaggattagatcgagaattttggttgtttctgtgagatggccgccgattccagcatgggattccatcaggggatcacggcctcgatgtacaaccatcacatgctctccttccaatctaacagcgacttgggcggggggcgccggcgctgcggccggtatggtgatggccccgaggagcatgaacgggactagtagcagcgctgggctgttcgtctctccgaacaccggtgtgctgggcaacgcatcggtggccggcccgtcgaggagctcgtcgggggatgcgttcagtagcacggtggcgcccaagtacaagttcgtcactggttcgccttcagattggaatgaccgtgagctgaacacactgaaggaagggcttgtgaggtagcaaatccctattccccttttgctttctgaattgctattgcctgtgctgtgctagtgtgacttgttgcttgtgcggttgtggctgatggaattttggttgtgcaacaagccgttttttctcccctcttatgtttaatggagcatcaatccggaacaggaaatctggagctggattcattcaattgaaccctgttaccttttgagttgagagcaatatcaatgaatgttctatagcacttttgtgattatttagcgtacttgtagaatcattgttcttaaccatagaacgtctttttcaccgggccagcgaaaccataaaacgtcttggtagccacacttgagtaccttacgactatatgtttgcactatagctgattaataaagtcactatccggtctgtcaatcttatctggggaccagaccatttcttttcagttcctcacaatttcttcaatcttactggcagatatgctcgcgaaccggatatcatgaagtacataaaaatagcagctatgctacccaacagnactgtcanggatgttgcattgcggtgttggtgggctacagttaagttactcttttcaaatgtcacattatctcttctgtttccttgtaaacatatatgttgattctggtcatgtgcaaattgggtagaagaccttcttaacttcgctaaaaattaagtcagatgtacactgaagaccaaaattgacaccacctagcaccctcaccacattgctcttttgactttttgatagaggtgcttaagcgcttcatatatttaattttactttttataatcctttatttccttttgtgactgatgtgataatttgccatctgccaattacattctagatgtaggctgactttagtcccaaactttttcttcaaacttccaacttttccatcacatcaaaacttccctacacacacaaacttccaacttttccgtcatatcattccaatttcaatcaaactttcaattttggcgtgaactaaacacacccgtattgtaacttggagtatacagcttttaaagttctagcaaacgatcaattccaacaggcatatcaagtatacacagcatttaaggccataataatgacctgccctggctgaaatagacactttgtttgtttgttttattcttaatacaaagctgttcattgtggtttcagactggaaatagatactttgtttgtttactcccgttaataccaaaatgtacaaagcttttgtgcctcccgtaaaatttggaaatagccaccatgatgcatgtagttgatatttagctgttgctgcatgcattgttttctcttacattgctcctccaacaggttatttgtttactggcttgcattagtatagcagctcatgcactgtattctgctcacattcgtttactgttacagagtaaagatagaaggaagaaacctgatggattttatacagggaaaaagataagagacatgaaggtagttttctatttgtaacttgtttggtgtacctcatttcttttgcttgtatcagccatgttcttttgagtttaatttctcaacagccaatccaggacaagatggttgcatctgcctccatggctaattttcacctggcacctg

SEQ ID NO: 52181 - DNA, 8431 bp, Oryza sativa
  unsure (1)..(8431): unsure at all n locations
atatatacacaaaaaaggagcaagcagttgcattgatgtaacggagaaagacactagagcactgacccagaattctgtcccttttttgggttatttgcacatctatatcttgtttgatggagctggatacccttagtgtctctttcctgcctccaatgctgccgggagcgctaatttgaaagttggaaccattaaatcgataggttgtcccttcacagataatacctttcttatgctcaaaatcttgtataagtctattttgttgccataagtcataggaccaaaggaagcaaatgaaatcctctaatctgttcatgcaacttagccacttgacatgaactcattttcacaagtatccaataattccatgtttcctttaagtctaagcaattcgctgtggcaatcatctatatgagagtggcattcatcgtctgcagagaagacatgaaccacatttttcatctcgacccagctcagcccaggctccttatcagccattagccctctcattcttttcctaatttcagcaacaaagtcccatttacctaaagaggcgtaaaggtttgaaagcaatatgtgtgttgaaatatcatttgggtcctgctctagcgcctgttcagcagcatgaacaccaatggataaatttctaaatgttatacaggagcttagcagaattctccatagttcagggcatttcttggcgaaaggggatttcatcattaaatcaactgcttcatccaacaaacctgccctacccaacaaactgaccatgctagtgtagtgcttgaacccaggcacaataccatcagtcatcatacagaaccaatagaattttcctttctcaactagtccgcagtggctacatgcagagaggatggagatgtaagttacatggtcaggttgcagcccatcccgaatcatctcaccaaataacttaaatgccatttcagaattcccatggttaccgtatcctccaattatagaattccagcacttcaaatctggtctttgtatgttacgaaacaccaaataagcccctgggagagcaccattttttgcatacatgtcaactaggcttccggaggcacaaatattgccttcataaccactttttaccacttgagcatggagcatctctccttgtttaaggcctgcaagctcggtcgtggagtttaaagcactgctcaaagagaagctgtcgaccttgtaaccttcctgaagcatgctaacaaagtaccttaaggccaattctccctcacccaatgaggagtggcctgcaaccatctcagtccacatgattacatcctcctgggtaatggaatcaaacaaaatccgtgcagaatggggatcatcgtttgtaaaatacatgttgagcagtgtgttccctacaaacacgctgttctccagtccagctttgatcacttcggcatgaagcggcttcccaccaaacattgcaggcaaagtagcagaagcagacaccacagctgcaagcgtgtactcatcagggacaactcgttcatcgaactgtacagccttcagctgcacaaaggcatgcacagcgctgcacccatccccaactccagaaaacccagcaatcagagtattccatgacaccaagtccggcgtctcaattctctcaaacacgcgcagtgcagtatccagatcaccacagcttgagtacatgtcgagcagcgcgttctgtagtggcatgtcaggatcaagctcctccaacttcaccacccatccatggagcacacgccctcggaggcaatccccagctcgtccacaaccactcagcactgacgagagcgtgctctcggtgggtggcaatccacccctcaccatccggcaaaactgacctagagcgcggtcaaggtagccataccgcacattgcagtgcatcacgcagttccacgccaccccatcccgcgtcgccatttcgtcgaacacctggttggcgtccctcggcgcgccgcactgggagtacatctgcagcagcgcagtgggcacgatgtcgctcgcgaggaagccgagcgtcgcggcctgcgagtgcgcggcggcccccgcgcgacggtcgcgcagttcgccggcggtgcgcaggagggcgcagaggctaggtgcggtggggcggaggcccgacgcgtgcaggcggcggaagaggcggagaccctcgggcgcgtggcgcggggcgcgggagagcgcggagaggacggtgttgtaggagacgacggaggggcgcggcgtggagcggaggagcgcgagggcgtcggggacggcggagaggcgggcgtagagggagagcagctggttggcgaggaaggtggtcagcgcgggcgacgagggcgtggaggagaccacgaggagcgcgtggaccgcgcgcgcgcggcggaggacagcgcggcgaggggagcacgatcggagcagcagcgccgccccggcgagcgcctcctccagtccgaggcgcgaccagtccggtggcattcgtgatcacgctcgcatgcaacgaaccagtgtacgctcctctctccctcttgaacgctttgctaatggctgagcagtatttacaaaaccacagggttatcgtggttgtcacgtgtggtaaacattttagtttttaaaatcatgatataccacccttaatggtttggtaaaccatggttcaagcctcccaacaattgctcgctcaacggaattcaattttaaataaattatgatgattgtttttatcatagcttatttttcagcactatttatttcatccttaaaataaacctatggtttctagacttggacgtgtcttttagttctttaataaatcaaatataaaaatgttacttatatattaaatttggttgctttggttaattttcttagggcttatcttatcaaataattgaacaaacgatcagagaggaatgtgctatactgatgcaactagcagtaacctctgctaacaacaatatcgttctgtcgtacatgcttgacccagtttcattttagagactgcaaaactgaagacgttcttgttcatcttgtttattagtcacactattgagcctgctggtatggtattaataaaggtttcagttcagttcctctagtcctctactgattggtgagtttaaaatcggatgtttatcatgtttgtgaaatagaaaattgattacacattatctaaaaaaatgaaattgtattacaatctgagtttcactttcatgtttcgacggatatgcctacgcagttaatgtagtacgttactgttttcattcttctagttggattttttttgtttgggaatgattttcttttctgatgaacaaatataaattgttttgttttcactcatttcagtcacccatagcgagtattcaggttcagaaacccatcggtagctctggtttaaaatgaaaaacaggtcaattcgttggttggttcagttcagcctgggtgcttagcttgtaatggtcatgttatttgcatacactctaccaggtggtctacgctaactccacacttgagttggaggtattgtcaagcaatcagcttactttattcaaagcagctgaagctggttttgtacagcaaatacgtcgtagtttcgatctgacgagcactaaaatgtagatttgtttttggccagcaactaaaagagggcagagttaaaccggaaagtctacatcattgatgcaacttcagagcacacagctaatatttatcaaactaaaaaaaaatctgaatcggcacttattgatcatgaaaacaataccgtatttatttattctgaatttccaaagaaaaaaaaataatactatcccgacacaaaatataaaaaaactaatactcggccgttcagattgtagtatgatgtgttctacgtagacacgtagtataggatgctataatattaacgaagaaaatagtttcttttaaagtaacatttattaaagaaacatcatggaacgagtgtgtttagttcatatcaaaaatggaattggaacgatgtgatggaaagttggaagtttatgtgtgtaggaaagttttgatgtgatgaaaaagttgaaagtttgaagaaaaactttggatctaggctgtgtttagttcagcgtaaagtttggattttagttaaaattagagatgatgtgactaaaaagttgtgtgtgcatgatatgttgatatgatgaaaaaggactgaagtttggatctaaatacggccaaggccaaataaacaaaaaagaaattcttggattagtcctttcgtggcttcctgtgccaagaagataagcacatcagtctcatcacgccccgcctcgcttcctctcgttgcccccgcaatttcgcggtctactacttctcctcctcccctggtctccacctcccaatccggcgattccccaatcctccaccacctcttcacccacccccccgacgaccacttcccccacctcgcccaaccacgcggcagaagcaagtcaagccaacccgtacggcaccccacccccaccccgcgcaatgccgggcctcgccgccgaccaggacaccgtctcgttggtgcgccgggtctcccgcgccttcaaccgccgcctcaccgacctggtcggcctcctcttccaccacaaggtaaacatcgcgtcgtagtttcggttttacacgcgcgtcgcgcgaaccctaaccctagatgggcttccccgtctcgtctcgtatcgtgtgtgtgcccccaccagagcgccggatccctcggggccgtcgccgggttcgccatcgctgtcgtgttcgcgtggaagttcctgcggtcgtcgccggccaggccgcgccgcccccccggaccgaagcggccgctcgtcggccctgctgcccccgattccgccgctcgcgatgcggccgagcctgccaatcctgggaaggttggtctgatcctctgattggtgtgatgatttttggataatatttattctaggttctatttgtttgtgggtttttcaacccttgattggattggggtttgtgtgtatggcagctgacgacacggcaaatcgtggtgaagcgactgggcgggtgtagaaaggtatggtttctccttgcgccttgtcatcagcgggttgatgaaacttcgatgatgtgatatcaattacgcgtttaagaaataaatgtttaatttgcctatgtggcagcttattgcttgggtttggcatgcctgattgtctaatgttgagataaattatatttgagaacttttggaatttagcttccataaatgtacaaccacacgtgtaaaatcttggatcaatgagaagacaatggcctaaaatgcactggttccacctatggatcactaattactacagaaagccgcattaacttatgatgcattactacctgtactatgacgggacaaaaggtaaggctgttgagtctaaggttatcgcatgcatgcagaaaagttcagcctagtggcatgttcagaaggtggtcggtccctgcagctgggtggtattaagaaagcactgacctgaaatatctgaggcttattattttattttctttgaaatatttgtaaattgccgggatacaaagaaacttgtagagcttctactgtaaccccggggtcaattgttcactcaaactgctctagctacgaagaatggtgatttgatgggttattttgtttttttaaatgctttgtctgtaccaaatattcacctaaacataattttatcctgtgtttccatgattgattttaaggatctagagcagcccttatttaaaatttaagcctgtaggcttacatatactcctaaacaagtcagtttctttttgtttgagatgnccatagcaaatggtataaggaattaaaaaatgaggacaattttattgtgatataagtttaccactagagagcgaagatcaaactgttaggtgctttctggctatagtgatctgacataatactcttagttcaaaagagcaaatgctttagtgatttaacttgacactgtaaattgtaatcataaatacggcagacttgaaataaatgaaatacatatttggtttcttaaaatttgcagaagttcataattttttttttatcaaggtgacttgccaactgcttggtgttgtctttgaggagataactcctcaggagcttcaggtttgtttagcaatgcctcttccaatggttatgtgcccctccaataattgctgaaatgctaaaatcatctgcactcttcttgatgcagacacatgccactgttagaccttcagtggtggaactactactcgaaatagccaaatactgtgattgtatctgatggaaactgtacttgatgataagagtgaggtatgaatttcatagtgcatcctttcatttctttgcagttttatcatgtgagattttttatgagaattatcgagggaaatattgatatataccgtattaatagttctggaatttgattttgagtaggagaatgctctattggccctggagagtgctggacttttcaagactggtggcttgatgaaagaaaaggtgaaatgtttgcgttacttttagttattgtactgcgtttgtttttttgttcctctcatgttccctccattccccacgtcatttcaatgctgcattgagtaattattctcattttatttatggatggtagaacatgaatggcctgttttcaccaaattcataggaggatacagatgttagcagttacagtaaacgtttcacatgattgaacttttggtagaggcaactgatactaattgatacatgtgcatggaaatgctattggcgcttgcatatcagttctgcatatggagctgactttgtctggcactcatatcagttctgcatacccagctgagtttcagtccaagttctggctgagaaaagaagtatttctcctgtatattcagaaccctgaaatatctaggtgttaaataatttatttacttctgtcacctacatctataattgagtgaaaaaggtgggtattgcaggtactcttctgcagctctgaagttgggcgaacttcatttgttcgacagttagaggcagattttcacattgacacaagcctcgatataatttcccaactatctgtatgtactcttgcatcttcatttcttttttcttggaccaggtgccttctgatagtcatgttctacatgtttatcttcgtttctttgctaccagcggttcattcggtgccaactctttgtttcctcaatagaaggaggacaacttgcgggtaatgtatttaactctccaagccttgagcagttcttctcatgaaaccagagcataatgggggttcgtatctaaacgtggcgactacagcagcacgtgtttcaagctttgaaggtgtcatgtgattctgtgacaccaatctagtagtagaatcctcaggtacataatggaggcatatgcggttggcacatatgttgtgtgctatgttgtgccttgtgttcccatctttctcatagctgtatcttagcctcatagatagcgagaactataagttggatgagtgcagttcatggccatctaatggtgttgtaaaatgtaaattgaatgccacaagtctttttttttttgggtttattagtttctgtagctttcattccatgacgagcgaactagtacctctatcgcaatagaagcaactgtagctgatgattccggtaatccggtttactttcgactgaatgctggatggaaattgctcctcaagctgaggaaattaagttgtgctgtgttttgttattgtgggttaggaactaatccttaacgcaatgaagtggtggattagcatatgactaattaattattagcaaaaacttgataaagtattaatataaaattttaaactttaaagcaacttatagaaatttgttgtaaatgtcgaaaaatctattgtgttgttttctaatgtattatgtcaactctctaacggggtatgtactccatagaatacatatgagggctatattgttttatctttagaaccatagaagtcggtaaagaggaggtgaggattaagatccgctgcatgacatgtgggtccagatctgatctatatctcacaaaggcgtgatgcagttgattgcagaggatcctgatccgaaaataacacaccctaaactgctctcatgttgaatggttccaagccaagctaacatttttgcttacaagctaagctaacccttttgcagtaagcaaattcaggcgccatcaccgtattcgaacgtcgtaggcggcaccgcggccgtcaactccgacgagctggccgcccattgcaattcaaaactaggctgccgggggccaggtcgtcgtggagccatagggtaacacacacgaacgcgtaacatttgcatttgcagatggtgaggagaaagagaataaaaacggggggagagagagaggcaaagg

SEQ ID NO: 52182 - DNA, 4337 bp, Oryza sativa
ttcctatccctagaagtcacggagacaaaaaaaaactatgagactgccatgtttcctgccagattctccagatgtttttgagttgaccatgttacttccacactttatttttttgtcatttgccgaatggttttgtggaacaaccgagttacgtctagtaaactgctccaattaatacaccctatcctttatgcctaaactgcaatactgattctatcttgcagttgacaacagagatcaacatactcttgaaaacctccgtgctgaaagacaggctaagattgatgagttgaaggagagaacgaattactacactactcaacaacttatacaggtgggcttgttgcctacttgctctatgttatggccacccaagtgtgctatttttttactcttcccctttgaaaggtttacatcttctaactattgctgaaacttcgttttggtcatgcagagatatgatcttgatcctgctgcaaaagctgctgcagcaactgttttggcatctaaactgggtgctgattctggattgagagtcttcttgggagatgagtcgaatagggatgcaacattgagtaaaagtaatgatgcccaaactactggaccgaggcaaagaaaaccaggacacttgagcaacagcactggaaggacatacggccctgagtcattaggcggttcatatgcctatgatggtaatgaaggtgtcaccactccaaatcagaggactgttgaccacttcagaggtccagctggtaatgatgggggatggctcgcacgagcagctgctctgcttgtaggggaagatccaactcagtgctatgcgttaatatgtggcaactgccatatgcataatggtatgaaagtgataactatcttcccaatatttcatacagattctatataataaaccattcactgttgcaggtcttgcaaggaaagaggactttgcattcattacatattactgcccgcactgtaatgccctcaatggaccacggcagcatgatgagcatgaaatggtatctcctggtaaggagactcctatttctcattccgatggcagcattggccacgccggtgcaaaccttgcaaactcaggtgccggcagccctatcgtgaaagacttacccacggttgaagaattacctgcggaaagttctgttgctactaacttaccatctgccgaagaactacctgcagaaagtcctattgccaacaacttaccagcagttgaagaattagctgcagagagtcctgttgccagtagcacacctgctattgaagaactacctgcagaaggtaccgtggagaaggcaagtattgatcatcctgccagttgatcttttgtaaagtaactgcatatgtatttgttcatggagggcttttaaatggctcacggtggttttatagtttgctgcactgctcgttgctcagaaagcacacagcttctgttccaaacttccaatgttttgtgcttgctacatagcatatgcatgttgcaggatagtggttttcactggtagtgctagataggatgttttccttgtgtttcgggcacggggcaaggctcatttttcaagtccagtaacagatcttgattaaaggggtgttcttgcatttttcttttctggagtgtatatgattgtacagtagtactatttgaggtgcgatgaggggtcattttcggctttttaataatggattataatttttgttgtacagttgcagtatttactatgtcaacaacacgcaacattggtttctgttcataataacctgttagtttggaacatgttgctatcaacataatagcctgctgaaaatttggaacatgttgctgacacattatttatcgtgtttgactatggaacttcccaaaattgtgccctgagctagcacacaggattagtgtgttttgcctaaactagcccatagggcgtccatcctagttctccctccatcttaaaatatagtatagtaatagtaattatttcttgagttctttatggaggcgaaggaaaagtgtagaaatgcctttattaattgtcctggccggtagaggtgagatgtattttagatatttcatcactgtaaacttttacccatggtacttggaactttagaacaaagtttgaactactaaagtcttttggaacatagatgaagatgaagactaagtttttccggtaaaccaaggtggtattagcatatgagtgattaatttttaattattacaaacttgaaaaatagattaatatgattttttagaacaacttttatatagaaagttttcacacgaaacgcaccgtttagtagtttgaaaagcgtgccacgaaaatcttaatcttaatctaactgttattggagaaaaaaaaggggaagagagtagaagatcagatgtggttggcggaggacggatgcagttgtcagcgcagtacgtgcggccggttactcatactgccttcgtttcatatagaaatcagttgaacgttttctaattccaactttgaagatttgatttaagttatattaaaaattagcaataaaaacttttaaaatatattgaatgttaaattttggcgccataaatattattaatttctataaacttgatcaaaactttagaaggttggctttaaaagaaggtcaaaacaccttgggggagtaataagggcgatcacagaacgaagtataaatgcaatgggcattctattcaaaacctaaagccatctttttgttggttttatcaacacgatcttccaactatgcaataatacataaggtgccctcctaactctccaaagtggaaaaacatacaaggtacccttccgaaaaatatattgacgaccaatcagagagaacaaaacaggacaggggaacacctccagccatccaaatatttacagtcacttgtgtgcgtgttactcactcccgaatcaagtgtctggtgtattcatttcgctggatacccaaccaggtacaacaacagcaactcgctcgcccgttgcgcatacccccgcaagcagctgcaggcctcaatttccggtgctttcaacagctttcaactcgggcaggtaggcaggcgggcagacaatcagatcactggaaaacaatctcgctggaagaaagaaacgccgggactgttcctggcgctcgctcactcggtgcggcaacttagccttcttcatggtacacgaaacttgggcggcggagctccagccatctgctcttttttttccttttcaagtccttgttttcgtgtatgtttatactagcttcgcggttcttgcttcatatgagaggtttgcgttacgccatacgaaggaacctagcagtgggtgtcgatcattgtggttaaggcatgtagattacaagatcctgctgttaacatcctatgtatcgactactttaagagcaaagggaagaaaatgaagtaaatggtgatgaacgtgctgaaaaatactgcgtacatgtttgaatctcttgtgattacgggtcccctcttaccattctgtccagctgaagaagtgaactcagatggtcttcgtttacttgcactggcaattggggcatctggcccatgataccaggcgtctcgctcattctgcagcacaaaaggaaaaaatattatattttgtttctacgaacatgaatattgaatactgcctagaacaagaaacaccagttaacaggaagcaatcccaaaatgataaaagatggtacaggctttgataatgataatggaacatgataatggatggtatagttaactaggggctcctatctaatttggaacattataatggatggcaggccagtgtttggacatgaagagtaaaaatcgtcctcaaagccatatattaagaacaagattcatggcgggcacataaatgacgctttactgcttaaaatatttttgaagttgttgtttgtccaaaaaaagagatccgtgttctctcccgtctgcaagaaactcaggattcaggcataataaattaaaaagaaaacaaatggtaacccacacctgtccagttgtcctgccttatttttaatattcataaagcctgagagtgacaggttccaacttatattaagtgtttccccatatctagtaattgatggcagatgacattattggtttcacacgatgccccgtaaatataacagttaaaggggcatatattttcagggcaaggactagttgatcacatattacgacagcattttcaatagataaaccgacttttaaaccaactattgtaatgaaattaagatgtttggcaagcatcatatgctccttgaccggcactcattaacttttttttctaacgtaaggg

SEQ ID NO: 52183 - DNA, 793 bp, Oryza sativa
tgataggcagtggaaaacgcccgacaggtccactaatgtagcatcattttgaggatctggtacttatttttgtttcagtgtgttggtgttgtttggcattagattgacaacatggataaggcattattatgtcattagaatataaatgatcgcttctgttctccttgtatcatatcatgctaaaataagtgatttgagcttgttcaccttgcttgccctttatatgatagtaatagtgtttacctttttttttttaatcattttggatgctagcctgctcaatcatatttctacaacagctagttcaggggaaaataagtttatgcctcgcctttttgttcagcttttaattgatggtgttgttttactgcttttgtgacataccatatgttttgatctgtccttaaaccactcggtacttgtaaccctgagcaacttagacccatgtagatgtaattttttctttctgacatcatagaacatgccatgagttcctgcagtactttaattgcatttgaattgaactgttcattttcattgtgtcatgttgtggaatgtctattcttcaggatccataccatggacctggtcaggcgatggggttgtctttctcagtaccagaggggatcaaaattccttctagcttatcacacatatttaaagagctgcaaaaagatctaggttgcaccgtgccttcacatggaaacttggaaagatgggctgtgcaggtaaggcggtttgataaacatccgaataaactgccctgagtccctgacatttgtaacaacatgcc

SEQ ID NO: 52184 - DNA, 8264 bp, Oryza sativa
ttctatgactgttttttgggagatgttgtctaacatgggaaacacatgttttacagggtgttcttatgctcaacactgtattaactggtatgattattgttcccatttacattgaaaactatttttatttttgttgctttgttagctcttatgtattcataatcttgattaaactgtgatgtaacttgtaggttcttttataatcatgaccacaaaaataataaagtgttgcattacacataggcctgttttgggagcccacgatccatggcccatccacagagatgggctggggattacaggctccccaaaggtttcttccagttgctactgtatcacatttatttgatgttgcttgtcctcttcctctagcttagtgcaaagtaatgcattcctctgttgagaatctttattccatgggaattcactattgtgatcttagttgctctatccttgcacgagtttcttatcagcactgaacaatcctacttcttaattttctatagtgtcaatctataatcagagaaataaaacatctcttttgttgttactatattgctaggataataatgtaaacgctaaacaattttcttactgaaagctccaactagaagtttggttgccaccagctgtgctgttctgcatttccagcaggagataaacaatactaatatcattaccatgttagtttcccattaaaagctactctcagtatgtgatctgcgtgaatgctgtgatagaattgactccgttgggaagttgatcttcgctgggtatatacatgctgatacattttcatcttgtcgggccagtgagagaacatcaagccaattcacatgcaagaaaggacgggagcaatttactgatgctgtcattaagacaatatcactgaagaaatctggaatagtctttattctctggggaaactcagctcaagcaaagacaaggtattgcttcgttcacatctgcaaatctgtgacttggaatgttggcgctatcaaaagaatattttgtaaaactggctattataatgtcagctgagagacaagagtacctgcatgctgttttgcagattgattgatgaaacaaaacaccacattttgaaatccgctcatccatcagggctgtctgcaagcagaggtttctttggatgcaggtttgttttcttgtcagataaaatgaactttcttcatttgtttctgtgagttaaaaaataagactagactctacataggagtaaaacatcacagaagggagagctgatatatttctgtaacttaggttaaatttgaatagcatacttcagagagaataaagactatgttacttagtataaaactgaattattatgattgttcagcacttgcatatcaggattgccctatatgcggcgccataatatctatttgatgctagacaacccaccaatggctggtatctttgttactgtagatgatttagtgggtgggttataatgatttatcctaagatcaactttaactcacctgcaccactatacaatggtactgtcggtccatgctgagtggtgctatactgctataaaccctcaatgcttttggccgtcttgtcctgtcttgtttttgccaacttgatattacttttgccttttcactcactagtgttaatggctagatccaaatgagcattagctcaggcacaacatatagaacgtgaattggatattggcatctcagatactgtttatggggccaattcaaatcattctaatgctacttttgcccttgtgattatcgttgaatcagcctgcaataggataaatttttattgatgatcgttgtgctgtgcttatcttaaacaggcacttttctaaaacgaatcagatcttggagaggctgggactatctgccattgattggcaactctagaccatttgaagacatcatgtggtctgtctgcctgacaaccacctcagctttgaaggtacttgttgcaaggaccatcgaattcggccaaaattttgtaggaccttaaattatatatggccgatcaaaatgctaatgtaattacgcagttcttatatggtatctaatgccgcaccgaaacatctaaattgtttcggttgtcgtatgtgcagctactttgcgtagcgcttgggcgccattttggtcgctttgttagatctgaagaattgcttaacaaccgtcctggcctttcaagttttttaaataccataaagccagatcgtccttcctcatctgggatccctttgtcctcttagattttgctcgtaggcctgtcaccaacccttagatcctaagaaattcccgtgctagagacatgtcccctcttttaattcgatgagtgccgcacctacgtacagagtgagtatttaaagcccgtgatgagcaggtgaaagggtacacgtctcgcacgatacctaccgtggctgtagtattttttgtacagcaggtggttgcctgcaaataattagacagatactccatgcttctagagcttgcagaaaaccggcacgtcagtcgccgtgtgtgcagccagagagtgacatgtaatactccagaaccgcagcgtaagcgttacaactccagaatcgcagcgtacgtacgcatcaggcatcgcaacgtgttagtccatccagagtccagatgctttgctgaaacttgacacacaaccatgcacgttgtctcatcagctcaaaccgggggcagtagaaaacgacatggtggcattccatgtattgacatcgcatccgatccttccggctccgtcaagtcttggatagattgtgattgtgagatcgatgcatcctcccgtcgtaatctctcggcctcacatcaaaattttaagtattccattccacggggcaaaatcaccggatctttgcagatctgcaagcgtgacttccatgtttcacccagctccatctcatgtttgataacatgactactaaatcgcacctacgtacgtacagtgggctccattgcaatggaagcatcgcaagtcgccgatcttggaaaagatcggcacgcacttggatggaagtctagcagcaaagcagccggtctcttgcactgttcgcaggtcgttctgaaagcgacgaggtgagctagctcctgcccaatctccttgattgtaccgtgcccatttgattatcattacgccctggggacatgatagcatgtacctgtggacgcaattgacgacctgagacgctgtacatcgtaagctcacctaccggtcccatgcatggccggtgtctgcgggcaaacgtacatgtcaccgtggacccgtattttatgttttcactctctagttccttaccttcttcactgggtgaatgcacgccacatgcatggctgatattctttttaggaaaaattggaaccatgccattatacttctttttaagtagcttatggtaaagttttaaaaaatatatacggagtcctataaaaaccataagattgtattcccaaattatagactcatcagctaaattaccattagctgtttcttactaaaatctaaaagcttcgggcttgtttggtacagctccaactcctaaatttaactctaggagttgagtctggagtagagttgtggagctgcctaaacccagctccacaactctagtttattttgtgagagagctccactcagctccactcctagttttgattgagccgaaactatttttggctgagctccagctccagaagaggtgaagctggagctaaagctgtgccaaacagtcccttcctttgaaaccattagctgttactgctggtgggtagatctctctcctgtgacactcaggactacagtggtaagtaccgtactagtgttccctattctagtaggggtccggatgagcccaaccccgatcgaccgtgccgatcgatccagccagtggcagcggccagcggcatgggaaggccaagcgtccgcgtcggcgctggccgctatcaagcggtcgggtggcggtccaccgcgcgagatctcccccgcgatcctgcggtcaaatcccccgcgatcgcgttcgtgtcgcgggcgaggcgcgaggcgacgcgatccccccgaccaatcaaccaccagaccgcgcctccatgccatgcaaaacccgcgcgagcgagccgcgagcgctcatggtttccacgcccacgtttccctcgtggatatgccaaatacgagagagctgtccagttcatttctatagagttttggatgaagataaaaattttcatgacacgttttttaaactgataaatagtgtgtttcgtgcgaaaactttttatatgaaagttattctaaaatatcatatgaatatactttttaagtttataataattaaaacttaattaattatacgttaataccaacttattttacataagtagattgatctttatttttatttttaagagaaaagaacaccaccgtagcctggtggaatgtggatggctgcctgccgttttgcatgacctggggctgggattggagtatttggttccacctgacggcaggtagccccaggtctcggttcttctcgcttgtcgcctctgccctctcgattgtatgcgcggtttgcctcgctcgtcgtgatccctttcccgtaatccccgagatttggatgcttctccatgggatgacagccatgccaacgccaacgccaacgcccatggtctggccatgcaacgatgttcagtcatggaggcctcaaccgtagcacgtgcctagttgcaccggacacgtctatggcctactgtggacgacagggtaaacttcatgtacgacatctggggttctcaatttgcatacactgtacacaacctgacagctctgcttgtgtcgtccattctacgcgaatgcgaggtcgtcattcattttcatctactaatgtactcccatctggtaaatgcaatgtgaccatgtgctgcacctgtttttcgtacaggagtgcttccgtttacaaataaatgacgttgtaaaatacgtgccgttaaacctcaaaaacttaaatatacaaatattagaacttcacgcgagcaggagcggatccagtatatggtagcggggtctcgagtctccactattagcgtgaagactctaagagccctgatgaagccctcaccgctattttttttaccatacatagatgagagagatgattgtagctttatctagtttgttttctggattcaccactgcacatgagaaaataccgtggaggtgtttggttcctagctacattttgccacgccatacttttagctgcaaagtatgactggtaatcaaacacaccctgcgtaaagtagttagaaaaagtaatgacaaaataattgggaaactattttaaactctcgaggagatatttcctcgttgtttgcatatcactcaaatggttatattttttttagaaaatcaacaagatagattaacatgtgacagatcattccacaaacatgaaatgtaaaattaacttctacatgttacaatgaaaaaacatttttttcgaggaaaaataaatttaattgcgaatatacattaactagttgtagtttaattttttttaacatgtaaaatttgaatttcaacttgcatatttgcagagtgattatatgctatacatcttcttaatttattttataactacttgagtgacatgaaaaaacgagtgaacgtttctcgagagtttaaaattcactctccgaaacaatatctactagtactatataatatacacatcaatacacatagttagagaggtagcttcaggtggcaatgtatagacctaaacgtacatctgattgggatcgtatgacatgaaatcagaggaacgtggtcactgacaggttaggcccaccgcttatgggccgacctatcaatgaccacgttatcggttagttcacgtcagaggaaccgcttccacgtacaccataattaagtactcctagcttaggggatggaccagttgttaaaaagaggatcccacgaaaagcagcggccgtggcagtggcaactggcaagtagcaactgaaccaaagcacacagggtttactagcttagtttaagtacaacgcccccacctccccccgtacaccacgtaccacacacgggatacgatcccgtcgggtccccacacgcgccgcgacgcactctcgcacgcacgctacacgacccacccggaccgtgttgcgtgcgcccgtcgctgtctcgtatctgcatacggcctcggccatcaactctccccgtacgcgcgatcgatgcgtttggttgggtttttcccgtagagaatcggaatcgccagtacgctcgatctccgtctagagaaaaactgatctaggacgagatatgacgaactactatctccgttttattttaattgtagttaggagtttccgtattcaacgttttaccgtttatcttgtttaaaaattttttatgattggtatttttattgtattagatgataaaatataaataatactttatgcatgacttattttttctaatcttttcataaatttcttaaataagacgaacaattaaacattggacacaaaaacgacaactacatttatattgggccggaggtagtattagaccacccgcaatggtaaaataaggtgctctctataaaatatgtacatctcagcaatagattagattaatagtaaaccacctcaatagtatgtctacatgggtatctatagctctctaatccattgcctcgtttttctctatagactatccccagattagtagatagttttactctctctcttcatttaatctcttccaagtaggaaaatatgctgacatgtatctcttgtagagagcttatagataaccattgtgggtgcccttagggaaatttttataatggaggtgagtgccatatctaatttaaaccatgtcatattctcattaattaagaggtaacaagtacaacatgccacctatagttcacaaaccccaacattaatttactctcacatcatcttatatttttcttggagattgtgtggaggttgccccttacatgagaggtggctcattttctctctctcctaacttctctcctccaactcatcacctaatcttagggcatgtttagatccacttggaatggcaaatggcaaatggcaaaagtcttggtggcaaaagttttggcattacaaaagtactagttggtgtttagatgcatgttaaagttttgtcattctagcactaaagtgagagagagaaagagagagggagtggtcccaaagcactttttggcacaatttgctactatgtactagcaaatgccaaataccaaattgccaacttttgctactagtgtttagatccaaaatggcaaaaagtgctataaaatgacaaaacttttactattttagagaatctaaacagtgccttatgtggtaaatttaggggcaacatgcagaggcttatacttgcccttatacatttttccattaacgcatttaagatactgctactgtagccgattggtcatgtgacgttcagttggagcagtggtgactggtgaaattaatggtgcccggccggaagagtttagtgaccgtcttaaccgtgcaatgcaatcaatgcaatgtcgtcaagagaaaaggaaagtttctcatcaagctgattccattcgtgccgtttaagctagtactaattcaacacgaatttagacccaaagaaaagcgatttcactatcaatcaggatttggagtacgtgcaggttagattttgagtgtagagatgcaacgaggagcagacgagagacgacctgtcgtccagggaaaaaaaatgtttgatttatctacacaagtgaaacgtccatgcgtagcaatcaaacggagatggacaaaagaaataaaaatgtttgagtacatcgtttttaaccagtaaacaaatcaaggtcaaagtcagacgtgctcacacacacagctgaagcgatcaagcaaaaaaacatggcatggcatatcgcacagtgttttcgtggacttttcctcgcaagcaaaccaaaaactattccaacgaaccaacacgtccaatccaggctctccaactttgacgttccagaaaatcgcaagaaatcagaacagttcctgtacctgacctaacagttgctaaccaatctgaatgcatctctctctctcagatttttattttcttcaaatctcttttcataatctggaattaacacttgtacattccaaggacatcagggctgagaggccacatgcaatgca

SEQ ID NO: 52185 - DNA, 2020 bp, Oryza sativa
tgatacggctgcagagccgcgacacgtcggaggggcgtacgggcttgagcaggaagtcctcggcgccctcctccaggcaccggctgatccggttcggcacgttctccgacgacatgatcaccaccgggatctccttgagctgagacgattcctgcagcaagaaccacacacgaaacaaattcagtctcaagaaattgggggttccacattcacatggatcatcgcgataattcgatcgaatcgaatttaaattaccttgacgcgcttgaggagctcgtagccggtcatgccgggcatccagtagtcggtgatgatcatgttgacgttggggacgaagccgaggcagaggagctcgagcgccctcgtcgccgactccaccgtggtcaccctgtacttggagctccggaggatcttggcgatgacggctcggtccacggagctgtcgtccaccgccagcacgtgcatctcgctctgcgcctagtcgccggccgccgccgccaccacaaccggcaccaccttcctgtccccgccgccgcctccgcttccgcctgccctcggcgacgtcgccaccaccaccttcgccgccgccggagcctgcgccgctgccgccattgatcaactcaaaatccaacccaataatccaatccaagaatcctcgagcgattgagtaagcgagtaggagaagaagaggagaaaggctttgcggttgcaatgagttgaaggcgcagccatcgctggcgtatatatacaggcggggtgatatgcgtgtcgtgtgactcgtaattagaaaaagaagaaaaagaaaaaagaaaaaataaatgggagaaatcctgcgagatctccaaagggatccgaggctcggggatcgagtaaaccccccctcaccctcacagcgggtggggcccacacccacacggctcgatccggggacgggatccgcggggtccacacgccagacaccgccaccccgcgatccgcctgggattttcgggcttggttggtttcgtaccaatttgtagccctaccaaattcatggtaggttcaatagtaacaaatgtatatttagtttgctatcaattttttgacacaatagtttaaactcaatagcatttaatttgatagtgtcaaaacttgtcaagatttgattttagcactaccaaaatttttggtaaggtcaaaattggcttcaaaccaaagaagccgttcctgcccctctctctcccccgtcgctttcgcctcctcctctcctctcctctcctctcctctgcgtgcgcagctgtttttcttttcttttctttttttttttggccttttgatctcctctcttcttcttcgcttttgaatgttcgcttttgaatgctgtggttgctgtgctgctgctcgcggtatcagaaggcgaatccgagagttgtttacgtgccggagatttgcatgcatgggtgccgcgtgcgattcttctctgcttttttttctctctcgattgcacaatccgcttttgattggtcttggatttagctatccggtttggctgatttagttcagttcaaataggattcgtcgatatccaaatccgtatcatcgttgatatgttggttcggaagaagttttgttctgatctcttctgcagtgcgggtttgactgatgatacagatcgcttgtttttaggcgtctctgtttgaaacacggttttttactattaaaaaaaatggagacttaacccgaaaggcaatacggagtgtgaaccagacaatgccaacatctgggagaggattttgtccttcggagattagcattcctgaaaggtcagctggctctttgctgggaaagattaaagaaatatactagtactaatcgcttctcctgatggccatatttgatttgattagtttttagtctgacaaaacctcctggcttctgggtcagcaacaccctggacccgatctcctctggatgccacacgatcaaatcaatccatccatgtagtgtatcaatcagtcgtggcgtgcatggcaggatccgc

SEQ ID NO: 52186 - DNA, 9740 bp, Oryza sativa
  unsure (1)..(9740): unsure at all n locations
ggtgcgtaaattcgagagatcggtgtggagatctgctagctgctgctgtgtcggatggatggatggatgaatgaatgtcacggtgctgctgctcgatttggtcctataccaaaaggacagatcggataattgtgccagtaggagtagtagtagggtgcatctgcgttttctgcgatactctccgtgctgtgctgggcctgttcatgttcagaagatcaatttacggacgcttgagatcggaagcaatgtcctttgtgatcgtcctccttcaatgtgtccttcccctgtctctgtctcgattccaacatcggatttgacttagacaaaacgtgtatctttttatccggagtactccctccatccataattctgggacgtatttcattttttatgaagatcaaagaaaaatcagctcatcctatatgtaataaaaatcaagaaatatatacatccatgcaaacagtaagtattaagatagccacttaagtttcaatcaaccattaaatttatctttatttaagttttggatacatgatgattacaaatatgactatctcgtttaaagaaaatggaatatacttaaaacttttggataaagagatagtatttaacttgatcaacaacaaaactgacacatagcgacataggtggtgtttgaatctactgaagatgaaaattaagtgtttcatgcaaaacgaggtgttaatagcgtgtgattaattaagttttaattattacaaacttgaaaaatggattaatctgacattttagaacaactttcatatagaaagttttcgcacgaaacacactatttagcaatttaaaaaacgtgccactttaatacaaaatttaatccatccttttcattacattagaacagggcctataatagtatttctactacccgtaataacttcttacagaattaaagccccccaaaaaaattaacattttgtttagattctcggcttctctgtattctcacctgttggattcacaataactgtagaatataaagtttcctaaaggttgatatatatgtgtgtcagttttacaggttatgaatacatcctatacttatatttctaactaccaggaataccacatanttgatattatacaaaaggtatattcaaatatgaaaatatactatttaagaatggaaactccttcaagagtaaagtccatcaccggtccctaaacttgtaccgttgtgtcatcccggtccctaaactcgcaaatcgactgtttagatcctcaaacttattcgactgtgtcatcccagtacctaaacttgcatattactcgtttaatttctctaacttgtttagtgagaatagaagatgtcagaccccgatctgaataaggtaaggtcttttctgcgaagttctatttgaacatgaagttatttacccgcataaatgcatagtttataaaaaaagttatttacccatataaatgcatagtagtagagaataagcaagttgtgcctacttttagagattttctgactccgcccatgcctattaattgcgatgtgttatatgtacacttgactccattgaccagttgctagaagatctccattgatattctacacgacaaaagtttcaggaaattattagccccgtatcgtggtcccatcagctggggcacatgctccctccctctctcctttttggataatattttcttcacgacagaaaagttcatggcttgatgccattgccgccgattcggcacgtcaggagctgcgaattccgtgtgcttttgcaggaaggccgtatctgtgcgcttgcttgcgtcaaccacgtatccgagcggattctcagcgtcgaaacttctcacctgtcgcgttgaaaagttttggttgaaaccttctcctcctccaactaccttgtgtgtctggatgtaaacctgcattgacctgtgaccccagcagcacacactggtcccctttttcatttctctttcgtttccatcttctcaggtggcctacgcttagtcaaacgttaacggagaattggaattaagggaaaaacaagaaacggtctattgccgatatggccggcagtggtatatatctgactatcttgatcacatgggagctgtatgatcatgctagtatcgttttcatttcggtcctctagaatttccgttcactccatggcctgataggaacagtgaagcaagaaaaaaaaagaagaagaaaaacagcgggcaggctgtggtcggctgctgcacctgcttgccgaagaggtctaatttaaatgggaatgtgacaccacataaggtaacgaataatattacacattaaatgaaacacgtgttatacgattgagtaatttgaaaattttagtttttttatacgatgatcattggtcatggaacggagagggcgaagtactaatttcctaggacttcatactttatggtcaatttcactcgtaagcattaaccgacttgtgtaaaagttacagagagtaacatggacatgatttgttaaccatcaaatcatcgattggattatacagatattgtcataatctgaaacgcatcgtgcaaaaagaagagggagttggcaacgtacggtgcacgcagtttacaaaataaaacgacggattgagatatgggaggagaagctncaaatcggttntgcttgatcgtgttggatctgtgcacgccatcgatcagtccgtttggcatgtgacggatacggagaaatctgggtggggtgtatgtacaagtcacaattcttcgcagtcaggaataacaatcgtacgggcaatcgcatctgtctagcctttgcccttctttctcacttgcattttttttttaaagaaagttggtacgaacaatcgcatcattcattccttctcactcgtacgtatgtgttttaaacgtaatatttacaanaactanatgtcgtttatcgatctatcagaaaatcataaatttaagaacgtgtatgataaagtacagatttaacatcatatatttttttttataaaactacatatttaagaatgtatatactatagttttaactatttttttaataaaattgtagatttaacgtattgtataaaaacaacagatttaacatcggttttattgataaaggaacatattagaagggttcttaaataacttgttgaatgggtgaggctccgaactcagtttatctagcccaccacctcgtggagctagtcagaagaacctgggaatttcttactgtttttgtctctaggttctacatcatgggaagcatcgtcgcagcttgtgtcgatttggatgtcagtcattcccttgttctggtacgcagatctggtacagctaggctgcagctttgagtatcttgcctcgaaggggaagggaaaggagaagagcagctcgctcgctttctctgaaactgtgatactcctagataacgcaagcagaggcttttctctgaaagtgtgatactcctatagagaacgcaagcagaggcaggcgtgatctgcatgcaaacaatcacgccagccatgcccacgcattcctcttcttttttgtgaatttggatatgcttcccgagaatcacaagagtagtcggcgtcaggaggacacggtggacaggagtagtactcctactccgggatatgttcactgcggcaacctgcagctcaagttgcgagtagtagatgtggatggaccacccgggagagtggtagtaggagtagatgaggagatcgcggcaacatgctctcgtgccggagaatcgcatcgcatcgtatcgaatccttgccgctgctgctgctgctttcggagatagagatagagaagggctcgtttgcccaagtcatcagaacccaagtgggggcgtccggtacgagaaggggagatatcgtcagagaatcggttgtgctgctccacattgggaacagcatttacaaatcatccgtatccataaaaaagctcactactgctcctagtaggagtatttactattggtaccgtgatcggtgtacgttcttcagtcagaaacaacggcatctctctcaactctgatgatcgccgtagtagcactgacgatggacaacgccgacgccggcaaaatccaacgatatcaaccgaaaatcaaccgcatcggagataagttagaccactcaagcttgggcgacgggaagcatattgagaaattgttgtcattaaaagttgaaaggtcttatgtgtaaagaaatttccgtcaagaattgtacagttcttttccttttctttaaaccttcggctgggtggcttgacccctatatcaatataacaccaaaccaatctgtttaggtgtttgaaaaaatcatccaagaagatggcaagcaagaaacggcggtggtggcaccggcgcgccatctgctcgatgccggtcgcgcgcctcgaaactgcgcgcgaggcggtcaaaattactcgccacttgcgtttgctactcatggccggatggtcggcatggctcacgtggctgattatccttttgctgctttgcggaatgcggatttgcttatcgccggagattgatgagactgcatcggtttcggtggcagatccctcgccctagagccgtacgcactgcacggcccagaccaccgatcaagatagtactccctccgttccaaaataaatacaaccatagttttccgtgtccaactttaaccattcgttttatttaaaattcttttgaaaaaaattaaaaaaataagtcatgagtaaagtactattcatattttatcatctcataacaacaaaaatactaattataaaaaaaattaaataagacggacgatcaaagttgagcgcggaaaatcatggctgcaattagtaaatctcattgtcatcctggcctgtcgaatcttgatcggttggtgagaaaaaaaaagagatctagagcaattacaagagtaggctataagttagttgtaaacacatatgacacatttatagagaagagaagagaagaaagagaaagaaagcggactacaaatttgtactcttgtcaactgcagcacgaactctaatacgttgtgtgtgtataaaaggtgcagtgggactatatattaatagtttatagataaatattgtatgaatgagctattaaattgactatagatgatttgaagctagtagttggctatactattaaacttggtcttaaaaggagatagtccctctaaacatttattaaaaataaattattcgtgtattgatgattgaacacaagatttcgagattgaggggttgtttggttcaatacttcaacttgccacaccacattttaggctgccacacctccttagccttgtgtttggttcattgccatagttatggcaagccacactttcttaccatcttacctcatatgtcatagacttaattctttgcctaactttgccacaagtgtggcttataatttgtaggccacaaaagtgtggcttgcataacattgtctaaagtgagttatggtaacgttagttaagaaccaaacagcccttgaaaccacatattctctccgtccctaaatataaggtattttggtaggatgtgacacatgatgtgacacataacacattctagtatgttcatattcgttatattaggatgtgtcacatcctatcaaaataccttataattagggacgaaggagtatcttttatcactgccctgtctagtgcatctagatcggtcggtgagacgactgtatgcacgactccttccttccattcttcatctcttgctttcaccttgtcaaatctcaaatataccaatgaacatgcgtgcagcctgtacatacacagtatgtgggttgttgtctgcaaatcctcaactgttccggcgaggcagtttcgctgtgttgagttgagtgactcgaaagtcaacatgaggggagctaatctgcatgtcacaatattctcgagcagatcataggatcgaagagaatcgccacgtcagtgaattttgttgtttactagtgcagctaaatgggatccgcatcaggacgagccaatgatgcaatttccaattccgtagtcgatgtcaacgaggtttgattaaggggagtagtatttgctaactagtactagtatatagtagtattagtcacgcaacatagttgaattcttttaattttgggcggtcaaagtaatatggtttttaaactctgaagatgatgtgcttgcgtctggtgatcttgttactagtttgatgaagccatcggcattgtcaaataccgaagtagtcagctcagaattaagaaatgccgagacattctgttcatggtgagctactattcggaagacccgggcttcagtgtctgggttcagaaaccctccggagctggagagatttcatgagatattcaatgggattttgacagcaacatttgctcaaaagaatagcgaagcaatcttgacggttccagtttgaaatccatattgcattttttgtggtttggtcgtgtcaagcgcatctgctggaaaaatctgaaatgtagcaagtagactagacattagagcatctccaacagtctctgcaaatctgactctccaaatgtctatttggccaactctccattaatttatcaagtcaaactcgttgtttactccaacagcctccccattcaccctctctattctaagtctattacagtgggacccacgcgtcagtgtctcaacctttccttcttctcatctttctccccctttccccaagctctgctggtctgcccccatccgctgacgccatctaccgccggcggcacctaccgtcgccaccatctaccgtcgccgccgccactcgggctccatctccatccactgccgcggtaccgccattcgccgctgccgctcgggttttgctcccatcactcgccgggcgctcgggctccgccccctccatcaccgccgtcgctcgggctctgtccccatccactgccgccatccgccactcgggctccgctcccatccgtcgccgccattcgcggccgccgctcgggctccgtgcccatccgtcgccgctcgacggcgagggacgacgaagactacggtgacgacgacggcgagaggggaaaagccagcgccatcaagccgtcgccggcagtagctagttgcgccgattgcaagtagtaggaggtgagagagaagcatcttcaacgtggggcccacaaatagcaaggcatttgggctggccaaatttggccattgaggggaggagtttggccagtcatttggcttagccattctagtagagaggctgttggagtaggatttttttgctaaaatggctaaattttaacttggagagcctattggagagtttgttggagatgctcttagtagttttatactgatttcgctatcaatattattccagcaatcttctaaaaataaataaaaggaaaataaaggtttaaattgaaggcttcaattgactagctcctcccacaaatgtcagtcatatatttacagcctgtcaaggcccattcaactttggaaaaatcaaacatatttcaagtcaattatttttccactatggtgtaaagaaaacagtaaataagcccctacttccagataaacttgagcatgtgttgacaaattgaacactcaccgtttgactccaccacaatagttttgaatcccatgacaattttttttgcaggaaagcatttttttcctcattgggccgggacaacaacttcgaaggcccaaacaagtgctgtgcaattacccagtgggccagaatcaaggcccgaatttctgcatatgtgggctattcagacctgtgccctaattcaaccgtttggttttactcagactagacatagatattagcccataattatgccacttttgggctttaggcccctaatttttgtctaattatagaaggcccatctgcattaatgccaacataataaacagatacactatattgtgtcctttgaaatctgaaccccagggaatttcggtaccatctctggaaataagctatagaaatattttgaattatatactttaatggcgatatgagctaatgagcagcataaagttataatatacgcgtactaaaatagatggcgaatctagtcgttcaaaaccaccagaattattgcgatcgagaacaagtgcaatcgagagaatttgatctttgctttcgagtcaacatgaatacggatcccccccacgctttgtgggctgatttctgacgaaatttctcaaaagaggaacacactgcttgatgggaataacaatcgctacaggcctacagcgcaggcgaacacatattcttcccccaattaagtgatgatctggcagtttcctcgtttgagccctgggagttattccgcaagactgtaaggctgatggcatcatcaccacctgcttacgaaaaccatttacttgggatgctaaaacttggagtcactaattatgcatgtaaatatttgtcaagtttagctaaagatttacaaatagatttaaataaatatatttctccttatgtgtttaattaagttattaattaattctgtgcctttttttgtattttttatttgctctttgtttagtgaacattgggcctgttcggctacactcatgcggcggtggtgcaactggccggaacaatgcttgtataagcagtttgtggcaacaataatgttgcagcagagccgaacaggcccattggctgcaataagtggttgcaatttatttgaacaaagatcaggatttgtttctttatagaaaaaggataaaactatatactcgcagctgaaagctctagcctggagagctcctttaaaatataggaattttgtttgataaggtatgttctatattttctatgcaatttattgcattacaaacacggtgatcatcctaaagagctaaaattaccacattaattacatatatttttaaagatattagatcatgcaggatctaatgtttttttaagataatgtagattggtagttaggggtgggcagaaaaagaccgaaccgaaaagaccgagaccgagaccgagaaattcggtcctaggtagtgaaagaccgaattttattcggtcaattcagttagtctcctcgggtaaccgaatagaccgaattatcaaaaaatgtctaaatgcaacctacaatccactatgtttaataggattaaaatctaattttcacgtccctacttcttctaggcatgcaacctaataagaatctttactcataagtgcttacgattttttttttatgatttttgtgttgaaaatttccattatttctttgtatatatgaaaatattgttgaatttcggttaggaccgagaccgagaccgaatttgtctgtactaacatttttgcgctgaaattcggtcttcacttttcaaaaaccgaaaagacagaaagaccgaagaccgagaccgaaattttcggttagaccgaatgcccacccctattggtagcaatagttgtatgcaaagtacaattgtactacctccgtcccaaaatataatatttttttgctatgaatttggacacacagttattcagattaatagctaaaaatgcttatgggacatagggagtatatgatttcaatttaactagcccacgcaaaatcgtgcatggaagttccctagtttgaattaaattcctctgttataacggaccatgatcatctctgacggcaagacattttttttgaattcaaaatatgtggctatttatatttg

SEQ ID NO: 52187 - DNA, 1661 bp, Oryza sativa
agcatgcgactgcaacgtctcgtcttgttttgctctcgggtgttttgtctgcttgctgttcctgccatacaccgtattctactgtcacttggtacgtacgggtagttatttttaaatgaactgtaactgttgttttaggaagttgttagggaaaactgtgattattaagccaccggaagaaattaaagatgctaccactagcccctttacaaaggtgagataagctagactactggagggtagcttggggcccgtttggtagtgtaaatattttgggttgtggcctatgaacagaaagaactcgactggtgaacgaaaaataattttattttacagtaagacttttgtacttatatttaaaaaccaaagttaaatgatacaaataacaaaaaaaattattttcaaagttaaattccaaaatttaaaatttgttacggaagtactccatccgtccaaaaaaaaacaatatagatagggatatgtctacctaagacaataaatctggacaaaagattgacaagattcattgttctaggtggagttacatccccacccacacctaggttgttttttaagaacggagggagtacagcttaggtcgggttattttagctcatagcctatcaaccggttatttaatgtgtctatgctttgaaaagtgtgctttctcaaaaaaagaaatctataaccatatgtattgcttagataactttctgaactactccatccatctacttttgatagtcatatttccaaatctaaaaattttatttttgataagcatatttcacttcaacaacctatcgtcttgatgagtttctcggatttaatgcatgactcttcattcttccacacatgattggctacatgggcattgagaaacgtaaatatcaatgaatcgcttgtttacgaggaataactagtagcatgtttatatggatgataagtagaattacttattcttagtctgtgtgccaagatgaaatatgactatcaaaagtagatggagggagtattataaactttatgatgtataattatgtctatatatattcatgcatgagctttcgtgggtatttaggggatgtttagatccaggggtgtatagttttggtgtgtcacatcggttattatacaaagtatcgcatgtggtgttcgagcgctaataaaaaaactaattacagaatccgttaataaaccgcgagacgaatatattaagcctaattaattcatcattagcaaatgtttattgtagcaccacattatcaaatcatggagcaattaggcttaaaagatttctctcgcaaattagtcgtaatttgtataatttgttattttttaaactatatttaatactttatttaggtgttcaaatgttcgatatgatagggtataaaattttagaatgggctctaaacacccccttaagctaaaaacaacattgtctaaaggtggtttccgcagccaaccgaagccacatacgatgaacactgtgaaccacacaagggaaagtattcctcttgtccggccggtatatatatatgtacacatatatgcctttttataactttctagcacagcgatgtgcataccacagaaaggagaaagtactttgagtgacgtatgtggtgccgagtgccctgaccgtctcccagttgatg

SEQ ID NO: 52188 - DNA, 1313 bp, Oryza sativa
tagctgtcctgggggtgctggctgccagttgcgtcaacggcagatgcgatcaatgtcgatgcagagatgcaagttgcagcatgttggcgtgtcatgccgaaagaagaaacgggcccgcgtttaattagccaaattgtcacaatgcacccggctttttcgccgtactatagtgacctcaaacgcatacaagaacaagttccatttcccatcttgctctctccaagttaatagtagtagccttctgtgtagtcaaaatttaaaatctgaaactttgattttaggattttttttttcttatcatagtctatttatcaaccataatttgttagccgctaattatacatgtataagttaatgttttacatatgaattattttcagttgcttcgtttatttatctttacacggctgaggcttatcacccgtagctcaaccaattagtgccgttaaaatttcgcaacaggatgtgaaattatattatttttttaaaaaaaaagattataagataaaggtaagattgtacagtcacactagcttgcctagtgttgagacatttgttagggccttagggcatgtttgcttcgtgccctgaaaaatttgtctaactcaggcacaactctcaggcgtccgattttgtgcgcccgcgactggatcgacctgcctgagcgagagcccccggaccagggcagcaaccaaataagcccttaccccttgcaagtgcttctttgcaacaatatggaatgtgtagcgagcagtgagaggaattttgcattggtacatccctggttcatttgggttgttaagacaacaacaatgaaatttagagttggtcccattttccatactgctccaagttagattggactactgactatactgtactagtagtctttcattgtctgcttgttgacttataagccacaactaattttagaattgattttgggacttttcaccatggtctattttcagccttaacttttaaatcactagttatgcgatataaaagtgttacccatgaacatttttcggttgcttcagttatttttctattgcttattagttgtagctcaagcgatcggggccatgagtaaaaatacttaatagcaggatatgaaatcaaactattattttttaaaaaggagagaaaagataaaggaaaaattatgcaatcacattaccctagtgttgagacatttgttatggacttgcaccttgcaaaagtgtttctatgtaacaatatggaatgtgtactgagtagtgagaggaattttgttttggtaaatcccttgttcactaacaacccaaatttgt

SEQ ID NO: 52189 - DNA, 820 bp, Oryza sativa
gatgacgtcctcaccccacccacccccacccacagccacgagcaacgagctcgacgctaggatgggcggccaactcggcgcagggggaggcggcgcccgccgacggctcccacggcggcggcctcaccggagctccgccacgaatcgaactcgcagggttgagatgaagaagcggaagaggcgcggcggtggcgcctccgccgccttcgaccggagcgtcttccccatcctgctcgccgccatcgccgccggacagcgctaacccgcgaccccgagcagcctccgccaccgttcatcgccatcccgccgccccaagctgcgtccgccaccggcgccgtccaacaccctcctcggcgccgcccgctgccggcacatcacgcgacgccctcgtcggcgctacccgtccctgcgcgccgctgcccacgcccgtcgccatcccgcccccccaagctgtgaccgcccccggcgccgtctaatgccctcctcggcgccacccaccgccgccgcatcacgcgacgcccttgtcggcgccgcctgtccccgcgcgccatcgcccacgcccgtccccacgcgccgccgtcttccgcgtgtgcccgcacgtcgccacccatcgcccacgcccgtccccacgcgccgccgtcttccgcgtgtgcccgcacgtcgccacccatcgcccacgcccgtccccacgcgccgccgtcttccgcgtgtgcccgcacgtcgccacccatcgcccacgcccgtccccacgcgcctccgtcttccgcgtgtgcctgcatgccgcccgccatcgcccacgcccatccccatgcgccaccgt

SEQ ID NO: 52190 - DNA, 712 bp, Oryza sativa
aagcaatatgccctgaacttcactggccatcttactatctttacgaagcactggctaggaatttgatggttaaaaatgagcagcagacgaagttaactatgcatattaagagattaatgatggatctggatgattgccgaatcagagaaacttgagatattcaaacttcagattgatggagtatcagctgtctaaagttctgaaacaaaagaaaatgaattaataaatcaaactctaaagtgctatgcttcaccaacaaaggaagtattgattcagatttcaggcaccttgcatggtatgaacggcttgattgagacaggttgctctgaagtccggggtccttatgccgttagttaaaactgaacatttaccgagataactttgacataatgtcccatagaagcaaatatcaagactgaaaaatgtgtaacccatatactgaggaagctcttgtcagaaacaatatcagatagtactcaacaagcaacaacaaaattattgagaccattaaaaagggcaacatggaaatttagctaactcagaaaatctcacattttatgatcaaagttgcagaaaaccacatatattatgatgtgtggcacacaaccacatgtattatggtctaaatatttcataaaaccccacatttattgaaatcttgattaaggccccgtttgatcatccctttggcagatagatttttgacgcaaaa

SEQ ID NO: 52191 - DNA, 1117 bp, Oryza sativa
ctcggtaccccacggtgtacttcagcgacgccagcaccaggttcagcttcgacaactggttcctcgacttcttcgagtaccgcttcaccggccgcctgctcaagtacgacccccgcaccggcgaggcctccgtcgtgctcgacggcctcggcttcgcaacggcgtcgccctgccgcccgacgaggccttcgtcgtcgtctgcgagacgatgaggtagtaacaagctcaacttctcatctgtgaaatgacacgtgcagtgacctgagtaacattttaaggttacgagtgcaaatcttcttaggaacgaatttcagattggattgtttgtggggctaagttcctaatttaaatggctgcatatatctgattggatgtagaatctggatagaaaatacccttatctaaaataataataaaaaacgagtaattttacggttcataaggatgtaccctgaggtaaaaaaaattagtataaaatttggtatcttatagtatctagatataaagagatatcaaattaaaatagaaaaaaaatagtatctcatgtatctccttaagaacggtaaaattgctcataaaaaaaagagtctgttcactctatcgtcaagtgaccatgaagtgatattgtcaagtgcaggttcagatgcttgagagtgtggctgaaaggggagaaggctggggaggcagagatcttcgtggacaacctgccggggaatccagacaacattcggctgggttcagatggtcacttctggattgcccttctccaggtctctgctctctaacctttctgctgccataagcatctacacaacattttcagtgctcaaacttacaattttctgtgctcaaactgcaggtgaggtctccatggctggacctgatctctcgctggagcttgacgaggagggtcatcgcgtcgttcccggcgctcgtcgagaggaccaaggcgacgctcaagggagcagtggtggctcaagtgtcgttgaacggcgagatcgtgagggttcttggtgactctgaagggaatgtgatcaacatggtcacttcggtgacagagttcaacggaaatctccttctcggcagccttgcgaccaacttcataagaaaattatcc

SEQ ID NO: 52192 - DNA, 1142 bp, Oryza sativa
ttttgcataacttccatgctgtaaaagatttgaaagactggtgatcgtcctatatcgagcactttgttttgctctcgtcattcacctccgcgtgcgcttgaatttcactgggtgcagagttacagttggatcccctttcttgataaatccaagctgacaagaaagtttgacttgcgtcgttcagtataatggcagtgcaaatatttcttaacgttttatttagagaagttttacattctttaagaattccaaaatttttagtacattttttttaccttacactgggatgtactaaattttacactagaaaatatggtatctttcggtatctcctcagaaccgtaaaatcactcttttatttaacaatagtgagtgcaaacagaacatatctacaatagggctaagaatgagcactacctcaaattctcgggcatagaaatccccctccaggacatgtttcaacgcagattttgccaactggaaacaaaatcagtaaaaattaatcacaaaggggatcaaaatattggatcaccgtattgccaactggaaacaaagtcagtaaaaattaatcacaaaggggatcaaaatattggatcaccgtattggatagggcttgtgactacaaaagtgctaatgtacaaataaatacgcaacagcatgagggaaaaaagaacttgcaggcatgcattattgacagtagtctgtcgaagatgctgcacagatagacatcccaaaacgcactctgttgttaaagaaacagctaaaacttcatgtggtaagcatccaaagagaactaacagagtggtgcccttaataatgatgttctcaaattcagcttcagagaaaagggaacttttgttgtgttaaatactagttactagtatttaagcatgtatgagatttggatatcttgtactgtctgcaatgtgtggcttggtgttgaaccatcacatttcatatgaacatgttactgtaactaaaaaattcaataacattttttccattacagatcaatgcttacctagtttactcactaatctgaatgccattttatacatttctagtcagcattggataagttcaatttcatggtttgctaagaatagtaacacacaccccttttgttgtgccagatgatagag

SEQ ID NO: 52193 - DNA, 2696 bp, Oryza sativa
  unsure (1)..(2696): unsure at all n locations
aacatggtttatcaccatgtgtatacatactcatcaaaactgaataagagtagacatttggtgaaggaccagtgctcttcatatcatcaaacaagctcctcgcatacatgaactgattcctcttgactaagaacttcagcaagaagttgcaaagctaaagctccactccaatcttcttggcctcgatgtaggtgacaagagcatcctccaacattgactgctctataaaaacccgtatgagcgcagcataaacttgaagcaatgttatcgatccacccaaattgttcaccagcataagtgccaactcaaacaactccggaccagcatttccacagtaattgacaatgctctgaatcaagcaccggacctctatgactctccgaggcaagaatgactgtataagcaatgcaaacaacccaattgactgggaaaggccatataacctctcacactccctgaagcttatctttcttgcgccgtcccagtttgaagtccgcactgctagtgtgatcaaaggaagaaggcactgacgtctataatcaccagaaatggtactctgagtgggctcttgatgatccaggttgttcaagcaacaagccagtgaagtaaatcgcgacgcctgggggtgggttctgggtatgagggctcgacgcnnnnnnnnnnnnnnnnnnnnnnnnnnnnnnnnnnnnnnnnnncccaatcccctccttacattgacaggatatgagcaggaagaagatcctacacagaaattacactttatggaccaggcctccgagaaagaattcgcccaggtttacaaatttgaatcaaatctcctgcaaagagaacaaaaacacaaaatcatatcgctataacaataccagtcaagctctcacttgaagcaaagaaataatttaaaaaaagaaataataaaagtttgtgtgttccagagaatcccctggtcagtgagctcccgcgaacgagagcccggtcatcgctcaccgacgaagcagccgtccactctccgagtctccgggcgcgagctggatgagaggggcagggggtgggcgggcacagcggcgaggccatggggagcttaccgggagggacgacactgaagtgagctggaggaggagcacgccgaggaagtggcggaccgcagtccgtcccacgggagcagcgctagggtgaggcggcggcggaagggctcgccggcggtgggcggagggatccacggcggcggcggcggccgggaggcggggaagagcgagagtcgatggccgtgcagctcctggggtttaaggatgtggttgggccgtatctgctttccatgggtgggccggatgcgcggctcagaagatcggatgggctcctcttcgggtgtactgagttagtgggcctcaaatatgggcttcggtttacggaacatccagcccataccgtcgtgcggcccgtccgaccgtaccaaagctcatcagttcaagtagggtaggctgagtgggaaaagctaacgcgcgtgcccgttggcggttgagcgttccggatagtttagcctaactaactaagttattagtagataatgacgataattaagatacgatttcctttttcccggaagattttttctactacctgactgaaaactttcaagttagatttgaaaatttttgaagccaaattttaaaaactttcaaaactcaatttgaaaatttttaactcgaaatttaaatgtgtaagacaaattttgaaaactttcaactcagatttaaaaactttcaactcatatttgaaaactttcaactcgagatttgaaaactttcaagtacagatttgaaaatttttaagttaagatttgaaaaaatatgaaagctttcgactcagatttaaaaactttcaacttgatatttgaaaactttcgactccgattcaaaaactttcgatccagattcgaaaactttcaactcgagatttgaatactttcaaatcagatttaaaaattttcaagttaagatttaaaaactttcaaatcaaaacatttaaaaaaataagtgtgctaaagattaaaaaaagtaatcagaaaaaacgggaaaaaaagcgaaaaaaaatcgcaaaagaaaaaggaaaaataaatcacgaaaaaagaacaaataggctaatgggccttgggctgggagtagctggcgcgcgcgcgagactagcaacccccaggttgagtctcacttttccaacccacctatcttttttttcacgccaaactgctgaatggtgtgttttttataaaaagtttctacacaaaaattgttttaaaaaaatcatattaatctattttttcgaaaaaaagataatacttaaataagtatcacatatataaaatacagtatgagtattacacattggtagtttggtaaaggtagtacaaaatttaaaattatgttgtcattttaatatattttaataataaattgagaaaaaaaacatatatatactattatacgagagaaaatataataatactagctgcgcaatctgcacgggccaccatgctagttaattaattaatcaattaactagtcttgatttttgatcttgcaggcattcacgtcccattgacgggattggagtttgggacgttgcagtctacagataaaaatgctaaaagcgatgttgcaaaacaaaaaagaatagacagagaaacgatgaatgagatgtttaat

SEQ ID NO: 52194 - DNA, 5179 bp, Oryza sativa
cgttttctgagtgtcttctagcagattttgcctatatttattaagaccatctaaaaagatgcactttttaagatgtagtagtataaattgccctagcaaatgttgccgctatcttaaaattgcttctggtcttatcatttgctcctttactcaggcttatggatggctaactttatttttttcagggaaaaagaacacatgctacttgagttaaccagctatccttccagccactataaataagtagtacatgactccactaaagcaatgacgtaaaaaaaggcaaacaagagaacacatcactatatatacatcaaaagcaatattttctgtggatatgctctgaataaactatgaactgagaactcattagccctaacagccacccttttatacggggaagaatatagccaaaaagaaaagaaatattgatgtcaaaagaatggtcctgcatgtttgtgtgctctgttctttttgggatgatttgctgatgtgatgcaaggttccatgatatgactttgcaattttgtacctttcttccctggccgctagttgccatttcaatgctgagaggtcatttccaagaaagaaatattaataatatcctatagcttatataattatcgttttgaacgagaacatggtattgaaaaataacttcgaccactattcccagttataatgtatatagaaatatcaataaatatattattttatttaaatagtttttaagattaatttatacatataatcttcatacttctaagatatatattttaaaatttatttttcttggtttttttctttttccagcggcaaaatttctcaaaagtgaaggaatctcgaataggcaaatataacttatggcccaagataataaaattgccaacaaagcataattcacaaaatatcctatacttgttccttttcttggagcaaccatcaacctttgtcacacataatttggaactatctccatatatatagttcttcatcgttattgtaattcttgaaaaagacataaaatctataatatatatattccttcaacttgtgcttcgagtattttttttccttggagtgatgctataaatcgaaaataataatgtaatactacaaaccgcaatttagatgtaccaagaattttctatggtgaggctcgctttgccaaaaacgagtgaccatgtggggtagcctctgcctccaaacatgctgaactagcagtgtaacttcaagaagatccccaaggaatcatatccctttcatctgatgctctacaaaacctagaagcagtgtgggagcaaaagtcactagccacccatggttttggctatacgcctagaatatgcttcttgtatgcttagaattttagtcaccactctttctctatccgtgctctagggaccccccatgtcacaccttttaccaaaaatcactaaatccacactagccatcctgcctattgcgacattcttactctactttggagtttggaggtgctgctaaagttaaaacacaccaaataaaaccatacacagaaaccctaatgatctggaactacttttaaccctaatgatctggaactacttttatcaagatttttgtcaagttcaagaaaactttatattcaaacaagaaaattggggcaaatacaaggagttaattccatttgatgttcttataagatggaatttcattcaatactttgggtctagatattttcatatatggtatatttattatgcaacaattgtgcacgaataaagataggtttttttatgaaatttcatgatggaacaatatgttacctgaaattataaattataagattacgtgatgacaaataaccctcggtattttcaaaaaaaaaaggaaagagagagagaactcgatctatattgtaataatattactctatctcaaatccatgctacaaatcatacgcatgtataataaaaccacaaacttaaaacgtgacacccgacgcgcaaatagatccacgggggtgtccatagcacgttttgggcaatcacgccagtcaccacgcttggcatatgctggtaaatattccacgaaactctgctcttatatcacgagcactcaccacgcacaaatccaccaaacacagatttagctaaccaatgctgttcttgctacaagattaatcagttatctgtaggtattgatcagtgatcagttgcagagatgaagtttgggaagctgctcaagaggcagatcgagcagagcctcccggagtggagggacaagttcgtgagctacaaggagctgaagcgcatcgtcgcctccatctccggctcgccggccgacgaggccgccttcgtcgccgccctcgccgccgacatcgacaagatcgactccttcttcctcgagcaggaggaggagttcgtcatccgccatagggcacgtacaccaattcgcttcaattcgtttgtgaatttagataagttttctgatggcgaaatgggttcttgccttcttggttgcaggagttgcaggaggcgatcaagaaggcggcggaggcggcggcggaggtggccggaatccggcgggagatcgtggacttccacggcgagatggtgctgctgctgagctacagcagcatcaactacatcggggtgggcaagatcctcaagaagcacgacaagcgcaccggcggcgcgctggcggcgccggtggcggaggcggtgcgggagcggcggcacttcttcaagacggagacggtgtcgcggatggtgcgggagtgcgaggcgatgatggcggacgcggcggtgctgccggcggaggcggcgcccgaggcgctcgccgcgccggcggagcacgggatattccggaacaccgtggcggcgctgctcaccatggagtacgtgcggcgcggcagctccacccacgggcgccactcgctgccgccgctcaccctgccggactccgactggctccgctccttccagccgccgtcccccatccccatccaatgaccaccgcctcttcgtcctcgtcggccgcggcggaggtttccgggaaattctgcgctgcgaaatctgtaattaaatttgcttaattatcttcttgatcttttttctttttctttttttttttgctgcttcttaaataggagcggctaaataatgtaaaaatgcgagttaacatacatacagacgaattcatacgtgttttggctttcaaatattcaaatgtaatacgaattttcctcttgttttcgaatgttattgggttaggggcagtttgacagagttaggcgtcaaagagagaaaaaaaagaaatacaaaaaaaaaagaagaaaaccacatggacgatgtcgctgcggcggcgaagcgttgaacaaaaaatcatttgtgatttgatacgctcgagtggccgtgatatatactcctatttcataatcttcagatcatgcaacgagtcaacctcaactgttcgcagcgatcctcacctgcaaattagtgctcggtgacacaacgcagcgtagaaattcttcatgttaaaaacggttacaataataggcaggcatgccaattgtcaaaattcaaatcgaaagctatgcaggatgattctcttggcccggacggatatacctcacatgtactacaggagttactcactccgtcaaaaaaaaaaaatctaaactggatgtgatatattataatataacgaatgtcatatccaatactaaattaatttttattgaacaaaatgagtagctgcaaagtaggtacatagtggcataagagggatggcaaagttttagtttgtctacggtgaaccgtcaaacagacggatgtcaattggaagatataataatatgcccccaactttcccactgaagctgtgtgttttggtgtggtttgggaagtaatcccatacgcgaaaaacggagtgacaatattagctacttcctcggttacaaaatgtagctacctagtacgttatgcaacactaactagtactacgaatctggacaatccaaaatgtagctagtacgggtgtgacactacctctcatgttcagattcgtagtactagatagtacggctgtccagattcacagtactaggtagtgtcacataaggtagctactttcgggacggaggaaataacctttttataaaaatggttaatatgatttttaaggtaaatattacatataaaaagtttataaaattgcatcgtttaacagtttggaaactgaaaagcgtgttcgcgggaaataaggaagtggaggttaggaacaaccgcaaacgaactcggcctaacttcattgacaaatgaagtctctacacttccattcagccattctcccatcttctcaggataaccggaaggaagatggcaggaatattcttggcatgggcagataactccaacgaaaagccggcgtatttatcaaagaattaacacttgggatattcctcaaaaaatgcctggtctccagaaaacaaatgtgggttgatcttttgatgccaagttgcttctgcaagatcacacactctctgaaagagatggagtaagaaataaatagactttgccgatgtcagtgaggagttgggcagcgtcgccggtgtctcgttcaattcctcactgaaatatctcctcgcttcatggaggcaggcaagaactggttacggaatacagactgaaacagcttttgagaaagggacatactcctttgaattttgaatttggtagggagagcttgcaggtttgcagctgattttgaaattttgaatttggttttgtgttcgttttggccctttttcttgtcactttcgttgaacagcgttcacgcttttcgtgattgctaaaaggatatgtaaaaaaaaggacctaatatcaaaatccaaatttcaaaatttaaaaactgcttcggcttttaagagtgagaaaaaaaagttgagccaaacatttacatggtcatggaaggctgaatttttttcatttttaatttttttttaaaatatttacagaaataatctattgttacaaaaatttaaaaaatagaccctgccgccctagcggagggcggcaagctgacgtggcagacgacggctcgacggcgccgtgtgcacattttgcgctttggtggcggcaaggggcgtaatgcaatttgcccagctgaaaagaagcatttggctagttttttt

SEQ ID NO: 52195 - DNA, 2452 bp, Oryza sativa
caattctgttgatatggccctttccgggttggcttttttgcatggaggccccttgccgccctggcagtgcgcggcaagggtgttaatgcaaaaaattcaactttttcaatcggccgtcatcgagctgccatctgccacgtcaatttgccgcccttcactagagtagtagggtctatttttgtaaatttttccaacgatagattatttctgtaaatattttaaaagaaacatttaaaaatgaaaaaaattcatggaaggctttacctcggccttcccgtggtttgggcctggaagggcatctacatgggcccctgtgtcttttttgggcctctggagagttatgattgcaagacaattagcccaagtaacagaccaggtgcagtgctctgtttagtaccacaccgtcagttttcagagaaaggagcatcaggagagctataataccagggttagtatcacgcaacaactcatacctttctcggccttttggctaagatcaagtgtagtatctgttcttatcagtttaatatctgatatgtggaccatgtgcccactttgatattaaatttattttttatgggggagggctcacaatagtggcttgccactaggtccctcaagcgtcgtttaggcgttgcactacagcctaagcctggcgcaccccaaccaaatcaatttcaagtgttagcacgtcaaagaaaattcgcatagaaatttcagctgtcagttattgttcattaatcttaatttgaagtgttgtcaattcaaatatactacttagcaatttcagttttcattggcaagtgcacagtttcggttacttgcaattttgaagctgtgcattggcagggtagttatcaatttcatacacaaatgaaaacatagggaaaaggccgaaaggctaacgggcgatcgatcgctgccagcgatcgttttttttttcttttcctctttttagtaagtttatacctaaagtttacacatctaaactttatccacctaaagtttgtagagcgaatgtgtataagtcaaaagtttatatacccgattcaaattcgattcagattcaaatattttatataaaaatatttctatacacaaagtttatacgtgcaaaatttatggtataaagtctatgcacatgaatgagagtattagattctaattgtcttttacttttttttgaaatttatgatgtaatagaaaagtttttgaactcgtcattttgacggtttgaaggatagatatatgaggaaagatgatacaaacaattaagttctttgattaatataataaagcttttagaatgaccctttttcctaggggctgttagtgggcgggtaatcgtttccctctcctcctagcgatcatacgtccctccctctaatactcctctttcatctctctttttttaacaaacagtgcccctaattgaagtactcagttgacacttgacagtgtacctaccagtgtttaaactaatcaactccttcttaatcacttagacattttctgtcccatatctgctagcacgctcctcctcctcacaggctcacacccgtttgtactcttcgccggctttagcgtacacgccagagtccgtcctcagtatgatcttggcgtcctgcgtgacgtagcacgcccagttgtccacgtaggacagcggcccggccctgatcagcggccgcgtgtcctccacgtcatcgtcctcgtcattgtgctccgtgtcatcctcacactcctccctcgagtaggcgaacctgcttgacacaccacacgcacacacccacgagtcggtaaacttttgttcatattgatataagatgatgggctgtagtaatggtgagcagtagtagcatgtacctcattgaattttgtgagggcgtccataggatgcagatggtgcagaggaggaagaaggagatgagctcccacaccgcggggattacccacgccactcgccaccgctcgttgtgctcatcagtcgtcttaaaatggacctgaattttgattttagaatttttttcatacattattttgaagtgctaaaagtcttcttatgttaattaatttacgagcttgtactaatgtaccacatgaacagttagtgtcatgacgataaaagtcaccagtaatgtggacgaaaacaactaaggttgtgtttagttccacgcaaaattggaagtttaaagaaattagaatgatgtaacggaaaagttgaaagtttatgtgtgtaggaaagtttgatgtgacggaaaagttggaagtttaaataaatgagttgaaacagggcctaagaaaatgattagtcatttatgagagcaaaaacaaatgctgaaatgttcaggccctgtttagatgagactaaaacttttaaatccctatcacatcaaatgtttttggacactaataataaatattaaacgtagactattaataaaacccatccata

SEQ ID NO: 52196 - DNA, 1112 bp, Oryza sativa
actaaaacttttaaatccctatcacatcaaatgtttttggacactaataataaatattaaacgtagactattaataaaacccatccataatcttggactaattcgcgagacgaatctattgagcctaattaatccatgattagcccatgtgatgctacagtaaacattatctaattatagattaattaagcttaaaaaatttgtctcacgaattaactttcatttatgtaattagatttgtaagaagactatatttaatactctaaattagtattaaatataaagttaagtccctggatcctcagttctctgaagttgctgagccatcagaaaacagctaggactgcagcgaagttatacctcaaatgtgatccagccgagcgacagggccacggcgatggtgagagaattcgcgaatttccgatacatttcaagcttcgccgtcatcctcctcgcctgcaagaatcagattaatcacagaattcattgatgattctcgaagaattattcgaattttggtagaattttgaaagtgggaagttcaaatgatgctaccttgagcttgctgatagttcttgacagcgaggtgaagatccagtagatgaacaccgtgttgagggcggcgacggggagaatgaagaagagcctcctcgccggcgagtggtcactgacgatgccgacgttgtcgccgacgtcgagcacctccgccgcggcgaggaacgcggcgccgagggcggccaccctggcgttccgcagcccagtgcgggcctcgtcacgccgtaccccatggccacgagcagcgccagcacgcggtacgccgtggcgcgcacggcgcctcgacgttccgtccagaacgtcgtccccgccggccggacgcccgacgcgtcgaactcggcgaggtcgaggtaccaggtggtgacctccaccatgcccagcgcgatggccgacgtcgcgaagttctgcagcgacgacacctcgcgccagaacctcgcgtaccgggcgaaccagagcgcggcgagcgcggcgaacgccagcgacatggcgccgtaaaacggcttgagcggagccatcctgcccgggaggtagacgcggctgttcttccagatggtctt

SEQ ID NO: 52197 - DNA, 4898 bp, Oryza sativa
  unsure (1)..(4898): unsure at all n locations
nnnnnnnnnnnnnnnnnnnnnnnnnnnnnnnnnnnnnnnnnntgcagcacgaagccattgccgacgccggcgaacctctcgccggcgtactcatgcaccgacgcctccgcacaaacgacggcgcaagaaacgaccaccaccgccaccgccgcgccggcgaggaggagccgccttatcgaaggcatcactgacatcgccggagacgggagactgctgctaccaccaccgccgccgcggcagcatcggcggcggcgtggagtagaaatacgagaggtggagggatcccgagaagtggagggagaacggaagagacgactttgacgttgggaggcagccatgaattttgttaggtccacaccctaaactacagaggaaaagaaaaagaaaaaaatacagagaatccattgcaataataatggaacagtgacaaaaccatgatggaattaggcagacatgcatgacaaaaatgacaaatgagagggaacaaatatgagcaagatttagcattgagattatcttggtgcatgattggctccatttcgttgagcactatgcaatatgaagtgacacggggatcgtttgatcacgcgttttaaacaaagatttcgagggaaatatcattctctaaatcaagtaagaatacacatagttatgatattatcggactaaggagaaaaaagaaccatgaccaaaacgcctattgttttaaaacgattttctaacctaaaaccgaagtggtaatataggttgtagctcaacattacaagggttatgtgggcaaatgtttggtaccttgagcagataaacatcgctcctgggtggagaagacctaggggtttgagaagagcagtgatattgtgacaagtttccttaattcctcttgctttgtttagtggcagttttacttgtggactaagggatgaccgtgagcttgtaatgccagagctgaagttgaggttttagtgacgtgccactggggttttagcggtttgaaagccacgtgtgtgtcctctcctgattacacttacaccatcactttcttggtcatgtcaagtcaacgacgatgttaattaccgcaataagaacaaatctaatactcctccgtcccaaaatataaacattcttagcatagtgacgagtcaaatgtttttaattttaactattaacagcaaaaaaataaaaaaaaatcaatcatgtaaaattgatattagtagatttatcattagaaaaactatcataatatttaactttttttatttaaaacatcttacttttatagatattgttggttaaaatagcatctcagagaccgtgttagagtaaaaaaaaatgcttatattttaggatggagggagtagttatctacattcactctaatagcttagtcatataataaatttataaatatatattttactatcaatatttgatcacctcgcatacacacgtaaatacatgatatattgaaatccgtgtgtcacagctgactatatctatagctccgttttcttctctctacgcttatctcttcttgacatttacttgtagctaacatatagcctgttgtcttaaaaaaaacatatagcctgtatttgctacgcgttgttatattttaccggtaccactgccctgagttcttgatttgtagcataaggtacaatatttttttcccataaacgtgatcattgaagaagaaaaaaaagggatattgcagatgtgctgactgagctattaagaataagatattcaggcataaaccaagttagctagtgacttttgcatgcatttgacatgcataagtccactagcaaatatctgcagccaaaaatcatcctaatcctaataatcaaccaaaaaagtccaaaacaaaaggaaaaggtcaaaaggtactcatcgcaagcctgcaacaagtcgcacagcaagacataaactcacaccagttgggcaggaaaccacatgaccgtgtgtactgcatgccccgtttggctcacaacctaaccaccagcacacgcctaattagtttaatcaataattaccttaccttgtttttgctttcagaattaagtgatcgtctcgtctaagcttcatgacctttacgcatccgatcgagtgacaagagatcaattggagtagttataaataagcgtgagtattataattaggagaagttttactggtgtttttatttcaaaaataaaaaaaaatcaacggtctaaaatagaagtattatataagggtatttaagtatcgatctaacagatgacatggtgaagggtgtcgacaaataaccatattttactgttgattaccctgttgtcattatttactgtaattttattttaaaaatggaggattttcccatataactatataaaccgatgttcaatgaccgaacgaaaatgggaaaagtttcaaaaaggaaaaaaacttttcgccttcaaccgggcctaattcaaaacagcccaactattttgcctctgtttttttacgtgatttttcaaatgttcaatttcaaaaaaaaaaggtcaagttcaagcttgacatgaattttgaccttgtttttacatgcattttaaaatggaaactgaagttcaaaacataggggagaaagcaatagcctagcaaacaaaaccattttccccctccaattggacctaatttgaaacaacacccaattgaaaatggaatatgtctactttgactcccttaactagtgtcttaacctaatttgtatctttaaaccgtaatagcggatattttgacccccaactattaaaactggtgtaatttgtctccctcaacggttttggaggactgttcactatcatggagcatacgtggcggtgttgtaagcgtctgtcgaggagtgatcctctctagcaggagatcgtgagacccccctttcgtgagttcggccggggaagaagctcgcctctagaaatcgcgtatccgtccccaaggctcctagctagctcgcacacaaccaaattatacaggttcgggccgctatgaagcgtaataccctactcctgtgtatgggatttagactgagagttacaatggttcctaaactcgggagaacactcttacctccctcctccacaagctcaggttttctgagagtcgtcctctttctcggtgggtaaggtcctccttttatacctcaaggggataccacatgcaccgcttctacctactcttttttcgggaggggacccaccatatcttgactggaactcgacccgtgccttcgcctggaagctaaaccatagcttgtccttgagcggggcccagcaccgtccttcgctgacacgggggacagccctgtcattccctcattaataggtgaagacttgtggtggccgcgtccgaatgaccccccgacgggaccggccatacctacctccactccaccggaagcagatgtgacgtgggagcacggttgtccatccagtcagacgtgaccggcgtcaggccggtcacagacgggtcattcttgaccatcgcgcgtcagtttagcacgccgcacgtctgccccactgcattaaatgtgacatggggcagttgaggcgctgtgcggattaaagaagttcagcctgggcccctcctcgcttgctccccccgccaaacggcggctgggcgagggcctcggggcaaagcagtgcaagggcccgaggggcatgacgtggcaccccgaggccccgacaccccggccgctcctgcggttcgtggaatgcggggacaggaccatgctgtagggacacgtggtaggatggaaaggtagattcccctcacttcgcatacccccgggcccatatctccgacagtttagggcttagggtttaatagttggagagtcgagatatccggtactgcgattcaagcatacgaatcagattcggcccaataatccagatgccaataggacggcccatcaatccagatgcaatacgacggcccatcagatcccgtccccgagaaggaatccccctcaccgttggatccgatccgacggctgagaccagccacacaaaccctcaatatatattcgctcgccccccgctgcgtctcgccgctcctacaccgcgccgtcgccagcagccgccgccgctgcctctcctcctcctcccctcgccgccgatccaatccggtaagcctcgccgccgcaagctccccctcgtccctcccccggatagttcgtcgcctcgtcaggcatctcgccgatttggcgccgttctgttgttctgtttggtggagccgtgcgcgagatttccggtgtttgttgacctgtttagctctgatggattcaccttgtgttagttagttttccgtcgaatggtgtggcgattaggtttggggggattggttcgtctgtgattttgtagctagattttttgaaatctagggtagtgtgagtggggaagctgctggccttagtggatacatgctgttcgtggtctcctggttcttgaaatcatgatgagttagtgctgtttgaaccttgaagcaaagttttaagttattggagttcctgtgcttagatttgtatactattagtgaagagatgcatagctgtactgctgtagtggatataggagtgttgtttttgatttgctggtgctcttccatagcatccggatgcggtgttcaattgtgtagttgtttatgtagttcaatgcactagaagcttttatttctgaatgcctagttattagttgggtatgaagtccaatgtgtgaaatgctgtcatgtttcaacttttagttaagatatgaaacttgagaaacaaatgaaaggtttagattcagtactgatgtacaacttaagtaacatctatggttgtaaattgtaccatgcattggttattgtgaattagctcttttggttgattgaaacaa

SEQ ID NO: 52198 - DNA, 1555 bp, Oryza sativa
  unsure (1)..(1555): unsure at all n locations
nnnnnnnnnnnnnnnnnnnnnnnnnnnnnnnnnnnnnnnnnnnnnnnnnnnnnnntgcggtgttcaattgtgtagttgtttatgtagttcaatgcactagaagcttttatttctgaatgcctagttattagttgggtatgaagtccaatgtgtgaaatgctgtcatgtttcaacttttagttaagatatgaaacttgagaaacaaatgaaaggtttagattcagtactgatgtacaacttaagtaacatctatggttgtaaattgtaccatgcattggttattgtgaattagctcttttggttgattgaaacaattctctatgtgccaacaggtcactttcagtcttttttcttgagggggagatggcggtttctttcaccaacgttagctcagaggcaggcctcaaaaagctcgatgagtaccttctcactcgcagctacatctctgggtatatgatcagtgtccactgtccaccttattttctgaattgccatttatgttcactggacttaaacccttcaattatctgtttccaggtaccaagcctccaacgatgacttggctgtgtactctgcattttcaactgcgccctcttcaagctataccaatgttgctaggtggtttactcacattgatgcactcctacgtctgaggtatgcatttttcccctttttttattctcttacattttatgttcagtgttgtgaattttctgaatgttgtatttcagtggagttactgctgatggtcaaggcgtaaaggtcgagtcgacagctgttccttcagcttcaacccctgatgttgctgatgcaaaggtcatacaaccctagccttgtcttgtttgcctgaaatctgtgaagtgttctagcatagtactgtgaattgtgatttgatgctgtttgcaaattacgtttttgtggctcaatggtgctggttaccatctctaatatatcatcatatcttctaatttcaggctcctgcagctgatgatgacgatgatgacgatgttgacctttttggtgaggagactgaagaggagaagaaggcagctgaggagcgtgctgctgctgtcaaggcttctggcaagaagaaggaatgtatgccatcctgcattatactataccatttttatgcaatgaataatacaattattcattttattttattctcatctgtagctgtaaattaagaccaaatcatcactattcattataatgcaaagtgctacttctaacttgtcaacacctttttattcagctgggaagtcctcagtgttgcttgatgtcaaaccatgggacgatgagactgacatgaccaaattggaagaagctgtgaggaatgttaagatggaaggcctcctttggggcgcatgtatgttactacattaaatttcttcctacgaatgtactgtcttttgcttttgctagtttggttagattgtgacatgaatatataccactgtttgcagccaagcttgtcccggttggttacggtatcaagaaattgcaaatcatgatgaccattgtcgatgatcttgtgtcggttgatagtctg

SEQ ID NO: 52199 - DNA, 4716 bp, Oryza sativa
tgattgaggactacttctacaccgaaccagcgaatgagtacatccagagctgcgacattgttgcgttcaacaagatctgtaagttattccataagtatcagagcccgtcgttttatttgctagcgttgttcttgttattatactgaagcaatcggatgaccagctgtcttattttaaggaatcgatcctatattattctttaaatgatgatgcatgccatatatattattctgtaaatgataatgtcctgatgtttcatatctagatacctcatttgctgcacattactctctttattcagtaggcttagatacctgatttgctgcatattactctctttattcagcaagttgctcatatctagatatctcatttgcagcacatcaatttgatttcatatggtcatgtaaatttcatctgccttgagccatccttgttcagaactaatgttttgattatgttttattgcagagatcttccttgagtcaggtgatggcgatcggtgcacaaagataaaaagaaaaatccggaagtttgaattaccgttgatacttcaatctagaagtttgaattaccattgatgtgtcgttcgtggtgtcaactagtacttgagcccgttttgtgttgagattgtagcactctacttctactgagatcgttttctcctcctttaatgtttaaagaccaatcaggttattattactgtgtctgcctgtgtcaccatagcggcattgttggtcgatccagttttgatgcggtcttcaattctcccgtctttcgctttgcttgattgcttcatcgcttttgcggctaaagtttttctgctcctaccaaaactgtaggggaaactttggttgtgctgtttgttctatctcttatgcattgcacagcctggttttttcgctcttctgaagtatagccctgtgcgctctcatcaggcctgtcctgaaatacgtgatttccgttcggtatcgatgttcggtttgtcacacatatcttctactttcttttctgtaatgaagagcattgtctactgttatcacttatcaggttcgaattggtgaattcacagctgagtgttggtgcatatatcacgatcaaagtaacaattatcatggcaaaataggtggtttcacctctcggtatcggttttcttccattggcatccctgactcgtggctcgtgggctggcattgctgaagcagcacttaggcaacatgcgataaataaagtttctcttcacaatcctcttgaaagctgctcaaggaatattcagcttacgataagcacatccgatctttgacctacataggcagcatatgatcctgagcagtaaaatttcctgcttcacctagtaaccttcactctttccattaattctttgtcagtctaccctggaaatcctcgactagtgtctactaggcactagctagtcaactgctagttcccagagggatacagcaatatctgagtgattcaccgcagatatgtcacccatcagaagttgaccatcatcagttactaagagcacccgcaatggtaaagtaaggtgctatctataaaacatgtacatctcagcaatagactcgattaatagtaaaccaccttaatagtatgtctacattggtatctatagctctctcatgcattgtctcgtttttctctatagactatctctaagttagtagatagctttgctctctctcttcatttaatacattccaagtaggaaaatatgctgacatgaatctcttatagagagcctatagataaccattgtgggtgccctaacaccatagattagtagtagataatctataggactgcatgcaatgcgatgatatctaagctcggtgtagattcagaaaccgcatgttcagatatatatgcatttcttttctagccgaaaagcgacacgggattcaggaccacatcgcggcagcttctcgctgcttctctagccttcattctagaactccacacacacccagatgtgtactacttttattttgtccatcgatccaacggtgaatgatgatgggtgcctcttttctgtccagacattcttcaagagtcagagattaatgaatgcacattaatctggactattagctcttgataacaaactctaccagcatagtatcatgcatagctcctatttaagtttatctctcatcttgtggatccctaggatccttcctcatctaacaaagaccaaatgtctcatgagagaaaagggcctcttcatcaatcatccaaatcaagtactccatccgtcccataatataagggattttgaggttttgcttataacatttgaccactcatcttattcaatttttttttcaaatataaaaaacaaaaagttgtgcttaaaatactatagataataaagtaagtcacaaataaaataaataataatttaaaaaaatttgaataagacaagtggtcaaacgttataagtaaaaactcaaaatctcttatattattggatagtgggagtaccaatgtattttagcatactagtagtctactagtagagtacatatatggatatattagtacatctgaacataagatacagtacataaatgtacacacacaagtgagtagtgatcacatatatattcaatggcacatcggcattggccaaaggtgtagaatgttgcttggcagccactcctggccacctttttttcccaaagttgggcacaaacacacacaaatgtgccggccgaggggcctgcccttgatcaaagaaattcagaacgccgatgaagatttggatattttgtagcctctgctccaggttggcttaccgattttcggccatgggcatgccccaagaaccctagttgcactgctgtttcggtacattctggtgtatatttatcatgcaccaatgttcttgagatgatcaagggtaggtagaataagagcatgaggggttcactagcagatgaaatgaaatgaaaacttgttgctgtatcccacaaatttaatggaaatggagtatacattggggggagtagtactatatggtgaaacgtacaccaactgtatctgaaatctgaaaaaaagaaaaagataacagagcttgaaaatttctcctattttcagctcaaatccaataatgattgaactagccagccagtcgacgtttgatcttcgttcagaattacaccgtcgcgcatcgcattcggttctgtatgttgtccgtgcgatcgattcgccattcaactgaacctcatgaacaaatggggattattgtggcatcaaaattactgcgaattttcctccgcgtaaatcaggacaccaggccaccatcatgtagtctgaagaaaacagaatggcatccagaattcagtgcttaatttgactgagcaagagtgtagggttcacattccactatatatcacttaccattgtgcaaacaataatgatcgcattgaatcgtgcgtctcggtctacatctccagaacaatgactgcaaaaaacatcaagaaaatccactcataagttgatgcttaatcaattacttctacacaaactatacttactgcaatatatatgtaatcttttcatgcatatatgtttgaaaatatgtccatgaatgcaaacaaatatatgcagcaagaagaatattaactctcacttacaatctgaatcagttttgtcccatttaaagatatcttctgcattctcatcatcatcttcatcatcaggagatgctccctttgcatcttctccctcggcttatcctcaagatagtatttcctcgacgacgacgccgcagcattactcggtcgagcgttcatcctcttgtgaagcatcgtcctgaacaactgcatatgaacacaaaatgcaaaacaaaacaaaacaaaccatattagtttgcactgtttcatactttcgtcactgatcatatcattattagttactccctccatttcatatcataagttgttttcactttttttcctaatcaaacttctctatgtttaaccaacatttcatatcataagttgttttcacttttttttcctaatcaaatttctctatgtttaaccaagtttatagaaaaaattatcaacatctacgacgtcaaattagtcttattaaatgtaacattgaatatatttcgataatatgtttgttatatttttactaatgtaatcaaacttaaaagaaagtttaactaggaaaaaaaattcaaaacgaattataatatgttataatatgaaatggagtgagtagatgataacttgttctactgtttaattgagaccttttcgattcttgattcgactggatccttcaaggtgggcggcggcgccggcgacggcgagaagccgccgcggcagacgaacatcttcttgaggagggacctgaaggatttctgcttgatggcgccgccgccattggtgttgacgaggagctcgcgcgccttgctgaggatgatctgcgtgtccggcgagaactcgccgtcgaccgccgccacgcgccggtcgacctcgaggctggaggggcagttgaggaacctgtcgagcggcagcagcagctggttgccggagaaggaggaggaggaggagcgctcgtcggcgtcgtgctccgccgccgtcgagccgcggcggctgccggacttggtggacttggctcgccggagcagcttgttcagcgcctcctgcagcttcttcacctcctcgatggtgaagt

SEQ ID NO: 52200 - DNA, 942 bp, Oryza sativa
  unsure (1)..(942): unsure at all n locations
cttttgcgtggtgatggatgtatttctttacattcaagagcttagtctaatctgcttctttcttagattgccctgtttggtgaaatcatgatggctcaaaaggttatgtatgaaagatttggcgagaactttgttgtaaattttgtaacaaaacttcgagaagcacactgcccaccagaccttgctgaacagtactaccaaaagttacaggtatgcttgttcttttgattccactgtgtttgaggttgctaactgcacaaaagctagaacatagctatcattgcaattttaaaaagttgaaccgttcccttaatttacgaagttaaatgtaagtacattgtgttgctgtctcgttgataactggttgacttgccatcaaaatgccatcgaggtttgggaagttgttagtaccatgatggagctctagtttatttgttgtggcttatatgagagagcaagtatttagcatttaccttcagacttgagtaatgattcaatgggtaattatcatttgtttgtcgtattactaaagcaatggtgtttgttctatggttttattacaaacaaagtaataagatgctgacataattcaggaatttgtaatctgatctcttatctgctgtatcaaatttaaatttttcacttttacttttctccatcacagggaaatgatatcaaggcattcaagtcattttatgaatcacttgtcatgaaaataagacaacagcagaatgggagtcttgtcttcagatagcgtcattcaattattttaaatctgtttgccagtgaaagattcctcagttctacaatttgaatataggtagttatttcattcttttcttggcttatcaacaatatgcttattcctgcatgacttgcttgtattattnnnnnnnnnnnnnnnnnnnnnnnnnnnnnnnnnnnnnnnnnnnnnnnnnnnnn

SEQ ID NO: 52201 - DNA, 946 bp, Oryza sativa
  unsure (1)..(946): unsure at all n locations
nnnnnnnnnnnnnnnnnnnnnnnnnnnnnnnnnnnnnnnnnnnnnnnnnnnnaaactttcttgtcagcttggatttatcaagaaaggggatccaactgtaactctgcacccagtgaaattcaagcgcacgcggaggtgaaggacgagagcagaacaaagtgctcgatataggacgatcaccagtctttcaaatcttttacagcatggaagttatgcaaaaccattaccgctaactgattactgtacgctatagctatatgtatgactgcgctcaagctgtgtcaagtgtcaattatgagttgcccccggatttacgataccaactgatgatcacacatcaacacttcaaactgtaactgtctacgaaggaactgcatcctcctgctcccgtgtaaccttagccagggataattttcctatgaagttggtcgcaaggctgccgaggaagagatctccgttgaactctgtcaccgaagtgaccatgttgatcacattcccttcagagtcaccaagaaccctcacgatctcgccgttcaacgacacctgagccaccactgctcccttgagcgtcgccttggtcctctcgacgagcgccgggaacgacgcgatgaccctcctcgtcaagctccagcgagagatcaggtccagccatggagacctcacctgcagtttgagcacagaaaattgtaagtttgagcactgaaaatgttgtgtagatgcttatggcagcagaaaggttagagagcagagacctggagaagggcaatccagaagtgaccatctgaacccagccgaatgttgtctggattccccggcaggttgtccacgaagatctctgcctccccagccttctcccctttcagccacactctcaagcatctgaacctgcacttgacaatatcacttcatggtcacttgacgatagagtgaacagactctttttttt

SEQ ID NO: 52202 - DNA, 2257 bp, Oryza sativa
gaaaggaagaggggcgaaggggaggcggagttggggttgatataggagaggagagggtttgctcctcttcctctccactgcggtgcttttctttcccttcccttctttcttcctgtctaatcttccgtttttgccggatttcgtgggtttatggacggttttggttttgggtttgggtttgggtttttaggtttaggactagggaggggagggtcttttgatatttttttaatctaaaaataaattattttgcattgtcctttgagaaatatctagctctaaaagaaatattaaaggaatattagcaatacttgaaaaaaataacaatgtcgtatacatatgaattgatcatgtgtcactctcagacattattatgcaagtattttttgcgcattacatatataatatgagttttgaagtttttatgcaggctccaagttgacaattgcaatccttagggtttcgactcctcagctggttgggacgttatgtgcatggaataattattgctcggggtatagaagttacgtgtttccttaattacaacataccaaacctatcgtttctatgaaaacattcaagatttgacatgtatttattttggtgttggttaaatcatatttttggacggtcagagattccttgtttgtgcatatcattattgatacatgacacaattagtagggatgtagatgggctgggtcaacccatttacccagtgacccaacccacgatctatggggcaaaaaccatatgggtcaacccacaatttcacctaggctaacatgggttggtggcctcgtgacgcacggaccacgcatggggttgacccatatcttacaccacgtttacgcactcacaggctccagtagatgttggtgggtggaggcgacgacggcgtgcatctgcgtcaacactacagcaaaatcggtagcctacttctcatgctcattacctcatcatctatatctccacctctgctcaccccttgtgctcgacgtcgggctcggcatccaattcaacatgtgtctcttggagctccggtcaccatgtttgtgaatttcaccatagagaagatcacgggaggctgaggctagaggctcttagtagtgcttgcttgacggcccagtgtcctcatcgtgttcctcattgctagcatcgtctttctgctagagatccaacaaggcatagactatgacaaaatcaagatgttgctccagaggatcaggggcatcggcgttgtgggcgacaagttggacaatatcgccactatgaaagccatgtaactagacgagatcgaaccttttgcagtgccagtactcatgcatatgcttattcaacttttgggttatgggtcgacccatgggtcaactgcctaggaacgttgcgggggcaagatgacccatgacccataatctagcacggggggcgtggtgggcagggtttcccttaccggcggttaccggacttatcgcggggtacggtaatataaataccgcggtaacctccttaaattcaaataaatttaaaaaataatttgaatttttgataaattttgcacggtttttcatggtttttcacggttaccgcggtaaccgtgcttaccgccggggcgcggtaaccccggccccggcggtttaagaaaccctgatggtgggtcaagccttggggtcgacctaccagtatccctaacagttattctttattataggtaacggtattaccatattatcttattgttctcatcaaacacatgtgttgaaaagataaactaatagtagtgatattactcgacgagaaaagaaccatgtcaagtgattaacacattccacttccgagttcttacaatggttcaaaagacgcttctcttctcttattttcccctttctttgttgtctcttatctaactttctatccattgggatgtggcaatcttactgccaaaatgttaaagataaaaccaatgatgttttttaacaagaaaaaaatatttatcgacacttgtctggcttactatagtggtttgaaagacaactttctcctatttcatctatgtcacgtgattcctttagggctccaaccgtgtgtccggtgtgacatgggactcttaaaatagtaaaatccccttgtgatgcatttgcatagttcatctacatggagattccacaacaaaaacaccaggacaacacatcaagaaacaaaaatctaatttctttttagcttccaaaaaaaatctccttccttcttggaccaaaat

SEQ ID NO: 52203 - DNA, 2038 bp, Oryza sativa
aacaccaggacaacacatcaagaaacaaaaatctaatttctttttagcttccaaaaaaaatctccttccttcttggaccaaaatggcgataaaaccccaaaccacagcccaacatcccagcataacaaaccaagagagaaacaagcctaaaagaagcaaggcccagcccaatagcccatcaagctcaccattcctcgcctcctagggtttcctcctatccaatccaccaactccgcctcgccgcctccatccctcccattcccgaacacgtccccaaggtaagccggcggcggcggcgatgacgacgagcctgaggaagaaccgcaagaagcgcggccacgtgtccgccggccacggccgcatcgggaagcaccggaagcacccgggaggccggggcaacgccggaggcatgcaccaccaccgcatcctcttcgacaagtaccacccgggctacttcggcaaggtcggcatgcgctacttccacaggctccgcaacaagttctactccccggcggtgaacgtggagcggctctggtcgatggtgcccgccgagcaggcggcggaggccgccggcgccggcaaggcgcccctgctggacgtgacgcagttcggctacttcaaggtgctcgggaagggtctgctgccggagaagcccatcgtcgtcaaggccaagctcatctccaaggtcgccgagaagaagatcaaggccgccggcggcgccgtcgtgctcaccgcctagggtttggtcctggccctgccttttgttctgcttcttggtttttgagatctattaatctgaagtagtagtcgtttcttgtctcaagctatttgcgttaagaagacttgattagtttgttttctactgtacttcttgcatgttaagacagtacgttatgagaatttttgcactaagcgatgccagttcatgtcagatgcttcagatatatcaatgctattttgtgctgccaattatgattcgttcgatctgacttggcatgcccgcgttatattagatcgtctgatcatgttatgtacttgtctgccaaattatgtggatggtaaggttcacattagttttgatctggcctctgcattatgcttcattacaaatttacaattatctgaaatatgttgagaaatgtatgatgttcctgataagaacccatatttataagttaactgtagacatgtactagtaataagcatgttgaatacttcgggttctgccatgttctggattatcttttagccatatttctgaaaattagatgtaaacctatagcaagcgctgtttgggttctgtgccacatgacaaacttctcagtgatttactgatttgcattttttttctctctatgaaaatttttggtccatttaggcattccatggttgtctgaattattctagaccagtaacttgagcactgattaattatgttattcattcacaaattattggataggatcaatcatgtagctgtcctttctggaaaattcatgtctgctagatactggatgattaaaatgtcatggttgtttgtcagaattattctattgttatttggggatttgttctactaggttgtctactgtctaggggcaggggctggatgatgatcatgttggtcattttgttgtctagtgtcttgtcattcaaccctgctcgcagttcaaatttctgtgggtgctggagtacatggttccgcacttgcactatagatgttgaaatgaaccagcgcgaagtgcagtcatgatgtttttgtgatgaagtattctgatgtttcatattgcgagatatcagtttccactcattttgaaattttgagtagcatgggtggtactgatttcttctcgtgtttcataagtagatcttctgtacggtgaagtcttggtaaatatttcaagaaatatggatgtgcgaaattgatattaggggtgtgtttagtttacgccaaaattggaagtttggttgaaattgaaacaatgtgatggaaaagttggagtagcatttgcccgttgcaatgggacaggcccataca

SEQ ID NO: 52204 - DNA, 1801 bp, Oryza sativa
taattgtaaaacatatgaaaaaatataaaaactaccgtttgattgaaccacataaaaaacacttaccatagaatggataaaaaagatagattcaaaggaatctcttgctaacttttctccaaaattttcataggattacctatttcataggaaatgataggatataattcaatccgttgtttgaaagatttttatagtaattatttttcatataattgaaatcctccaaaatttctatatttttttctataaattaaaggggctcttagcttttattgattttctttttgtttctccgggagtctgcaggatttttgttttagcttgtgtacgaggtgatgcctatgatgcacaagctaaccatgagacgccaatgtccaattttcgggcccctttaaatcgtaggaatgaaaaaaatagatgaataggaaaaaatcaggattctgacaggaatgcaattgtataacagaggattacaaaacacaggaaaaacataggaatgaccatttgattggaccacaggaaaaacgcaggaatcagatgagagagatagactcagaggaaatgttccaagaggttagacctcttgctaactttcctcacaaatatgcataagattacccattccatatgaaatttataggaattttagaggattttattgctataggaatttttcctatatagccctttgaatcataggaatggatcctatataatactatataattcctatgggatacctcttcccatgcaagttttggaggaaatttaacatgaggtagaacctgttggtaactttcctttgagtctatctctctcatccaattcatgtgtttttccggcggttcaatcaaacgatcattcctgtgtttttcctgcgtttgcaattctatgttttacacttacattcctatcaaaatcctacgtttttcctattcctacgttttctcaatcctacgatttaaaagggcccttaaaggattgaataggattcaatcccttaaaggattgaataggattcaatcctttgtttcaaaggccttcataggatttttttccataggattgaaatcctccaaaattcctacatttttcctacaaatcaaaggggcccttcatgtgctttggagtgtcacattctcaaggttccatactatcatgggttataagcactgaccacatcttagaaaaaaaatactttcatctaatggatttgcatggatatatttcattacttatgtccattatatgaaacaaaccgatgagaaaacactaacattgatggtggagttgaccatgtttaaatcctggttctccacgaatattatgcacgcacggataaggttttcaataggtatgtaagtgtgatacacatgtataaccgagcgagtatgtgttttcattttaaaagaaaagaagctaatggcttaacacctatgcaaatgcatgagtatattaactttccaaatctaaaggtttactaatacgaggtgtaaaacaggcacgagtgtggtgcgggtgtacagggatgtgtatgcatcttccatgtaatcaagaatgtacactggtgtgaatgtgtcttcagtgtaatcaggaatgtacgtaagatgtgtatgcgtcatccgtataattagaaaaaaaaactagggcttaatcagattgtagccaaaataacccttatcaatttttcggtaagttgataatgttaccaaaattttggcaggattttttttatgtatttaccaaactttggcaagaagctaaatgtatacacacctttgacaattttatcaaaaat

SEQ ID NO: 52205 - DNA, 1268 bp, Oryza sativa
ttttggtttcttgttctttctgccttctgaattttcaagaaatgttattattgtaatttggaggattcgatatccagtcaacgagttaggagatttcgtcatgaccaagaacaaatcaatcagcttgagccagtgaggcagctgggaagattgcagcacactagattactatgtcaacctgaaattgatccaacaactacaggtgacctcactttcatctgacgtctgtaatctagcattagaaaacgtctagtagcataatctatagcttgtctcgcaagggtgagtgaatgtataattgacccttacctaatgaaatactattttccatgggttttgcaagctcataagtgagcagagaaggccagtcaaattcagtttggtcagaactctgaactctaataagctaaagaagttggctagccaaacgaaggaaaacatatccatcatccaagctgaaagcctcaaagacgcaaccaagttttttgagtagcaaagctacccatttgaagtagacttctgaataatggctttgcttctctctcattttgtgatatctataatccattattaagttggaatataacctcattttctcaatgaccatcagaccatggcaccatgccgtgccaggtcattgcgtttgtgtgagaatggtcaagccaacttctgttttaaatctccacttcacgaccgtaccaaaccactcattaaccatcagttaattaggtagtcctactcgaactaaagcttcaatttgacacacacccatgacatggtaaagagacatctcgtcagataaaaaattagcacaatggcaagttggcaactagtgctatagatcaatggaacagtagtacaaacttaagctgaaaatcaattagcgaaggatcagttcagtgcttacgtttgaagaggtggttctcgaggctgccatgctccatgtactcgtagacgaggaggcggttctcgtcctcgcagcagtagccgaccagcttcaccaggttgggatgccgaagctggccaaggaagatcacctctgcctgcaagcaacgacgtcagaatcatcagaaatcaggtagtagtagtagtagcagcgaatcagcagcatgatcacgtccatttcagtggcactgttgcattgggcagcatgattagatcactggaaacttatccgaccgtcgccggaaccgtcacatcgtccaactacccctcccttgttctttgcctcgcacgtcctaatcgtgctgcttaagatatttttaaac

SEQ ID NO: 52206 - DNA, 2901 bp, Oryza sativa
tgggccggaatacctgcggattctgggcccactcctgcctctgtggtgcgttgctcacgccgccacgcgggcctcttttgggccgcaagaaagagaggcgagatgggctcctttgctcttccttgcagcggaagaagccgcgggccgtttcctcctccccgagaccaagacacaccaccacgccaccattcccacgcctcacgcggcggagagagagagagagggtgaatttgctagcgagatgccggaagccgaggccgcggcggtggtcaccggaggcggcagccgcgccgccggccccgccgactacgagcgcttcatcaccctcttctccccggagggccgcctctgccaactcggtgagtgcccgccgccgcgacatgccccctccacgccgaccaaattcgctgctggtgtctgcgctttggctaacgatctgctgcttcaattccgccgcccgcctccccgtgcggccgtgctgtgtgctctcgcagactacgcgttcaacgccgtgaagctggccgggatcacctccgtcggcgtgcgcggcgacgactccgtctacgtcctcacccatcggaaggaggtgagcacgtcgcgagagcggaatccccttgtcccctcatttgtgattcattctgcggccgtttgatttgcttcgttcccctgatcaggacaagttgcacgacccgacgaccatcacgaacctgttcgcgatcaccgaccggattgggctgctcgccaccgggatgccaggtgagccacaactttgctctctcagattctcagttctaagtgctgcgtggaacatgcggtgcgcgcgtttggatcccgctggcacaatatcatttacgagttacgaattgcgaattggaggatcactcgactttatcctgccgtagaacgtctcagcgaaaccggttccaataattaatctctgcaactcttggtgttcatgagagcattgcgatgtgataaggatgttttacataccgatgatgcgcttgttcgactggatgctaattttgctgactccctatattgaatcagttttagtataggagtagtatgcacttccaggatacgtcatacatgctgattagatgaaatgttcagtgaatgagtgaaccactgtggtgtgattggatcctacatcctagtagtatgcactagatagaatggaatcttggccttggttgcacaatatactgacttatttggcagtcgatcgcccctttactaccatactctcatctattttgtgtttctgaggttgtaaatggctaatgtgacaatgtgagccagtactgtaactactgtactgagctattgtcttgtttgatttaacctatgtgagacagtaatgtaactaggcaacttttgcttgctaagtaatcaatcgttctatttgactactttcttgtatgatataatgtactgttttgttactaatgcctgataacttgttatatcattctgttggtggacagttccttcagtttagagggagttagggacttctcaattccatagcatgtgatttgtcactgagctctaaatatcttaatatagttctgtttagaattttatggaacagctagaatggctcacatcatcataagaaacactctagaggccaatggcaggacataccatcgcagtatcattttacttgtctgcttgttctgatcttttgagttttgacgggctatatctttattccaggtgatggaagggcaatagctcaggaggcaaggaacgcagctgccgagtttcgcttcaagtggggatataaaatgtctccttgtatgttagctcaatggtaagctttggtctaaatgaaatagatggctcattgtacaatacctatgcttacaaacatctaaaatgatttgatcatcacgctattttatataatggttatataattatctctaggccgctctctgcttgtagggattgatcatttgccactcccattagaatgtcaaaggatcaatttcgcccattcacattaagacttagtattggatatatgagaaaatatggtgagagttcatatgagatcaacgggctgggaacttttctgaattctgataagcatatgctcgtgctttactatcaaacctacccttattttgttaagctacgtggatacattactctgttcaatcttcaatagcctaacgttgtttactaatttcactgaactgttctgcattttactagtggtgtatcattgcttgtttgtaggattgcagacagagcacagatccgcacccagcatgctcagataagaccttatggagttggttagtgctatccaatttgtgttttgtgagtggtgaaacctgccatcatcgtctaccatcaaaggattacaatgattactttgatcctacacattttcctctgcagtttctatgatctttggaattgatgaagagaaaggaacccccgagctcttcacatgtgatccagctggacaattctttgcacacaaggtattctaggaattttttgcagttcattaaatagctcttttcatcataacacaagttagtcgtgtttttttgtgaatgactacaacaaatgcaaatagcatgctgtattttttttcagttatcatgtgcaactagaaactgattaggtcacagagccactgaacaatctagatggagaaaccaccccataagctcaagcattttctgtatctgagaaacatgaatctcctatgtcattgcaggccacaagtgctggtccgaaagagaaggaagttatgaactttcttgaggaaagaatgaagagcaaaccttctctatcatctggcacaacaaaaggggtgtgtgttactattcttagcaaaccatgaaattgaacttatccaatgctgactagaaa

SEQ ID NO: 52207 - DNA, 1161 bp, Oryza sativa
aaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtacaagagaaagatataaatgtttcaatgcaaaccgaatatgtagagggtcctatcaatgcaggggatgttgttggaccatcgatgcaaaatgaggaaaatcaaccaagggaggagcaggctatgggcatggcggatgagggggagagagtcggtataattgttgatgaaatggagagggaagattcggataatgaggaagtggacgacgacgcatcatccgatgaggaaggtaatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggtaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgatgatcgaacaaagagtgtgtgcaaagagcctttttc

SEQ ID NO: 52208 - DNA, 1116 bp, Oryza sativa
tccagatcttgtcggagaggccgagggagcggaagaagttggcgtccatggcggtggctccggtgatcgccatgttcgctcccttcttgaagtcggcgctcgtcgacttcgacggcggcaggaacggcagcccgaacttactcgctgcaacaaccaccagccgccgccgtcagctcgccggagcaagcaaaccaagaagacgaaggaatcaaagaaagaatcaaagttaccgaggaagtcgacgacgacgcggccgtcgcagcagcggcaggtaggggagccgaagtaggtctcgccgtagggaggctgggtgaaggtgatctgcgacggcctgccattggtgcacaggttgccggtgtccgtgatcgagtccccgaagttgtacaccgcattgtacttctgcgccgccgccgccgccaccaccatcgccgcgcacaccaccaccaccaccctcctcgccgccgacgagctctgcctccccatcattgcaaagaaattaaaacagagcacaagccaagaaaagaagaggagaagcagagcagtggatgatgtgatgatgcgtggaaagggcaggggtggcgcgttttataggcgtgaccgcgtgagcccgtgaggaggcgtgaggcccgtctgcctggcgcatctggggacaggtgtaatgtaatgcatatcatgtagtagtagcaatgtaatgcactatcatgtgtgcactttaccttttcgtgccgtcggtattcggcaagcactgttcctcccggatccgggtcctctaccatgcaccgcccgatcggtatcggacggtcgagatcgtccgatacgtcggtcggtttgcgacgatatggatatttgttcccagcaggggtttattatcccgggagaaaaccggttctgatttcgtgaaatctggttttttcggaccatgtctaaaacataaaccgctcgggtttttgtgtgaagttaaaaaattaaaataaaaatggattattaatttttttccagatttgttcggatttcatcggttttcttttggtttatcaatggtttctacaaaatccgaagatactgctcgtgagcgatttttatctgatatcaggatagcgaaccacagtttcaagg

SEQ ID NO: 52209 - DNA, 1266 bp, Oryza sativa
  unsure (1)..(1266): unsure at all n locations
gttgcagcaaactgatagttttatgaaatttactctatttttaaagcggattcagagcaggtgtggatggtgtgcagatgcggacatggagtggattatttcggatgttgaaaatggtgtagagtcggtgtggacctggttcggaatcggagtaaatttgacagatgttttgtgtatatgtaatcaacacaacatcaacttaggcatttaacaaagcaacggacaacaatagagtaatcaatggacaatccatcgtgataactatatatttaagtgctaaacaatatgaatacatgacggccataacataaaaacgtagctaagactgatttagtcataatagtattagtgttgaaagagggcaatcccaaacgaaaaaaagttatttctcaatcccaagaatcaagctttcatcattttccgctatcgtcaagacaaaccttaaaacattccacctcaactatttcatccatagaagcgtatctgacaactatgtcatcatcgttttttcttccaaaagctagaaagggcctacctagtgcttgcatttcggggtaaagtagcttccccagctcaataagagctacctacaaacatggaatgccaatgcaatgatcagaacttccttgccaagaacatcctgatttattatcaggctttaacctttgtaagtgtaagatgagacggtgagagtcttaggccctgtttgggggagcttaagattctgagaatctgttggttggtagccagcttctgagaatctgggttttccagcttctgggttctagttcattttctggattctacaactatatattctcataatctgggtgacaatttggactgttttggggagctggagattctgagagaagctgcagcaactagaagctccccaaacagacccatagattaaggagtctatcttaattgatgtatttaacatatagagcggttacatgggttgacaatttcagattatctagcaaacggcctaccagataatctatatccgccgaattttaaagataccacatccacacagaatccatatcacactatccgcatccacatccatatctatcggatttctataaactcgtaccatattctcgttttgagcggatttggaatggatcagataagatgttatccgattcgttttcacaccaactctaacccgataatgcccgagcattatagttgtgtttggtagaattnnnnnnnnnnnnnnnnnnnnnnnnnnnnnnnnnnnnnnnnnnnnnn

SEQ ID NO: 52210 - DNA, 797 bp, Oryza sativa
  unsure (1)..(797): unsure at all n locations
cttgtaataaagcatagggatagaatattttcccgtcagcccattttatgtctctaggttttacctcatcgcttacatgtcgtaaaaatatatttgtaataaagcatggggatagaatactttcaccataaattaaatgaaaatttaatttttagaacaaaaactaaatgaaatttgtacatcattttcaacaaaatttaaaccaaaataaaaaatattttttggttttcactttctatgtgaaaatattttatggatttaatcttttaattttttttgaaaaaagtagctcgaaaatttaaaagtatttttcaaatttggtaccaaataattgtcccaattcatttaaatctttggtttttcatgaattatgtttctcacatttagatttatgtttcttaagtaagctaagtacgtgagcacgagatatggggcgatacagccttttgaaaaaaaaaaattaaaattgtcaacacacagtgaactaacaaagttaagttctatatagaggggatcaaaatataaaatataaatgcaagggcatgtagggaatgtggaaaaattcaggatacataaggactgagaaaaatttatagacacgtaaacaatttttctcttaaattgaaatggttttataaatgtttttaaaaattttagtatagtgacatctattaaagaacatccgactcaaatttgatgtacacatcgagggaaaaaaacaaatttgggtgcaaatnnnnnnnnnnnnnnnnnnnnnnnnnnnnnnnnnnnnnnnnnnnnnnnnnnnnnnnnnnnnn

SEQ ID NO: 52211 - DNA, 840 bp, Oryza sativa
ccgcggtcgtgggggcggcggcggcgcgcgtgtccgtggcgggcaccagctacggcggcttcgtggcgtaccacgtggcgaggctgctcggccccgcggccgtggcgcgggtggtgatcgcgagctccgacctgctcaaggccgacgccgacgaccgcgccctgctccgccgtggcggcgccgagcgcgtcgaggacgtgatgctcccgcgcacgccggagcggatgcgccggctgctcggcctcgcctaccaccgtccccgccgcttcagcttcaccccggccttcgtgctccgggacctcgcccaggtaacaccaccaatccaatccaccatacattgctgcctacatttgctgaacaaactcgaacaagttcttgtgcttgccatgatgccatctgacatcgagatcaagtagttcttggatcatctggatgatccgtgatgtcacctcatggaagtgtgacgtagcactgtagtatcatacaacaactgattgatcactgaatcgtcgaaagagatatggtccctgaattcccaaccgccttcgtagctagctagcactagcagtcactcacctgtcaccaactcaccaaccaatcatccctggatggagatgtctccctcaatttcccaaccgtttcgccgttcttccaatcaattcagagtttcagaccgccgttcgatccagcctagcttttccagttagagacatcctactgtttttgtgtagttgacaagcacagaggcactcacactgtgtgaatgtaattgccatctttgccaggctaataatcttccaatcaaggtgagactgaatgaactctgcgttttcctatctg

SEQ ID NO: 52212 - DNA, 936 bp, Oryza sativa
cagagaaaaaaagaaatgcgccgtaaaggaggtcgcttgattccagtccatgcatacgcgtttttgactcggaacaagcaaaggaggaggaagaggaaatgagccgacgatggatggatcgagaggtgtttgcaagagtcccaatcgcgagaagagatgccaatattctcgtcggtttggaggtttcttggtcgatctgactgaatattttgatcactattcgtcgatcagtcagtgcgtgcaagctgctgcccagcatcgatgtgatgtacttagagcaagtttaatagcatagcccactactagcttcaattcatctataggcaatctaatagcttattcatataatagttacatatatactacactattaatatctggtcccacatggcatacacacactaagtcttggagtccatgctacagctggctacaaatctgtagcccgctgttcttctttctcctcatttatctttttaaaatatatttacagctggtttatagtatgctattggacatgctcttaatggtggcaaatggcggccaaaacgacgtttgtctgtgtgtgcaggtcgttgtcgattggtcatcgttgccaccactggaatccgggcatccagctgcgacctgcgactgcatctgcatgcaccatccagatgagaacaccttgctgggaatctgagttcacgacatcaacatggttatgaagttccaaatgtagcaaatgcagagttagatagtacagtatttgagagtattaattattttaaatttaaaatttagaataatttgatttttattcaactttcatatagaattcttttgaaagaaaaacgtactgtgtttagtagttcgggaaacgtgcacgtaaaaaacgagatattttttcatctctatcttctactctcaaaaccttacagttggtgcccagcaagt

SEQ ID NO: 52213 - DNA, 1631 bp, Oryza sativa
  unsure (1)..(1631): unsure at all n locations
cggttgtttggtcggtaaagtattttcgtttgattgattgagaaaaccacggtaatatatttgttttttttattgggttgattaagtgtgtatactttgtgcctgttcagagtacggcactggttgatattattttaggagaactaagcagagtccactaaataatgacaaatacaggtattatatactatacattattacatggtagacgcatggtgttatgattgctttgttgtttatgtatatatatgagtgtattcgaaataatcaaattgactttgaggaaagacttccattacagctgttgataaaatttaagcacgcacctgcacggtttctcgtggagcaatgaaatgcatttcttgaagtaagaaactttgatgaaacgtactaaaagattataaagaacaatcagtactagaagcaaaggcagctagtaggtagtaaggagattttgtttatccctattaatctatccactactattacactacagatgaagcgtttacttgcaaggaaggaggagcgcgaggcggcgtcgcgttcgtttcacacgcacgctgacatgcgtcgccattgactttcgccgccgccgccgcggtggcgcgcgcgcgcacgcacgctgggcgacacgccacgccgctgacgcgacgcgcgccgtgcgcacgagcaacacgtacgcaagggagaaggagagatcgctatagcttccacgcgcaaagcgcaggggcacacgtgcgtgttcgacgtacacatgacacgncgnacagcnaagncggcncggcncggcgcggcgggggcnnacggcaccgaccagcgaacggcgtggtggcggttgggcgcgtcgcgtcgcgtcgtgcgtgggcgaagttggtcggcgtgtcagcgcgcgaccgcgtctcggtctcggcctcgttgctcacggcatacgaagccttgggcttttacgcacgggagaagcccacatatactgattcttttgggccgtcaatctgaggcccaatcaggctcgaacatggcatatatgctgcgtggttttatattagtcccacctcgcgccctagacctgattggaagaggagacatgggtatatgagatgacccagggtttgtaaccaaatcatacctttctcggccttttggctaagatcaagtgtagtatctgttcttatcagtttaatatctgatatgtgtaccatgtgttcactttgatattaaatttattttagccaaccatgtcctcggcgcctagggttcctaggcgactcaaggtgggttctgcgtgggtagggtttcaatcttctctcaaccccatcggtctcatgcctgatcggatcgatctcttcggtctagatcctgagtcggatcgatctcttcggtctagatcctgagtccacatcccatccttcctctgtgtccacggttagattctctgttttggagccgagccaaaccttgctagccggggaggggtagttttagggttcggagggcaccatggaggcgatgcaggcactgatgaagcgcatgcaattgtcggaggcagagaagaaggggatccggatctgcgaggcggagtctggaagtatgggatcgggggatccgaaggcgatcgggaaggtcctggcgga

SEQ ID NO: 52214 - DNA, 1111 bp, Oryza sativa
cgaggaagaaggagaaggaggcggcggcgtggccgtggtcgctgtgggggttcctcctgaccggctgcctcggcggcggcggcggcggaaggaagaagaagagcggggggaagaaggtgcgtccccgcggcggcggcggcggcggcctgcggcggctgtcgttcacggacctgacgggggcggcggaccaggacctgtcggtgtcgctggtggggtccaacctccacgtcttcaccgtcgccgagctccgcgacgccacccgcgggttcgtctccggcaacttcctcggcgagggcggcttcgggccggtctacaagggcctcgtcggcgacggcgtcaagccgggcctccgcccgcaggccatcgccgtcaagctctgggatcccgagggcgcccagggccacaaggaatggctggtacttcacccctccacgtgtcccttttccacttaatcatcaaaaaaatagaataaaaaagtgatatgatttcatttgattaattagacatgcacgcgttaatcactttagttagttaatcatttaatgcgataattaaatcagattgatcgattatgtttgtataagattaacaattaagcttggagtaattaatctgagatagtgtagtgccagcttccttggaagagtccctaaatctaatgcttgggggaaacaacattttctcacatggtttcttatagtaaaagagtggccatcaaatatagcttaattggtagagtagtagttgccttgcaaggatcactcaaatatatgtatcccagtatatgaatatcctagggcattgagtaaccctctagataactgaaatttgcaggtgaggaacagtattttttttttctttttgagggtgagagatatgagatatcgttgattttgttttttaaattaatattattgtttttctttgggaaagtgtcgattttccttttatttattgcatagaagcaaagttgtgtcgtttctcctgtagcaacagggaaggggatcagtcaaattacccaatcctttcttgcctaagctatttagtttcccatcaaacagagactgatcagcggtaattagtttggttatcggtcgatagaggttaccac

SEQ ID NO: 52215 - DNA, 1328 bp, Oryza sativa
gctagattacagacgtcagatgaaagtgaggtcacctgtagttgttggatcaatttcaggttgacatagtaatctagtgtgctgcaatcttcccagctgcctcactggctcaagctgattgatttgttcttggtcatgacgaaatctcctaactcgtgactggatatcgaatccctccaaattacaataataacatttcttgaaaattcagaaggcagaaagaacaagaaaccaaaattccacaaaggcgacaacacgcatggccggctagccagtactgttcatcgtcttttttttctcctctgctgcaacaatacgcataaactgctttgtttttccttttccagctttcttattcgattgatgtgtatacataacatggctatcagctatcgattaattaattataatgatgacatgcgcggctttagctgacgttgatcctgctgagatttctgaagatattttcttttcttttcttctttttctgcagagattcctgcagtgctgccgtggtcgacccgattaaacatcgcggttggcgccgcgaagggtttggcgttcctccacgacgcagagaagccggtcatctaccgtgacttcaaggcctccaacatcctgctcgattcggtgagtgccctgtagcttttcctaggtagattgacacctctcatatgcatgcatctcagttagctaggagtttttgatgcacacatcacatatgatatactatatatatagtatcatcctaatgaccttttcatcatcatcagtgaaaaggtagagtaatgactaggaaattgtacttggcacagtttggattttgaagcattttatgacatgattatgtcagagaaacttagtatcatactgtacttatgctgttatagtgttatgcatcacttcatacttaactagtactagttaatggttattatcatattgtacttctctaccaaagaaaaggaaaggaaagcttagtgatgtgggctatggttcataggttgggccgtaagtgagttctgctcaagattgggctaaaaggaggcccaaattttagtttcaccactgaaaagcgtcactgaaaataattttatcgggtcatataatcaaatctttattatctaaaaaatataatcaaatctttacatttttttccatgaccgtgtcaatgttcttttttttgaaagaaaaagcaaatgttaagtttgggcctttaatgggttactactcaagatgggccaaaatcaggcccaacttgaatttcccccactttaaagcccattcattagtaataagcccaagtaagagaatcgcatcaaatgggg

SEQ ID NO: 52216 - DNA, 4212 bp, Oryza sativa
  unsure (1)..(4212): unsure at all n locations
tcttattaccggccgttgacaaggcattggtatctgacgaggtctcttgccgtgtagttagttttagaggttactgtcgccgtcgtgccctcgcatgcaacgtgttcgtccgacgacacgacccggcacgggcggcggcgccgacttcgcgacgccacgctgtctttgaccggctccgacgagcgcccgccgtataaagaaagaaagggtcgcgtagctgataaaagcacggtgtccatagctagctagatcgtcgtcgtcgtcttcttgcaggagaaagatggagctcccactgcggtgttttcatggcgctaaggtggcggcggtggcggcggcgggtgatggcggagtcgccggccgtgcggctgttccggcgaagggcggcggcggcggcgttgcgcggggggtgaaggtggtggtaagagggctcgtcggcaaggccggcaaggtgttcggccggtcgatcccggcggcaaggttcggccacctcgcctacataaggtgaaggcgcagctgcgtcctgaaacgtcagtgatctgatcttcttctcctctctcactctctgccatcgagggaggtgtgctttgtactagcttttttcttcttcttcttcttcttcttcttcttcttcttctttttttttgtttttgggccaatgatactttgtgctagctaggtgctcgacaaaatgcgtccttgattgatgcttggtgattttcactagatctgttcatacgacttgtaaatagtagaacatgctaggtacaaggtacttttcagattacactgttcttcagttcttgtacttagtacgttttcttttttttttcttcttctgtatgaaatacgctcgtaataacatcgatcttattaaggttgtttaactttttggtgttctgttagatctgcagttccttcttttttttatatatatggacaatttgatggtcagatgaacagaaggcctttaccaagtagtttctgaacttctgatgctagatctatacgaaggttaggatggatgcacagctgctggtttctacaaacatcagtacatcatatcccgttgcgtatgtggttgccatgagtcttttctgttttaaaaaagaggcagattagaatgttcgatacagctatgaatcattgatttgcttctgcattattcatgcatgcagccatacagctcaagtattcgttgttttgtctaatacggtgtactctgtatctgggtttctttcagaccacagtctgcgtcagatatttttcttctctaatccatttgtgtatttgtgttgttcaccagtagtgcacgtctggtatgtacttgctacttccatcttctgaaaacaacgagggaaaaattatctttggcttgtaatactaattaactccttacatattcttgaattcctcttcggtgttccagacactcttgtatgaaagtatagagctattttctcgtagtacaaaatgaggataaaatccctctcattacaaaacaaagagggaggttatgtgtcttatggaagaggccggggatgtaaaacatttctgttgtctttaaaaaaaaagataaaagagggatttgaagaattgtatttgaaattctgaattatacataaccaaaattgatatggattcgggattgagtcggtctggtaattgcagatagtccaacattaccaataaatcatgttggctttcaaagttttaacttaaattggtcgacatggagtactagtattgcacttgtttggctgcttgctgaagtttgcggcacttgagttaggagtacaagtgtttttttaaacggaaaacggtacaagagtgcgccttttcattaaatatagaaagaggttaggagtacaagttacgaccatccataacaaatgtttgattcattgctaaaattgaagcatattaacccttaacctcacatgttattatagccaaaacttgccacaaaatctatgggcaccgtctaaatctctatcttcggtcctgccagattagtaccaatactcctactgtgatggcgatgtcatcgtttcgttacgctgacatgcgagcgtacaccgctagtagtacaagtgtaattcaagttgaacgatggatcatttctgtcgtaacttcacatccagcggatagatgagatgactgatgatcacaagcaagacagggaaggtccctcgtttcgcttatatagggaataagacaaacggtataattgcaaatgaaaaaataattttntatatacgtgttcctacgatctaaaagtaaaggctaaaaaataaacttcgattaaaaaaacccttaaatcaactctaaatttaaggttgaaaattaaaatttagttgataaacataagcataagtgaaaagatgaggctgaaagttgtatatacagtactttattctcatcttttgtttatcgcttaccggtcgtggccaaattaatcgttaaagttctctttaaacattggggctgtgtttagatccaaactttgaattcaaacttcaacctttttccatcacatcaacctgtcatacacacacaacttttcagtcacatggtatcaatttcaacccaaacttctaactttggaaggaactaaacacagcctggatttcaaatcgcaaataatacacatacaacaaatggaaaactcccacaattttttgttgcttcgttcacgggacttcggcttgtcacttcacttcatctacaactacaagttctcacttgagcatcctgcaatcctactatgtttcgtcttgttcttttgtccctcttttgccatgcataccgctgttgcttttccagttttccatgacccatccagtcaaaccaatactccctccatcgcaaaaacaaacaacctatgagtaaatttgacactatacaatgaatttgaataggagtattctctccgtcccataaaaaaccaacatagtactggatgtgccacgtcctaatatatcacatcagttctagattcatattttttggaacggaacgagtatatcatgattagttgtactagttagtatcaaattcacttctaggttatttttatttttgataaaaaggagtacatatgatagcatgataggaatacgatgccactaccctttaacaaaaggagtattcttgagcaagagaagcaagcagccattcgttcacaaactctggtgattgatcgtgatggccattttccttgtcttccagagacaaaatggctatgattccctcgcctcgggagagcacgcaagattgagatagcctcctccaattattgggtcactcacacacacacacacatttacactgtactactctactggtcactctcgaggtcttcttggcccatgcagaagatggaaacagggaaagcaacagagaattgacagggttggtctcgtcctgctactcctgtttgccgtatctgaatcctgccaagctttcagcagttcagacctttctttttcttttgcggaggaagttcagagaaattttcctgtggttacaacagcagccagcaatcagtgagaactggctggctgtttatatccaaagacaagtccgttgtttggtccaaagacaagtctggaagaggcccctccaataattggtgtggatcactactcatcccataaaaaaacaaaactaagacatgatgcaacattttttagtacctggttcagaggatttgatcagcgtagagactgcatttacgttaggttacggtcagataacagtaattctacagttcatcagtgtttaactggagccaagggtgtgtttagttccacgccaaaattgaaagtttgactaaaattaaaaatttgaagaaaaaagttgaaaatttatgtgtgtaggaaagttctgatgtgatggaaaagttgaaattttaaaaaaaagttgggaactaaaccaggcccaaatgtgcctttcggacggtcagtgccaccaaaacgagcgaccgaaaaccaccgaattttttttatttataattttttttattaaaagttttacaaaaataattttccattttgaaaattgacggaagtagtcgcctaccgcccaatcgccctctcagagggcggcgaaaatgacgtggcagacggccgttcgctctcgggcgacggccgtcaacgaaatttgcaggcggccccctgccgccctccgctagggcgattttatactgtgcgg

SEQ ID NO: 52217 - DNA, 1716 bp, Oryza sativa
  unsure (1)..(1716): unsure at all n locations
cctgcaaatgggcggcgagggggggcatggaaatttgcagcaggcccccttgcggccctccgcaagggcgattttgtactgtgcggggggccgcctgcaaatgggcggcgagggggcatggaattttgcaggcggcccccttgccgccctgggggagggcgattttgtactgtgctctatatttttgtataaatatcaatagttatcaaatctttttatattgaaaactatacaagattaaaatctccaagactgataaaatacaattttattattttttagggcatatttggattgttaccgtacaaatattttattaatttttagggcatatttggattgttagtgccaaatttttcttcacgaccaaatatttggtaaggtaaaattgcatttgatcatatttggtgtgctggcaaaatgtaaaattgtagtgaagaatgttctacataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactgtgcgcgctactggatctgacactaccgtgcagcgccgaaagtgtgttgtcgtgagcataagttgttctagccccatatgaatgaaaagactatgtagacgagacaaacacaagtagtactgcagtagtaatagcaaaagtagtactgttttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgcgcctctggagctcctccaagctgagaggagcctagtacctcgtggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggagctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtaccgtgcgaaaccggtgctgtaggtcgcactgctccgaagctaggggcgctcgaaggcaaacgaggtcctgcgaggatggaacatcaagttacgacggggtgatgttttcgtccaaaaacagaaacaaaacttaagaaacctctgggctgagcagtaccgtgcgaaatagnnnnnnnnnnnnnnnnnnnnnnnnnnnnnnnnnnnnnnnnnn

SEQ ID NO: 52218 - DNA, 1287 bp, Oryza sativa
ttgcggaagtttttcgctcgaaaatcatattttcctggcggccaggcatcggatttgtgattttttattttgtgatcaaaatcattttccctaacaatcagcgtaacctaactgtggtgaagttccgcctgtaaagatggttcattttcattggcctttagttgctagcggtagcgccggccgtcatagagaacgcaaagtagccgtcaggaaaaacactttgtttttaagtagtgtcggttttcttcgatgttgcatgcagtggttactttagtgttgcaattagtatttttaatgttgcatctgtttgaaatatttttagtaagtaataaattattttttactaaatgataaaactccgttcgacgtttttcttcaaatcaagcgtacaactaaataacctgcatacttttaaattacggcattataatctgatatggttgattttaacatcaaattaatcaaacgtacgcactacaatgacaaatccgacaaactcatgcagtattttatatgcgtagtatatatagacagatacatacatttcactaatcaacatcctgcctacctttactgaaagcaacgcacactgctccagagcaccaaaggttagctagctgaatcatagatggtccatgatctaaacaaagatctaaatactagccgtgttgactaattacatgtactgattacacatttatacccgtaataatgcatcatgcatgttaagccatgcaaaagctgatggttacgtgtacgcgatcgataattattgatttaagccttaacgagcaccacctgcagtgaccctgaaaacatccaactcacctacatactatacacactgtcagcacagctacctgcatccaccgaccgtctgcactgatgactgatatatatgttgactggcgaatgaagaaggagaagaagttgaatcaaacttcgtcatcaatcagcagcagcaaacctccaacagaaatgcagtcacctacatgcatccatgatccatgtaggagtaagcaattattgtcttttttttaatccttttcctttggtcgttgtataactttacttcattagcttggcccatcttgtttttgctgctactgttctctccggtttagaaggtaagatgatattctgtttttttcatactgaatttatcgaaaaatgtaatgacatctacatgacttaaatagttttattaagtccatcgtttccttcagacacttattaaataggtaatttggaaccataccattataatttttcaaagtttaagatatg

SEQ ID NO: 52219 - DNA, 1052 bp, Oryza sativa
ccaccaccgggcgagcctctcgcgccaagtcggcctcctccaccggacacgcctctcgcgccaatccggcctgcctccatcggctgcgcctctcacgccaagccgacctcggtctccgccgcccgcgcctctcgcgctgagtcggcctccgctgccatcagctgcgcctctctgcgccaagctggcctccgactcctcctccaaacgatgccacgctggccagatgcagccgtctgccacaccctcgactagccgtccgaagccgccatgcctccggtgaccgtggtcaccgccaccgcagccgctgctgccgaatgcccagccacctcgccgtcgccatcctcacctcctccactgcagccacgtccacggtcgccacggccaatgccacaagccgtccgccatcgcagcctgcagccaccagcacccgatgtcgccggtcgcgactccacaccgtcgccggcctccatgacgccctcccgctgccgcacgacgctggcctccacgacaaccacacgccgccggcctccacgacgcctgcacagcaggcctcgccacccacgaggccgcacgaccgcctccacgacgcctcaaccaccacggccgttgcctcgccagccaaccgtcgcagtcgatgccgccacagccgtcgccaccgtcactgctgccgtcggcagccgccgccgccgccagctagatctggctagagacgtcattgcctcctcccgcatcgccgacgtcaccaccggctctcgcggcacctccaccaccacacccgtcgtccggccacgcctccgtgctcggctaccggagctagctccagcagcgtctcccgccaggtcgtgaccgcccaaacccaccgccaaaactcgccgccgagctaccaggacgccgccgtccgtcgttgggggaccggatccgggcaccacagcaccggatctggacgccgccagtcggcgtcgacgccatgccctgagctcctaccgtgccgacgtcccgaccgtcttgaccgtgaacgcgggagagagagcccctccgccgccgtccttgca

SEQ ID NO: 52220 - DNA, 1285 bp, Oryza sativa
caagaacttgctgaaaggtgagacagtcagacaaagaccatttgataaaggtaaacttgggaagtaaagcactcttgtaattattcatcagctgctaatcgctatggaatacctggggaaatggagcgagatggaatttgtctttgtcccccagtgttgtccccttgatgatgagctcttctcttctattttgtcggtgtagagatactgcaacacagtgttacctgttactgttactcattctttttgataaataagttactgatactaaagtcaagaagctgtaatcaaagataatgactctcaagaacaattagtgcagttgattacatgattgtactcatcactgccagaaaatttccatgtaatatccaaatgagctgaacaatgtgacaggtttttccattaaaaaaaacaatgtaacagcggacgagataaatctgttcaaccgtcggatcgaatttgttcggtcgagataaatctgttgggctgcctctagtaggagaacatctcggcccaatatcatttagttggcagtcagacaaaaggtagaagcccatattggcccatcaaataaggatggttgtaacccctagagcttggcccggcccccaattttgcgcgtgcgcaaggcccatgcgacctcttcaaagttcaaactgatcgagttttaaactgtgacaaaatttgatcggattttgtcggaattccgttcgacaccgtgcgcatccgcggcgaagtccgtcaaacactaaaccctagaaatcgcggcgacgcgcggcggaggtgagcgattccatcgatcgatcgaggccatgtccatgttcctccgggcccttgctcccctcctcacccggaggttctccgcacgcagcgcgcaggcgcagcgatcggcggcggcggcgacggcggggagtagtccagcaccacgctctcccgtttcccccagatctcagatcaaaattttcttcactcgcgcgcagcggctcacgctcccgtccatctccgcgcagagggatctcggcgtcggccgtggcgcagtgaaaggtgttcttgccttgacgagttcgttggctggattgctgctcggattcctctatttcaagcaagatagagatgactcaggtatctatctatgccttgttcttgaaagaaagcgccattagattagataagattcggttcctcgtcgttgctagcttcaatttgtttcctacctgtagcaaccggggaggagaccaggaaggaggaggaggaggtgactgttaattggagggacgtgatc

SEQ ID NO: 52221 - DNA, 3164 bp, Oryza sativa
gtactcaatgtctatccctaatgatctgcgcaagtattgttgttcatgcagtatggccactagaaggagtatcagatcttgtttaatttggaagcctgcaatcatatatttatctataagttcgcatgatatatgccgctttataattagcgaattggcttttcgatttccaattgatgaaagttgttctagtttgatatgatctctcctggctagtcgtaagccattgcacagcagtcgtagcaaagtagaaactgcaccgtaggagcactgtaggcaatgttatctgctcttttcttcagtctaattagttatcagttgctctattagccatttggaactggcagctaacaattctttcttcgcacatatctctttgttttttttctagctgtcttcctaaaattatttgtgcaatcctttttttatacaaatatataagcactgactctttagtttcaaaaagagaaatacaaagtaactccagaaatgtgcattgcaatactgtgtgacactatctgttcttgttagttattatttgttgttcttgtttaatattaactgcatatgataaaaagaaaagctgtatcatgcatgaacattaaaaccctgagtgtttaatgctttagcattagcttcaagatgcatttttcaaggaaactgtgagatgcattaattttacctctgtgtaactagtacatatgaaaaatacttttgctgtttggattttgcttcactcagtcactctttgtagtaccatagtctaatcctaaaccgaactcgctgaagcttagctccaatgcaagtggtataagataggaggatttttacagtccaacggtaccttgcggtaccgattattgaccgttggatcgaggcagatcgaacggctggcgtagatcggtaccgcggggtaccagttttgtccccgaagcggtaccgagtgatgataatcggtggaagggcagtattgtaatttcgcgtgcaatagatgggtctggatcgagatcgagcggcttgaaccctagcgaagctggatgattttcgccgctgccgccgtgttcctcttcctcgccaccaccgccgtgttcctcttccgccgccggacttgttcctcttccgccgccggacttgtttcctctcccgcgccgccgccgttcccttttttctctctcgcgccgccgccagactttatcctctcccgcgctgccagcgttcccttgttgctctgcgccgccgccgggaatgacaatgacttggacgccgccgccgccgggaacgacgactcgaaacaggtactccctcatccacccttgctcatcttttctctcccgatcctacccatcccggattcaacggttagatgtgtcttggtaccgcgcggtaccagtaccgcccggtacaacctgctggacggtagcaatcctcataagatagtgtggatgaaggcttagcttcatgcataaatctttccaacaagctgcaccatatttttggggggaacataatgtaattttcatcattctttggatgagaacagaggagaagggaactattctcaatgcgtgacaaagcaatgcgtcaagccgagttgcagacaaaaagcagctagtcagaaagaaagaaagaggtgatgctgacaagcattttaattgcacttttgtcttcattccctaatgatcacactaatacgattttgcatcgtttacatatcatgtcagcaaaagcatcgcgtctcttgacgccgccgcacccgagcagagcgtattcgatcaccacccgcgccaagagcgcttgtcgatccgatccggtgcaggacaacttcttccatcatcccggctgaggatgcttgctttgctgagctaattgcatgcaagagagcaattgaaacaggccaaggaagtcagagtgttacctagggacagtcggacagacagacaatccagatgtagtgagaatgcttgaggggagggatctcaacagatcagcttatggagccttagcacaagatatcaaagcgaaactcctcttacttcaggaggtaaaggttggctgggtccgacaaatcaggcgtcgcataagttagcgcagaatagaatttttttaccagtgcttggtttaatgtatgtaacccctcattcttagaggcggcttttttccccttattaaatccagggaacttcattttccccccttattttactgtagaaactagcaagtgcagaggattcaacccaattttgtatatgagaagaaaaacaatgcatatactctatatcatatttcccacttttatctcaaaaggtacaagttttaccctgtgccataagacaatgtacaacttagatcaagtactctccacagatagccgctcaagaagttggcattgatatccccatcacaacgacgaatttggagctggtaacaagaagttcaggagggcctcattgaaccgtttcgggtcctcctcctgtggcatatggccggtgttctttatgatttccaacctagcatttgcaccaagttgcctgcatttgcgttaattcatcttgtgtaagtaacattacaaggtgcaacttcaacatgtaattctactgttttttttttaaacaaaaagagggcaaaagttttgcttcatatgtattaataatgcaattatattagaaggaataagtactgaccttgctacttcaaatgccttctctatgggaaatatctgatcatgctctccccataatacaagaacttcctgaaagattagacagacagagacatttgataaaggtaaacttggcaagtaaagcacttctgtaattatttgtcagctgctaaatgctatgcatacctgaggaagtggagtgagctggaatttttctttgtcccccagtgttatccccttgatcagctctttcttttcttctattttgtcggtgtagagatactgcaacagtgttaaatgttactatttcttatattcttttagagaacaagttactggtactaaagtcaagaggctgtcagcaaagataatgactctcaggaacaattaatgaataaggcattttatcttaaaaaagtgaaaaaggacgacgagttaatttgagaatccagctcggataggttggggaaaggtgacaggtaggcctgttgtttgttgaaattca

SEQ ID NO: 52222 - DNA, 905 bp, Oryza sativa
tctgcacacgcattgcaagcattccaaagcatatgcatggaacagttgactgtcatttctgaagcgatggacttctgctacgcttcaccagctaccggagaaaaacaagaaagtaacacaatctatacacaaaaacggcttcttaattagttgcatggctaatctctctttgatcatcgtgtgtacaagagccgccattaattagacgtcaaaactcaaaaccgagttttttttttcaaagatcctgaaattaagaaggtcgtcactgcagagttggtgcagatgattgatttcagaaacaatatagtacatatttgcattcgaagctcttcagttcttttgttttttcttcaccttgcaaagcacgtaggcacttggtttgatggtttccagaatgatgtttcttggaagcaagtagtccttggcaaataatctgttattatcatcaaatgcagattacaggattacccttaacctaaccccagttctgacttaatcagttcctactcctagtgtttgacaacctactgcagcaaagaggattacactaattaaacatttgatccttgcctgaattcatgcagcatgcatgcgtgcttgcacggccgtctcatcaggtcatgtactaatcaattaacagccattgacccattgtgcatatggttttcccactggacatatgtaactaaccagtaattaatttcctgattagttcttgattgggcaccaagaattagctaagtagctaaccaagaaccaggcttcaaaatttcagttttgaccatttctattgggggcaccgatggtaccgaaatttctaaatattttgatccgaaataatttaaaacttgaatagcttcttatcggatgaattcttttttgataagatatatactcgattacat

SEQ ID NO: 52223 - DNA, 4700 bp, Oryza sativa
accaggtgccactcagctgttcataagagggttgcttgtgacggccctttcatctgcagaagttagtgttgaggatgttgaggtcgcgcttactctgttttaccggcttggggaaatagtgggtgaggaagagatccggactggagctgggttaattagggagcttgtcccaatgctcctttcagcgagattctcatgccacacacaccgcctagttgcattagtgtacctagacacaattagccgctatatcaagttcatgcaggagaatgaccaatatgtgccacatctgcttactgtgttcttggatgagcgtggcatacaccatcagaatgcccacgtgagctgccatgcaggatacttgctcatgagagctatcaggctgttgaaggctaagctagtgccttacttggataccattttgcaggtatttcctctatctcttttaataggtttaagccagtctagttttctattatagatctgagttatgtgtgtctatgagttaacagagcttgcaagatgccctagtgcaattcactgctacggactgggcaaacaaagatattaagttctccagctcagaggatggcagccaaatattcgaggtacaatgttctcacctttgtctagctgttgttttacactgggaacactaatcttggatcaatgacgcttgttatgattttaggctgtgggactgttgatcggcattgaagaggtgtcaccagataagcaggttcagtgcttgacagctttacttaatcctctctgtcaacaggtgatcatcgatctctttctccccctgtttatgctggccttaggtcctatgggtttaagaatcttacattcatcggtgaaaatcaatccagatcgagtcacttgttatggatgccaaagcacaaggacttgaagaatcatctccaagagctataggtcttcaacagattattgttgcattgactatgatcagcaaggtatgctgttcatcctcacacatcacgaggagttggcaatatcacattccgtgaacgtagtatatcattttatttctaaaaaaacgttctgattcgctcatatgccaaatctttggttctgtatatggcaagtgcctcaagtattaatgcttgatcttactgtgtctggatgctgtccttttttagggatttaatgaacggcttgtgatgggaagcaggccgacacttggcgttatgttcaagaaggtacattctgtcattctccattccacgtatatatatgctttttaattatcatatatgtgcataatttccatttttcgtatgtgatttttttttcgtattgttctcagacccttgatgtagttttgcaagtcctcatctcatttcctaatgtgaagcccctgcgatctaaggtaagtaactgttatcaacatcttttgcaatttactgcttggatgattaaccaatttgtaacttatgcaatgctgaaatacagatcatatcatttctccaccgtatggttgagatattaggcatttcggtgcttccatgtattccaattgcactgcgacagttgctcgttgataatgaggtatttcatgtccctgtttcctggttattggttttgcaagctattgcgatctctaatagtaactgtagcacctgtgttccctttttcggtaactgtcctgttttagctgtatttctctgaggaataataacggcaggactttggaaactatcgtactttgtaatgtttcttttatatacttatacaacaaaaaggtgcctctgttgttaatcataccatcaaaattatttcagccattggatcatagtattaaccattaaattagatcgatgttctgttctacaaggaccgctttagggccatacagtggattggcccagttagactccacatctcacttttccccctctttggcccatccctttgagcggacaatgtccactttatggactctaataataatttagtagttctacaactattttgtttacagttaatattatttctccatcttattgtttcatcacagttctgcagcttattttcattcattcgtactgcagcaatgcaaggggtatcatatagttcttaaaatagcaatatacaaaggaaaggattgtgtagactgtcaatccaaacaacaatggaaatcaatgaatatatgattgtccacagaaatccattaaacattcttttgtgcaattgtgttaatttcttgtgtcttagccttaatgtttttctagtacctgttgaactgcatattactatttgatgcaacatcaaattagtaccttattatttctctaaaaacaatattgtcgtacatataattctattttgcggcccttgctgacatcatctttttacaggcaaaagatatgtcggaatttctgtacttaataaaccaaataatatgcaagtttaaatcttcagcaaatgccttattggaggatgtgtttcctgccatcgcaagtcatttatctgtgatactatcacacgatgccttttcaaatggttttgcaagcaatactgaggtaaattgaattggtaaataagacccactatattactgcattaatttgtgtgttaaccaattagtttaatgttgttttctctaagcattttgttttgttgttagtcactaaatatcatggctgttaaggcgtcgctatggcatcgctatagtgctagggcaccctgagggggtcaaggcatccctccgccttagggcttaatgcagagagggagagggagaggtgaaggcggcagcaactacacccttttcccttttctctgctccatgtcatcaccattttgctcccccttagctctggtttccactctcttctctcccctgcgccagattcatcttgactcaagggagcagccgccagatccatccaagggaaggagcacatacagagagaagcacttgattcattctgaatcagggggaagggagcacagatagaggaatagagctagcatgattaagaagagccggtgcgaggaagaagcgatagagccgtgaggaagaaacgacatcgggggcggcgctgtgagaggagagacacacctggtgcgggtgttagggttatttctttgtctttgggctggtatgaaggatattgggcttttgtgggctggcctgctaggctggttttcttctgatcgctgctaaccacataggttatggcatcgccatgccttagcgttttactgctatagccttaccgccttaacaaccatgctacatatatggcaatcatcttgatatgataatgttcttggcttattgcatagttagtcacacactattgtttgtagctggcttggttcttcatcagctagtaggccccatctgaattgctaccttttgtctactttgttcatgccaatttggctaatctatgtagccaggcttttacaggtatttcatggattgcgtagttccttgtatactgtattcatgccaattttgttcattgcaggaaatgcgtgagctgcaagagctggaaaagagattttacgcattcttgcttcatatagcaacacatgatctgtctacagttctcctaactcctagttgtaggcattatctagagaacataatgcagttgcttttgattacttcatgcagccataaagagatatcacatcggaaggtggggtttaattgatcttgaatttcttatttccacttcaagcgagttacattctccatctccactttaaatagaattgtctattttatactcggttattgttttgtagacatgcgtacagacttttgtcaaccttatcaaagactggtgtagtagctctgaaattgaagataaggtattgttgtgttcagttcttcttatgtcatgttttgaagagtctatctagtacttgggcagttgcattactcataatgtcatgtatttcttgttttcctcagcttcctggcttccgagtgtttatgattgagaagttcgctactggttgctgtttgcagagtgtccttgacaagtcatttaacttccgtgatggaatttcggtaggacctgtcaaccatacaatctatatctatctaaatttctcgtacctgttttactgtgttaaatgtataccatcaagtagttattatactgtttgtctattgcttcattaaattcttggtaattttattaatgtccgtcctgatagggtttataggcatttgattgtgacctccagcctataggtgtccgattggaggtgaaactgcagtttgtagtctaatatgtgatctcttatcacttcctaaacatcagatttacttggatcaaatggcaatctaaatctccactctatataaactattcaggtgattatgtagcttgttgggcacactgatttcttaaaaattcttagaatatttaacttgagcgataaatttctttgtactttgacaatgtatatgttttctgtaaccaacctttcatatattattctcatgatgtttaaagtgccactaggtagtgtttgaattctattgccataaatgccttttaattgttctcaagcagactgggttgcgacatttgaatcttattggtcacaacctcttttgacattcccaagccccacagtttcatgttggtccctagaagcgagaatacactctactttctcttaaattgaaatacaatctgcaaatattt

SEQ ID NO: 52224 - DNA, 780 bp, Oryza sativa
  unsure (1)..(780): unsure at all n locations
ctataatttgcagggtagttgtatcatctatgtacataaagctctaccatttctgagatcagaaggtattcccttgattttgatacacttcttttttgcatctttgacccatctgttattaaaatatctctccccatggagcattattttgctgtatacatggtgtgcatcttcgttgggcactcccttgttgtcctcaccaccattagggtggtaatatagttgatgtaaagcttctggtttagcctatattctgtaatgatggagcatccgaagctctattcatacacctttcaatatcagtaatcatacctcgcattattgtgaaatctgacctcaatgcatgtttcagtgtagtttatgccagtggcacataactgatgaaaaattacccttgtatgcttgcagatgtatactgcgggaatatttttaccgagcctggctaccgtggcaaagttccttgatcaaggcatgttagtgagatgcaggggatacatccccagagtttctgctgtgagcatacagggtttcattatgtttgttttgatatttctctggaagtgatcattgttctgctccgagcttgaaattttttgtaaggcgattcgggtgaagctaaacagatgggataggcaaaagagtgatgtgtgggccgtgtttttcctgacagaaactgtcacaccgcctgttgtcgtgttaccaaattttggcagtggtttttcacnnnnnnnnnnnnnnnnnnnnnnnnnnnnnnnnnnnnnnnnnnnnnnnnnnnnnnnn

SEQ ID NO: 52225 - DNA, 1101 bp, Oryza sativa
ggatgctttaactttatagggaaaaatttgaagtggggggtatatttgtagacttgaatctccattgatgcctacacttcaacataaaaagtagggcacaacaactccaattagttcagtattgggcaaaggagtgacatgcactggctattatttggggatagggtggaagccttgtcaattctttgagctaacttggcactggatgagtggatgggccatgcagtcagttattagccaaagtgtgagaaaactatgtttcttttttcttaaaaaaagtgtaactgattaactgaagcatcagttagtcagactgtttgatctaatatcaaccatcatctgctgtcagtttgtcacagttttgtcactcataatgtgtcaacctcagagaatggattaagctgtgacatatgttgtttgttcagagttcaggctaatccagagagagaaataatatgccattgtgttaccatcattcagatcaacatcttgcaacaatatatcatgcatttgctgatttgctttgcatggatggatgcagataactccatcatgcatgtgacatgagcaaagctcaacaactactaattaatttacaagattatccacatgagacctctgtctacaagaccaatgtcaaagcacatcttttgacaacttcgattccttattcctctagctgtcacacattcccaggaggaaagctcaattagcatctaatcagtggatcactgtatttgtttaatctgtcagctgtaattatctgcctgctaactcagtactactccttctggtttcctaataccaaatcattaacttttaaatacacgtttaatcaacattctcatttaaaaatcttatacaaatatataaaaaatatatgtcacatttaaaatacgtttaattataaaaacaaatcacaacaaataaatggtaattacatattttttaataaaacaaatttttggataataaaaataaattacatcgtcggtttttattataagacatacaaacattaagtttttttaacaaataaccaatcttaagttaatatcatcgtatattaaaaaacaaaaaatatcatcgacgaatcggatg

SEQ ID NO: 52226 - DNA, 949 bp, Oryza sativa
tttatctatagccaacataatagtcaattcatacaatagttgcttactatattattaaatatatggtctctcacctgtcatacacacactgcgtcttgagtccgtgttgcagctggctacagatctaagtccgctattcttctctctcatcttttatctcattaaaatatgtttatagctggctaatagcctgctattgtacctgctctaagagcaagattagtataaccaactactagctccaaattatctatagttactttaatagccaatatatacaatagttacctataaacatatactacactattaatatatgatctcacttgtcatatacacattgcgtcttagagttcgtgctgcagctggctacaaatttaaaaggaaaaaaagaagaatgagaagaaaatggaaaataaaaagaaaaataaaagaagaaaaaaaagaaaaggacacatcatgtccatgtggcatgctacatcaacgccacgtaggatcctagaggtgatgtgtcaatttagaatctagatgatacactttgataagttacgtgactcagatatgtattttgagagtttagaggcctatataacacaaccctataagatgaaggaccgccaatgcactttactcaagttgaatggtagagctaactacttataaactcatattacaagtataagattggctataacatttgtcttcaccttttcttgcttatgtatttagtgcatgtaccttgaagcatatgactagagctttgtacttttcttgtcttccttctccatataaacttatagtttactattatccttgcttaaggtggttgcttcagcaacaccaaacacgagggcggcgaatgctatctagcgccagataatggtgtcattttcttccatatttttttttgctcgccatatcttcccgctcatgtcattctaccaacact

SEQ ID NO: 52227 - DNA, 1231 bp, Oryza sativa
tgcaacatcttaatttgtttttgatgtatgtgctttaatttcctttttgcataagatgttttctgagttctgacaatttgctgcctgatcaattgctaacagtttgattagtccctgtgtaatttagtagtactgctttagtggacgcggcaatgtggcttatattttcgtcgtcttttcattatatgcgtaataaaaactgaatgattgaatgtgtgtacaatacatctgagttggaccagcatcgctggtgctactctaggacagtatgtttcataattgaaagtttgaaaagaggcacctaatcatgtattccactgacttattttaacacttggaatagccttttggattgattatttggcaagtacaaatatactaatgcctgcagaacaattttcattttttgtcgaacttggaagtgagtgattagtaaattaagtaggagtactaatgcaacctgaggctgtcgactctgatgaagtatccatgcattctggatgtcactacatgtctacatgatgtctgcttttgcttctcagtagagaaattcatgccattactgtttgagaactgaaaaagatttaatttgggatctgaagaaacacttctccttatttactactaccagcattagtcttcctgaacattgaattgtgtacttgcaggagtggttgctattcataactgtcaatctgtcatgcatggtgttattgacttgcctgtaactgctgaaaaagctttttagtatttatcaagaactttgttaggtaatccaactctatcatccaaaacagcaccctcgctctcatctacatgctgcatgattccacaaacgcattatgattgtcagatagtcattattcatatcagtagccaaaaagttatttgcctgtgatgaaacagaaagctagtctagctaagatagttgcttcatttcagcatcatccagctaaacagcactgatcatcacctcccttgatcctttgtgtcaattagacgtcaccctacctttcttcctcctcttttccaggattgggaaactgctagcaggtcaagcagcattgtcagcaacagcatgagtctgcatctactatcccaaaattatgcgcatgatttatatagttaaaaagaaataaaaaaatatagttatatatgtataccaactctataaagatataggggatgctttaactttatagggaagaatttgaagtggtggttatatttg

SEQ ID NO: 52228 - DNA, 858 bp, Oryza sativa
tgcaatttgttcgattaagagaatttaattttaccgatctcgtgaagtagtgtttctactaccaatagatactactgtaaaacggtatacctttttggtggtttctagttgcatcgatctaatatgttttgtttcttaaaacctttagctgatgagctttcctctgtccttccatgaatcattgcttaatccaccgggtgacatgttcacatcatgagctggagaattgaattccaatggatgatgcatggatgcaaccgacgatccatcgatcgagacggtactaaatggagaatattagtgcaatacgtggttagctgcaacgacgtgcatgcataatgcattgcatcctgggagggtacagctttgtgtacattgatcataagataatccaaatgtaatccaagtgtccaatagcctcacagtttcgatcgaaattgacaggttgaaaaatagcaagagcaactcatcactcgcatgatgaacgtgtagtgctatcgatcaacagtcggcacaaattggggcggttaatgtgtcaagttcagagatgaatctggcagcaacatgttacctacctggaaggacgtccgttgattatataattggtttatttagctttaaggttgatcctatcttacaggacaaaaatggacggttaaccgtttgagaaaatctataaaaagcaatcgattataccagaggttcagtttacggatgcatctgagaaaatctggacggttaacagttcattttccgatcagacggcataagttcttctgcctcagatggtcgaatcagaccagaggtataaaacaaatacactagaaaacaatgttattttcgaatagctctaataat

SEQ ID NO: 52229 - DNA, 803 bp, Oryza sativa
cttaattaatcacgtgctaatggactgctccgtttttcgtgcggggagatgggttcccaaccttcaagtaacgaacgcctaagtatgtttaggatttgttctaaacaaaattgagttttagtctattatgatgtttatggagttaggtcaattatttagattctttgcctttttacttttgctaatgttttcacgggttcttcaatggagatcttgaaagacattgatcaggttgcagattatccaatcgacagtgtcggttttaggtgggtcactgatttgtttggtgatgccgttttagagatttgccaaatgatcaaagatggtggtcgatagaaagacttttgtgcggtccagagttgattagtgttatggctgtgcttgtgtacttgtatctcttgtggcattttaagatgtatgtagatcctctttgttctgtatcggtaccttatttctcatgtactagaactatcaaggttgtgatgatttcttatatttaatataaccaccattgtttccataaaaagaagtcaactggagtgataatccaaaagcagcctagctagttcctacaaatgagaggggaaacaaatgacacatcagaataaggaacatcgtcatcagacttaatcaagaacatgacaggttcagaatttatgtgatgcaagcctagcctagtttgctgatagatgcgagttagtaaattccatagaaatatatacatatccagggccccatccttttgtacatatcgatgtggtttaatagaaacccatacgatcgatgccgaaatcaagaggtag

SEQ ID NO: 52230 - DNA, 2185 bp, Oryza sativa
  unsure (1)..(2185): unsure at all n locations
nnnnnnnnnnnnnnnnnnnnnnnnnnnnnnnnnnnnnnnnnnnnnnnnnnnnnnnnnnnnncgagggagacagggggccatgtgagccgtagcaagattcctcagttttgtgccagtgaatgagcagtttgcttaagtagggtagtagtgtccgacatgggcaatccgagctcgtgattgccattttatatggggggaacagtagtcgtcttgctccaacgactagctagacacccaaattatgccagattaatggcagatacgcccggttaggtgtgtggacttatgtttgtacctacgaatccaactgcacgcacgttcctccgttccctcaccggaactcaccccatgttcccccaactaaacacacatgtgagacagtgtcaaacgactacccccgagcagtggcgttttggcagtgtgcatcctactcctttcgttctgaaatataagagattttaaacggacgtctaaattcgtagcactaaaaagagtcacatccattcaaaatcgtttatgttttatgacggatggagtagatgatacagagaccaaagatgattaaactgatgagctatatatattttttgacatgtaggatttagcacggtgttcgagacgtgctgcgggtcaggcggcggcaagttcaactacaacaacaacgcgaggtgtgggatgtcaggcgcatcagcgtgctccaacccggcgtcgcatcttagctgggacggcatccacctcaccgaggcagcttacaagcagatcactgacggctggctcaacggcccgtactgtagcccggccatcctccacagctaaagcaaaatgactggaaagaacgagccattagttaatttattactttattattaaagctggtgtntattaattaagcgggaattaattaaaggggaatggtttgggttcttgatttttatttgggtggcatatatggtgggtggtgtgacggtgaaatggtttacttgcgttgccaanaaagcaaagaaagcgatggcatctgtagaataaatgttggttactgttgtaatttgataattgtttctctttcagaatcaaatgaatcatcaatggtattatactcagttattttttttcttttgcttttagaagagacttttttgccatgcagcttatgtttggatcttttgcctggccaggggcatgtggtctgtgctttagaaaaagcaactgcagaaaattcactctgatggtcatcctgtctgagacggtcttgtcattattagtcagagactctgaaagtgaaagtgacagtgtttttttctcattgcaaacttttagctaactaaccactaggttgatgaacaaattggacactcctactggggaaggaaaacctgagcaaatttatccaaggatagatagatatgcagcatatgctccaagtacaataatgcaaaaggaaagcaagctactcttgcatagtgatgcactcgctctcctactgctgaatctagctagttgcatcaaatcgacttgaatacatgagatggagtaatatgcagggcatgtgggtgacgcaagtgggatggcctgaattattcgtagctgttggaattaaatccaacggcgacccatccttggaaggaggagacgaatcttcgtatttgattgcctaacacatctattgattatgatagtgatgcacatttgcaaactaggacagggcacacaagcaagtacaagcatgaagcatcaatcagagcggctgatttatacttacataaacgcagtaaacaaaaaaaagaaataaaaacatggcatgcgtaggattgaaacacagaaccaagcctaccatagaggttgaaggatgttacgtatagcgaaggttaaaaaaatatattcaaaagtacgaagcatagaaactgtgtgttaatttgtgatgcattctactactatacaacaaaactgcttcacaagggcacatgatgagcattcctggcaagaatatactaccaagttctgaagtcataagcaaatgagaatgtgacaagaatgtggaacaagagctctgtgatcccgtgtatctgacgcctgaaatcggcggtgttggctgcctggacggcgcgccccaggcaatgattnnnnnnnnnnnnnnnnnnnnnnnnnnnnnnnnnnnnnnnnnnnnnnnnnnnnnnnnnnnnnnnnn

SEQ ID NO: 52231 - DNA, 1645 bp, Oryza sativa
aatcatggtggtgatttgagtgctgggtttcagagcagatgtgtgtagtgcaatgcaaggcaaaatgcgacactgcctgctaattgatgcgtgcacacgtgcgattcgtattattgtccttctaccctcaagaaaatttgtacgtatatgtgcacacgtgtttgagctttcagtatttttttaatataaaaggaagttcagaaaaatcaatcaaaattttgcaatacaaccaaaattccaaatttaggaaatgtacttcttttttttatatataaaagggcctcattccgttgataaagaagagaagaaatgtactttaagcatcggtgaatttgaattgaagcttggaattggaaatgccatgttgcccaaccacatgtctaattcagtatttcagttatcactatctaactacgatgattagaatgtataatatttaagtacaataacaataagatgtcgaataaatgctgagatttcgatgattggattggtataaccgactgcggtttgtcttactggcgcctaaattaattgattaaaattttaaatgcaacaatggatgcattagttcgtcagctggaaaattttttttggagattaattaggacgtagctgttgcctgccaccaatcatggcgacaacacagccgctacgaaaggaacggagattacatactcgaaagagattctttatcgtcagaaaaaactgatgaccacagcagcagtgacaggccagcacgaagcaggagtagtagtatatgaattataatttaagaaatacacattatatttgtatatgggttttattattatacatgcgcatttcggatcatatgcgtatcaatgacaaacatgatgaggcaatatgaaatgctggactgcctgccctggatagagtcatgcagatacttgtcggcagcattacgcgttgcttcctgcagttgcatcatttttattttcttttgagtacttttaaggtgttttattattctactgccagtattatcatccataaaaaaaattttatcaattgatttataagttctacaactagtagtaaaaaatatttcttatactaccaacagttaagttagtagtataaatagaaatgatacattggactagaaaaggtgattataaaatatctaccacctctgtttaaaacatagcaacttttagctataaatttcaataaagatatgtttatattcgtagcttaaggttattatattttagaccagaggtagtattttattttattttcttttttgcatcatacaattttgctagttttttttattctacatcacccttccttttttattatagtttttttgagatggacagatacggtaaagagtactttggatgattgttaaactgttttggagccacagatgctgtgttttgttgtggggcttaaaaaaaaaaaaaaaccttcaagaactttgttgggtagattagtattctccgtttgtctggtccggcctgccattctacagtactttagctggctgggccaacatagcttgatctgatttgcctcagattaattctgcatcatccacacaattgcagtttggatacacacaataattacatttaattgtaggatccgatattggatttaagtttataaactg

SEQ ID NO: 52232 - DNA, 6507 bp, Oryza sativa
agtttgagtttccccctataagacgatttgtggtaaatacacccccctctcttagttcaccttgatttgagattcccctgattgccattgctcgtccattctcgtgacaaacccccccccacatgtgttcacatgaatactaatacgggaggagttgtggtcaccactcatgttgatcaagcctaatgacacgattgtgacattcttacacatgacacgccaacaccttgttgggcagtgtgatcacgagtctccgcacttgaacatcagggttgtcgaaagatgagctactgcgcttgcctcatggggtttcgggtggctagtttcttcgaggattcaaaaacgatgaaaatgagctcagtgtgacactgtgctgctaagaaagataatgtgttcagggtcatatacatcaagagatgagctaagtcgtataacacatgagaaaagagaaaaaaaatagtgtgagcaactggggaggaatatcaaactaaggtgaactaggaggtgagtattcacaaaagatcatcttatagcggaaatcttaaactcagtgtgacatttggagtgatcttctataaatttccctaaatataaaatgtacgatcggggtttaaaaaaaatgtacaatcataaatattgtttcacctctgtatgttgatcgtgctgataagagtagtcatgagcaggggcggagacaggagtagggcagcttgggcttgcaaccctattcctagtcctaaatattcattgaaattccattttaaaactttaaaaactagaagataaaggcaaaattatatatattcaactaattgagccctaagtttagaaaaattttggctccgccactagtcatgagggtgtgcatgcacatgtatctttcgtgttatcgggcaaaaaaaaaacaatggtttagaatgtactaccaccatcctagaaagatcgcagttttgtacagtatatgtataatatttggccgttcatcttatttaattttttttataattagtaattttattgttattagatgataagatataaatagtattttatgtatgactaattttttcaaaaagaaatatatataatttttttaaataagatggacggtcaaacattagacacgaaaactcacaactggatttaaaatgggacgtagcaacaaggcagaggctgtactggccgagagtagccattgtttagttcatagtgggtgagtaaataaaaaaatgtaagtcgcaactgcaagttttaagatcattaagtcataaattaatatacattgttttccctcattaagactgagacaggaaaaaatcgatatataaccacatgttggccaatttggatggactctgattggccgtactagcgaactcactagttcctttgtggggaaatacgttatttgtcaatatctttttttccacgtcttgcgaattgcgatgtaggttcatgcatggcactacccaaatgaaaggagtagctgaccaggatgaaatacactcccaatggccaatgggcgttcgagtcaattgaccactcgattctatcgatttgttttgtccgagtaacaggaacagaacagcttgatctatcttatcgcccccatcatcccataaatggcttgattcctcaaaaccaaataacccacaaatgtctctaaaccagcaccagaacgtttggactttggagaggtccaaacctgaaacctgatggctttttcatgggtaaattgtacaaccaacgaccgacctgatcacctgaccaagtgaccatccttgatcaagctgtacagtatggagatgcacgggcttttttttcttcttcgcaaactctatctatgtacactcgaatactctcctctctccccaaattacaaacacaaaaccagacggctacgagtcggaccctgaacacagctcggcgcagcactcgtagcagccgaggcaggcgaacgccgcgcagacctgcgtcatcacgatggcgcactggtcgttcatcttgttgcaggccttgatgcagcacatgcagcagaggcagtcggcgaggcggctgcagcagccggcggccttgttgaggatctcgaacgtctccagcggcttcacgtcgccgaaacccgtgacgaggttctccctggtggcggcccggtcgccgaacccgagcttgaggcattggagcgggatccgtcgaggttcgtcggggcccttgtgacctttcagtttctgcttgacctgttcgagtaaacaggcaagttagttgggagttctgagctagcgtggttgtcacaagatccatttctcgtaaaccagtttataagcagggaccattggtattattataaaaacagtgggacttaccttttgtgctgcatctaccttctccaatgtttgaagtaggaccatgctcgtgtactctgaaggaatgctattttgaatgcttagtttcaccaccttcaaaaatcaaacgaaatggagttactgaaacccatatactgctaactgaatggaactcaaactactaaagaaagtaacatatttcaggggcaactgcaattcacaagagaatgtgacctataaagatttcaaactagttcagggaataaatgaaatggaaagcgaacatcaaaataatattcagcaccaacaaccacactagggctgagtttagttccaaactttttcttcaaacttccaacttttccatcacatgaaaacattcctacacacacaaacttccaacttttccatcacatcaaaacattcctacacacacaaacttctaacttttccatcacatcattccaatttcaaccaaacttataattttggcgtgaactaaacacaccctaaggctgtgttcgaatatggggagttgggaactaaactccccgcacggaaaacggatcggtccattagcgcgtgattaagtatttactttttttttttcaaaaatggatcaatatgcttttttaaagcaacttttgtacagaaactttttgcaaaaaaacacatcgtttagtagtttgaaaaacatgcgcgcagaaaaagagaggggtgagctgggaactctgtgttcggcacaccaagttcccatctcctctccatcgtgtttcgtgcgcacgtttttcaaaccgctaaacggtgtgtgttttgcaaaaagtttctatacgaaagttgcttaaaaaaatcatattgacccatttttgaaaaaaaaagctaatacttaattaatcacgtgctaatggatcgctccgttttacgtgcgtaggagattggttcccataaagcccaagcgaactcaagcatttttcaatgtattgcccattaaatgcttaaatgcttcagacaagcaatgtgagaactttcaaacattaccgattatcttcactatatctcatgactccaaaattcagtggaggtataaagcgaagaacatgtataatgcaacccttagccaaaagcctgaaacataaactcacctttctctccagttgcttgtcagaagaaagccatgccttcgctgtgagaaggccaatctgctgtgccgccaaaacctagaaatcataaataaaaaaaatgcatatattattagtatactcgagaaatctatggccccaagtatgatattgtgcaagtttctcaatggaaagaagagaaaccaaatgtacacaatagtgagcatcttactttgtcaaggggtatatcctttatatgctgcaccttaagttcaatcgagatctctctcatgtcagccaagtaacctttagctgtaaccatatctgggaacttgccttggtatttcccagatatacataaaggactttttgctgaaatgtctggaatgtattcagaatcgatctgaattggaggaaaggaacagtcagaagacaataaaactactgtttttttctagctactactagttacacctgcaaaaagcatacccacaaaccacccttccatacagcaaataattatttctatatacaggacaggctctttgctaggaagagcagtataagatggtatggcagcaatgaacacagcacacatacactaccagagaaaatgagttgggaaatcacaaatcaaatactgaaaaagagtcaatttcattatgaaacatgatcgcaatgcagccagaaccaccttgatggcattactcgtcttacatatccatctctacataaccaaatttacaatattgagtagttagtgatgaattaactcacttcaaattcatcaagatgtgctgtagcatcaatggagatgtttgcaactattgtactcgatgctttcctgaaccacctaagtacctgactctcaattgatcctgcaaaaacaattcaccaaaaaaaaaaggtttatgaagatgttacatggacttcataaaagtcatatttgtccaattaatgcatataatagaacagtattgcttagatatgaacctcaggaataaatccagatcaataacaataatgtattggtagaatgcccatgaaacttgagcagaggttgcaagatggagtgtcaacttaaacagcatgcagggatcataaagaaacagtgttacgtggaaaattgcaaaccaagagtacaactagctcttagattgcagagcaagaggatcccttcatagaaaacattattgccacctctacaatatgaactgattgcagtttggtttttctattataatttggttgagataacagtatatatcgtgtgtctcaggaaaagctaagaaatccatggagaaagggtagactgtgtagatcattgttctaaccttcaagtttaaagaccaacataaaggtaagagcatactgtttgctatgatgagaacaaaagggtttaggggcttggtacctgtctcaaatgcagcatcataatgccccctgcctattgatgccagcatgcgcaagaaatagtggttgcaatacaaacctgttattccagtgataaaatgaaaagagcaaaaagaatatatcaggtaaactgtaagcaatcagtaacgaagtagtacaaaactaaaacagcagagtaattaaaatatggttcgtctcatcacaagctggcagcatatatcaccacactgactggtctgttgacttatggtgtaagcatttttctcttacacaagaaaggatatttggagatagagaaatacatgagcgttggtgcaaaaagtagggaggagaattttcatgtgatccaggagataagtcaagagttttgaataatgagataattgtatatttgacgctctccttaacattacctagtccaaaagtagaaatccgaggagatttagatcctctgctgatgagctccgttttcacagtttggcatatattatgttcatcatcaactgatccatcagtcataagaaagatttgtggaagcacatcatgagcacttgacaatgatgccattgcctttcatgaaaaaaaaaagtgagagtattaacagtaatagaataaaaaataatactacatatgcatctattcacaatcgagatttaatattcaataatacctcattcaaaggatgcataatatctgtaccaccaccagcaacaaagtttaagtttatccagtcaagtgcacttgctattgatttctcatttactttctccaaacacgatgagaatgagtgcagctcatcattaaatgttataatgttgaagtaatctccttctgtgagttctgacagagcagtagacatcgcattcttcacattctcaagcggatgtccttgcatgcttccacttgtatcaatgacaaacacaactgcttttctgaagacctattgaattgctcaggtgagatataggaacaaggagagagattttgtgaaacacagaagaaggaaaaagggaatgtacttctgtgtcaataaaccaaaagtgctatgaacaaggccacctcagtaacatccttatttactataactttaatgatttacaatcgcaaaatatcctgatagtatttgctaaaagaagtccagattgtagtttgcacatagctagtggaatttcactagaaaaagatcaccaaatggcagtttagaatggtgggtttgttgattggttctataaaaaagtagttctacattagcttcatcagaaaggtttctgctagaggccctcttctaaatataaaagttttgtcaactgcagatatctcactcaaggaagatatgcttaaataaataaaaataaaaactatgggacgaaaccccgcaaaagtaagagcaactaacctttctgttgccacctccaggtaaaagaaatatgcagaacctatctctatcatcataatcacgcaatgtcgatggttgaacaagcacaccaccagataagtcaccagaataaacctataggaatgaacataaatcagacaaatctgaacatatatttagctattgcagttttgaaacagtaaacagttctcgagccagatttcagttacatctgcaactaacatatgctcacaaaaaaaga

SEQ ID NO: 52233 - DNA, 2119 bp, Oryza sativa
  unsure (1)..(2119): unsure at all n locations
nnnnnnnnnnnnnnnnnnnnnnnnnnnnnnnnnnnnnnnnnnnnnnnnnnnnnnnaaaccccgcaaaagtaagagcaactaacctttctgttgccacctccaggtaaaagaaatatgcagaacctatctctatcatcataatcacgcaatgtcgatggttgaacaagcacaccaccagataagtcaccagaataaacctataggaatgaacataaatcagacaaatctgaacatatatttagctattgcagttttgaaacagtaaacagttctcgagccagatttcagttacatctgcaactaacatatgctcacaaaaaaagaaaaatttgagaagtcttggaaagtcagattatcacaggaactagtgagctcataactacttaaagaagtgactaccgattacagctaataaagagatcacaaaagggaaactcacactgtatgaaaaattgaaatctttgcttgaccaattctcaacagttgcttcatgccggaaagacaacttctcaccctgcctacctttttcctgaaatagtaagggaaactcttttgaagattaaatgttgtaaaagcactgatgccaattgcccggaaatcaaaagagttctagcaaaaaaaaatgattaccttcaatgggtggcttgttccctgcagtaaaacctctttactgaaaccactattcacagtcaactgaattttctcccttttcatgaatacttttggcaatgggttaacataatatggaaaacggaacggtatgtccactgagaatcgtccattgtcatagtgtagcttctgagaccatctgattgtggcagaaatatccgccccaccctcaatctttatcggcaagatggcaatgaatcttcaaagtaagactccaattccaaaagttcaaagaagagaacaaaagacagttctgcatttagcatgtacctgtgatattgtcaaataaaataattggggtttcaagagtccgccactatcagcttttggagcattctctgtagtgtgatcttctacttcaattacttgagtattatatgatcttcttccaacggtaacctcggctcctagaattgaaccctattagccaaaccgttcataggttgagaacaagacaaacatggaaattaatgcaactcatataacataattaaacataatatactagtagatgcctaatgttcatttaatggtgatgtttcctacggatggaaagtagaatcagatgtttcaaaatatcaaatattagtgtatgtgagttatttattacaaatttccaagttgttgttaatcaacttcgctaggcaagataacaaccacccaacaccaatgaataatatgctatagtcatccaagacaaataacttcaccaccgaattatctccattctgcaagccattatattctacaaccagacataaaaggagcaatggagcatcatgtgtacttctagatgctgaagtaaagaacaagctatacaatatgtttccaaatgacacgaagcaacatatttcagtacacatcaacatatttcttcttcctagctgcctcatttttgatacacaagccaggttaccactctgctaaaccagcacattccttcttgtgtttgatttccataggacaaagcaaggaattactttcacttgcttatgccactttttactgaaaattgctcttgtaatataaccaaaggcatccatttagtcagctggaattcataaactagttataaagaaagtacagaatttagtgcagagcacgccatgatttggggtcaaccaccttaagacaactcaatcaaacgaaccatatgaacaaaaaaaaaaaagagaacatattccacttggacaaacactgggttaagcaaacacttgaataatgttgctaccaaccattccaacagcacagtcaacaataaggtacaaaaccaccaaagcatccatgtgaagaaaacaatagaactaacggctcaatggagaatcaaaactgcaaatcgagaggcacatatacatgccgcaaaaacaaatccaacaaattcatggttcccaactatgtaataacactagccaaacagccggaatcatacatagcacagcaccaatcattt

SEQ ID NO: 52234 - DNA, 1027 bp, Oryza sativa
ttcagccagtcctccaccgccctagcgaacccctccatgacccagacgcgggatgcgtcgccgcgggcgtctgcctcaggtagggttccggctgcgccgacgagaggaggagattggtgtggtcgattgatctgggggggaggcgatcggcgcgtcggcgtgggcaagggagcgatacgagtttatttgtggagatgaaaatgatgagatgagatgggatgggagccggtgagattaacgggatggggggaaggtttgattcgatggatcgttgtcacgaaagatttgattaatgtttttaactgattacacggaagattatggtggagttggtttggtatcttcgtttggttatgggtgtttcctttccattgtttatgctgtcgctttgtccgttgaaaaattgaaaactgtaaatttattagaaaagggggaaaaaacacgggacattaacatgagttcggagtgaattagcgcttccggggcaattaaaaaacttgcctaatccagttatagtatcagccatgttacattactcggaaagaaagaaacatgttacatcatgtattgccttctgatacgttcacacaaactgaactttgctttagcaccgccttagcgtcagactaaccattagctttattgtttaaccacaacctgctaaagagagtaataaagagacctttgctttttactaaatgatctgcatatagtttttttatagttttttttatttctaaatgatctacgtatttatattcattcattaggtctattcgttatttgtgtataggagtaaatggacatggatacacgcatccatacacacaagtatttatagctcacatgtaatatcttgatttgctgggatcggctagagtcaaatagcaggcatgctagctgtatcgagtttgttatatattatgagagagttattagttttcgttggttttagtgtacctatgaaatatttagatcaatttaaaatggagggaggatcatctttggagaagttgaggttagacgt

SEQ ID NO: 52235 - DNA, 1764 bp, Oryza sativa
  unsure (1)..(1764): unsure at all n locations
gttgaggttagacgtggctcaatcacgacagccggccgtaataatctcatcgaagacaactcgccgacgagggaaacgacgttaaccataacgttgacgacgttgataccgtgaaaatgaaaataatattttaaagatctatttataaaaaaaaatttgaaaaaaactacaatgtgaaaaatactccgcgggcggtgagcggagtctcggacgacatcgcggcgcttccaaagaaaaggagcaacgtatacacgcggtcaaaacacagctgcggaaaaaggccctgggccccactttgtgggccccgctcccccgggccggccacgcgcgtcaagcacgcgccacgtggcctccaaagggacgacgacgcgcgggagatccgatcgtgacggctcgtttcggcttcgacggtcgggatctccgtctcgccgtcggcaacgcggcgtaacggctagttttgtgtcgttttctggggggaccgctccaggagccgtgcgtgtggtgtgaacttcgcaagtccgttatacaggagtacgtacgtcgcgccatcaccagctgtgacacgcttggcgcccgtgaaacggttttgaaacacgttctcgcttgtttttttaatggtgcgaagttctattgagcaggaaaaaattactccctccgtttcaaaatatttggcaccgttgaccttttagtacgtgtttgaccattcgtcttattaaaaaaaacaattatttattcatatcatttgatttaaagcctcatcgtttggcatattttctgaatatgtcaaatgacatattttgcaaacgaaaatcaatttgtgaataaaacttttatatatgtgttcttagcgatctaaaagcaaaggctgaaaaataaacttcgatgaaaaaaccccaaaattagcttcaaatttaacgttgaaaattcaaattttggctcataagcatatgaatatgccaaacgatgaggccctcattgttaaatatactttcatgtacacatatagttttacatatttcacaaaattttttaataagacgaacggttaaacatgtgctaaaaagttaacggtgtcaaacattttgaaacggagggagtacaagattacaaccttgaataccaccacccacacaccgatagcgccaacacacaatccggaagaaggctagcaccgaaccggccgccgctaagcgtgaccgaccgccgttagaccaacaaatgaacacatacaagatcgccccctagggatgccaaaacaacgtcttcaagaagagaagtgacagaaaaaccgttgctgccgtccgtcggggctcagaggagccaagacatggctttcacccggcaaccactcttgaggggtgagacagcatgacaacgccctcaggagggggaatgaaccgtcgttgtcggtccggctaaggccgggctaggttttcacccgccgctcaccatctgcgaatccacggctgacgcaccgatgctccaccaccactcaagctctgccgacatgtgagacccctgcaccggcgtccccagccggccagctttcgtgtgccgaagaccgcgccacacccgccggcagctcctcctcacaccgtccttaattgtcatgagcacgaccatcaaaaccatgtgctcacaacccaccattaccaggttttagttggcacattaattaattaactaatcacgattgaccatcgtgaactatcannnnnnnnnnnnnnnnnnnnnnnnnnnnnnnnnnnnnnnnnnnnnnnnnnn

SEQ ID NO: 52236 - DNA, 729 bp, Oryza sativa
ttttaagatagaaagtaacaactgcagtggatacttaaatatatttgtagagcatctgtgcatgacttctatattactaaatcacatgcaaacctaaatattttttttaaaaaaaaaaactatgtcgatcctttttacctcttgatccaccctaacctaatccaggtggtataggtgtgtcatcactttattcttaatgcgtgaattgagcatcattcttaactcataggtgggaatgttgaaagagtcattgccttgtggtgttttctaatgttgaaaatgcattgttccctgtgtcaaaacttttgacctgattttctctgcatgtttcatattactgaatgcccccttatcttttctcctatttcttcttatccagttgaaggtgcccttgcacatccttacctggcatcactgcatgacataagtgatgagccagtctgctcatcacccttcagctttgacttcgagcagcatgcattgtccgaggaacaaatgaaggatctaatctaccaagaaggccttgcgttcaaccctgattaccagtagctggtgttctatttcaccttggattgattctattcatatggagttttttcctcctgcgccacaaaaggtcgccgacagtgatcactagttgtaaataattgcctcacctgaaaaatcctccctggttcaaagctgaaggtgttgttctaagagtagaaatgtactttgtgatcaagttcc

SEQ ID NO: 52237 - DNA, 2218 bp, Oryza sativa
tattccatattcacaatgtgcttgtagccatccagtgaacgatgtgagggctgcatatggaggaggaaaaaaattactgaagtattcacacagtgctgcaatttggtttctaatcaaattctagtggagatcactgaacacctttgtaaggtctttttctcttcttattgaagatgttcgccatccgaccatatctggcatatgttcaagaaaacaagagcagcaaaatagaaaatggtttggagcaaaaaaaaattcgtttgcatatcaggcagaggaaatcatgtggtactaactaggagtaaggaaggatacggtcgtacgaaacattagcgtacaaaatgcggttcttgaaagctgctagtgcagatctgaggaacattgaagaaacaatatgttctactacaatgtttgaacgaagaagatatgttctactataataagttagccttaagacctttcttatgacttacataaattttttatcctcatgatcagatgccatctctagcagaagaggtggcttgctaggttcaccatccgtgagaaagagttgggcaccagtgcggccaacaccaagggagccaaaggtgcagcaatcttttctagaatagatagcccttgaagaaatggaagctggtaatattattgcagaaaatgcatgtaattaatacattgatcacaagtcacaacatattcagaagtagtacttggttactggtctttggcctccgattagctatgcaacaatagtcgtatactaaaatcttactaggcaactcaaagtccaatatagtagtttttgcttccagcagaactaattttgaggggaataaaaatgtatcagataatttaatagatttagagacccacctgatttttccctctaacaccaaggtgtggggttgctaaggtaataaaattaattggttccagcccagcaattgcacctaatcctgaagtgcactccaacttttcagaccctccagttgtaggagctatacaagcagcactttgacttgcatccttcattgctgttgaataaaggatagaaatagcatatcgcgcaaacaaaccacccaaagaatgtgctaggaaggaaatctttctcaatccagccatcttctgaatcacatccaatacctgcttcgatagcggattttcgtcagagccctcttaagcgcagccatgagtgcagaccacagtttctacaaaagtgaatacttgaaaccttttgctaggactaactagcgagtacatacttgatttggctaccttgttccagcaacatcaatcccatcgaaagttttggtgtagatatttgacgaactagctgcaatgatatagttcactgtaagttttatggctagaaacgaattgttctcatttgcaaagtgcaaaccaatgtagctacagtaatgaagtggtgtgaatttcatcttgcagtactaattaaaaatataggtattctgtagtctgtacatctgatcctaagctcaattttgtcagaaagccaataggaatgggcaggtgatccctatatgtcatacctaccatagatgaaaaaattgtcacctaacctcttctttagcactgcttctccataggtccagtcactggggctgcattaaaagggagaacaatgaaggaaatttatcagcaaagctcaagaaagaattgtgacaggaacaactagcactgcaatcttgctatgcattttcagacaggtgctatgttatcgtgacaggatatactcaccttgcaatgataccatggacaagaatcagcagatgatctggtcctcgctttctttgggatttttccatgaaagatgaacgcgacacacggctacggcttcccccgaacgttggatgggaataaagttctctaccactgtcaagttctgcatgaatcaactgtcagcacactatttcattttcattaacacagcattttgaagaacatcgcgatactaagtacagtagtgttactttggatgctcatttggttgtgtcaaaactgaaagagatcttgtaccctcatgttgctagaaacaaacaagttaatatcacctagcttcttctccattagcaataaaaataaaaatcgacgtcaatcgatcaacgaagttatctactggataaccaattgtttatcccatcttccccccaaaatcaagaatgaaatacagaaggaatgggtatggaaaggcgggcga

SEQ ID NO: 52238 - DNA, 791 bp, Oryza sativa
  unsure (1)..(791): unsure at all n locations
nnnnnnnnnnnnnnnnnnnnnnnnnnnnnnnnnnnnnnnnnnnnnnnnnnnnnnnnnnnnnnatggcttgactagtgagttcagggcaccggcaacaagttctactcaggttgtggacacgatgttaacatctctgaccactgcacctcaactcagccgttcccgctggcagccttcgcgatggagcaagaggtggcagtgcagcagaagatggtgctgagtataatgatgacaaggccggctgtggcaccatcgcctcgggcgaagatggcggctgacctctggaagaagcaggagacacaacaaatctgacgaaggtcatcgtcacacggcatcagcaaccactaccgtgtccacgtcacttcaagttgtccaggcaggtggattcgtgtcaccaacggccaggtccaggaagccctcaacctcgacgttggacttggcaacgacgtcgtcgtcggcgaccgcgatgcagggtgatgccacgagcagggccgtttcttagggctcacaacctctagcaccaacgactgcggtgattgcggcgcaacggctgacacaaccttgggcgcgatttccaggtgagatggctttgtttcgtcatgcatcggcacgattttcagagccggatggattgaagcaatgtgcagcggctgcatggcttgagtcatgttaggcttgtttagggagttgtctcagccaacaaagatcgtgttgcagcttgaggatgagctgctcaaaagaagggtgtagtgtcatgggcattgggacagaaggcagaggcccataagcag

SEQ ID NO: 52239 - DNA, 1243 bp, Oryza sativa
  unsure (1)..(1243): unsure at all n locations
nnnnnnnnnnnnnnnnnnnnnnnnnnnnnnnnnnnnnnnnnnnnnnnnnnnnnnnnnnnnnnaacttttctgtcatatcgaatgtttggacacatgcatggaacattaaatgtggatgaaaaaaccaattgcatagtttacatgtaaattgcaagacgaatcttttgagcctaattgtgccatgatttgacaatgtagtgctacagtaaatatttgctaatgatggattaattaggcttaatagatttgcctcgcagtttactggcgaaatctgtaatttgttttgttattaatctacgtttaatacttcatataggttcgtatatgttaattttttttttgaaaagtaactaaacacggcctaatactaaccagtagagaccatggtatatttacctgtttccctagtcacagtcaaaacgattgacgcagtaacttacaagttgcccaagacttagaatatgagttcatacctcactatcaagactgcaggacttttagttattccggaatcaatatccacaattcgatctctgacacacacatagtcgcctatgaacactggaaatgaatatagagagaaacatttttgaaagaaataggagggattatgctgagaaaggaacttaattattttttaaaccttttttattttttaattttaaaaataaacccttcaaaatttatttccacaatctaaaccttttggtcacgctaaaactgtcacgcacgttgcaccgttgcggatggtgtgtcagtgatgttttaccatgccaggcgggctggcgtggccaaatgattcagattctagaaataagttttgaaatggttcatttgtaaaattaaaattttaaaaagttcaaaaaaaataaaaaaaatcatgagaaagagcatttctaacctaagcactactctccttctctatcaaaagtacctccccagggcttatctagcgagtctcgcttaatcaattcatagtttcgctcccagcgtagcgtgtgttcgctgcagcctgttaccggcgttagctatccattagcacgtgattaattaagtattaactatttttttaaaaaatggatcaatatgatttttaaagcaactttcgtttaatttttttttcaaaaaacgcgccgtttaacagtttgaaaagtgtacacatagaaaacgagggagatgggtttgggaaacttggggtaaagaacacagccaagtgtggtttgcccctcctacaaccaatttg

SEQ ID NO: 52240 - DNA, 2203 bp, Oryza sativa
ggtttgatacctataagtaccggattcgatacctaggtcgggtttgatacctatgagtaccggatccaatacctatataccaggttaatacatattagtagcggatctgataccaaatatagggtgtgatggtaggagacttcagacgtgataccactaattctgatatttatgggttatatacttctattcaaccatcaaataaaaagatggaccatgcatagctaggccagaaagtacagccaaacttgctcatgtgccgctgagtgcttaattctaacttgctgacatgctttgtttaggctcatgctactagctctagtgcttaattctaactttgctagttgaagcaggtgtgagacccatatggacctaaagaggtgtagaagtagtgttgtattagagtatttcatagctattttgtactgtaggagaaaagagacctctcgtcagtcgtcactagtcagcagcctccatgtgaaaggacagcacacgacatgctttcagagagaaagaatcgatgagtgattggtaagtataaattataaactataccgttgagacggtacaccatcccatagtttttctattttattaaaaccggtacaatttaactcggtggttttcaagagcggtttcgttgatgtggcgtctacatgacggtattaatctggcatgtggcattgactttatgccatgtcaatgccacagaccaggtcaacagtgccacgtggacgtcacgttaatgaaagcatcctccaaaattatcgagggagttaaattacaccgatattaatagttatgagtcgagatatctagtattgtggtttaagcactggtttaagagtttaagagagtcaaagtaaacttattccttctgccgttgttgtcacgtacagccgtacaggagagaggaaattcggatggttattggtggctcatctgggtacacactacacagtattcaatggcgattcagagtactacacggcattgcatcattcaatcatatgcaacctggtagatcgatcagggagaaggcaccgcatttggaatctatatctttactcttcataaagaaactgattttaagccaaactttactctttagcatgtaacagtagtagtaagtacaggcttaaagatgcttaattttgttcttgcagaagagtttgttagccttggacagtaaggtggagaagccaaaataaaaaaaaaaaacagacagaaccaaaagggatcctgcattattttggtttggtatctaaaactggggtgcatgcatcatattcagacttaaagttggccaaacttctttaataaaagaaactgtttttttttttccctgtaaataaactccaaagcaacatgcacagtcactcactctgtgtagcatagtttctgtaccagaaaagaaggtgaagcattcattcactagttccatacaagcatgtggtcatgcgatccaggattcctaacttgtattaaagtttttttctttctttttttgagatggcagcaaaccaagttgatgagcttagataagatcttgctcgcatttatgatttcatccggatccagcatgtgcgtatgtgaccatctccaaccaaaccatgcaacaaattactaagatttaattaattaattgcaacacataattaaattgcctcccaatctcatacatactacacaaatgtgcattacctaaaacaaaaacaaattaaccacccacaacgaaaatcaactaatcaccatcttattcatttcccagtcgatcgcaagatgtcttcttcttcctcttgctatccatttttcttctcttcttctgctaaacaaatcaaatcagcagcagctagccggccatcctccggccgccgtcgccgccgccggcgatgatctagggcatgatcggcgggtggcagtagggcccgttgacccacccgtcggcgatctgcttgtacgccgcctccgtgagatggatgccgtcccagctcaacgacgacgacgggttggagcacgcgtaggctcccgacatgccgcacctcgcgccgttctggtagttgtacttccctcctcccgccccgcagcacgccctcaaattcgtgctaaaccctgcgcaaattcatcacaaaaaaccgtcgaattaatcattcataaacttcaaaccatccagggtaccgagctcgaattcgcctatagtagt

SEQ ID NO: 52241 - DNA, 835 bp, Oryza sativa
cttgtttggttattccttgacttgtaaggtgcccttactgcaaaatggcgagttacgcggttgagtaccgcggtgtcaagacgaaggaggaaaagggcactgagcagattgtgagtgtccgcaagacatgatttcgttcagtgttgtcttctatgttttgtatttttgccaatggttggagctggaacttgtggtgtggataggaggagcagagggtgatcgaggcgcagatccggatgcggcagcaggagctccaggacgatgctgagcggatgaagaagaagcaggctgctgctttgaccgatgtggtaacaactgcacaagtagaacattgtgatactggtggcgcatccaccacaggtatatgcactggaatgtgctaactttgtttctcagttattcttttgtcatgcaatctctaaccctgtctattatgttgacagtcaaaagcagtgggcaaggcagtgatatgctctcatctcaagtgcagcatgcggagttactgctgaagacttctgaacgcttaaagcagatgcggttcgtactgcttactgagttgtgcttgatattctgtaaaagtagctgcttattgttgcatcagtgcaatttagatcaaagtcatgacagtatctcaatgactgactaccgtttaagatctgaaatgtctatatctggtccctccaatcctcaaatagtttaagttttcgtccctcaactccaatattagccagaactcatcagtcaactatcaaaacgtctaaatatgttcttgggcatgttttccaagtggttttgagtgccgcgccatccttttttgccatgtcttttaccacat

SEQ ID NO: 52242 - DNA, 3547 bp, Oryza sativa
tatatggcgaattcgagctcggtacccctagcctacgctctcaaaagaagagcttcctagtgagtaaagaaacattaaaatttaataaaagggaccaacacggtttacaaaaccaacaaaaactgcttgattttcatgcaattttgaggttttgaactggcttgagttaacaaaacagctttgttaaccagtcaaatagaaaaccaagtgaatttccaattttaaatgaaatatatctgaatttcatcatttctttatcaatttttcacaaaaaccaagaaaactgctaaagagcggtttccaatttggtattgcggctttgtgaattttggagagcactcgacaattaagtagggttagaagctcaagtattttaaagaaaaaatcttgtcagcattaatttagttatatcatcttcttgccaaaaaagtataccatccacacctattaaagctcctttgaaacattggattaaaaaacggagaataggaaaagcacgaaatttgataggaatgaaagtataaagcacaggaaaacagacaggaatagtcatttgatttataaaccacaagaaaaaaatgcatgtatcagaagagagaaatagactcgaagaaaattttccaagagatatgagatcttgctaatttttttcaaaatctatatgtaataagtcattccataggaattttataggatttaaaaagctccaatcctttatatcaaagggccaaataggagcaaagtgagcgtagctcaactggttaggttcttgtggtggaatcagcctacccaggttcaagttctagacttacatgtgcttgcatttatgattaattattctttcattgataggcaacatatccattgatagcgagacatctttgtggtgacttcatgaatcacaacacatgccggttcagtcttttagggggtgttcataaggataggttttgtgttcataggggtgaatgagtgtctgcttttgtaacatgttttttttttcaaatgttatgaagtttctcaataaatcactagaatcaaaggggtcttagtccccaaatggcgtatctgtataacacacactgatccaaaggctacagggttagtgacctgccttgatagcacaaatcccctgatcggaaggcaaaaggattccgtttttgcagaaattcacctattcctaagactaaaaggctccgatttggacacaaaaccgcaagatccaaccccaaaaaccacgcagtcctgacgatttcgcaaccgacgatgaaaattcgatgtcctccgcagcaaacaacaccggcgaaaaaaaattccacaaaagcgaagaggggcttcgggctcaaatcaattacctcgcggctcggcggcgcggcggaggacatgcccctggcctggatggcgaggcggacgtcgtcggcctggagcgactccctcccggcgtggccggcgtacgccttcgcctcgccgagcacgtcgccggcgtagcggtgggcgaagagcaggagcttgtgcacggccgcctcctcgtagtccccctcccggagccccagcgagtggaggatctcccgcaccacgcgcaggtcccgcggctcgtcggcggcggcggaggcggccgccacagggggaggaggaggaggaggtggtgcctggtcggcgccggtgtccattaggtcaggatctagagtgacggatcaaactcccgtccccttgagcgggagaggtaaaaatgaaattcgaggctcgggtatatgcatggttggatggaaacaagtaaaatttgttgctttccgcattcacaagcgacgctttggccgagtggttaaggcgtgtgcctgctaagtacatggggtttccccgcgagagttcgaatctctcaggcgtcgttaatttttgttttctttttctatcttagactctttgtctcttcttctgtgagaaccatatgaagtgagaagtgctagagatgctttaaaggaaaatcttaaccgtttgatttaagttcgtgggagttacgataaatgactcttttattttctactctttgtttcttcttctgtgagaaccatatgaagtgagaagtgctagagatgttttaaaggaaaatcttaaccgtttgatttaagttcgtgagttacgataaatgactcgctgttttcgataccagccgttcccaactcccctctcgtttttcgtgcgcacgcttttcaaactactaaatgtcgtgtgttttgcaaaaaaaattatatacgaaagttgcttaaaatattactccctccattccatcgatctacatatagttttttttgaggttattcctaaatgatctacacatttgtgtttatttattagagtctattcgttatttgtgcattggagtaaatggacattgatgcatgcattccatgcacacaagtatttataacacatatacaataccttgatttattattggctaggaaatattggggatggtgcatgcattgagtttgttgctagagtaaatatagtatgagagagttattagcttttcttggtcttggtatacctatgaaatatgtagattaatttggaatggatggagtatattgatcaatttttttaaaaaaaaaatagctaatacttaattaaccacgcgctaataaatcactccatttttcgtgcgtgggtgatgattcccaacccccaccaccgaacaccgatcaatcatctattggggtcgggagcacttcacagaaatagcagacatcccacaaggattgacagtttaatagatgatcacaaaaaatcgtcacattgacatcccacaaggatcaacaatttaacagatgatcacaagtcagtctcacatcgacagagtagacgtctagacgagcattaacctctgaaatctcaccccaaaaaaaatgcaaacaggaaaaggctaacacaaaaatataaacaggagaaaattaaaaaaggaaaaaaaattaacgacgcctgagagagtgcacctctcgcggggagaccccatgtacttagcacgcacacgccttaaccattcggccaaagcgtcttttttgcttctgttcgcaaataagctataattgtatcttctaaaaccaccttaaaaacaatggtactccacagtcatgtagcagttttaattgtttgttctacgattcattggcacatttaattttgcaaaccattttttagtatttaaggtgaccttaatatcctagaactacagaacatgctccagaagcgtcaataggcgacgataacagttgaagacaaagcattgcttctgccatttaaacctatcggtttggattaacaatcattcagaggctgggacggagataatcgcagcaaggtgaggaggaagaaccgctaatgccatggagacagccaaacaggagatgtccggaatgcagaatagtggttcgtacttcgtgcgatcaagaggatttgctgagtgaaaatctgaaatgtgccgtccattaaccactcgaagtctacccttggacgaagaacacaccagcgtactacacattgctgacag

SEQ ID NO: 52243 - DNA, 734 bp, Oryza sativa
tcccaaacaccaccttaattagctgcgcacaacaacacagtgaattaattagtagttactaattgattgattccacgtagggagttggacagcctcatgcaaaattcccacaggatcaatcaatggtgctgaggatcgggccccccggggctcgacctcttcgactcggagtacggcatcgccgccgccaccgccgtctgcgagctgatcgtagtggcagtgttgctcccggcgacgacgagcattctccgcccggtgatcacggccagctggagctgcacatgatcatgatcaggctcgccgcgcgagacggcggcggacatgacgacgagcagcagcatcagcacgacggcggcgcgcaccagcggcgacctcaatgtgctggatgaggagtaggccatggaaaaagctagaggtcttcttcttcgtctaatctcctagcttagcttagcttgagagtgagctagctgtgttctcaggcgcaggttgcaatggcatgcatggtgctgaatttatagctaagctaagctgatcgagattcgaggggcagtttccggccgttaccgtgagcactatcgagctagcgacaggtgtagagagtgatgggtggtggtgatataccggaagtggatttttgtccctagaggagacattccctcgttttgtgcataatgtttaaatagttattaaaaaaatttaaaaagggtaccgagctcgaattcgcctatagtagt

SEQ ID NO: 52244 - DNA, 2119 bp, Oryza sativa
  unsure (1)..(2119): unsure at all n locations
gtggtggtgggatgagagtcagagcggatttttgtccctccactagtttggctagtcttcccacaaggagtgcggtgttgggtaatcgtaggatcagagttcatcaaggtaaactcctgtatattacaagtttttagtcaacctcgcggaagataaaagcatgctttttagaaaggctgagatattaaatacataccggtggaggggggttgaaagcattgtatggtacaactggcagcagatgtgaatagctgacaacgatagcatttgagaagatcttgtacattctttccttcatgaccttaaagtcaagagagtctggatcttcacgatttggatcatgtttgccatcaaattcaaaagccgtgcgggatctctctttgattggagctagccgacttttgatgaagtgccgagtgatctgctttccctgcaaaccttgttccttcagttttagcatgcgctccatcagttccactggctgagcagcttcatctcccataggcaatgaattccatgtgtcctggcagaccggagggagacaggagtactcggggagtgctggttcaggattctgaacgtaaaaccagtttgcgtgccagcctttgtttgaggtcttgaagggcatggagaaatacttttggcttagtgttcctctgagttggaaaccagcgcccccaacaacgcatggtttgctcttgttcggctggggcttgaggaagaagatgcggcggaacaaagcaaaatgaggtctaatgcccagaaaagcttcgcaggcatgaataaaattggcgatatgcactatggagtttggattcagatgatgcaggctaattccatagaagttcagagttcctcggaaaaatcctgaagttggaagagaaaacccgccataaaagaagtgagaaaataccacgacttcgtgtgtatagggggtcgggaacgcctcgctgaacgctggtcaccacccgatgatctccttcactggaagaacgccgtgtgctaccatttctttcagattctcctccgtcacatcggagggcgcccactgactctcaaaactttctctctcttccgccatggatgcgtgtggaatggtttgatttggtccaagatatagctggaggggaatgaggaatcggagcggaggacgcgcggagaagtttcgtgggatttttgagaatggattggggcggattgatgaaccctagcttcgtcggtgcggtttttaactgtagcaaggagtggggaaatggcgagagtctcggcggggaagacgaagcgtcgcttggacttcggtgttttgttagggtatcgggagtactaatgggcctgggcctgtacagtacttcagcccaatattattatcagcgtggcccgttgtgatccttagggacttaggcgctttttgctttggcaatttgtgctcataatgatgtgactcgatgctgctaaaatcctttttgatgcagttagataattctttggaattactacgatgcaaataaaaaggtgcccaacagaaaagtgttatactaattttgtaggccttttaggctgcaaatgctgttcgggttttcttgagatgattggttttaatgcagtcatccattcggcatgttatatgcttattttgattatggcatgagtcatagcctaggctatttaaactcatcttttatcaaattttatgccacgtttgataggtcttttgagagtttttactcggccttttatcatctatgttgatttataaacctttagagtgcttctcgctcgggtttttctttatgtttctttggcgcattaaaagcagtcggcaggaggttttatcagatgctgcacatgcttagccttagaccgtttggtttaaaaccactcggatggatgtcttgatgcactctgactatatgtttagttttatttaactaaccacatagtcgggggctacacctaattaggtgcatctagtcgatgcacctgattttttctattcttcagcccttcacagtctttgattttattactcgggagaccaaaacagaggaagttaaagcactnnnnnnnnnnnnnnnnnnnnnnnnnnnnnnnnnnnnnnnnnnnnnnnnnnnnnnnnnnn

SEQ ID NO: 52245 - DNA, 2677 bp, Oryza sativa
  unsure (1)..(2677): unsure at all n locations
tcttgaataagaaggcctgaacctatataaaattccttgtctctgaacccatctactttttcagcttgatagccacccccttttagtattgccgaaatcttgtttcgacactgcgtggtcagagaggagaagggtgtaggagaacaacaggaggaagaagggaaggtaaaggccaagcaattttggggtttatggtgacttcgcaactagtgggtttgttcttaaattctagtatcctcgctgcaacggtacttttgtttactttctggaagcataatattcaaatagaaattgattcgatagccgcttacgcaattttttttaggttcttgtttacgggctgggaaacgtattttcaaatctggtagtaaacaatcaggtttcgggttatgcatcctaaataaagtttgtagtaatcgtcgatatatttctaacaccactggtttcgctcgattccaataaacggtttaggagaaacaacagaaacagtattattgaccgggtctgttttaacatggacaataattagttttacttcatctgagaccaatagaggcttaatctgattttgtgcccaacatgaaaaatttagacaattttatctagatgtccgaagttgtattatttgctagattatattccgttagatggcataaaacagtaatagaactgctgagtattctttactcactcttgtgcataatttggtttttaggtaccaaatgatatcgatcagcatgggacgagagtaggacaaggactacacattttattacactattgaaatttggttttagatcatgattttgcttagcataagttttgcgtagaacttgtaatggtcaattaaagttttggttcacatttccttgtggaatttatggagttaggatggttagcaatgtgttgattaattcgttattgatttatcttatgacttcctgtcgtggatgtccctatttttaggtgaggctctgccgaaatttctaataattttaggagttagtggttttgagtgtattttggtgtggcactttaggtacgtggttacctgggatgttacagttgagaccaacatcgattcggagtcggcaccggcatcgctcgggccgccccacgccgtcaccgctcgggccgcccgacactgtcgtcggatggaccgccccgccagccgccgctgctcacccccagccttcggcctcatattgttctgccggttgggaaaaaaaagaaaggagagagatagagcggaggggaagatgaaagtgaaagaagaaagagagaaagaggggtagatgaaaagtcaacttgcactgtagagcatttagcttacaatgttcttagtctacgtggcatgtgaaaaacagcaaaaatggaggacaccctgctaatacccgaatgctagagctgctggagcagtggggactggtttggatccctgcttcactagggaagtgcgatggagggggaccgctagttggcgcgtatgcgccaccggggcgcattttttctgaggataaggtggttagactaatcttttagttttagataccgatagtttgagataataatggtagtagataagattttctttttcccgcgagatttttttaacgaacaaattgaaaaagaaaatctatatctgaagtcaaattttcaaaattttaaacctatatttgaaaactttcaactcgaaatttgaattttaaattcaaatttcaaaaactttcaacttttcatcccaaatttgaaaactttcaacttgagatttgaaaattttcaactcgatttaaaaattttcaactcgagatttgaaaattttctactcagatttaaaaactttttaactcaaattttaaaccttttaactcgagatttgaaatttttcaagtccagatttaaaaattttcaagtaatgatttaaaaagttttaacacaaaatatttgaaaacacgcgtactgaaaatttaaaaaaataatcaggaaaaagagaaaaagaaagaaaatatcgtgaaaaaaaacaaaaaaacgcagcgccggggagggaccgccaccagctggcgcgcgccaattagctttcgcggggtttggagcagttttggactggatgtcaacccactagctgactaaaaggaccaagctgttcgccacgtgtgcgtgttgacttccacgtcagccttgcccttcatcaggctcaggagctctagcatcgtcaaaagtcctagcggcgggaaaagcgcggcagtttcccgccaaaacgccaccaaaatccccaatctcgcgctatcccgcgtcccacaaacgcgccgacggagagacgggagggcaacgggagggcttagcgcgtcgctcccaacggtgattcgagccaagacctagccgccgccatggagatcgtgagatcccaccggcagatcgcggcggaggcggcggccggcgtaggatgtggcggcggggcgggaggcctgccaacctaccgggtggcgccgcagctggaggtgcggttggaagagtttgagctcttcgccatcgaccgcctccgaggtgcgggcgcctcctctcccctccccactgtggcggcgtttgtagagtccttttttcctttccttcctcgcattctgtgaacgatttgacatctagnnnnnnnnnnnnnnnnnnnnnnnnnnnnnnnnnnnnn

SEQ ID NO: 52246 - DNA, 2092 bp, Oryza sativa
  unsure (1)..(2092): unsure at all n locations
ttcaagtttgaacctttgactaacttctcaaaggctttgtgctatacccgcattctagggaggagctgcggaagtggtttctctccatggagactacgctttttcgctatcgctttcggctcgagagtcctgaatcacaggtgactttctgtccttttcttgcatacaaggaaagctatcatgctttaaccgttccttgccacactgtatttttcagaggatgcttatgagtgagtttcaacttccatacaaagcattgccacactcggaatttgaggtatgtgttatggtcactctgttgacttggaccttgatgatttcagtaatatttacagtagtgagatgttcttgttttcacgtttttaggctgtcaaagacaagttgagccaagttgcacgcaccattggtcaatctgcagctggtatggaacatcttactatgtgatacctgttctttatgttgtttcagcacaatggtgcttcgctgcttgcaggtgtgatctttcacttgctaagtttgttctatgttttcgttttgcagttgaatctgtgttcttcaaggtatttgcatcagtttattttacctcttcaattccatatccagtagaaaaaaattgttcgtgtgattacccagtctaaataaaccttgttcgttccatgtaaggtgccttttgaagaagttccagatcttgttgccagccgccgagtatttctttcaaaaggatatgcttatgttgcgatgagtcaggtttgctgcgaaaacgagactggaaacttctatgtactttttggatgttgtttcctgcccattctaaacatacttgtataatttaataggttgattcgcttgtggttacccaattccgctgcaatatctcgaaagcacttgttttaacaaataggtacatggtacaaatgttctactttactctgcctagctacatatcatgtncgggagtgtgctttcttagttctttgctggaaaattgttgcactcttaggtgatataattaggaacattaacagcattgtctactatttgccaataatttacatagaacaaaagccccttgacagttggatttatttctcaacttagaacactctttagtacaggctgtactaagctataatataaataattcgatgtacagaaaatggacggccaccattaaggaacaagaaaaggataggttgactcctgtgagtatcaattaaccacttcccgtattcctccagacaatcttttcataacttttataatccacactttttatcttaacagattgtcgaagcattgagtaatgcatattttggacctgattactctcaggtatgttgctttatctataggtgtttttccagatattgttaatgggattttcttcaatgctaatgtttactatatttgttattaattgtctggcttatcaaatatccaatattctatacagccaaaggatgctgttgagatttctctgaaggatattgaccaactggctaaaacttctttccctctttgtatgcgccacatgctagagaaggcaaggcaccttaaaagttcacatactttgcttaccttatgatcaggttatttagtgattgcttttatttttcagttgagagaaaaccatcatctgaagcatgggggcagaatgcagtttggtcttttccttaaggtaataacttaatgaattatcttaatactggttctgttatcagtgaacacttattttatttatgtcacattaacttgcttcttaaaactatggtttaaggagctggactaaagttggaagatgctctagcattttggagggcagagttttctcagaaggtgcctaattttctttcagaatgtaaacagcaactatgttttggaaatagcacatgcaaaccttttctgtttctttacaatacaagtaagccgtgtcaagaaaattttctataggatcgtgtactgcattcttatctatagtgttgaacattgagttaaccagtaagaagccccaaactaaacaagtaataccccgtgttgcattgtgcaagccatcacaaattatattgcttcactgatgttgggttttctttgg

SEQ ID NO: 52247 - DNA, 2132 bp, Oryza sativa
  unsure (1)..(2132): unsure at all n locations
ctatagggcgaattcgagctcggtacccgttctgttatcagtgaacacttattttatttatgtcacattaacttgcttcttaaaactatggtttagggagctggactaaagttggaagatgctctagcattttggagggcagagttttctcagaaggtgcctaattttctttcagaatgtaaacagcaactatgttttggaaatagcacatgcaaaccttttctgtttctttacaatacaagtaagccgtgtcaagaaaattttctataggatcgtgtactgcattcttatctatagtgttgaacattgagttaaccagtaagaagccccaaactaaacaagtaataccccgtgttgcattgtgcaagccatcacaaattatattgcttcactgatgttgggttttctttggataaggttggctctgagcgatttgacaaggaatatgcctacagtatcaggcataattatggaaaggaaggaaaacgaacagtaagccccttgttctatttttggtgcttgattggataatcaacttattcatctctcagacaaatggctcctccaggattacactccgtattcatgtcaaaagattatctctgcaacacctggtgttggtgatcaccatggttgcccttatcgacattttgggtataatctcattctaccatgccattaacagagtagttaagcatttatttgttttatggttaactttctgttatcagtagactatttatcgaatatgtcaatgggacatgggatttcatatcctaaaactctctgttagcagtagactatttatcgaatatgtaaaagaacctacagctatcactgtctttgtgagttacatgtgtccttttcttgtgtgatatttctagtgaagacaacttgagagcagctctcaataaaatgggaatcagtggtcatccattagaagagataatggataaagtgaagaacaggcactaccaggtactgcacctcacagttctacctttaataagcaatcttctaaacttcgtctgcttgaaccatctgagttatgaaatacacagctagcttgcacgatgacttttgaggcagaacatggtgtctcatgtgatactggaatcaatcatcctaatcagtatttcagtgaaagccagaaagtcttgaaagcaaaggtgagtcaccatagttgatttgcattcatttgtgcattttgtcagcatatgagatgttcaaattgacagtaatttcgttttattccacagaatcaagcagtgcagagccaaggaacaacctaaactgtaatgctgctggcaaaagtcagtccatccaaatgcggaatttcaggtttcgacactactagtctgtcagctgttgcgatgcattgttttctaatatctactggttattggcaacaaatttctaatgttcaattgtgcgaacataaacatcattctcaccctttgcttttttatagctatttttcagtattcagcaatcaaatccatgatatgtgtacaattggcagcaattctaagttatttttcttttaatttctgtttttagttttgatgaaataattttgctgtttttccatatgagatgtttttactcctagatttaaccatgaattaaagttttactcatggtcacattggacgattttcaaatgcccattttttgattcaacggtagtttctaggtttgcactacaaattttcccatttatctttggcttctaaattgcccatgaagttgtggctttgcattctgttcaagtgtgcctcgtcgtttggcctgtctattgttattggaaaggggatataactctatgctaagttctgatctagattttaagagagtatttttctgagttggtttctatgaacttcctgcaaaattcttactctaaacagggttcaaatatcagaacctgctattcctaaactaaggatcattgctgtaatttatacacaacactagcaagactctttgaaacttgtagaataataataataccgattcatttgctaatactactgggatgtctgtaaataagatttgcgttaatnnnnnnnnnnnnnnnnnnnnnnnnnnnnnnnnnnnnnnnnnnnnnnnnnnnnnnnnnnnnnnnnnnn

SEQ ID NO: 52248 - DNA, 1436 bp, Oryza sativa
ccttatatggatacgtgaatctcctcactgtagtctgattttcctcccaacatcggggtttgtcgtctgcatacaaatatataccaacacttatggaatatgtgagattaagcacctatcactatgttggatgttttattatccgaactttatgcagatgttggcggtatagaatcggcatttaacagccgccaacaaaaccccccacacttagcccttggctcgtccctgagtaaaggttagtgtagaatgaatttctttaagatatgaatcaagcatataaatcattcacaaccatacctgtacctgtgaactttataagtggctatcttaccatcttgagtaattgataaatggaatgatcttgattccagtccttcttgcttctctgccagactcatgggatttttatgactctctcttgtctctcaaagatgtatattttctttggatcctcaccaaggcaaaatgtgctagaacttatccctattctaaggctaatatgtggagcttggtagagataaattgtgacgtacctgcatcatatatattgcaaatccaaaaagatagactcaagaagataatcaatcatattcctagatcaagggtctttatttatggtggaaaatgaaaaagtaaaatatttttgtggaatgatggagtaaagaaaatgattctccctttttcctatactttctctccaattggttctcttggcatggttatggaaggggcttggctatattttctttgctcaatgttttgagagcaaactttatttccttctctctttttttcacagccatgcctttccctccttttctcattttctttttgccgagaacttttctaggagaagaaagcatagttcaatgtaggagtttatttgaatggatattttttttgtggaaagccaacttccagtgtagaagcttagcttaattttatatgtggacatgaaggtggaattgaccccttgatcatgagagtatgaaagatatctaacacaagtcacacaaatttgacaaagctcaatataatgtcaagcagtcatatgcatactaaggtttatcaatgatatacctgcatatggccttggtatgtataaggtaaaatcaattggaggattgagcctttaaaaacaattttatttttgaaaacaaatccccaagagtcataacaaagttgcaaggattcctttcatcttaatcatctcacataaagcaatcacttagatgtataaggttccctaatcatggatggttgttcacaagcacaagttcagctgagaataatgaatatacacgatcaatcatatgaagaatttcattagttggaaattttatctttcacttatgcttcaaccagttgttttctgaattttcagctctagtactataccatggtgggggtaccgagcggaattcgccctatag

SEQ ID NO: 52249 - DNA, 2136 bp, Oryza sativa
  unsure (1)..(2136): unsure at all n locations
caaaatctaaactttattaagcatgaaacaaaacaaactttggcaaacattggggttaacaccattgtgccacattattcatagcaagtgcttacatgattggaaaaataaaaccaagcacctactactattttattcatgggaaaggaaacatctaattagcataatatatatttttcttccccatatctatgaatgcacgcttgattttagcgcacaaaccatgactaagggtatcgaaattattcctaatttcagcaagctctacccctagctccgcgttgcgatccctaagctctatgttctccttgcggagtttcttcacttgcgcagcgagcttatggatcgagggctccggtgatttcacctcattttcttggaattggccgggagccctcacaattggagggggcgtcaagtgacgcttcaccttcataggtggatggctacgggattccgctgccccctccttctctgatgccatcaaaggcgggagtaaacccttaccatacctaccgttgggagttcgcactccctgaatgcggaatcgctcctccttcggagtggatggagtagcggtgggtgtggtgtacttgtgagcacctcatccactgccttggtgaacagggtgcccacataacactcggtgggaggcggcgcggccttcccgtcatcttgaaaaaggcgacatgcctttaagagaccgagctctcccatcgtcagccgttgagcagccgaatccccccgaatttttgtccttgtgacatggcgaggggagagggatcgcgctgccgaacagggggccgaacggggccgagaagggtttggccgaaaccctggtttggtcgaaccagggagctcgtcgacgggctccagattttcaggggagcccggcactgctgcgaggggctgcacccacagtgcattcaccccttccactgtgtaattttccaccgggatgagttgattcgccggtgttggctctccggtgaggttgtccggttacggttcgttgcggaattagttcattttgagcatttgcaacgaccgtcatttctcctttttcggcacaacctggactgggctaacccactcactgtatggtacgggataaataatcccggcatgcaggagtttcaagacctctttctttacaacctctcgcattgcattattgagccatcgttgaggttccctggagggagtactctcggggtcaataggaatacgatgggtgcaaagcgcgggattaatccccctaaggtcctgaagcgagtagccaagaacagaacgatgcttttctaacacggtgagaagacgttgagtctcgtcttcagagagcttgtcactgattatgagacaggggcctgtcacgcccagaaattcccgaatagaatttcaagcagaatgtgcattaaattccccgtccaggaccggccggggtacacaaacgacaatgttgacattcagatccacgtcttacaaacatcataaaagtcttacaaaaaatgcagcggaaagaaagaaagacaacaggagctaagccttgacttgaactgcagcgggaacaccactccacaggcatcctcgacggcacggacaaagcctactcctcggagaaaccttcatctgacccgaactcgaactctggggttgggaaaagtagagcaagactgagtactacccactgtactcagcaagtcataccggaataggggtatgatgcagggaatcatcaaaggagagctgaagtggttcatttgcataaagcgagcatttataagcagaaattgaaagatttaaacggttgtaataattaattaatattaatcatccgctgtccaacgctaacccacgttgcgacaggcccaaccatccacctaaactatccaaattcaaaagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggnnnnnnnnnnnnnnnnnnnnnnnnnnnnnnnnnnnnnnnnnnnnnnnnnnnnnnnnnnnnnn

SEQ ID NO: 52250 - DNA, 1119 bp, Oryza sativa
  unsure (1)..(1119): unsure at all n locations
nnnnnnnnnnnnnnnnnnnnnnnnnnnnnnnnnnnnnnnnnnatgcaaggcgatctttcgggtcgatgccaaaggagacgaagaagccattgacatcagtgcagcgggcgccctgacctggtccatgtcgtcaccttcctctgggcaatcactgaagtgaagcttcgctaactagcgatggatcttccggctctggctccgccaaccatagcgcaggtacatgactcatgagctcatatgacttgtgattctcctcccaacatttatttttgttagtttggggattggaatctgttgcagatcgaggagcttgagcgagttgttgggattaggtttatctatagaggtgcagtggggacacgccgccgtcgtcagcgtcttgctgaaccatggcgctgatgtaggcggacgcagtgatgatgattcttgactgtattttagggaactaattgctccaattctgacaaattttaactatatttttggttccctgaaatgctaattgttccaatcctgacaaatacaatgtattaggcaggtagttttgatttgaaatctcttttggattttgtagcccaacaggattgccaatttcgtcttcacaccgttggtttcgtcacttttggggggatcattggaatgcatgaagttgctctttcagatagattttctgctaattatcttcgttctttttttctccagctccatgcttttttacttccttgtaccactaacttcattattcttgcaattttgtttactggcatttataccttaaccatcattctggatttacagtgctttctaaagaatctactgtgctgaacacatgaactaggccgatgctaacgttaatggcgctggattcaatggagcaactcctctgctgttagcatgtagtcataccggctccatcagatttgtcaattgcttggtggaatctggggcagatccaaacattcccgacgaagtgagcatatatattgcctgtttccctcaatacttatgttctttttgtcgcctcatgtgcacaaaattttgttccctacagtttcatnnnnnnnnnnnnnnnnnnnnnnnnnnnnnnnnnnnnnnnnnnnnnnnnnnnnnnnnnnnnnn

SEQ ID NO: 52251 - DNA, 722 bp, Oryza sativa
cccatctcctccacccttttgtcgaaagcggctcgcccgcaaaacgattacctaagtgcataaggcaaacgagatattttggaaaaccggtgtattttggaacaagccgttgtttacaaccaccatcggattgccccggttaaacggctataaaccctatagaggacacaaggtaccactgcaacatccgaccatcgcgcgccatacccgtggccaggcacgcatgcctacaacaggatacaagtacaatcgcctgtcatcagaagacatgcaagcaggttcgtcctagaaagaagttctaggtgaccaaggatataatcaggagcgctcccatcgacccgaagccagtcccgtgaaaattggaatttcatatatcttaccttcttcgtttcttcaggaattttctaaaataattccgtggaaccctcctcgcaagaaaatacctaggtgcagttcctctccctctctttatccaacccttactaatcttgaggacgagattattcttaagggggtaggtttgtaacatcctggaaatctcgattctgaaatacggaattaaaaattcggaataataaaaaatcttttaaaacatttttgcatgctgggatttattatgtatttgtgtgtatttaggttgtgtgccaaagatctcgattaaatcttatctcctaaagggacgccctctctgtccaacgtcctttccttcccttatcttcacg

SEQ ID NO: 52252 - DNA, 1873 bp, Oryza sativa
  unsure (1)..(1873): unsure at all n locations
aaaggnaagagatacccttagtggaagnaggagtgcttagtgcaacctcttgaggaaagggttagccaagacccggctctttagtgagctcctcaacgtagagtagaatcccctcaaggattcgaacttcgggaacaacctcgtgagcttcatctttggtgacttaacttcctccctctcctctagctttgcttgtttgagccgctataggtctagttgctgtttgtgctagcatattcttgttgtaggcaactagatctaggatttactttcctgtttgtgctaactccgaaaattttcggatatatccgaaaatttcggaaatatccgaaaattactgcttccgcttttagttgatttttgaattagcctattcacccccctctaggcctaattgacactttcaattggtatcagagcctaatctcctaattaggcttaaccgcttggagagatcatgtcgggccaaacgggggaaggaaaacatggtgataagggagctacgtttccttatgactatccacctacatctacatcttatgtgagtacctatagcggcaaagctccgtacttcaatggtacggactatgccgcttggaagcataatatgaagatgcatttaaagtctattaacccatctatttggagaatagtcgaaaaaggctatgttttgcagaatcccgaaaatcccaccaaggaggacgacgagaacgagcacaagaacgctcaagccgctaatgcaatacttagcgccttgagtggaagtgagttcaaccgtgtggatggcattgagagtgccaaagtgatttgggacacgcttcggaacttgcatgaaggcacggatagtgttcgtgagtccaaggtggagatcctcaaggggcaatttgagagatttgtgatgttggatggtgagagcccaagtgacatgtatgaccggttgagcaagatcgtcaatgagatcaagggacttggctccaagggcatgaccgatgaggttgtggtcaagaagatggttcgagcaatcactccaaggaactctaccttggtgactatcattcgtgagcgtccggacttcaagactctcacacctcatatttgctcggacgtattcttgcccatgacatgctcgtgcaagagtccaaggatgtcatccaatacatcaatcaaagttcaaccacaaacatcaagaaagaagacttggcgttgaaggcgaaggaagaagaagaagagaatcgcaagagcaagagcaaggcggagatcgatgatgaagagatggctctcttcgtcaagaagttcggcaagttcatgaggcgaagcggcttcttcaagggaggttcttccaagcactactccaacaagtcaagtggaagacactccgcaagagtgtgctacgtgtgcaaagagcccgggcacttcattgcggattgccctcacctcaaggatggttcccacatcaaggaagataagaagaagggtgagaagaaggatgagaagaaggagaagcacaagcatagcaagcgggaacattatggccaagctcaccttgggatgatcttcggctccgactccgagtcaagctcaagtgatgaagaaggagtcgccacatttgccgtcaagccttcatcaccaccgagactcttcgactactcaagtgatgaggatgctcccatttgcctcatggcaaaggagcctaaggaatatgtctccggtggaagaagttgggtgattgatagtggatgcaccaatcacatgaccggagaagaatcaatgttttcatctcttgatccaaatggctcttcacaagataacatagacttcgaggacgatggaannnnnnnnnnnnnnnnnnnnnnnnnnnnnnnnnnnnnnnnnn

SEQ ID NO: 52253 - DNA, 757 bp, Oryza sativa
cggttgcagtgatcaccctcctcgacaccctcctcaaggaagatgcactcaatcaggccgatcatgtcgtcaacatcttgaatcagacgaagaccatgatcgccgcctcgatcccagctaactccgtaagcacccgcacgccgactggcagccgagtcctccctctccgatctcaagactatcaccaaccaagcctcagcgtcgttggcgccggatccaatcgcaggagcaggggtcacgacgagcgatctgtccattcacctcccgaacgacacagggagcgccgagttgaacgacctcgcaggcaccccatcgatcttcacgataccatcaaccagcgccgcgcggcaagaggctacgctccccaccgttcaccagactgctacgatgacgacgtggatggtgtagctaccttcacggccgacctgcgtcgagtggattggccagccggcttcaaaccgactggaatcgagaagtaggacggcaccactaacccggagtcctggctcaccgtctacggtctcgcgatccgcgctgcaggaggagatagcaaagccatggcgaattatctgcctgtggccctagcggattctgcccggtcctagcttcacgggttaccccgtggcacaattggatcttgggtggaacttcgcgaacacttcatcgccaatttccagggcaccttcgaacgccctggcactcagtttgatctttccaacgttgtccagaagtccagagaatccctgcgagattatat

SEQ ID NO: 52254 - DNA, 1288 bp, Oryza sativa
ggacttcaaaactctcacacctcatatttgctcggacgtattctggcccatgacatgctcgtgcaagagtccaaggatgtcatccaatacatcaatcaaagttcaaccccaaacatcaagaaagaagacttggcgttgaaggcgaaggaagaagaagaagagaatcgcaagagcaagagcaaggcggagatcgatgatgaagagatggctctcttcgtcaagaagttcggcaagttcatgaggcgaagcggcttcttcaagggaggttcttccaagcactactccaacaagtcaagtggaagacactccgcaagagtgtgctacgtgtgcaaagagcccgggcacttcattgcggattgccctcacctcaaggatggttcccacatcaaggaagataagaagaagggtgagaagaaggatgagaagaaggagaagcacaagcatagcaagcgggaacattatggccaagctcaccttgggatgatcttcggctccgactccgagtcaagctcaagtgatgaagaaggagtcgccacatttgccgtcaagccttcatcaccaccgagactcttcgactactcaagtgatgaggatgctcccatttgcctcatggcaaaggagcctaaggaatatgtctccggtggaagaagttgggtgattgatagtggatgcaccaatcacatgaccggagaagaatcaatgttttcatctcttgatccaaatggctcttcacaagataacatagacttcgaggacgatggaaagggaaaggttataggattgggtaagattgcaatctctaatgatctttccattgccaacgttctcttggtaaaatctctaaactacaatcttttgtctgtttctcaattatgttctatgggttacaattgtctttttaccgatgttgatgtgaccgtctatagaaggaatgattcctcgatagtctttaagggtgttctcaagggaaagctttaccttgtggatttttcctcaagtaaagccaaacatgagacatgcttagtggctaagtccaacacggggtggctttggcatcggaggctagcccatgttggtatgaggaatcttcccaagcttctaaagcacgatcacatccttggtctaacaaatgttcaatttgagaaagatagggtgtgtagcgcgtatcaagccggcaaacaaattggagcacatcaccccgtcaagaatgtgatgaccactacaagaccattggagcttctccatatagacctcttgggtaccgagctgaattcgccctatagtagtc

SEQ ID NO: 52255 - DNA, 1834 bp, Oryza sativa
  unsure (1)..(1834): unsure at all n locations
nnnnnnnnnnnnnnnnnnnnnnnnnnnnnnnnnnnnnnnnnnnnnnnnnnnnnnnnnnnnnnnnntctcatttgtttccaggatacggattggtttctcaacataagtcaaatcctcttggacttctatcttctcaatattagcttcttcggtaggtacccttaaacattttttcaattgtgacacatggaacacattatggactcctgccaaagattgaggtaattctaactgataagcaacctctcctcttctactgacaatcttataaggtcccacaaaacgcggtgccaattttcctttggtgtgaaaacgatgaactcctcgaagaggcgtgacacgaagatacacatagtctccttcttcaaaactcaaatctctacggcgattgtcggcataactcttatgtcgagactgagccactcgcaatctttcttgaatgacctttaccttttcttctgctttccttaggatatccgtcccgaaaacctgacgttctcccgtttgatcccacaaaagcggagtgcggcacttccgaccatacagtgcttcgtaaggagccatctgtaaactagcttgataactgttgttgtatgaaaattctgcataaggtagattcttatcccaacttccaccgaaatctaaagcacaagctctcaacatgtcttccaaaatctgattcaccctttcggtttgtccgtctgtctgtggatgataagcagtactaaagttcagcttagaacccatctcttcctgaagtttcttccaaaaatttgaagtaaactgactgcctcgatcagacactatcttcttagggacgccatgcaaacacacaatccttgccatatacaattccgccaagcgacttccggaataggttgtctttaccggaataaaatgagccactttggtaagtctgtcgactatcacccaaatagagtcatggcctgatgacgttctgggtaaaccagtaataaaatccatacatatttcttcccatttccattcaggaatcttcaaaggctgcaacaaaccggcgggtttctgatgttctgccttgactcgctgacaaacatcacatactgctacatattccgcgatttcacgcttcatacttgcccaccaaaatctttccttgagatcctggtacatcttagtactaccagggtgaatggagtataaagtatcatgagcttctttcataactgcatcttttagatctttgttgtcggggacacagattctctcacccaaccatacagttcttgctcatcctccaagaaaccaatagcttttcctcttctcatattcttcttgatctcttgaatatcaggatcattaatttgggcttctctaacttgatcaattagagtgggcttcgcttctaaggctgcaacgaaacctctaccgacaattcccaaatttaatctttcaaattccttgcataattccaatggcaactgtcgtccttctgtagcattgcaatagccttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtgtacacttttgtacgagtaccgaaaagataatgacgccaaatcttcaatgcatgaacgactgcagctaactcaatatcatgagtagggtagttcttttcatgcggacgtaactgtcgagaggcataggcaaccaccttcccatcttgcatcagaacacaacctaacccaagtttggatgcatcgcaatacactt

SEQ ID NO: 52256 - DNA, 1600 bp, Oryza sativa
cgaagatgttcctcatgctcttctttggttcgaaggtagataagaatatcatcaataaagaccaccacgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggcacctttaagctgatcaaacaaatcatcaatcctgggtagtggatacttattcttgatagtcacatcgtttagtgcacgatagtccacacacattctctgagtatggtctttcttttccacaaaaataaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcataccaggtaaatcatctgggaacacatcaggatactcccggactataggaatctcttccaaagttatctggttcagtcttgaccttaaagactcagatgacaatgcatgaacagttacaactcgaccatcatagctggtgagagttacttttttgttggcacagtctatcacacctttatatctggctaaccagtccatccctaggatgacatcaaggtctttggattctaataagataagattggccagaaatggtactccttgaatttctattctgacagaggggctacgttgcaaagagagtgcttgattacttggggtactaaccatcataggacgtctaagatcttctacttccatcccatgatttcccgcaaaactcatagataagaatgaatgtgtagcaccagaatcgaaaagcactgttgcaggaactaagttaacaagaaacatacccataatcacatctggagcatcttgagcttctgcagcagcaacatgattgacacgggcctttgatgctggtgcggtagagttgctctgggtagggacaaccttcacacgtcggggcttcggacacttgtcagcgtaatgtcctgggtctccacagttgaaacacaccacgggcttgctgccttgctccctcttggcaggttgttgctatgtcgaggctgcaacagggcgtggagcttgattacgaatgttgttgccggcattgttgttgaagaactgacgctgcggacgaacaacagacgaagaacctccctgtggcatggactggggtcttaaagtaagacgcggcttttgattatttccctgttgtgtcttgaattgagcaatccggcgtttcttttgctccatgcggttgtacttgtcctcctgacgaatagccttatccactaatttctggaaatcaggataatctccagtcataagtgggtaagaaagctcatcattaagtccttctcctggcgctcttcatcagtgcgtacctcttccggagcataacggggtaccgagctgaattcgcc

SEQ ID NO: 52257 - DNA, 2101 bp, Oryza sativa
tcccccattgctgcgagtgttcaccatctggcatggacagggcacaagaagagaaaccggggaaactacttaggacagagaattactttaacttttattgatcttaactgagtttcattattacaaactaaagattctcacaccactaaactcaccaacttcctaacactcaaaagcaaacaaacgcatgcacttacatcccaccactgatgtaaatcacatgcgagccacacacaagcaaactttaagcaagcaaactaacacaacgatctaagacaacgacttaacaagtcactctagttcttccaagcatcggaggtcgattgaaggctcgtctttatcatcttgagttgctacccactcaatcttggaattgttgcgcttggattcttcttctccatcactacttatgatgatgaccggaggatccgcttgagctggggcaacttctttctccaccacacgaacctttggcgccagttgatagcgagggacaaatagagctctcttccttgcggtaagacgaatcctggccttctgcggcggtgcttctcccttcaatgcggctaattccttctccaaacgatccaccttgtcttctaacttgcaaatcttaccacgattccggtcttcacgatcttgagcggctaacacagtctccgcacgactttcatccatagcccacaacatctcaaccaaatgcttcgtggtagcatcattctcaattccttcagtctcaaggtaactgccacggtcacttccctggggttggcgaggatggtagcgatactcagtgtcggccaattgatcactgtagcgatcacggagctctcctatggcgatccttgccacttcctgacatgcatggatgtagtttcttcctccagcttcaaacatcactgaggggatatcttcactattactgttcaaggtgactttgactcggcacttctcttcatgacgatcatgaggaatctgggcataaaaaggggcagtcccaaatccaatgacaaaggacatcgtacgcaactcctggacaaaaccctcaacaccaaacaggtactcaggcttgtaacgcggcatctaaagacaagtgaaaggagggagttaagacctttatccaattaatagcacaagtttttggattaatttgaataaagttagaaaatcagagtaaaaaggtaagtaaataaagtaaaccaagctttgcgagataagttaaaacagttggaaacgaggtcacaaattttgtaattttgaataactggtttcaaaagaaatgaaagaaaattataaaatcaacatgctaaatttattttattgcagcaagattaaataaaacagtattgtaaaacttttgctggtaaatgagccattagtacagtaatagatgtacagtactaataacactggaataaatttttaatgagaaccattaaaagagattatgaagtgcatgtgccattagtttggtttaattaaaagagaaagggaggagaacagttctacttttccaatatttttagagggcttctatggataaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcatagtagggttgcatttgcaaaagcagcatttagcaaacatctgagaatttgataaaacagttaagtcattaaacaatattaatccaacgctatacaacataccctgttgtataggccccaccattcttgacaaccacccc

SEQ ID NO: 52258 - DNA, 975 bp, Oryza sativa
  unsure (1)..(975): unsure at all n locations
atcgaacggtccacgaccggctcacggcgggacgaccccgatgacgtcagcggtgacgtcaccgacagcggcggcggctcggcggaacggacggctcgggcggcgcacgcttgccggcgaacggcggcaccaggacgcaaacggagggcaccagcacgtagaggacgacgcggcgaacacaccggtgaccaaaacggcggcggaagaacaacggacgacgacgacgacgaggaggaaacggcggaaaccttcgggttgtcgacggcgacgaagctccggcgatctccggcaacggcgaaggggcggacgagaacggcgacgcgacggtgaccacgacgacggtcttcccgagcgacggtgacggctgaagcgacggcggcgcacggctggagcggcggcggcgacggcaaagctagggcacacggcgctagagctctttcggcgacgagaggcgaaggcgagggtggcggcgggtagaggagacaccgagggtccttttaaaggggctcggaggcggcggcaaaggcccacgacggcggcaacggcgaaggaaactcgcggcttgaaggaaagaggtcgatccgaatcgaactcgattccacgaacttccaaaccgatttagccgaagattccaaaggagaaaaaggtagaggagatcccggagattgtttcccctcttttgattcgaccagagaaggaaaggaacggccggatttggaaggaaacggcggcggcgcgaaactagggtttcggcggcggcggccgaaggaggacgaaggtcctgacaggcgggaccctcctgtcagcgacagcgagagggcgcgcgcgcggcggactgggccgaactgggccgaggagagagagaggggttttgggccgactttcggcccaaagccaaaagagactttttaaaannnnnnnnnnnnnnnnnnnnnnnnnnnnnnnnnnnnnnnnnnnnnnnnnnnnnnnnnnnnn

SEQ ID NO: 52259 - DNA, 1300 bp, Oryza sativa
  unsure (1)..(1300): unsure at all n locations
nnnnnnnnnnnnnnnnnnnnnnnnnnnnnnnnnnnnnnnnnnnnnnnnnnnnnnnnnnnnnntgtaaatgagactaaataagataagactcgagtaaacattagtttcacacttatatatcaataacatggaaatcatatatatgaacctatcaaaaagtaggagataagaagtggtacatatcgttttatctccatgcatttcatccttgtcatgattaaggtccatcaaaaaataatgcatgtcttccacacctcattatcgggaaataacctagtagacaacttatgcaaaagagaggttaatcccataaacatcggtttatcatctatcaccaaagtaacaattacacaaattgtttaatccaagatctttcaatcttctctctttggtgatggataataacctgatataaacaattagagagatgagatggaagatgatttcaaatcaagatagaaatcttataataaacaaaatatagaataagctccccctcaagatgtgcatacatatggatataaaggaacacatatgcacataatcaatcaagatcaatgaggtagggcgaattcgagctcggtacccacaagagagaccaagttagaatatgtgaagtttaatacatacctctcatcatttttattttcatatccaaataagactagtcaaagaaaggctcgtaaaaacgttagtctcatataattagatttgtcattaatcaccaaaaccaaattaaggcacttgaacttacaatgggcggcgacactgtagcccgagggaaaggtcaacgtttatcccgaatcgtaattatcttcaactcaccgaaagatcgggccaatcatagacgtgagtttctcaagtggagatcagggttcatcggggggggggaggggggagggggcatcgtccttttataggcggcgagaggcgattgtcgacttggccacgatgacggtgatgtgaagaagaagagcacaaccgccgccctcgtcttctgattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 52260 - DNA, 774 bp, Oryza sativa
  unsure (1)..(774): unsure at all n locations
aatttaaaatttataaattgttgtttaaatggaatttttagaaataattttaaaagtcttgaagagaagatctagttttaattaataaattccaatataaaatgggcccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaaacccctctctctctcctcggcccagttcggcccagtccgccgcgcgcgcgccctctcgctgtcgctgacaggagggtcccgcctgtcaggaccttcgtcctccttcggccgccgccgccgaaaccctagtttcgcgccgccgccgtttccttccaaatccggccgttcctttccttctctggtcgaatcaaaagaggggaaacaatctccgggatctcctctacctttttctcctttggaatcttcggctaaatcggtttggaagttcgtggaatcgagttcgattcggatcgacctcttttcttcaagccgcgagttttcttcgccgttgccgccgtcgtgggcctttgccgccgcctccgagcccctttaaaaggaccctcggtgtctcctttacccgncgncacccttcgctttgccttttgtcgacgaaagagctctagcgccgtgtgccctagctttgccgtcgccgtcgncgattcagncgtgcgccg

SEQ ID NO: 52261 - DNA, 1080 bp, Oryza sativa
  unsure (1)..(1080): unsure at all n locations
nnnnnnnnnnnnnnnnnnnnnnnnnnnnnnnnnnnnnnnnnnnnnnnnnnnnnnnnntcccgttgtcttggccgtttgcggtttgggggcttgacatggtcggcccgttcaaaaaggcagtcggcggttatactcaccactttgtggctgttgacaaattttccaagtggatcgaagctaaaccggtcattacaattacgacagacaaggctagagatttcttcatcaacattgtacaccggttcagggtacccaatcggatcatcactgataacggcacccaattcacaggcggagtattcaaagatttttgcgaggacttcggcatcaaaatttgttatgcctctgtagcgcaccccatgagcaatggacaggttgaacgtgccaatggcatggtacttcaaggaataaaagcgcgagttttcgaccgattgtgtccttatgccggcaagtgggtagaacagctgccatctgtactttggtccctacgcaccactcgtagtcgagctaccggctagtcgccttttttcctagtttatggagcggaagcaatgttgccgagtgaggtggaatttgaatctctacgatttcgcaacttcagcgaggagcgctatggagaagaccgagttgatgatatcaaccgactggaagaagcccgcgaagcagccttaattcaatcggctcggtacttgcaagggttgcgtcgttatcacaatcgcaatgttcgctcacgagcttttttagtcggcgacctggttctgagaaaaattcaaactacacgggatcggcacaaattatctcccttgtgggaaggaccgttagttatatctgaagtcactcggccaggttcttatcgactcaaacgtgaggacagtactcatatcgacaactcttggaatattgaacatcttcgtcgtttttatgcttaggcattacttttgtattttcctctttgacttctaacatcaagcctttccttgagttatcagttgggggctactataataataacggagtgtgatttttatcaattcaatttgcttnnnnnnnnnnnnnnnnnnnnnnnnnnnnnnnnnnnnn

SEQ ID NO: 52262 - DNA, 1523 bp, Oryza sativa
ttcggatccacggatcctatgtctccgttgaggggccacaagaccgggtctatttcaaccatttcctacgagattgcacaaatgcactcctcggtttcactcttgatttcttcccttacagaggcgaaatcgaagtcttcacaaactttctatggcacaccacaaccttgggtgatcaccgacgatgcctagccatctggaaaaccttagtccccaagagtaacaaacacaatcgaagatttacttgctatgaactcgagtgctcaaagtatggagtgaaactcactagctctcaacttctcaatctctcaatccaactctctcctcttctcaaatccctctaacaaagaggcaccacaaaggatggagtgaagctcactagctctcaactcctcactctctcaatccaactctcttcccttctcaaatccccctcacaaagaagcaccacaaaaggatgggaaatggggatggctatttggctttggatgtgtttaatattgcccaagaacagcagcccctcaaaggaggggtgtaggagtttatatacccgagcctctcaaaaactagacattgtaggtcaagactgtaattttcggaagttccgaaaagcattttcggatatgtccgaaaatttacagaagccaatctcagattcgtggccatttttggaatttccaataattttcggatatttccgaaatattttcagaatttctgagaagcacatagtaaaacgactataacttttcgctcgggagtctgtttttgatgatcttggactatatggaaagctcactcagaggactacccaactcaaccaaaaacaaggtccaaaaccactcaaaggatatgttaaagcttaggtttctctcaagagaactacccaactcaaccaaaaacaaggtccaaaaccaatcaaaggatatgttaaagcttaggtttctctcaaggtagtactataataggtcactttgagcaccaagacatatacaaacacctcgatgttgcatccgtcttaatagtacggcattcctaaactcaaatataaataggaagagaattataccaataggaatgccttctttccatctttctttatcttaagggacgccaatgccgaaaccgtttcaccatatattcatcaaatgattgatgaggttacttctagcttcaaatggccttgcacggtccatcatgacaaagccgtcactcgcccttcaccacatgatttggttcttcggcgccaagccccttgcttgcccttcaccgccacatggtccatcgcgaccgagcatcacttgcccttcactgtcttgccatagtagccacttcatatcccatatcttcaatatctccactttgttattcttggtattttaggtgcaatcatatcacttgagtgtcaacaccttttcaatccttggaacctatttttctcattcaattcaatgaaattattagtctcaatgatccggttgtcaacctccacatgttgaccaaccgatcgcatgtataaaagg

SEQ ID NO: 52263 - DNA, 3335 bp, Oryza sativa
  unsure (1)..(3335): unsure at all n locations
cnnnnnnnnnnnnnnnnnnnnnnnnnnnnnnnnnnnnnnnnnnnnnnnnnnnnnatccggttgtcaacctccacatgtttatcaaccgatcgcatgtataaaaggatataaataaatgatgagtattaatcaacaccacaagtgtcatatacttaaatatatgctcaaatgtaaatatcttaattaaataaaagtgaataacttggatcgattacatgcataactaaagtataggatttgctacccctaaatgtatgcatacaaaatgtttgttgtgtgaagtaagaatatgcataaaagaatgaaacattaggagcttatcctatacaagaatagaaggcatttatcaaatataggcattaaaataaaaacataccttcatcatctccatgttctgaatgtaaatagactaaataagatatggctcaaacaaaatattagtctcacatgcttatgtaatcacataaaaatattatatatgaatatattaatatgtgcacggagagaaagagtgtcatatatagcttgatctccatgcatttcatccttgttatttaggtacaccatcaatgaacgtttctctctcatattccattttcatatccatatgagactagtagacaaagaaatatttataacaatgttagtctcatgtaattggatttgtcatttatcaccaaaaccaaattaaatggatttgtcatttatcaccaaaaccaaattaatggcactcgaactttcaatttacaagtagattttcttgactcgaaactagccgagccgtctaatgtagtagcgagttgaatatacttttctcctctcttttttttttaagtgaaagcggcaaagcattatcgaatatattagaaggccagaaataaagtttttacaatagggtgattacatatagcatttgtgagcatctaggagatgaattaacatattaagaaactataattgaggcgtttggaaggcgaagtcacactcatgcagatcttccgggactggacgtgccgttctctgtgtgttcggttcctccccttggaaaattttcatgtttctctgaagccaaacgtgctaccacatccttattagggttccaattttactcatggctttccaacctgctcctcgttgaagctatgcttgtcatccattcaataatactagagcctggggcgcgccgttggcgcgccgcctgtacacaacgaaattgaaacaacacgtgataagcagggaacaaataggaaaaggaacagggaaaaggagagaaagcagggagttatagataaacaaactgcagcactaattacatatatgtatttcgatacataggagtctttaataataaacatatatagatggtagtatgtaagatatgtaaggcagctcagtacttctgataagaagtgaagacgcagagctaattagcatagtaatagtggtagggttggtgagtggttcatcttcatagcgatgaatgtgcttactgctagcaaaaggatgatcctaatatagttatgatcgttcagatgctgttcacagaacatcgatagttacttcaatgtgagttgccttgtagaagtggaagatgcatactaatccagcatatatgtgattgtgccttgcaaacttcatccaccctttcttcaagttgcagcgaccatcagatgaaacgtggaggatcacgttggttgaaatacactgataggtcacggcaattgagaacaacagctcccaaattcagcaccatttcgatcaacatctgagtagatcctccacagcttccactattccagtagcctggcagcatgtaaacaaaattttcaatgataattagtttctcactccaaacaaaaacgtacaggaggcgcgcaataattagtttctcatgatcgctaaaaactttaatcaaagaatgaaggaggagatgcgggcagcggcggcggcgagggcaagagagggagaatgaccatatcaacacgcacctgaaaagacttgagaagaatacaattggtcgtccataccatcaggaagattcacagcttgaatcgttctccgatttcttgaataagtcatcacttttcttgagaattccttaactaatgaattatctgaaaacgtcaagggaatctctcagcaattggatccctcacataaaacagtcgaataggcatcctttcaggatcatcagttggagtttcttcaggtatatcatggtacagatgtttgagaatgaagagagcagtatcatgatctcgccaataattgctacaagaataaacctgcaggccagttaaatggtgaaatagacatgataaaacaattagcaaacaacaggattggttatggaacctacatatgagatccaagggcagataagtataggtgttgaaatgttttctcctgaaatcagatgattcagactgtaagctacaacatatttgtactgacaaataatatacaagccagaaaataaaggggtcaagggaattggtgatgctgacaaaagggttcgcagtcctgacacaggaaccactaaaccagcagagactggggaaccagccaattaagcttgccagtggttatatgatttccactgtcagttccttcaaggcacagtagttggttaagataggttagctaaagggttactgaacatattaggcatattttaaatcatgttctcactcatttggtatataagtgcatttaacagtatttaacctcttggatttatgtgctcttttatgagccaaaatttaaccaactttagagtttatgggtttaactctcttgtgaagattaaccctgaagctaatttagggtgttaaactaatcacttatattggttagggtgatttaagctctcaccattcatgtcaaaagcaatgtacagtacttttcatatccacagcagaccacacaatttcaatgcttacacatacaccagcagagagtgaaattgaacttgctttaataggaaaagtctgataacctgaagtacatggtcaatccgaccatctggtgaacctgtcagcctttccatcatcatgtaaccatatgacttctctttctcattattgctgtcaacatcctctgaacaaccaaaaaacgtaatcagaacattgctttttgtgacttgcaatgcgtagaagacagaaaaaaaatctactatatgcataccggctgtgtcatttctgctcagtgatagcaaagcaactactgctttaacctaaacacaaaagggagattaaaggtcccaactcattaagaaagagctacgtgaacagctatgtttctagatcattcacaggtaacaaagcatttatgta

SEQ ID NO: 52264 - DNA, 1354 bp, Oryza sativa
gactactatagggcgaattcagctcggtacccctagatagataattacttatatgtatgcggtcctctagacaatacatttcatcatgaaaagaaggtgtagtcaaattcgaacaaatatatactcgatgaacattatattctcctttactatcataattgccaataatatgaaaaatcacatcagaagggcatggcaattccaatctagcaaatagtttcttctctaaacagttgagtggacaaagatcatcaaattgaatataaccccaagtatttaaagaagatagcaatttaagctcttcattctcgctagcaatgtgaataacatgtttaaactcaacacatagtggttctactatagaattaacatgttcattcactagttgtggcatggatataagtgaagcatcgcacaactcttttttatcactaaaaacatcaagcaaattgttttgtgacaaaggtatttcaacaattgtttccactatgggttgctctaacgtagcataagtagtggacatagttggcacaacataaatatgcataccttgaatagctatagcaccattatcattaccttctttctcatcttcctcttcgtctttcttctcttcctcattaccttggttgttctcagatgcatgcaaaatattagtatccaaagcaataggcacaacaatacgttcattttgtaataattcaggaggcccgaatccgaatccaaaacgtgtagaactttatctctgatcttctatggaccaaaagtgacgtgatgagatggaagtggacttggagaaggtcttgatatggtccccaatcaacttctttgattatccatgaattcgttacgctcagtctcctttcctttgcccaagcaagtacctctgcaaaacaaaaacacaggaaactcatagtgtagcaacgtttgtgttggcaactttttttgacaagttgacaagcacgatcgcaacacctaaacgccttgcggtgatatggagtcgccaaccacctcgatctagccaaagggccaaatcaagatgggttttgtagaaaaacaactaaaccggctaccggctagaggataactacccgtctcgtgggcaaaacggaaggttttcaggacaaacctacaaagaggtgtcgcactctcgcagcgacggcagacggtttacggcgcaaaccgacaaagatggactaaaactggggtaaaatagaaaacatagtaaaagaacgattcaagtagattgtattctggggttttacaatgaaccggccttgtcccttaaataggggttggtcttgccctatacaggcccttctccacgtccaactcgggatagaaactaaagaaa

SEQ ID NO: 52265 - DNA, 1712 bp, Oryza sativa
aagtaatccagtgcatctagcatgaaccaatgcccttttgataacgaagaataaatctgaccaatgaaatccaaagccctacctcggtacggtcatggttccatatgcgcctactaaacatttccaatccgttgacgagcttcacttcctctgtagcacttgaaataatcatcaattactttcggccaatagaattccactcttataagcaaccaatgcatcttatgggccgattaatgaattccacaaatcccttcatgcacatctcccctagcaactttagattaatcattgtctaaacacatcaatagcattccatctatatttcagcgatataatatttgaacgcttgccgccgaatcttccggtcaaccccaagactaggatctttcaaatattctattcaaagggattctccaatctatttctgacttatgggcacaaatgtccgaattcacaattaatccggtctttaaatcaattgtaacgtgccccccagctctctacccgggatcggtcagaccggacacacaatgccggtcagacctccctgtctatccggtcggaccggccatgcagagccggtcagaccgccggtcatcaccggtcagaccggccatgcaatgctggtcagaccgcccctggtccgtgatttggccaatttcatccaaagacttaaaaatcaagcaccgacttttctagtaaaaaatactcctttcttcatattataactagatgcttggtgtatcaaactattggaccaaaatccatcctctctagacatatgaaaaaattataacatccaactaacatgtctagatgaatactaattcaaatggcttttgaaacaataatcatcatggcatcaaaacacttagccaattgaagtatgatcaataatgaatcaccaaagtcatatgtgtcacatgcatagattccaataaactacaaatgtaagtaatcggcttgagtatgtatgtaaaatattaacaatgccaatgttcctaaatacaataactctaggacaaatcatcacattgaccattgacactagccgaattactaataagcaaaactttcatggtgcaataaatatgaaatctatatattatatggtgatccataaaaacacatatgatttggctctaaataaatatcaaagactcatgagccaaatcatactttaaacaaattatatgccaacctaccaattccactacctagaactggcatttgcaacatgtatgtataatatcaatttgataaacaaaaacacacatgtgctagatagcaagcaatgttctaacatggcataggcatataatataacgttgaacacaataaaccaataaacccataccttgccttagcatccaacaaacggcggctcaaagatatgatgttgtatccatcgccgttcatcttctcttggttccctcataagcataataatgtcttgccccccaagcaaaatcagctttctagattgtgcgatttcgaaggcaagacggataccgcactaacacccatagcatcatgtgaaggagacttatctctaatgaccgatgattcttctctcatcaaattggatttacctctactatgggaaatcaccggtctcttaacttttacctctttggatctaaacacttgcctaggtgtcgttcgaggctctaaattataacatgttttgttctccacatcttcggcct

SEQ ID NO: 52266 - DNA, 1064 bp, Oryza sativa
atgaatataatttaaggtttttggtgcaaagttttagtggaagctccccctaagagtgtgcataaaagcaagtggagagctccccctaaattattgcatccacattgaagctcacaagagaataaatatatcacatatgctcatcacatccaacacatcacatgcaaatgaataattacatctcatcacaagcaccatataaagaggataagatattgcaccacattaaagataataggatccattacatcacaagcattcataattaaacaatagacttacaaagctttaaacttaacataaaaaacacaaaaaatatcatacagataaaaaccaaccgtgctcgacgctaaggataagatagataaactaaagctatgatagatattctccccctttggcagcaagacaccaaaaagagaggacgatgagctgacgactcaagcgaagggcgcctgaggaggatcctcgggaggtggtggaggaggatagccatagccatggccatatccaaagaagtcgaagtcggaaggcaacccggcaaaaggatcctcaatctcttcatcctccggctcatcgggctcggcctcgaaacccggaggagaaggagggatatcaatgtggtggtcctcataataccgtgcctttaggaacttgacatcacgagccgtcttcttcgccgaattccgcaatcagcggttctttttggcctcctcggagcaaagaccaaaaagactccgcaaaatgcggaataagggagacggctcacgacgagccacagaggcagggcgctcaggagcaggaggcggctgggtagaagaggagggtatgtcccgagcagctgaggagcagggggccttaagaaggcgcaagtgaagctgagaatgagtcacatcatggcgaaactggagctgagtcacagtctcgatcatccgcataatgtgaggggcatagaccaaccccttcttgtactgaattgaagccatgcggatctcctcccacacaaagtgatagacatggaagcgatgaggagggggatcaaaccggagaagcacggtcctaga

SEQ ID NO: 52267 - DNA, 1245 bp, Oryza sativa
aggtttcacccccgtccccagcgggcaacgggcagtcccctctcgtgcctaggtgaatccggaagcgacagaggccgtcgcaaggcccgccccgttccatcacgcccacccttgcctggatgcgtctactagaggagagctacactacaagcccagccgttgcccacgctggcttgtggtaagtacgataagttcttccagggcatcccgcgaaccggtccttaactgccatgggtgcgaccagcaaaaccatgcacccacagcccaccatgtggtttattttaattaaccaacaccaaaacggtgtcactaatccaacaacaccattggaaccaacagtctaaacattaataggattttccccaatgtgaactagctgaactaagcatggctaagcaatccccagtcctaactctaatcatgttagaaccccaagttgacaaagaaacaaggtacaacaatcgcatggctatgacaataggtaaacaacccatagtaacattataaaacaatgcaatatttgaaagaaaacaatagagcatttgcaatataggatcaacatgttcaagtgacaagcatgacttgccttgctctgctgctggaggaacctcggcgactatttcgaagtacaccggagcgtcggacgaattggaatctatcgacatacaaagcaaacattgtaaacaggctataagactactgaaacagggaacaaaaccatttttaatggattctacacatttatcttgatttactggaacttgaacggtcttaaacggagctcggatgaattaattatgaattttagaagatgcactgcgtttattactataacagaaatccttaaataatttattgcgcaatattttccagggctgacgtcagcacaggggaagcggcgccgacatgcgggccccaccggtcagcggctcagggggggaaagaaagggcggcggcacgcggctcggcttggctcaaggccggccgaccgaccgcggcgacggcgatggcgcgcgcgcgaacgcgttgccggcgacggcaaccggcggcgaaagcgacggcgcaaaaggcgacgcgaaggcggctgcgctaagcggcggctaggaaggggagggaatgggcggcgataaaggccgccgccgactcggctcggcatcaaagccgaccggccggccaagtctagcggcgacggcatgcggccgacgacggcggcgaccggcggcacgggaagcggcggcggtggtc

SEQ ID NO: 52268 - DNA, 738 bp, Oryza sativa
tgtgtctcactcttgtcatgcaaaaagaatacccacgtgaagcgtgaaaagtcatcaacaataacaagaccatatttgttacctccaatgcttagataagcaattggcccgaagaggtctatatggagaagctccaatggtcttgtagtggtcatcacattcttgacggggtgatgtgctccaatttgtttgccggcttgatacgcgctacacaccctatctttctcaaattgaacatttgttagaccaaggatgtgatcgtgctttagaagcttgtgaagattcctcataccaacatgggctagcctccgatgccaaagccaccccgtgttggacttagccactaagcatgtctcatgtttggctttacttgaggaaaaatccacaaggtaaagctttcccttgagaacacccttaaagactatcgaggaatcattccttctatagacggtcacatcaacatcggtaaaaagacaattgtaacccatagaacataattgagaaacagacaaaagattgtagtttagagattttaccaagagaacgttggcaatggaaagatcattagagattgcaatcttacccaatcctataacctttccctttccatcgtcctcgaagtctatgttatcttgtgaagagccatttggatcaagagatgaaaacattgattcttctccggtcatgtgattggtgcatccactatcaatgggtaccgaggtgaattcgccctatagt

SEQ ID NO: 52269 - DNA, 1054 bp, Oryza sativa
catcttatgcaatttataaataacaaagcatttgcaacatataggattcaacatgatcgaaggaggaattgaagagggcttgccttgatttgttgtcacataatacttctctggtcctgctcacatcacgaatgaatccacaaatatgccatctattcaattttaaacgtaatccaaatgaacaccaaataaacaccaaaaataaattatgcgcaaacatgcatgatactggtgcagtagatagaacattattttagatgaatttaggtgaaagaattttaaattttcgataaagcatgtgagagatattaacagtcaaagttttatatgcggtcagcgacgtaactaatacttctctatttaaactggcattgcacattctagttttgcaaaatttgaccttacagcattaaggaaaatattattatagacctaacaaaatttggttcagtcgaaaatgatttaagatgaattagttatgcatttttgaagtttgcctatttttcagttttccaaattccccgtttgaactgtgcttttgcaactcgaaccctgagcttttatttttattacaaagaggtcctgtcttcttctccaaacgagcagagacagagcagagccatggctgagctcgatctcgagctcgcctgcgtcaaacggcggaccgaatgaggtcggggttaaaggagaaaatgcagataaggtctttgtgattccgtttctctattcatcccagccggcggtggacggagatggccgggaactcgtcggcagctgggctactcaaggactgcacatgcatgtggcaatgcgtttgcgatccgagcaaagagattaagagagacatgcaatagcaccctgtggctcacaggaagcttaccagggggtcggccaagggttgacgagctccggtgaggtcgggcagcggggtggcggtggagtagaccggcggcgacagtgacacagcgatggcgggatctacatcatgcatgccgaaatcattacatgcaacatgtacaacaccatcccaggttgctactactgcaagcaatcg

SEQ ID NO: 52270 - DNA, 3731 bp, Oryza sativa
  unsure (1)..(3731): unsure at all n locations
ctnnnnnnnnnnnnnnnnnnnnnnnnnnnnnnnnnnnnnnnnnnnnnnnnnnnnnnnnnnnnnnnnnnntattgtctttatgtggccgtgtctaatttattacttccccacatcttgattttattttctttgccaaaaatgcacagggaggaacaactccataagtttttatttttaatgatttcagaataactgattttcatatttttatttcttggtatgtcacatgtactacccttgactagactcatagattttaatactgcatagtgtagagatgagagacatgagaaccttgcctaatgagtgggaaggttagtatagagttggtataagatgaatgtgagggtaaaccgaaccaagcgaggcttggagaggtggatgaaccctggataattacaacttcaacattaacgttgtttttagttaaaactgctaagtcataggtttgtgaaatgaattgtgaaaactagctttatgcaaataaaccaagccatccttgaacccctgtgtacattagattcattttgtagtagtggcttgctgagtacgtatgtactcactcttgcttaattaaatcttttagaaaggagttggagtcgattatattcatgccatgctgctatcaagtacgtgtcgaagacgatggattagggatcatagattcaccagtcgttgcctgtggagttggatggaccgcaactgcttcgcttccactattcggtatacttctttggaattttgtaatgtatgtgaccatgcttggtctattcaggacccatttgggatacccttgttttactattgtagaaacatctgtaaatgatgtcagttgtgatattatattgtgctatgtgtgtaccacctattgatccagagagtgatactatatgacacatgggattaccggtgtataaaaccgggggtccccacagacatactttgtaacgtcccgcctcttttgtaatgtccagcctctcccaggtcgagcccgcttacatctggcaactttcataggtcatagactaccctcacaagtcttttctgcacactttgtctattgatccagagtggtactgtatgacacatgagattaccggtgtataaaacggggggggggggggggagggtcccacagacatactttgtaacatcccacctctcccaggcttaccctcatagcctaccctcaattgcttcaggcctcccaggcctatccagagtggtacatctggcagctttcataggtcatagcctaccctcaattgcttcaggccaagcactcttaacctcagagttctttagagatcggcttccggaaaagaagttgcaacatgttgatatgagtattctattaatcctattaagccctggtccggaaaagaagttgcaacatgttgatatgagtattctattaatcctattaagccctgggccgggatgtcacagggttgttacacatcaagtggaccaaatagaactttataatatgtggtaatatgcgcttttaaattcgcatcaccatttatcatctcgtcaccattttgtaattgataaattcttgtttacctatgcttaccatttgctgccaaataaaaatatttagtattggagtctcctttcaaaatatttttagtctttagtcacaatataattatgtaaatacattgtaattacactcgacgactatttgtattgcaatgaaacgaaccagtcatgggcgtaagtagcttgattgtctcaacgtgagtcaatgcgttaatgataaaactgggtccaatctaacagctcaatcggttaaaaatcaatttgctcattgctcaataattatgttcttgcgggttttggctgattggatagatgtgtatgggaattatatggatttgcttctttcctaatcatttttcaatttgcgagttttgacttttggttgattggattggaattctatggattttaggtcataaaattccatataatttgtgagttttccctgacatgaatgctgtgcaatgtagattttgtggatttgcttcacttctgtggacatttttatgttgaaccaaactaacaatgatgctaatccaggctacatgcttgttgtatcggtttattggctgcaggtttgttaatggaattttggagaatggagttgtaggatcggaggttcaggtatttttctacctcagcttgtgctagttattttgcactatttatatctttgtgatttccacattaggcaccaattaatgcctttttttctatgcaaattgcacttccatttgttgtagttgccatattttagtcatgtactctgcttttgaatttctgcaacttcaattataattttcagcaaataccttttgctttcattatagctggattttctcttgaacatgttgcgcataataaatttttagccaatcatggattggagaaacaatacagttttgtttctgccgatataggatgaatatcgccgtttttgcaaattctattataaacatatgcaactttagttataaattttgagcaacaataacttgccatagttctggctggtctctgcgggcttgtgattgtttttgtgtgtttggctctaaacatctcttgttttaattttgtttcttttctcccttatttcttgatttgcctataaaatagaaccagtagaaatgaaattttagatatctagcatcttaaaaacacatgctatatcgacatcatatgaaaactatgttgattggtaacgtttttatgattattgtcaacatatgtcgagggctatatttgttttttggcatgcagtagaccatagatccaccctgtggggctcatcaggttgatttgctttttgatggggatgtgatgggcaatttttaaatcaatttcatgtatgttgattcttgatttgattttgtgtgttttgtgttctgataattttctcttacaactagacaaaaaatttgtttttttaatagcatggctttaattaatttttccgttctagtaacgtttatgtttagccatctacaacatgcagttcaacagtttttccattggtaaaattagaatacaaaataataaaaaaatgttgttaaatttgttctatgtcatttttacacttccctattgttgaggtcgccattttcaaatctgcaaagttttggttataaatttgtgtaactttagttataaatttgtgcaaccattgatttgtttttctgtaattatttcatgtttgtgtaggattggcaaagggacaattttaaatgttccatcagaagattacgacttgttttggatgtaattgatcctaaatgtaatgtgttcagtgaaacagatctttgtattacgagtatttaccttggaaaactttgttatgtgacatgttcttccacaaattatgtcggttagggggagaccataacagaaggcaaattttcagccatgtgtggtatcaaattttgtataggtcaatgcatttgttgtttctaaaccagaagcatcaactaatttgatttgcacatatactattcttttctatcttaattctgcataggctaactttcgttcttgatgcttcccaattgagtttttttaagagaacacatgataatggacaaaaagccttgaaaattaagttcttttgcccaacaatggtaaggaacaaaagcctggccaacatgcattggaaaaaaaaggcccaaacgcgttcaacttaaaaataa

SEQ ID NO: 52271 - DNA, 1156 bp, Oryza sativa
ggttattatccatcaccaaagagagaagattgaaagatcttggattaaacaatttgtgtaattgttactttggtgatagatgataaaccgatgtttatgggattaacctctcttttgcataagttgtctactaggttatttcccgataatgaggtgtggaagacatgcattattttttgatggaccttaatcatgacaaggatgaaatgcatggagataaaacgatatgtaccacttcttatctcctactttttgataggttcatatatatgatttccatgttattgatatataagtgtgaaactaatgtttactcgagtcttatcttatttagtctcatttacattgagaacatggagatcatgaaggtatatgttttatgttggtctacatcattactacatatgccttctctatgtgtataggataaacccccattgatcattctctaattatgcatacacttgcatctcttgtatatttatttgtatgcatatatttagggggagcaaatcctatatatttattgtgcatgttctagatctatgttgttcactgttggcggttgttaaatgccgattctataccgccaacatctgcataaagttcggataataaaacatccaacatagtgataggtgcttaatctcacatattccacaagtgttggaatatatttgtatgcagacgacaaaccccgatgttgggaggaaaatcagactacagtgaggagattcacgtatccatataaggaggggttgtaaacttcatccaaacaccaataattcaacccaaaactccgagaaatggatagaggaggtccaggggagaagatgggccaagagccaggccagatgggcccagcccaggttcggccgaaccagagccatccaggctggggttttgatgaggacataactagctcggatataatcatgactaccttatgtattaatcaaataaaggtgcatatgttctacattagatttacttgttatatatttgaacaaacgttgctacacaataagtttcgtgtgtttttgtttgcaaaggtacttacttgggcgaaagaaaagagaccgagcgtaaggaatgcatggatgaaagaagacgatgagggatgttaggtgggtaccgagctcgattcgcctatagt

SEQ ID NO: 52272 - DNA, 3517 bp, Oryza sativa
  unsure (1)..(3517): unsure at all n locations
ctatagggcgaatcgagctcggtaccctatgtattaatcaaataaaggtgcatatgttctacattagatttacttgttatatatttgaacaaacgttgctacacaataagtttcgtgtgtttttgtttgcaaaggtacttacttgggcgaaagaaaagagaccgagcgtaaggaatgcatggatgaaagaagacgatgagggatgttaggtcctgatcttccgataggtattgataaacagtcaatttgggcggagtcgcgacacaactcgatccggcttctgaatgaatacactactgagccccgcaatcgcagcaccacgtctcctctggttatcaaccgtgccgaaatccggttgacctcgccgagagggctaatccctgcatgcgaatcgaagaacacaagcaagaacaagatagattgcaaccaaattgcatatgaatgattaagcactcgaatttggggtttcacaaaccaatctagcggcaaaacagttcttgatagaataatctaagcaaaacccaactctaaatgatgacggctactgaattaatatgattagggacgtcctagggttgtcctaaggcgcacacccccttggcctaagcccacgacataattacaaggcccaaaactcaaatcagattcggactggatgagatacgtggtttgttttgcagtttcccggcagctcggtaggaattttgacgtgggaccaaaaccatctgaaagtagactccataagctttccaacaagtactcatgggccgtgaaattccttctagatcagcggctaggttcatttgaagttgatgctgtcaggcggcccgaatccgaatccaaaacgtgtaaaactttatctcttgttttctatgaaccaaaagtgacgtggtgagataaaagaagacttggacaaggtcttggattggtccccaatcaacttcttcaatcatccatgcattccttacgctcggtctcttttctttcacccaagcaagtacctctgcaaacaaaaacacacgaaactcattgtgcagcaacgtttgttcaactatataacaagtaaatctaatgtagaacatatgcacctttattttattaatacataaggtactcatggttatatctgagcaagttatgtcctcatcaggtttggcgtgaacgctccagatcattccctaatggcggttacggggcatttcggacatttccctttcgccaaccgtcatatctacccctatataaagacatcagtccctcacttcacacacacacttccaagcttgagctgaattataagaggctctattgtactatattgtatactagaataggaagagagtagagtaggagttggaagaattccggagttgtcgctaatcttctcctatttcttttattctgtttattactctgaattcaatataatattcttcttgagtaatttagatttatcttgtgagaattatctcttggttagttcctaaatagcatataggattattgttcactataattaactaaaatatagtgattgctttgatgagttataaacactaaagtagatattaattgcttagacgtggtgtttaggtaattgttatccagtaattgctgcgtatcccacagtacgtttgaggtgggtgtagaggtggtgacagccctcgagatcacttaagtcctccctgttcgagtacgtagtagagcgacatctggaaacagtgggttgccagtgcctgaagtattgcgttggaattgaagttaagctttccctagacactgtttctcactagtgaatcctctctatcctggcctatcctttgcttggtgtccttggatgaaccagaggaagatctgaccacacacgttcccttggattcgatacccttggaatactccgtaggggaagtgctacatcggtatatccgtgcgcttgcggattttatttgtgaccgtattaaataccaacaagcatttctggcgccgttgccggggaacggttgctgatcattttcgaacccagttcatcctttatcctttttcattttttattctaccttcacccctgctatcctagagaagtattcctgtcaaactcttctcgaccttggagcaacctctttttgagctatctgctcctcggggcgaattctacgagccacctccttcatcggagcccatttatacaactggctatgaaattcgtcccgaactaattagtatggttagggaaaatcctttttctggctttgatctagaaaatccctaccatcatctgcgagactttgaacaagtctgctcgtgccttaagattcgtggcatgagacaagaaactgtgcggtggaaattgttctcgttctctcttcaagagagagcaaagcaatggtatacctctaccgttggatgtgtaaacggtagctaggaaaagctgcaagacagattctgtcttgccttcttcccagttacttgtatcactgcccttcgagtagaaattctcagttttaagcagatcgaaaatgaatcaatcggtgcagcttggtccagattcactaatttagtgcagtccggaccaaccctgtccttacccgagtatgtgcttctccaacatttccatacgggtttggataaggagtctgcattctatctggacataactgctggaggatcattcatgcacaaaacgccgtcagaaggaaaaacgattttggatcgcattctagaaaatacttccttcatgatgcagtccaatgaaccccagctggaggcatccgtgtccaagatagaggaacttctaacaatcgagccacttgctgaaccatccacttctgctagctcgattgatgagaaggttcctgtgtagccgtccgtcgggaatgaagaaattcagactccggattgtaccgtaattatgttcagggacagttttgacgaagactacggcaataccctgaactattttagcaagaggaaaccacccgttcctttgtcacctcccgatcctatggaactcgggttcctgtgagaaactgtccgagttgacatccataatgagcaatgaatggctaagggaggtagagctttcatccgaagtaattcagataaatacggctccccgaatcattccatgccatctagaagggaacgatgtcggtattctctacagtccatctgtgggggccaacctcgtctctgagtcttttgcactcgcttatttaagcgataaggcagtgtccccgacaaacaaattcttcaagcatccgaacggaaatatcatcgaagggtttgggattgtgcaagatgtgcctgtctgctttgaagacatggaggcgatcttggatttccacgtctttgaaattcaagatttcgacattctaatcgggcttcccattgagcaacttcttattaacacaccccgattaggtagcctcaaaataacactgggagagaatgaannnnnnnnnnnnnnnnnnnnnnnnnnnnnnnnnnnnnnnnnnnnnnnnnnnnnnnnnnnnnnnnn

SEQ ID NO: 52273 - DNA, 832 bp, Oryza sativa
  unsure (1)..(832): unsure at all n locations
nnnnnnnnnnnnnnnnnnnnnnnnnnnnnnnnnnnnnntttccttgctcgggaaggcatgtttcgtgtttcctttagtttctatcccgagttggacgtggagaagggcctgtagagggcaagaccaacccctatttaagggacaaggccggttcattgtaaaaccccagaatacaatatacttgaatcgttcttttactatgttttctattttaccctagttttagttcatctttgtcggtttgcgccgtaaaccgtccgccaccgctgcgagagtgcgacacctctttgtaggtttgtcctgaaaaccttccgttttgcccacgagatgggtagttatcctctagccggtagctggtttagttgtttttctacaaaacccatcttgatttggccctttggctagatcgaggtggttagcgactccatatcaccgcaaggcgtttaggtgttgtgatcgtgcttatcaacttgtcaaaaaaaaattgccaacacgatttttggcgactccgctgggtaatcgatctattcggctttattatagccgaatattttgatctactgttcgcgctgtgatcttgcttgatcacgctcgggtgtcgtcgtcggtttagttttatggccgaattgttttgattcggcggaatttgtgatcaatagcaatagcaatcggattgtttctatacaagccgatctgctacacacggtataaaaaaaaatcaggctattaaagccgatttattactgcacacggtcatccagaggtacacgtgtgaataaggagcaaggcagtaatactcgtacaccctagcagtacacggctatttttaatt

SEQ ID NO: 52274 - DNA, 779 bp, Oryza sativa
  unsure (1)..(779): unsure at all n locations
ttttctttatctttgtccggtactgcttttacatggtttacttctttaccggcaaattctatttatacttgggctcaattagaacaaaaatttcatgattattttcacactaatgaaactgagcttaagttatttgatttaacatcggttaggcatgaatacaatgaatccgttgctaattatattgaagggtttagagatgttaaaaactgatgtttcaatttgaaaataactgacaaagatttagccaacattgcatatgatagattgcttgattctattaaagagaaattgaatggccagatatttcttgatgttgatcatgtgttgcatgaagctctagctcaggaaagccgagtggatgacaatagcttacaagctagtttagatgaaaatgcaatatcatgtgtagccaaaccaagcgatggttcggattgtgttaataatttgtgcaatgatgccataataagtatagctgaaccaaatgttggttcgaattgtcttactagcttggataataatgcaacaaccattatagccgaaccaagtgttggttcggattgtgttactagtttagacaacgatggaatagccgaaccaagtggtgattcggattgtgttgctagcttagagaataacatcattgaagatatagccgatctaaatgacggttcggattgtattacaagcaaagatgaaatagcattgtcannnnnnnnnnnnnnnnnnnnnnnnnnnnnnnnnnnnnnnnnnnnnnnnnnnnnnnnnnnnnnnnnnnn

SEQ ID NO: 52275 - DNA, 730 bp, Oryza sativa
ctatagggcgaattcagctcggtacccaggtgattgagcactctttacatgttaaggaagacgctaaacccatcaagcaacgactccgtcgttttgcataggacaggaaggatgcgatcaaggaggaattgaccaagctgttagcagcgggcttcattaaagaagtccttcatcccgactggctcgctaacccagtcctggttcggaagaagacggggcaatggcgcatgtgtgtcgattacaccgacctcaacaagtcctgtcccaaagatccttttgggttacctcgcattgaccaggtagttgactcaacggccggctgcgagctactcagttttttggattgctactcgggatatcatcagatccgactaaaagaatccgactgcttgaagacctcatttattacgccttttggggcctactgctacatcaccatgccctttggattgaagaatgtaggagcgacctatcaacgcatgattcagagatgtttttcaacttagatcgaccgcaatgttgaagcttatgttgatgatgtagtcgtcaagaccaagcagaaggatggtctgattgcggatttagaagaaacctttgcaagcattcgcgctttcaggatgaaactaaacccctgaaagtgcatcttcggagtaccgttagggaagctgcttggattcatggtgtctcatagaggcatacaggccaacccagagaaaatcaacgccatcct

SEQ ID NO: 52276 - DNA, 1444 bp, Oryza sativa
  unsure (1)..(1444): unsure at all n locations
nnnnnnnnnnnnnnnnnnnnnnnnnnnnnnnnnnnnnnnnnnnnnnnnnnnnnnnnnnnagtcacactgatcccaaacaaccctttgagcatgttgatcctatttaaagctattgtttctattcaactattgcatctattttcgaatgtcattgggtggaattgacctattctttgttatggcccttttgtacttgattaccttattccttgataccttgggttattacaatttgactagttgagctttatttatattggttcaactagatattagatataattgcttagccctgcttagaaacattagcacacattcgggataactaatgactcactaatatttcatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgattagctcctggtttggaatggtatattcctggtttggagatagaactgtgcagccggggtggttgttcagaatggttgggcctatacaacagggtatgttgtatagcgttggattaatattgtttaattacttaactgttttatcaaattctcaaatgtttgctaaatgctgcttttgcaaatgcaaccctactatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatnnnnnnnnnnnnnnnnnnnnnnnnnnnnnnnnnnnnnnnnnnnnnnnnnnnnnnn

SEQ ID NO: 52277 - DNA, 1994 bp, Oryza sativa
  unsure (1)..(1994): unsure at all n locations
nnnnnnnnnnnnnnnnnnnnnnnnnnnnnnnnnnnnnnnnnnnnnnnnnnnnnnnnnnnnnnnnnnnatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttagaattttggatagaaattccgggcgtgacatccataaatgcctaaggcccgatgatcggcgatgaagaagtcctaaggattcaatcagctgaagattcatgcccacccattttagtcaagtggtgggatgacgacaagcaacctcagggaatcgtgataaacagacaaaaagaagatgaggaagtatgcttgctgaaaaaggcactcagccaagccactcgcattgtaaatgtaagtttccttatccgcagccgcaactatcctgcttcctattttgatcaaatgccgataaattcgtattgcagagaatccatctcnnnnnnnnnnnnnnnnnnnnnnnnnnnnnnnnnnnnntaattttggaactctcgaggccactaggaaccagctgcacgaggtcaaggagctcgccagaaaaactgagctgatttgagggatcgagttgctgagctccaggagtccaactttgaactactaggttcatcaaaaggtaagtaccacctctgtctaacttactcatgttgccatccctgtcatatctattaatcaggaaacaatacagtacaagctgccaggatttctgaattagagaagcagatccaaagacagagttgaattggcaaagcagagagactcggctctgaaagatgttgaaggtactagtgattaattcctcatgtctttacgcccacttgctgatataagtatatttgtgcagatcgcaaaatcaagtcccaagcccaatttgacgtcctggtgaacaaaatcaagaggcttgagggagctagagatgaggttgccaacgttgctacaccactcattcaggctatgttcttcaataacaatggtccgagtgcattcgatgcttccgaaatcttcgacaagctaagagttgctccggatacatactttaagaacatcaagaaagctgggagtatgggagcgagtctggcgttggcaatgaccaagtctttgtatccgaagattgatgtcgatgccattgatggattcgcagatgggacgagcgaagaagccgcctttgacctcatcaatgatgcgcagaaagctgccgagaagatagccgttgatgtagttgatagattccaggataacgacctccggccgactggttctaataactccgatgatgaaaaaactgacaccgattgatgttatattgtagcagtgattctgatgatgatggaggcacaatttgtataatattgatgaatttatgctgtgcttgatattccaaacttagctcctgatttcttaaaagtttttatcaaaccttgttgagcctaaaacccgcaaaagttattaaaaaactttcagtcctcattgactaagccaaaaaaatcaaacaaggcaatgataaatcgagtaagcaaattgaattgataaaaatcacactccgttattattatagtagcccccaactgataactcaaggaaaggcttgatgttagaagtcaaagaggaaaatacaaaagtaatgcctaagcataaaaacgacgaagatgttcaatattccaagagttgtcgatatgagtactgtcctcacgtttgagtcgataagaacctggccgagtgacttcagatataactaacggtcgggtaccgagctcgaattcgccctatag

SEQ ID NO: 52278 - DNA, 1806 bp, Oryza sativa
atctttgaatactccgcctgtgaattgggtgccgttatcagtgatgatccgattgggtaccctgaaccggtgtacaatgttgatgaagaaatctctagccttgtctgtcgtaattgtaatgaccggtttagcttcgatccacttggaaaatttgtcaacagccacaaagtggtgagtataaccgccgactgcctttttgaacgggccgaccatgtcaagcccccaaaccgcaaacggccaagacaacgggatggtttgcaactcctgagatggtaaatgagtttgtcgggcaaaaaattgacaaccctcgcatgttcgcacaattttgtcggcgtcggatacagctgtaggccagaaaaaaaccctgccgataagccttgccaatgatggttcgtgcggcagcgtgattgccacaaatgcctgaatgtatatcctttaacaattgtcttccctcctccaaagacacacagcgttgcaggattcctgatggacttttcttgtacagctcggtctcatgtatgacataaagtctgttgcgcctggagatccgctcggctttgtctttatcctgagggagttcttgcgtggtcaaaaatcttatgaggggctctctccagtcggcttcaaccatgcttacatcttgggtgtccgcggcctcgattatttctttccttggtacagtcggctcataaagatgttcgacgaatacgtcagaagaagctgcttctcgctttgaaccaaaatgagccaatctgtcggctgcctcgttgttgtgctgaagaacatgagtgagctcaagtccgtcgaatttgtcttccaatttgcgtaccttctgccgataagcagtcatattatcatcaaggcaggaccactctttcatgacttgattaacaaccaactgagaattccacggacgatcagacgccgaatgcccaaagagatcgcgatccttaatccatgaagcagcgcctcatactctgccacattatgggacgcagaaaaatgtatccacaatacgtagctcaatctttctccagtcagggagatcaaaacaaccccagctccagtgcctgaaagcctcttcgacccatcaaaatgcatggtccaatactccatcttctcctcgggcatgtcttcttggcactcggtccacttggcgacaaagtcggctaaagcttgggacttaatcgaagttcgtggcttgaaggatatatccagggacatcaattctaaggcccactttgcgattcgtccatttgcttcgcgattacgaagtatatccccgagtgggaacgatgtgaccaccgtgaccgagtgaccttggaagtagtgagataatttcctaacggtaattaagataccatataataacttttgaacctgaggatatcttgtcttggagtcggccaaaacctcgctaacgaagtagattggtcgttggactttttgaacatggccttcttcttcatgctcaacaaccaggaccgtgctcacaacctgagaagtcgctgacacgtataacaatagtggctcttgcagatatggtgaggccaaaattggtggagtagtgagaagtttcttgaagtcttcaaaggctttttgtgcttcgggtccccactggaaattgtcggttttcttcagcagcttgaaaaagggcatcccccgctcgccgagtcgtgaaacgaatcggctgagcaccgccatgcaaccagtcagcttttggacatctttctgggggctcggcggtttcatgttgaggatggcgttgattttctctgggttggcctgtatgcctctatgagacac

SEQ ID NO: 52279 - DNA, 1088 bp, Oryza sativa
gggcgaatcgagctccgtaccctgataggtcgctcctacattcttcaatccaaagggcatggtgatgtagcagtaggccccaaaaggcgtaataaatgaggtcttcaagcagtcggattcttttagtcggatctgatgatatcccgagtagcaatccaaaaaactgagtagctcgcagccggccgttgagtcaactacctggtcaatgcgaggtaacccaaaaggatctttgggacaggacttgttgaggtcggtgtaatcgacacacatgcgccattgccccgtcttcttccgaaccaggactgggttagcgagccagtcgggatgaaggacttctttaatgaagcccgctgctaacagcttggtcaattcctccttgatcgcatccttcctgtcctatgcaaaacggcggagtcgttgcttgatgggtttagcgtcttccttaacatgtaaagagtgctcaatcacctctctaggaataccaggcatatcagatggtttccacgcaaagatatctttattattttgaagaaaggtgatgagcgtgctttcctatttacaatctaactcagcgcctattacaacagtcttagtaggatcagagggatctaaaggaatctttttggtcttggcgtcgctttctccactcttgggcatcttggtcgcgggcacttctccttcgcctactgtggacgcagccagtcggatttcttctcgggagagcgcgatctcacgggtctgggccatctcgcaactttccttatcacatgtgacggcttgcttgatgtcgctccgaagggatatgactccttgaggacccgacatcttcatcatcatgtaggtatagtacggaacgaccatgaacttggctagcgccgggcgtccgagtatggcatgatacgccgtctcgaaatcagcaaccttgaaacatatgttttccgtgcggtagttttcccgagtgccaaaagtaaccggaagagtgatctagccgagtggtgtagcagatagccctgggatgctccgtgaaagggcgcgttactcggctttagttcctctcgagggatctgcatgtcgtccagggtcttggc

SEQ ID NO: 52280 - DNA, 2092 bp, Oryza sativa
gcgcaaagacggcggcggcaaccaggacgagggcggcagtggcaagagcgcaggcgtgtggtggctatggctggctgtagcgctctcctttttccttttcttttttcttttttttatatataaaaagactaaaaggagatctaacggcccacgtcgtttcaatccctgggacttcgttcgtactccgattgaaagtgtcaattaggcctagaggggggtgaataggctaattcaaaaatcaactaaaagcggaagcagtaattttcggatatttccgaaattttcggatatatccgaaaattttcagagtcagcacaaacaggaaagtaaatcctagatctagttgcctacaacaagaatatgctagcacaaacagcaactagacctatagcggctcaaacaagcaaagctagaggagagggaggaagtaaagtcaccaaagatgaagctcacgaggttgttcccgaagttcgaatccttgaggggattctactctccgttgaggagctcactaagagccgggtcttggctaaccctttcctcaagaggttgcactaagcactcctctttccactaaggctatctcttccctttcggaggtgagatccgaccttcacaaacttcccccggccaaccacaagtagatcggtggctcgggagcgacacctagccgcctaggagtcctcaacctccaagagtaacaaatgaagtaaagaactcccggagatgatgcaagtgctcacaaatcttcacgaagtcaacaagaagcactcacacaaactcgaatccacaactctcacacacacacacaccaaatccaaatcgaacacgggtaagaggggaaacaagaaagcaaggctcaaaagtactaaagagagagagcaagccaagggcacaaatgattggaatggaaccagcagccctcacaagtgaggggagggggctatttatagccacagcccagattctgcccgttatgcacaataattgagattttcggatattccgaaagattttcggacatgtccgaaaattccagctcagcaccaacagcaaagtcaacgaaggatttttcggacattccgaaaacttttcggacaagtccgaaaattttcagtaccaacaacatcgttctggatgttctcggaaaagtccgaaaataactttcggacaagtccgaaaatatacagaagaaaaattgactctactgatgattttcagaaaatccgaaaatcagtttcggacaagtccgaaaatatacagaaccacttttgccttcgcagtttttttcgaaaagtccgaaaatcactttcggacatatccgaaaatttccagaagcgacaatttggttctgtgtgttttcggaaagtccgaaattgagtttcggaaaactccgaaaaaatccagaacacaccaaactgaggagaaacaccttttaaaaatagattttgagcactttgatcactcctcgtatgtcaatgcatcattcctcttaatagtgcggctttcctattaactcaaggaaacgaaaacgtacaaaatatcattttctcatttgccgcatcacatcacatcaacgtattccacgggatatgcattacgctaactctttgaggacatgacaaccttcacatttgcttaaataaaaatgttagtcctctctaatcgcattgtaattaatcaccaaaatcattaggggcctagatgcactttcaatctcaccctttttggtgattgatgacaatacgattagaacacaagagagaatgaatataatttaaggtttttggtgcaaagttttagtggaagctccccctaagagtgtgcataaaagcaagtggagagctccccctaaattattgcatccacattgaagctcacaagagaataaatatatcacatatgctcatcacatccaacacatcacatgcaaatgaataattacatctcatcacaagcaccatataaagaggataagatattgcaccacattaaagataataggatccattacatcacaagcattcataattaaacaatagacttacaaagctttaaacttaacataaaaaacacaaaaaatatcatacag

SEQ ID NO: 52281 - DNA, 1042 bp, Oryza sativa
cagcaacataagaatctctgagcatcttgctctgctctccatttgttttttatctgttcagatgcaaccagagtgcagaaggggtggcgcagaaggtctggaacttctccaaatgcaggggcatgtgtagttaccgtttatacaggtaagccatgtgaagaacatgcatgccatggtagattataattttaaggttagatacttagatttgatccttttaatttggtagaaagaagaattgggagatgctggcagagatactggatcatgctgtcaatacgttgggttacacttccgtccataaattgttgaacaagggttcatatgtggtggctgttgcagagatgttgacatcaacccctctagaggtgaagtccaaatgatattttcttcacaagtaacacaaccttctggattgtatatttatttttttagaacacgcaggagatctgtgtatcatttcattaagatagagggaaaatgattgcatatttaaaggcattgccaagtccaaagaaacaaatcataatatctagttggtggattatttgtcacttctactaaattaattatagatacatccaatttgttaaaagcagtgtatcctgtagatatatatttgtagtcaaaagatgcaacaagctctctttcgcatgttgtttattcataaagcccatagcatcgttgcaaacttgcattgccgcttgctttttttatcatatatagtctattaatctttctcttgggaagtatcaaaggtgtaaacttaaaattttacttattttattgtttgccccaaagaagaaatagaaccaattaatttataagctatgctaggcatgaaaacattacattgtgtagttcttttcgaaaaggagcatcatcttcttttagaatgatttaagacctgaccaattaaggagatacaaaaatagaaatcacatgtagattggttgctgtcacatttaatgatagaaataagttagataaatccagttcttttgaaagcacttcaatcctatagatgccaatagaaataata

SEQ ID NO: 52282 - DNA, 2165 bp, Oryza sativa
ccttgagcacaatctacaaattctttttagagcaacgataagatatacttgaatactcaacaggtgttcatcccaaaaggaaaattcatggcaaactaggtcagtagttcaatgttcaaaaagagtacatattcagaaaaatatttgtaaggtgacaaacaatgagcaaatggttactgaaagcttacttttaacatcctgccgtataagcgacatcagtgctttatgaacagcatcacgctccacattttcctctaaaatacatgcagaactcagaagaatgcaaatgtgtaccatttgatccaaattaaaaatagcaaaatgattgtaccacttgcaaggagttgtccaaggatatcggcaatttttgagacaaattctgcatctttggcaagaagtggaaaaccacgaatagcttgtattctagtctgcaagaacatttaaggaggagttaatcatgcagaattaatggaacctgagacacataatgcatccatattgatctaaagaaaactgaagacgtaatgatgatattctaacaaatgtagtttatttctgaagaagagctcttgcttgcctttacacatgagaaacaaccattaagtgacaaaagactcttaagtatcaagtaaccagggacaagcatgagaaaaaaccattaacggacaaaggactgcattactcagttcatttgttcagcataaatacattaagtcatatatgaatatcagaaagcaaatgggcatcaaaattggtaggaacagtctaattttctatatgagaaccgaaaacaaaatgcaccagatacatatttcctagttaccacatatcaaatagtttctttcaaaaataaaggtacagtttcagttagatagaatactccaagaaaaaaatattataatatttttccacaatgtgcatttcgattgtagggtctatttggcttgtagccactttcaacccaactacctttattggtagggtagcaattgttacaggttaccaagatttggtatttccagaagttcacagtctcaaaatctctactaagatatggtacggcttcaaaccaaacataatcccaacactgccaaaatttggttcgtgcaacaaaccaaacaagcccttagtagcaacaacgcatggataagataataagagctagagaagaaataattgaaggctgggaagagtgaccttgtctcttctttctctgagtttgttcatgaaatgatgatgttcaacatgaagaaataaatgatagatgaaatcccagtcaacgcatattgtttgcacatattagggaaaaaagcttcgttggcaaacaaaagaaaatgatgcgcctaagcaaggggcagaaaatgtggcacgattttgccaaaaactcagtggaccaagcaagttacctaaacaggaaagacctgaattccagaccttaaacatataaaagctctagcaattcaggaattttgttttaaacgaatggttaaattagcaaataatgcaagtgactcgttctgtaattctgtaaagctaaactaggtcgtacacgagcagcattatctggattctcgaaaagggagagtgcataccgcgagttcctccatgtcgacgaggtcgaacatggcctccatggcgcgcggggcgagtgccgggaagctccggaagaagcgggggatgagctgcgccgcgagctgcttcggcttcacgctcttgccctttacgggccgtatgatcgcctcgtagtcccccgcgtgctgcgatgcgaaagcccgcccccgaagcaaaccgaaaccccgtcaaacccttagccgcggcggccggggcccgtagcgccaattgaacaagccgccgaggggggaaccgaagcgccccttggaccttgtctttgccgaagaaaagcccctccccaagttgttaaacccgctcgacttcccggggttgggcttcgaagccgcccatgccgccggggaaccggtttggaaaatttgggggggttagggtttgggaagggaagggaaggaaagcggccggtaaaagatggctggctcacctacgcaacgcaacacgagaaaccagtgaactcaagaggcaggtgggtcccggtgctcagtgtgttattatcattcgggaagcctcacgtaccttctggcgtgtggattact

SEQ ID NO: 52283 - DNA, 893 bp, Oryza sativa
  unsure (1)..(893): unsure at all n locations
cagatcgcttgatctctcagttctatatttctgctgacaactacatgaccatatctacatgttgctcaatgttttgattttctgtgagctaattaaagttatgagttcttatagcttaagtactgaaagtttacaaattcaccaatagatgtaaggtttgtctgagtttagtgtctgaccttgacccttgcagtgtgtgtaaacaatatactcatgttaccttttaaggttacgatttattctctacaaattcatactaaattcatattatacaagttcatacttaacaattgatttggatttctaggtatttataaaatccagattattttgtgaacatgaacatggaatgtatctaaattctgcgtgtggacacagccttgccatgtttctcaagtatgaatatatccttgcacacactgtttcccccctatttttacttttcttaaatatatattatacaaatgtgcttttgattaggtaacttttctctctgttgttgtagctatcaagttgctttcttgtgtgcttttgatgaagtcgcagacttttatcggtcccagcttatcacaagtgaaactcgacatggcatagttgttgccacggcattggaggttgataaagcttcaagtaagtcgtattttcatgtttcgatcaattcactgtcttttacttgctgtcattatcaaacacgaaagacatttatgtttcagattgcctatccaccatagctgcaactacaataatgtttttgcacaatcgtgactaccagcggtatgctttgttggaaggtacaacatctcaatattttgctattacttttgaannnnnnnnnnnnnnnnnnnnnnnnnnnnnnnnnnnnnnnnnnnnnnnnnnnnnnnnnnnnnnnnnnn

SEQ ID NO: 52284 - DNA, 983 bp, Oryza sativa
atgcaccaattttttttttgtcaagactaacacatgtcggatgaattttatgtctataattttacaggatgacaaatggcattccttgaagggtttgaatctagtattttcctatatcgtcatagcggtgtgctttttcgtcatgaaagctctcccaagtaagcacgctgcacattaatacataatcatgcctgaccatttaatctaatgcattcatgtaaataaatttctgcatattacagaagttaagtaaaacaaggatttgatctaaccgagatagaaaaataagcatatatactaatctacagaaaattaatcacattttgtggaagatattggctgatttttatctatgtaaatagagtaacatccttaaataacttatgactcctttgtttatctacttggtgacacagcgctaaaaaaggaagatgactaaatgtgttgttttgaaccgaatcaagagaccgatgagacgatgcatgcatgtgagttgaagactgtagctagatcggtgagctcctgatcaagctgttcatcatcatgacgggttcagctaattaatcagcaacaacagcagtgaatatatggtaggttcatctgaagcgacgggaacaagattactgatagatgttttgattgctttggtgttttcaggtgattagtgtagatttgggaaatgatcttgaggtattcgtaggatggtgtttttagtgtaaaccatttattgggtcaatgcgttatcttctttattaacgaaaggaggcagagcttctgcctttattttaacaaacaagatcacagtagccttggttcttttgcctatcctagtgtggtcgagcgacagtctgacttgaggaaaacaactttttcttcagcacttattttagtttcattttatccgtgctatgcactttttttttcttagagaagggtatcctctacatacaaccggatatatatagtatttttaaattagaaac

SEQ ID NO: 52285 - DNA, 761 bp, Oryza sativa
tcatctccacaaggtcaaaaagggtttggggaaactagctggtgcgatgttcaagagcccaaagaaagagagtgatgatgaagcctcgcaatgtgtgacgcctcacccaaatataaaaccacttggagaaaaaagggtgtcagtaagatacgtcgtcgatgaagatccttctgaaaacttgccagatgaccagcattccagtcctgagagaggcgagtcggaaagtccgaccaagaggcatttgaggaagaaggctgtgcacatggtgaaacatgcggggaacaaaacagctcataatctgaagaacatgttcagcaggaaaggcagtgacaagagcaaagaaggccaagatgaccagaaagacgatcctgatactatagtagtagaaccttcaaaagttaagaaagacaatcctgatgcaagtgaggtagacatagacccttcacaagttgagaacgacatccccgattcaacggcaattgaccctttgaaggttgattctaatgtggccaacaacattgtggttgatgcactagagtatgcatctgaatctgatgcgaaggacaaaccacagtgaaatgtgttctgctatttttggcggtcctcgtgctgttgggactgttcatgtaggcaggatactaggtagcaaaatagtctgatagcctcctgacagcaagcgaaggttgacagtatagtccgtttggttggttgagtcctccatcttacctgacgaccgatgtttttcttgtattatagatgct

SEQ ID NO: 52286 - DNA, 1992 bp, Oryza sativa
  unsure (1)..(1992): unsure at all n locations
aacgaacatgtgcaagagagtttgttgcatctttcgacttcatatatatccacatgatacattgcatttgaataaattggatgtatctatattttatttaatagaaatgacaaacaaccaacctaatggacattatgattttggatctttttgggcaaggcaatgcttttaaatatacaatccaagaaaagaataacttgtcttgttttgcagtgagcggtcaccatagctataatatgagacatgagccaaacataatgctgctcttgcaaaatgtataagaaaattccttgtgtgcctaagtcttcactccatccttctatacatgctcctgattctttctttattcctagataccaccgagtttacgtactaatcacctcaactcattttgttactattcgatttttacaaaatatctatattgcacctcgctcaaacatatctagcttcatataaatattgaggttaaaacctttataaaaaaaatgaatgacacaaaattgtttgacccaaaatttgaaattcaatttcgaaattttcaaatgtattgaaacaaaatttgatgaaatttcaatacataaattacacaaaccaccatttttctatttctcctcttcttcgacaccaaaacaaatactccctccgtcccaaaatatagcaacctagtatcgaatacacaacctaatagtactataaatctggacaggacaggaggtttgtccatatttgtagtacaagtttatgttcgatccagtactagattgctatattttgggacagagggagtatctttttaatcaacttcaaccaaattggaaaaaatttccatggagataagtgaatctactctccaaaaaaatcaccaaatttgattgaaactcatttcaaattataatttttatatttcaaatttggggtcatataattatatccccttctatttttttagaactgaaacaattttcaccttgagaatgatgctttttatgaagcaactcacccaatgtgtatagaggggattagaaaaaatctagggcatgcaagacaagacaaagctcaatggcatggaaaggatggagcaaagactcaggggaacataaggaattttctaaggtatagcttggtgatcactacaacaaaagtatacattcatgatggctcaactaaaatggtcgttgatcattgagtaccaacagcaataccaaacaaaaactaccgctaataatttgactcatgacacaaaaggcaagcacattttttagactggagcatgtcaccaaaggtcctcacttatgagtcgaggtacaggatcaaggaacacggaatgctatttttgaaaggttttaaaacaaggctgggatgggacgatgatctgaggacaagcaacacggcataattccatgttttggctgacttttgactcatactccctccgtcccataatataagggattttggagggatatgatatatcctagtactacgaatctggacagggagcctgtttagattcatagtactagaatatgtcacatccctccaaaattccttatattttgggacagagggagtactgcactaataaacccacctacttttctttggagatcatattagcccaaacaatgtgatagctcaagaagagcaatttatcaaatttggagattcaattaataaatattggagtttaaggacctagcatgaacagggcaagttcgtgatccggctaataaactgaaaggatttcaaaaggtaaatttgatagtgaagtaacgccttcatacgtccaccaaatgcacgcagattatagtatctgcttcttagttcttaagaacaaaatttggaacaaactggcagaacttttgtaggtactagctaaatgttcgtgctttgctacgctaaaagaaaatatatcataatatnnnnnnnnnnnnnnnnnnnnnnnnnnnnnnnnnnnnnnnnnnnnnnnnnnnnnnnnnnnnnnnnnnn

SEQ ID NO: 52287 - DNA, 2098 bp, Oryza sativa
actaataaacccacctacttttctttggagatcatattaacccaaacaatgggatagctcaagaagagcaatttatcaaatttggagattcaattaataaatattggagtttaagggcctagcatgaacagggcaagttcgtgatccggctaataaactgaaaggatttcaaaaggtaaatttgatagtgaagtaacgccttcatacgtccaccaaatgcacgcagattatagtatctgcttcttagttcttaagaacaaaatttggaacaaactggcagaacttttgtaggtactagctaaatgttcgtgctttgctacgctaaaagaaaatatatcataatatttccaaaataaataaaagcatatctttcatgaagtatattgccaccttttttatagagaatactcacttccgtttaattttatatgtagctaaccatttagatttagatgttatgtgatcttaagaagttcaaggggtaatatgtaaaactacaatggaaataggtggggtggcagatacaccgccaccaccattggagtccttttaaatgagtatagatatcagcgattttctatcaagttgctcttccgaaagtgatgcagctataatctaaaaacaaaactggtggttactggtggcttactagaaatggaaacaaacagttttatgagttcacgatgaacattcacaagaaattacttgcaagcatgtgtcacatggttctaacaatcctaacaattgaagaggaaatttcaacatttcatagagtttgtcccttcatcttcttgctatttattctcttctttataattagacttgactggtttcctggatgatggccttgcattagaaccaaagctacctcaaaatcaaacagctatcttttctcgtttggaccacttgcagaactttccagattgttttttttgttgggtgatgggttcatgacatcttcacttctaaacccaagctctgacatatcttgctttgccatcaggtttctggaacaaagatatttttcccaaagatataatacacaagaatagcatgtcttgaatttataatggaaacagcagcattaaacctacaactgaaaaacaaactcttcaatgtttcgacttgtgagcctgaataggtaggttggaatatcgaagttcttaagcactcttaacacagcaagaatttcaggtattaatagaactgtttgatttctcttaaagttggctactacaagcatcaaaatatcccccacaagaccttttgcctcgaaataaagagaaaccttcaagacatggaaaacagattgagctaaccattgtatggtaagagtaagtcatggatctgaaattaatatgtcaaagtatcacctctccatcctacattccaggtacttcttcgagaacttcagacatttttcggtttacaatccagttgatttaacgcacgcaacataatctgtcttctcctgttagaacgagcagttgtcacatgacaagttatgacaccaaaaaaatcggggcaaaaaaggtgtgcaaacttaccaagtcacactcgtgcaagtgatccagtgggaacactcccttttcgggaggcacaggcctcacgccccgatttccaccaaacgcaccgcctgcgagagcccacaaagttattccgaacttcacattagcatcacttaacttgggagattaagcaggaaacagtcagtacacgaatggattaatggaacccataagttcttcacggttgtgacatacatccagagcaaatcaatgtagaaaaaaaatattaatagaggacaaattcaggatcagcacacctgcactcatttccaatggtgatactttctcagtgctcaaaccgccccaccagaacttcccagatgagtagcaaccaaggggggaaatgcggattcagttgaaaccctaaacttttgtggggaacaagcaaactgttacttgtattaaggttaaggctctgaaattaagagaagagcttcttccagatctagaagagaagctagggttaacgcaaagcaaattccagacaagaagtacttttcccggttggagagagagagagagatgaatca

SEQ ID NO: 52288 - DNA, 2221 bp, Oryza sativa
cgttggaactggtcatcttgtaaaaaagtcctcgattaacttgataattactcttacgtccctcaccctatgttcctgtgttttgtactctttcgtaacagccctcaatgtcttggtatatactatgtgaaggagacaaaattctagatataggaccgcgctctgaaaaaagggaaataagtgtgttttctgcaaaagagaacatccctatcctatcctctccattcccctgaaaccctacacatcactgttctcccgccctttctcttcctttcccctgcccttgcaccgccgccgccttgccttacctccccggcttctcctcgccgacgacggctttcccctcacgctctcccgtaccctcctcctctcttggcgctccctccatcaccccccttccagtagagcaaggggatttagggactggatggcgcaacgttggatttgggtgcggtgatggagtttcgccggcgacggccttcccctcgcgctcttacatgtcctgcccatctcttgccgcaccctcaagcactatccgcccgttttcatcgccacccgttgcagcagttaccctgttttgtgttgggctccacggagctgtgacgacggtagcttcggccaggaagcgacccatggaccaatggtgggagcatttggcaaggacacactcactcaagaaccagacattggcctgcgatgggaaacaagctcgaggatgccaggttcggtcgccattgaggtggttcccctttttatatgcttttcttcagtttttactcgctttgcctaccgtgagatagtcttgatctggttttttcctctatgtcagatggctacagacttgatccttccactctcacagccgtcaacaacatcggggcgattcgttttgctgcctggtgggctattgtatactgctgtctgcttgctgctgaatgaagcagctagcaaatattgttccaaactaaaagttgtagtggtttggtgtgatgaggaagccagaaaattaatggttaggattcagtggcctttcattttatctttatataggaattcattcccctaaatcttgcctttatatattgattttaattatgcagattttctgtacaattggcactggacattctttctgtatccaattggcactggacattctttctgtatccagattcattgaagcatgtaatatttcatctttgtaccatgcttctatttaagaggtgtgcagactctctctgtttcgttagaatatgccaaccatcatgtttattttgcaattacctacggcactagatgaagcacttatatgtaaatattactgcagagtgtttatcattttgcttaggttgcttcttaaaatctagcgcaggtgattggaagaaggtttagctgatcttggatatgttaggattattagaagctaaatgtttccttgattttacttaaagtagctgtttgccgcttgattttagcgattaaagtttctggtctgaaagaagttagggtgtgtttggttggtgggatatacccggataggacatggccaccgctttttggagggtgtttgggagtgggatagggcggcccagaggagaatatttcctccagatgctggatagagggatccggttgatttggccggatgcaaccgcccgaggctcgggcgagccgggcaagcgagttgcgtaactcgcgtcacccctcaccaccacgacgcgagcgaggcgacgagcgcggtggtcgccgagaggggcgacgagcttcgccgcccggcgtgggcgacgagagggggcgatgagctcggcggccggcgagagaggcgacgagcgcggcggccgccgagagaggcgacgagctcggcggccggtgcgggcaacgagcgcggtggccggcgagagaggcgacgagcttggcggctggcgcgggcgacgagtgtggcgggcggcgagagaggtgacgagctcggcagctggcgcgggtgacgagagaggaaggcggcggcgggaggaggcgagcctcggtggtgggaggaggcggccggcggcgggaggaagccggcgggaggaggctgctagcggcgtcggcgagcccagatctggcactgcttttttttcttttttcttttttctttttcttttttctatgtgtatttataatggaatgtgtatttataatggagtgtgtatttataatggaatgtgtattatgtattaatttg

SEQ ID NO: 52289 - DNA, 723 bp, Oryza sativa
cccttgcttttttctgaaaacaatgtagtctattcatctttgtcttgggaagtattaaaaagttaataacaatatattttttttgtctatcacttcttcttttgcaaagagaagtacaactgattggttttttataagctattctagttaacatcacgtagtgtttggaatgttttaagaccttaccaaccaaaagtatccacaaataaaaataacatgtactccctccgtcccataatataagggatttcgggatggggcgcacactggtgcgtgtgtgtttttccacatgaaccactagtttctgggttcttccccttgcttccgaaaccgtcacaccaaacaccattattttatatggaacacattaaattccttcctagaaaagggaacccaaaactgaataaatacgccaacggagctagccatggggagcataagtttcatttgccatgtgagtgcccgtgagtttttccctttctacaattcatcttccatagaaactgtggtggatggatctcaagaggagagatgaaggagctgaagaaagctttgtcaaaccactgcaacttaaggtgaaggattaccctttacttggagtccatatctcggaatgccagatctatgacctagagaaccacatgatctgttaccaggtgagcaatctctttagcttctatggttcactatggatctgtttggtggtttttattccattcaata

SEQ ID NO: 52290 - DNA, 1640 bp, Oryza sativa
  unsure (1)..(1640): unsure at all n locations
tgcctcgcactgtcgcacatagtgacatcgcatagagaaacacgaggctatgctgggtaaacgtgggggtgcaccaaaagtcaaggctgtcaggcagggagggagctacataagccaggcgcagcatggaccaaggtgatttccaggtgggccatagagcgttaggaccaatggcacacacgcacccaaccacatgcccacggtgaaccacacaaaggatccaaggcatcacaggatgaactataaacaccacctaattaaaccgacaaaccaaacgtgatatattcatcttattaatcacataggtaatatgttctgtgtagcaacacgaaagacacatgctaaattttggtggcagcatgccacagaattactgggcaaattcctatcgccagcagaaaatgatgtgatattttttgttacagaaaactaatctgctattgcctcttttttttctggaaaatgaatctccatatcgaatctaccatgtgctctgagaagcaacataccatagtttttttaatggctatctaatttgaccatgcaaaaatctgcataattcaaggtaagaacagagagaacagataagagctgcagttacaacaggctgtgtatgtggaggaatgatataattcaaggtccaaatattagcaggatctcaaggtctaaatattagcaggatccaggatcactaagtagaaataaacacactcgcagtttctgtttacagtggcgccataccagattctggataggaattttcctaccaatatatcacccctgtcctaagcacatatccagttatacatgcatgcttaataggaaactaatctggatagaatctttcctaccaatatcacctctgtcctaagcacatatccagttagacatgcttgcttaatagagaactaatctgcatattgagtgttatttttttgctgtagtaaataaatctgcatattgcatttaccatctgttctgagaagcgacatcattcataggcacaaatggatggggatctaggacagaagccctgatgtacttgtctagaacactaacttctttcaaaaaccagagtcagtattgtgattttttttatcaaacagtcaacatgcttgtatagaacactaagggtgtgtttggttcctggtcaagattggatgggatacggtggtccatattttgctggatatggcggtccagttttttgtttggttgtagggacaaaggtggatttggtgatccaattttttgtttggttggaggaagtatggtggatttgtaggtgtggtcacctctcacttgagatggtgaatataccccatcaaattaatacataatacacattccattataaatacacactccattataaatacacattccattataaatacacatagaaaaaagaaaaagaaaaaagaaaaaagaaaaaaaagcagtgccagatctgggctcgccgacgccgctagcagcctcctcccgccggcttcctcccgccggcggcccgcttctgccaccaccgaggctcgccttctcccgccgccgcctttctttctcgtcacccgcgccagctgccgagctcgtcacctttctcgcccgccgccacactcgtngccccgcgccagccgcaagctcgt

SEQ ID NO: 52291 - DNA, 1121 bp, Oryza sativa
tacattgatgtgccacataagctacagtacatcaggaatgagaggagtgcatcaaaatactttagaccatgatggatatttcgaaagtgcaaatgaggggtggccggtctgtaaaaacagttttctcctaaaagatcgacattggtcaagcgaccttaatctaaaaaataatttcaaaggtacttcagaatggtcaaagctcagttctgcgatagacattgtcatagacatttggatgcatgtgtcatggaagtgcttatactattaatatgaacatgtattttggtttttttttaaaaaaaaaaaactggcacatgattgtcaattttgcctaaccatagcaaaataggtgtgtgaagtttaaacatagcgaactatgactttatcaacccactcaaatcatgctccttatgaaaagttctagatgagaaaaattttaggtttgggagtgtctagattgaaatttttagtcgtttttctacccacttggatgtcaatccaatggttctcatcactcccactatcattctttcttaggtatatataaatatattgtttgtaggaaactaggaatcatggcatggatcaatgaggaggcactttctaagccaagtgatcaagtcaaggtgcaaacttatcacgaagggtatgtattctagctcttcttcctccgaacatacaagcataacttaaaatggaatcttattgaggagtacttttatatttactgaacttgggttgtagtctttcagaactcattcgaagtgtttttgcggcctgcaatcctaatcggccaataacacatacgctttctggccaaactcctctacccttactctcataaataggtaaccataatcctttaacgttcacattaaaaccccaaatttatgatattgatctagcgtcctttccatgttctcttgcatatttctttcattgtcttgtaggagctaaccttcatatgaggtcaatgtaccaaggaaaggttgataacaatcaaaatcgaaaggatggagtaacgattgcgtgagtgctagtcctcagaattaattggccagaccatcaaacattgttcctcattgattggtagtaattaattgtctagacattgtggaatg

SEQ ID NO: 52292 - DNA, 1088 bp, Oryza sativa
tagggtttgtctttttttgaaacagagggagtacatgactagggtactaggcatgttatatttgaaaacaaactatgtacttggtttctattttttttcttcttttacctctctctatccctgcacctggccttcatctgagcatatgtataacttatggttaagtgaacatgtatatgcttatgtggcattctaattacgtagaggagtagaattacgtagaggagtagacgttagtaagatcagccatgcatggtttgttgttttagccttcgtttacacaaactacgaatgttcctacatggaaattggcatcttataagtttaggttataaaaaaaatactctttttttaaaattgacaatattgcacccacttcacaggttcgtataccactaatataatatattctttttttaaaaaaaacctgtatcaaagtttgcacaaatcttaaagtaccatctgggcaaacttgtactcctgcttcatatcataagttgtttagttttttcctagtcaaatttctttaggttttcccaagtttctagaataatatagtagtatttttaatataaaacaaacatattatcgaaaatatttaatttcaattttaatgaaactaacttagtgttgtgcattttgctaatttttttttgtcaaacctaaataattttaaataggaaaaaaaatcaaacgacttataatatgaaacggagggagcaccttgtatagcagtctataggccatccagactatcttgacatatgtccgtagcccagctctctcctcgcttatctctgatccttctcctacctgctgcccccaggtaatgtgtctgcacattctttgtgtgtgtacatgaagtttgagaggcgttttgctcaagaccgcgcaacgattccatatgacaccgcatcgttgtccatgcctatcatgttcatccagagcccctgttgatcttcagataagagaaaagctcaaaattaaagaaggcttgtttattgatcatgtcaaggataggtatcgacggcgatgcgctggctatggccatggttgtgcggttcttgcgcaataacgttttgatctcg

SEQ ID NO: 52293 - DNA, 1189 bp, Oryza sativa
ttattagggtgtccaaactaggagatgataataattgttttttggttaaaggtggttgtgccttatattttggaatggagggagtactgagttattattatattttaaaaccgacggacgctgtaaaggcatgcacgcagcagctcttccagactcctgaccctccgctatgaaagggggcaacaaccaaaatcttaaatatcttgatgtggtcattgacgacaaagacagtacaggtgaaagggcatctaaccacgtaaaatagtattggtttgacaggaattgtgtgctggaagggcttcagtgttggtttctgctaaatttgtgtggtctctctttatttttctaccgcaacaaatccaaaatgcccaaaatgtgttggaagctgagtggcttggttgtacctatagctagtacttaaaacgtccatatatatgccggcccacagtttggaagtatttgatgtatatatctgatcatgttcaatcgtgtgtttattgtgtatgagagtgggtgtagcttcttaaacgtacccaaaacctaaatgttcacatgcatgatataatctaccatctccgtttcagtttataagactttctagtattgtccacattcatatagatgttaatgaatctagacacacatatattactagattcattaacatatatatggatatgggcaatgctagaaagtcttataatataaaacggatgaagtaattttttgcaactcctgtccaacttgactcttgtttgtcaacgaatgcatgtcctgataaaaaccaatgccaagttttttctttttttgaaaaaaataagcaaacaaatgatcggtagcttgctaattcgtcgatgcacatcttatgaattagatacacacgcatgtaaaagtaactataattagcttatcctgctgcaaactaaacaaaggattaaatttcggttcactatcgtagctctcatcacctcgccgaccgcacaacttgcattgcttacttacgttcagcctctcagctgtatgtttaactaatagcgtttagtcactaactgctcacaatttttagcaaaaccacccccgccatatatattgcatcctagctgtaacatatagccaaagaattgttccctcggttctaaaatatgcttcctctattttataatatatgacgtcattaattttttgataa

SEQ ID NO: 52294 - DNA, 3803 bp, Oryza sativa
agtaattaattctagtatcactaattatgctcatattccttccatctttttgaggaaaaaaaactgaagcaactaattaatattatgtttttttcttaagaaaccgtactaccgtgtctgtttcatattataagttaatttgactttagtttttaatcaaatttctttaagtttgatcaagtttatataaagaaatataatacaataatttgaacttaaaacaaacgtattatgaaaatatattacattttggttttagtgaaactatttagtgttaaagaaaccatccatatcttgctaatgcgacttattccagatgactcatctctaacaattcaaaaggtagtattacgtttaagatatgactaccagggatgactcgtcaccgatataaggtcatctttgacagattgtaattctaacacatcacggataacctataacggatcacaaccatgtcccgtcatggataatatgtcatccgtcatccgtgacggatgtaatgagatgacccgtcaaagatgagagcactcatccatgacgggtcttaattactacccttcacacagataatgttatccgtgaagggtgatagttacgaaccgtcatggataacgaaaaattcaatcttttgaaattttcaaataatctcacattgagacatatcctatatgaaagttgtagatctcaatgagatatgtaacttcaaaactgacaatatttgaacttgagatagtttacatgtccgaatattttataagtggtgagatctattttgaaaaatgtgattttaatttttcaaatgatctcggatggagacatggcctatgtaaaagtcaaagtgtttgatgagatctacaactttctaattgacaatattttcatgtaagattgttttcatccccgaattttgttataggtgatgtgctctatttccaaaatattttttgaatttgtcaaatgacctttggaccatggatggagacataccctaaactaaagttgtagagctcgatgagatctgcaattttgtagttgaaagcattctcatttgaaatcatctagagtttcatatttgaacatgaatagttaaaacaataacatgtgatcacctatatggtctataggtgaagctgttagaatggtttgtatgtgttgagagatcttagtttcaaaatcacatatggcatgcatgcacatatcacttgaagaatcataaacttctatctagtgacgtatgtgtgaccatggtttgaatatgctagtaatatttagaatttagaatatttttagggcttcttgatgcacttaaaataaaaaaaaatggatgactctcatcccattgaaaattaaaaaatgtgaatatcctaatatttagaatatttttagggttttttatgcatttaaaattaaaaaaaaaagtatattctcatccatgaaggttcataactaaaaatagtgagattagagacttcattttgccgctttgtcttccatatccgcgcatacctttgaaagtcaatagcatcatatttttttcattaaaaaaaagcattttagaaagctttccttgttttgtaaaaactcacagcgtatacatgtcttatcgtgtttaattacacctatggtacaactttgcaagtcggtgtgatatagtgcgagaacttaagaattgaatgtctaagtgtaacaacttaacaagtgggtgcgctctagtacaagaacttaacaatttaacaatttagtattttggtatatcaacttgactaagtatatgctaggtaagttatttttatgatgccaatatgccattacatagaaatcctacggatattaccttataatattaaatttaatcttgaagaattatactgcacataaaatttacatccaattacctttaagaattttttgttttctttatcttttcaaatatcaaccgaaatataataatttctacatccattttaattgactttcaattattagttattatgataaaaatataattactgcttatacaaatccacattagtatattgtcaaaaggttgaatctatataaaaagggctccaaataattaagttgtcgcataaatcataccaaccttgcaagttattgttattgtatttatacgatcacttataaagtttttatactaaattgcacttacctgccaagttattgtattagaacgcacatttctcaagttcttgcaccaaattgtacccacatactaagttgatacaccttgggtgcaatttactctaaaacgctggacacatcacgttaagaagcggtgaacaggtctttttttattattattctagtgaagaggtgtcttttgaatgtaagtggacatgaatttggtatttactacttcctccatctcattttaagtacacttatgggtttctagtccaaagtttgaccgtccgtcttatttaaaaaaaataaaaataagtcacaaacatatatacccctaaatatcacaaatatatataaacattaacccctcctctcccctcccaatctctccctgcacctcctctctcttcgcatctcccttccctagcggcgctgcctctcccctccccgctccccggtgccagattgaggcggcaatggcggattgagcagcggaggtggtggattgaggcagcgtcgccggatcgagcagcggacgcgacagattgaacggtggtggtagcggatcgaggtggcggcggcatcaggatcggggccatcttcttctccccgacctagctcctcgccatcttcgccattggcatcagaggtagttggccgcaaggtcccggggctacgacacgggacaacgcctctcccccaacgcagtttctcgccagttcctcgccaaaacctgacgaaactatttgatgctctgcaaggggtcgtggtactatgtgagggagcggtcccggccgagctggcgcaaatatacccctagggaggagtaaaaccacgctccagcgtggagcgttggccatggccgtattcgcacttcgtgggcacacctccagtaactagctgtccatgactccatctccatgttcagctggcacgtggcagtggcaaggaaaaagtacaatctgactcccttaaatatacgtcgaatctaatttgtatccctaatccacgaaaccagatatgacgactcctccaactattaaaaccgtctaaaacgactccctcagctattttaagagtggttttcgctgacgtggcatccacgtggcagtccactcatcagacaaattaaaaataaacatggggcccacatgtaagtcacaagagaaaaaaataaaaattgtgggccggcgatcagcagcatgatgagggagaggggcgggtggcggagtccagagcatcggcggcagtggtgaagaggcagttgtcccccctgggggcggcggaaacggattccccgggcaacggcagtgccgacggagggcaccgggcggtggaggagagccgatggggtccggtggcgtggtgggcggcagcggcccaccagatcggcatagggccctcctgcggcggcggccaagaagaggctggccggtggtggaaagacggtcggcggggaggtcgtcgaggtgagctcacggaggatgaccggcgcacaggcaaaggacgggccctggtcggcgacatcgtcccctccggtctccggcgagagggcgagaggccatcctcctggagacgacggggacgaaaaagcccagcgccgacgcgagcagacggcgcactgcgttgccgaggggacggcgcgtggtggggca

SEQ ID NO: 52295 - DNA, 1192 bp, Oryza sativa
  unsure (1)..(1192): unsure at all n locations
nnnnnnnnnnnnnnnnnnnnnnnnnnnnnnnnnnnnnnnnnnnnnnnnnnnnnnnnnnnnnnnnnnncatatgggtcccactgatatttttttaattctaatgccacataagtgccacgtgggactaagactaggtcaacaccaccacgttagcaaaaccaccctccaaaaccgctgggagagtcaaattgtactggtttcaataagccggggagtcatcctatccaattttctggttgaggggtacgaattaggttcggcctacttttttaagggagtcaaagtgaactttttcccagtggcaatgatgaaattgcaatagttgggcccgtaacctttttatagctgggcctttataacttttttaggccattagtaggaaggccgttcatggtccaccgatgccggagcttccgtgggaaaagtctattttattttccttaactgcagatcgagtttctcactttcctcaaccacaaaatcagttatagagcatcttttaaaactcaaaaccagtataaatgaaatccctcagcgtactacctttttgtccaatattatgtctacatagtgtgttgacttgatcttcgttcttggttaacacctacttcctccgttctacaatgtaagacttcatagcatttcttaaatttatatagatgttaataaatctagagacaaatgcaaagtatatatattgatcattggatgaatcggtgagtccaaaatgtcttacaatatgaaacgtagagtacttgtcatcataattgagggatgtgaagtggactttttctgcttcagtgtgcccaataacttgggcctttgagtccacgacgttgagagatcgacatttgtcagttgcaagtaagcaagttcgtcaagctgtttaatgatggaggcatgaattaagcataataacatatgatatgacaacggatcattaggcatgtgatgtccgtaagtgatttattccttttggtatttgctatttgcctatttgacaccagtgtgttttcttgttggtttgcactcaaaatttagaccgtccaatctggtatcaagatttgtgctgttatgttattgggcccgcaaccagcccatgtccggacccgttttcagggagaaaaccgacccgaacctgaggttcttctcgtaccatctactccctccgtcctaaaatataaaaagtttt

SEQ ID NO: 52296 - DNA, 1274 bp, Oryza sativa
  unsure (1)..(1274): unsure at all n locations
tataagttaatgaatctagacatattgtgcctagattcattaacatatatatgaatgtgggcaatgctagaaggtcttataacctgaaacggaggtagtacttgttagtgaatgtcatcttatcttatgctttttttttcactacatttgcatgatctgcagagagggggatcgagcagcaagttcctcaactatttcgttaagcaaattgttccagtttttgacaaggtaatcttctttatcttgtacattggtccctgtgctttgttggaaaaaacagtaaatgcttctttttaattatattatgcatggcagctctacaacccttgttttgttgtcatacataatgtaacattttgcagtttgcacaccattttttttttgaaacatttggttacattccttacttgtgataaagaaacagctcttgcaatcatgcacatttctgcattctgcactaacattgcatggtaaaaaaaagtctgtcgtatttttttgtgaactatggatattctaatngnatngccatcattttggcaatcagactccccaccatgccttgaacttgtttatcttcaaaacaaagtgaattcgcatcttagagcatgaaggttttctagagcatgaaggttttctagagcattaaggttttcccctcttttttacctgttttagattcctgaagagaagaaactggatttgctcaaaacagttgctgcaagctcaccatatgctacagcacaagatgcacggcagctgcttccccctgttgttcaattgctcaaggtctgtgcaattcctgtctgataggtgtccaatccccctttgttaatgttttattttgtcccctagaagacattgttagatggtttcccctccaccgcggtgttacacaataaatgtcgtgtcttaccattgcatttacgttttcttttacagaaatatatgcctgggaagaaggtggaagatatcaaccataattatgttgagtgcctgatgtacatttttcaccatttagcccataaggtttgatgacagaatgtttatcatctattatgaaccatgtcttttcttcatggatggccttgtgctgaccaaatgaaatacagacaccaaacaccacaaacagcctatgtggttacaagattgttactggacaaccatcggatagacttggagaggatttctcagaacattacaaagactttacggnnnnnnnnnnnnnnnnnnnnnnnnnnnnnnnnnnnnnnnnnnnnnnnnnnnnnnnnnnnnnn

SEQ ID NO: 52297 - DNA, 706 bp, Oryza sativa
catattttgtcagttgcaggttcaaactgactggcatgctcgcacctcccaagatttggacctgcattctaagcagatcttctagggtagtgtgtgtttttcgcgtcaacacatttttggcacgtccagtgggacacaagttttgcacccaacatgtttgaagaggaagtcaatgctaagaaaaaacaatttactatgtcgatggttgaaacacttcaagctacagtcgatgaagtagttcatcgtgcattgttcgaacaatctggagtttgggtggatatattgcaaaatttgatcaaaatgacggttgatgagttaattgtttaaaggcgccagctcggggggcaaacatatcagtatcagcagtatgttagctgacaagtgcagggagatcgatgtttttttttataaaaatcttctttcagggtagatcgatgttgatctagaccaataagcagattttgttttaaaattctcatccaatcaactcttttttctcctttcacccatctattcttttttcttttcattcttggttcatgcttaaaattggtttcacgcgtgagaaacgatttcatcttttgcccctctgcattaactctcttgtcacctaactttttgcttatgttgcattatatttaacactatgcaaactagctgaggtggatgtttgaaactgtccttagaattagtttatacaaatata

SEQ ID NO: 52298 - DNA, 982 bp, Oryza sativa
aagatccttcaaattgataagagtacgcacttttgcttgagtaacagcctacggagttccaattccaagttatgtcatcagagttttgagaaaattggaaatcttgaagcaaccctcccaaccgcacaaggtcatggatctcctcgatcatcgtaaattgtctgaaggaaactagccagttgcttgaagacatttccggttgaacacttctttgctttcgttttgccaattgaaaacaaaggggggcaacatctttaggacaacttccatgcagccaatgatcttgccagaaactagtttttgctccatcgccaattacaatcgtagttgctgcttgaaacaaccgtttgtcaatatcatcgcatggtagattcatgccggcctagggtttatcaacccctttccatttgagccacagctagcggagacgaagagctctagagaatctttccaaatcagggaggcccaaccctcccaaggattttggtctgcacactgtctgccagtttaccagacaacttccaggattcaaatgatcagggtcctcttccttccaaagaaacaatctctgaaatcgatcaatcctcttaaacacccgtttcggtacttggagggccgaaagatggtggattggcattgaactaagaactatttttaccagagtctctcgccctgaagatgagaaaaaacgtcctttccaagttgggaggcgcgcctaattttttcaattaggggaagaaaatcgattttcctcaattttcggaagtggagaggtaaaccaagataacgacaagggaaggccataactatacccgggaatatctggagcaatggagttaaatcaacttcgtcacaccttatgagataaatttctatcttgccaatatttggatggaggactgacacttgtgcaaagaggattaaaatcttggagagagtgctaagctctggcccatctggctttgttaacacgggaacatta

SEQ ID NO: 52299 - DNA, 1461 bp, Oryza sativa
  unsure (1)..(1461): unsure at all n locations
acagagcagcgattagcgcgtgattaattaagtatttgctatttttttcaaaaatggattaatatgatttttttaagcaactttcgtatagaatttttttgtaaaatacgcaccgtttagtagtttgaaaagcgtgcgcgtggaaaatgagtgagggaagttgggaacctttggtatagaacgcagcctagggatgatataggaatggtgtcaatagttgtaattatcattgtgaacaacagaacaactgcattttctactgcaggtaggcaaacatttctttgggttgccagatagggaaaaacctacacagtaatggcattgtccacttagctgcaatttgggatcatttacccatattttaattctgtctaaaatttatactctgtttctttttgtttctttttaccagtatgttttctctgttttgaattaaaatttcagaatctttgaaatgtaggtactgtggagtttgacaaataaaaacacattaaacaagattgttatttttcttgtttttggacacggtgcaccatttcaaacttactgattaaatccatcttctcataacacttatttgggcgagcattaaattgcaggacagttcagatagcagtagcagtgaagatgatgctacagacaaatcagttataggatttgccagtgcaatggtctggttgatagggatggccgtaatcactgctatagttgctagttatgttgttactacaatagaggtatatttgggaagatgatgaacatttataaacatggtagtcattttcttttcatcacccaaatttcaattggattgactactgtaccaatctctattaacaggaagcatcagaatcaatgggtatccctgtcaggttcattagtattatcctactacctattgttggaaatgcagcagagcatgcaggcgctatcatatttgccttcaagaacaaaatcgtaaggacgtatccaatgtttctactagtcaagtttgtacatattatgtgagttcagattacccaagttaactggtagatgttatgtaggatatcagtctgggaattactcttggatcagcaactcaaatatcgatgcttgtggtgcgtaattaatagtagtgttcttcgactttgaaggactttctggtatgattatctttagatttttcatgagtgtatttattctacatgattaggtaccagtcattctaattgtgtcctgggtgaatgccatccctatggatcttgacttcaaccttcttgagactggatcattggcaatggcagtaatcaccaccgcatttacacttcaggtaataaaaataattgctaacagatgcaccaattttttttttgtcaagactaacacatgtcggatgaattttatgtctataannnnnnnnnnnnnnnnnnnnnnnnnnnnnnnnnnnnnnnnnnnnnnnnnnnnnnnnnnnnnnnnnnn

SEQ ID NO: 52300 - DNA, 845 bp, Oryza sativa
ttgtttttaccaaaaaccaacaacacaagccactccctgcagcgatgaaaagacagcaagtagaacagtagattctttgagcgatctgccacattggtcgatccgcaactagacccaacaccattacaccaggcgacaaacaccacctgacaccttgtgtccaacctactgcagacggccgctgcagccactgggttaccatcatcactctgcccgtgccgctccatccatcctagagaaagagagatggagagagaaaagagaagtcgagtggaagcagaggatggtgccgtttggaggaactgcggaattcaaagatgggtatttgagcatagcctcacttgcccatgtgcctcaacattagccaaggctgctatgaacactagcggatgattggtggagatgtggactgttgagcatagattggtaagtatttatagaaaaaccaagcagaagtaagattgataattgtgcacggtgaaaagagtaagagagatgcctggggtgtcttgtgaagctcacaagccaaaatgtgtaaacaaaggctgggtgtgagaaaacatgacaggctacctagatacattagttcaaagtccagtatgagcctacatacccaatttcatgagaaaaaaacatttcttcttgcatttatcgagaactgtttatgaaggtcatatgtagagcataagataaacaacagtatgggtaatgcccactaaacatcactgctaaaatcatttaagaaaaaagaagggcataatgcgcagttaaggatgacaggtgacatgttatccaactaacggagccattgtttcgcttattcgcgggataagcaaaacggcata

SEQ ID NO: 52301 - DNA, 838 bp, Oryza sativa
  unsure (1)..(838): unsure at all n locations
gctcggtacccctctcccaaaccaaatcaagaacagaccagacatacaccaagaaaactgaagtactgaacgaacccccaagaatcaagcagcagctacaagggcacaaacctagccgggcaaccgccggcgggcgtcgagcagcgaggaggaggaggcggatctgcgcctcagcgcctcctccgccggtgagtcgcgccgccttcgatccccctgtccccgcctgcttggagccgtgcgcccacgctaccggcgcgccgcctcgtcgtcattaccccggctgccgtggtgccacccgccgcgcccacgtgtcggtgcctgtgatgcaagcgctaaggccggagagcgagattgggagctaactagaggaggcggaaaccctagaggaggaggagaacggaaaccctaggaggaggagaggagaggaatgaggagaagggcttacccttctcgccggaggaggagtcccgacggtggcgggtctcgccgaagaaggaggcgcggcggcgcccgctgttgttcgcacgagagagaagggactcctgttgcgcgagcgagaagcagcggcggattgagagaggaaaaattcccgacctccgaaggtcggggtcctttccctagggtttccccgcggattgggccgggaaatccctgcctcgtgggcttccaaatggacatggaataaaacccgtgacaatttcccccgtgggcctttctcccagggaatgggctgggatcccagtgggatcctgggctgccaaaggagccctaagggtnnnnnnnnnnnnnnnnnnnnnnnnnnnnnnnnnnnnnnnnnnnnnnnnnnnnnnnnnnnnnn

SEQ ID NO: 52302 - DNA, 1052 bp, Oryza sativa
  unsure (1)..(1052): unsure at all n locations
acagtcttacagtctttaattacttgattgtttcctctaatatggaatttattttattatagctggtgggattatgaatgcaacatgtgggaatgtacctgaattaatcattgcactgttcgctctgcataagaataagatggaaattctcaagtggtcactgttaggttccatcttatcaaatttgttacttgttcttggttcatcactcctctttggagggatcgttaatatcggcaaggagcgtccactagataaggtaagtgtaaaagtgcacatacaggcagtaactataacatatgtaaccgtgttaactttttgtgatcgatctattttaacagagacaagcagatgtaagcataggccttctgttgttgggtgttctttgtcatattgctaccctagtgtctaaatacacaagtagcaccggagatagcataaactcaagctcagttatgcaattatcaagatcatgcgctatagtaatgctaattgcttactttggaagcctcatgttccagttgaaaactcatcgtcaaatatttgagcttgaagaggtacaaaacttacttcactaagtcaagatgctgagtcgatttcacttacttcactaagggctcctttggatgcagggggatgaaacccccgggaaaaagtcccgtacagggattttcccctgcaccaaccaatccccttccaccaccaggggaatcactcctgttagggaaattttccctgctaccatttgagagtagggagagggggttgatgggggaagggggatttagagaggcaaactgctaaacagtgtttgaacaacaaaacatgtctatatgaaatattatagaaatttcaggaaaaatagaaagtatatagaaaatccatataaataggaaacaacctacaaaaattccagaaaaaatataaaaacataaaaaaatcaacaagtattagaaattcagaaaaatacaaagaaatatagnnnnnnnnnnnnnnnnnnnnnnnnnnnnnnnnnnnnnnnnnnnnnnnnnnnnnnnnnnnnnnnnnnnnnn

SEQ ID NO: 52303 - DNA, 1868 bp, Oryza sativa
  unsure (1)..(1868): unsure at all n locations
nnnnnnnnnnnnnnnnnnnnnnnnnnnnnnnnnnnnnnnnnnnnnnnnnnnnnnnnnnnnnnnnnnnctatgttcctccttccgtgttggatcagcactattgttagctgacttatccttgtctcagaatcttgtaacatcatattctacaagattgtttccaagttctttgtttggcaattagattgatactatgactttaaaaacaattacaacaactgatcatcgtttggatatgatgttcttttggcagaaatctgatcagcagaaatcaacaatgacaatgagggcctacaacaacatactagcaatggcgcaggtgatttctttattactttagtggaactgtgtgatatgtgaattgcaaaatgctatcgcatgtgagaataatgtggtgacacatatgagggtatttttgaaatcacaagaagcttccaaatgctctctgcttgggcttctcatggtggaccagttacaattttaaatgtataacaaaagaactattgaaaatactagcaaatagcagtgggagtttttttttcgttacagatctgcttttgagcatagtaccgaaatctgaccactgttagtcaagaccaaaaaaaaaactgtgaccagggcccggtctggtttggattaatagaaacaatgatagtgagaaaaactgggatgtttaaactttctggtacattttaattccgcttggagtcgaatcccttttacctgaggttatattgcatgtgtaggatgtgctgataagcaactgtgttgagattggcatgtgatttatttaaggaagttttcaatatgagcctttattttaatacaggcttggggtttaattcaaaattaatactctgaactgtctggctcactgtcaaaccatgtttgaatcagcgaaccgaggactgatttgagtgaatagttcacatgctggtttgagttttgcactatgcttttgaggcctgtgaaggaactgcaggactatcttaagtaaaagttaagtggccttttataattgcatgtacacaaccgaattcaactttggctaccaatctctacgaattaccttagatatatgaaaatgacgagtaggttgtgtcaaaaaattccattgtagttgtattaatttgtacaatggaaaagttgcatgtgttaatgtctaaaacacatcttattctactgctggaggaagcataagtacacggcaatgtatgaaatatactgcttgtgtatactaataatactaacctacctaaatgtttatgctttctaactaaacgtgatgaatgttcatttcagccgttgcgtgcgaaatcccctttatttattggtgacaagaaaatcactctctcatggatggagcagccaaagaaaccagcacctacaacaacagggttagatttctattacctaatattccatttccccctcagactttgcatttcattatagttaagtctgctttgtggatcttttagagggaagaggtcccagcctgctacaaatgggaacacccctgcgagcaagaaggggcggggagagggagcagcccggaatcaacttgtgaacagagcttttgaagggttatcccgtggtggtagagggagtggaagaggccggggcaggggaggccggggaagaggatggggctaccgctgagaatagttggaaatccctgcaatctgatgggagaatagatcagctttctgctttgatttgaggtacttctcaggagataagcttttctgtatgcagcaaaatgggattggtgatagcccgtgaaggcatgctcaattgctgaatgcatacagaaagctcatatgatggatgcttgagtatatcgatgattttttagaccctagtcg

SEQ ID NO: 52304 - DNA, 973 bp, Oryza sativa
  unsure (1)..(973): unsure at all n locations
cttcctccacctcattctctctcttctctatctcttcccctcttcctctcttcctccctagacgcgcagtgaatgttaagctcgagcgttgtcaccgtctccctctggtgcaacccctccctctcccttggccacgcacggctgtgatggtggccggtggtggttgctatgggcgactagttaggacttaggatgggccctcggtggatctgagtgatggaataggagaggtagccagtgagcgagagctcgccagcccatccgtggaggcgtggtggaggccaaaacggagcatcactgacccagcctcttcgcgtgctgcactgagcccataggtggcacgcttgcctgttcgcttccagtccgtgcgccttggcacactatgagccctgagttgggagagggaggagggaggaggagcggtgcaggtccttgccgtcatcgtctttgtcgccacagccgcatgacatggaggtcgaggcgaagggagaggaagaagatgaggcattggagtcacgcttcgcgggagagttgtcctgagttagcaaggagcttcaaggcggcggcggtgcagcgacgaggaggaagctcgggctgttgaatagttccacattggttgtggaaggctaaatgacctaatatataaacggggaagcccctcacctcataggctagcttttgaggtgagaaaggctctttacgatcctacaactggtatcaaagcctgactacttcaacatctctgacccgagagacactgtgtgaaggcctgatggaccgtgcatgtttgcgggcttgtatatctgagggaccgtggggatacgatgaaagggcagtgaatggttgagggacatcaatgttgtgaatgggggagattgttgaatagtcccacattggttgtggannnnnnnnnnnnnnnnnnnnnnnnnnnnnnnnnnnnnnnnnnnnnnnnnnnnnnnnnnnnnnnnnnnnn

SEQ ID NO: 52305 - DNA, 1016 bp, Oryza sativa
gattccgcatgttctgagattaacgggagctggaaatggaatcccgtgttgggatttgttgtggccggggtgagggcccgattttgggatgggtttgtggatggatggatggaggaggtgagtactacttccctccttgcgttgttctcctccgctgagctgcattggtgcgttcccgatcagagctagaatttcttgtctagttcttttttccactccctgtttggtaattggtgcgccatcaactgattttacttctcctcctccgtcgctgttgcacgataacttttacatttcatggaaaattgtagagtatttttgatggttttgattaaagcaagtagctggcaagccatcatctgtggatcatttttatccttaaattcccatcaattcatttatgatatgatgcatcgcatcaggacgcatcgcatcaagtatgacgtaggctgatgtttcagcttgataaaaaaaactggtcaacaatggagtctgtacctcaccttgattcagccaaagtggccaggtaggagtagatgccaaggaattttttcccccttcctgtgtgataattggtgatctgtggtctgctagcctacgtcagcaacagctttgcttgcaaatggtgaactcattgggatggtgggattggtgtggttaataaagtttttgtctatgatcacacagcttattctggattgcctgatgctgagtcgctgacactgaattcagggttcacagatcagtacatcttagtggaacagttgcacagcatggagtagttacgatggttgtttgtcgtgctttttacctttttctttattgggataacaaggccccctttttgaatgtgtggctttcctcagtcaaattttaacagcaaatatgaattgttttggtgcttaggagtagccgtgttcttctttttgaatacgccactgtggtgttcaaggaaaaaaaacgccatgctgctttctttaaagttaagattgtaaaccttttttttcaagaactca

SEQ ID NO: 52306 - DNA, 1348 bp, Oryza sativa
  unsure (1)..(1348): unsure at all n locations
nnnnnnnnnnnnnnnnnnnnnnnnnnnnnnnnnnnnnnnnnnnnnnnnnnnnnnnnnnnnnnnnnnnnnnnnnnntcttcaggtaatatgacagtagtccaggtttttagatgattcgcagcaaggagtgaaaataaattgatcagcactgcaacattgatctttttatgggttgtcgctttagctaccactctgcttatttgcaagctcgtgatattcatactttgaagtcctttcatatgatgctaatttcatattcattgggagcataacatggaataaattaatggtcaaagtatgttattgaacaccatgtaaaaaatatatcccttaaaaaatacatgccttcagtaataataggttcctttatatctctttcagtgcacccaattcttgagcttgagatgtgcaactaaacattttcagagtacagataagatagatatcaagtttgcattggctaactctttcatgaattatgtgtttgtggaaatggcaggtatggtttacaaccatacactgagagcacaaaacgataaatattatgtttgcaactttgcatgactagctggttcttgggttgggtatttttaaaatggactgtgttgtctatcacaaactctttgttttacctattaaccatacagatcatacatcttattaagttctattgcaagctgcctagctgtatgagaaaggaatatatggtcgttgcatgctagaaggatattcttttcttcatatatgaagtaagtgatatgggcctaacagtgacaattagagatgagatttctatcattcaagcaacatgctttggggttgttctccatttaagaaaattgaggttgtctataacttgggcagtgtaaatattgaagcatcaatgacagatatgcgcaatggaacaccaccatcagttttcttccgttgctttgtataccctataccatttctgaagatcactataataccaaaccaactgctaacattttctttatgaaacaggcaaccatgcggtcggtggaaaacaattagaggtacagtgtggagtggtttgcaatccagttagcaagcttatgcgcactcaagatgaaggaaggggatgatgcaatttggagcacctctttctgaccagatggactcaattttcacgggctcagaaactaatgaaaaattagttcatatgtatgttgtgcaggcaatagctgtctcttgaaaggttctcacagccttacagatcagtagatcacaatgggcaaggtcaagattggaaggaagtgagaacataacatgcatctgatgaaggaattgacagcaggatagactgagaataagccggtccttttct

SEQ ID NO: 52307 - DNA, 1337 bp, Oryza sativa
  unsure (1)..(1337): unsure at all n locations
nnnnnnnnnnnnnnnnnnnnnnnnnnnnnnnnnnnnnnnnnnnnnnnnnnnnnnnnnnnnnnnnnnncaaacacataattcatgaaagagttagccaatgcaaacttgatatctatcttatctgtactctgaaaatgtttagttgcacatctcaagctcaagaattgggtgcactgaaagagatataaaggaacctattattactgaaggcatgtattttttaagggatatattttttacatggtgttcaataacatactttgaccattaatttattccatgttatgctcccaatgaatatgaaattagcatcatatgaaaggacttcaaagtatgaatatcacgagcttgcaaataagcagagtggtagctaaagcgacaacccataaaaagatcaatgttgcagtgctgatcaatttattttcactccttgctgcgaatcatctaaaaacctggactactgtcatattacctgaagatgaattattgcgagctgaataacatggaaaattctggtatgcaatccaaaggtgtcaaacctgacatgaaaaaggaaaatgatcagatcaccagaggctcatcataccataccatcaatcttaagtcaaccaaactcatattatttgcaattgactgaaacctctgcatgaattcattattttcatctcttttccttatggctatcaagaaaccatcactacccattgcagtcccatttaaagtatttaacatttaagaaaacattcagtacagtaaaatggaagattgagatttgcatcttctgaataatagtgccaaatataaagcccttcctgctaccagttgtactaaaaaaaattgactgccaataaccaaaatgctaactactaaaaaaatcatccagtatgtgaagctcctaaatttttccttatgctactttgtaaaactatagtacagagtttctggcaagaaaattggttcccaggtcgtcaactcatgatggatcagcaagcaatatcactgcagtcttatatcttcaaactcccattttccagaaaaaaaaatatagtgtgttaggaactcatggagttgattttgtaagatgcagatgggcaacattcagccgtcatacagtaataaatcgaaagaaactaagatttatgttgttaaagaagataaccttggatgaatcctaattcaatcataacaaagccaagaatcataattcagtcttaatgaagccaagaatcctaattcccagtgtaccttggatatgagattgatgtcaatggaggtgcgagcaacagtcgacatagtagttgaccctagttccgaagcacgcactatattgccaaaaa

SEQ ID NO: 52308 - DNA, 1856 bp, Oryza sativa
  unsure (1)..(1856): unsure at all n locations
nnnnnnnnnnnnnnnnnnnnnnnnnnnnnnnnnnnnnnnnnnnnnnnnnnnnnnnnnnnnnnnnnnnnnnttcttcaaattgcagtgaaaattcatgcattattcattcaggggtaaattaccattgattcagagatggcgatcgttgccatttgttcattttagtctatgaatcattgtgttcattttaaactacaagaaccgcatgtggagggagtgaaggggcttgtgcttcagaataattttgatgtgtttcgtgttgaattgaatcttatttaaccctagcagtggcggatcgagcttggacttttgggggctacgaacaaacaaaacaagagaagagtttcatccagatgtagaagagaaggtagggttaatgcaagcaaatttgagacaaagtaggtgtgtgtgagagagatgaatcacagaatcagaaagaggatgtggatgctcaccaggatgcagcaggaccacggcgcccctcccctacccggctgtgctctgcttgccgctgacattcccaccagcttcggcttcttttttggccttggctccagctgcggccactctcacgtcgtcctcctgtggatggactccaacctcgccccgtagatcgttgcgagatgtttccttaacaatagattatatgtgctttctgccttatggagcagaaattataagccagcagacagcaagcaaatataccatgtcaagtaaataaatggatcagttaattgatatcattgacacattcaagaggaccaacttacagggttgtgcatctcttcacttaaaccaaaattttccagaatagaagcaaccaatgtggagaaatagtgtacagcataggagccaacccctacctgaacatcggaatactaatgatatgttatgtaaccagaactaattgcaatttcctgaagagtgtgccaacacaatttataccagaaagctgtgggcatatggaacttaccacagatccataaattgtgaggtaaaataaacttttccttcccattggtaacaatttcatcccctataacgaataataggtcacaccaacaatcaatttgatagaacacatttttccataagcaaaaaaaaaatcctagttaaaattgagtcactgaacgttccttatcaaaagaaaatggtattacttcttggtcttcccacacagtttagagttgcctcatggtgtattttacaacaaactaacaaaattacaacaaaaactatcttcgctaattagagcaagagatttctatgtttagactggaaaattctataaataaactcagagtgaggtgtttaataacaaaatacagtaagttaacttaacaatttcatatacttaataataagcttgatggaagttcccaataacaaaatgcagtcagttaacttaacaatgttgtctgctgataagtaatcaattagaccatcatgttatgtagaagactgtcaaaaaaacacagaaaaaaataataataggacattggaaccataaaagtttgaagatacaaacttacaaggggattatgaaacaacacaaatatgcgaaccatacgaaaatccaagtgttgcgctaaaaggaatatgtaaataaaaggactatacacgaaaagaagttcataccaagcacagagattaatcgaaacaaagtgggtacggtctagctattaagagatgttattcaggtaaaaatcatccatctgtatacttcgtaaaacgggaatacttatccttcaaccaaataggccgaaaccaccaaatacaaaacaaattttgagacattaccgaaatgcattggttttgaagtgaaaggaaagggcatgttactgcagatttattca

SEQ ID NO: 52309 - DNA, 2241 bp, Oryza sativa
cccatgatacacaagcgttacaaataaataatgatttacacagtacagcaagcagtgcaatggtttctacaaatataaccggattttaatttcataggcaaatgaaagacaagcataaattctacaatgtcagataattcaaattgtattgtcatgctccactaagtaatgattttaatggaagaatgttgaaaaaaaagtaataagatttctgccagaaaacataagtttcagttcagtacaaaccacccataccaagagaatagcaccagttttgaatgatccaagtgatagcatctcaattccctgtaagataaagagaatcagtaggtttatctccaagaagtttgggaggaaaacagaacatatttgtgaagctcttgaaccatagtcatttcaataatgcacattaaccttatatctcaagataagacaagagcatactgaatgcagaaagcaatccccaaaacattgtttgctagccaatgcttcttcgcagaataccatatgcaaaagaaaaatcctgggatcgatgtaacaacttgagacttggtaaactccactaagagcgctgaaataagaaattaatgaacttaaaaaggccaccaagatagcttgtaacatgattcataattgcagcaacaatctgacatatgatacacaattgcaccgatgattgagcattttaaaaaaaaagaagtttgggtcctacagacatacagtggaaaaaatgcagcacgctgaatgatgacattatcattccattcttttggaagaaatcatttcatggaaggcagcaatgttgcactgcatcagaaaaaagaagcacataaacaatcttaattgcccaaatacaatattacgtagttacatgaatggaaaagctactgtatcatccaacctgcaagcttttgtgtacatcattgatttattttcctaatgatctgcaacagcaacagtgaaaaaaatgattatagagatttggtgggggcaattagatgagatgaaggaaggggatattagatataaggatgtaccgtgaataatggcactactggaactcgccttcgatttagcacaacactaatgaggtaaattagaacatggacaaccagacaactaccctacccctgcatcagaaatatgaagctgcacagatgagcttttatctcagctgtcataagcagtgaagaaaatcaagcaaaacttgtaattgtaccaacgagtgagatggacagatggttgcacctcattaaaaataaaaaggcccaaacctcctgtcccacctgatgctggcctcctcctttgttccccatcacatcgctccagccgctgctgccatctctcccgcgcaacatggtcagaaatccggccaccctcactgcatgcaaaattgaagctcatcagaaatgactctgtgcaacaaagaacaaccaagcaactcctctgagcacggtcttgccacctcttaattatcagtgcatagtgatgtaaacacattcatgaaacaaaaaaaattatccacagccagagaaacaagcaacctttgatcgtgcgaacacgataaaggatcagtcattttgtgcagctccattatcctcatatactgtgaataatagaatccatacaaactgggatcgtgctgcatcagtaaagaatcggggatgagaggagatttcttcctgtaactcaccgagatggccactgggaagagccttggggatggggcttggacgccgccagccacctgcctcatgaccgctacgagcagttgtagcagctagtacacgaactgccaccatggttgcgcggccattgctgtcatcgattgaaccggcaattttttctctgttgtgaaagggatgaacaccgcggcaaagacaaggggaaggaggatctgagacccttagcctccctgttgtggccgattcgtccccttgtcatcgttgacaatggtggcaagctgctcaaggagagctcgattctgtgtccgctagatcaaccacaagcaaaagtcagtattgcttgagatcacaacacacaatcatcacagctgcacaccttggcccttggggcgaggcggcccatgagagtggcggtggcattgccggcattgttctcctcaatgaaactgattgtggagttcattatgagcagtgtgatgatgcccacgaagtcctgccagcccggcagcttccctgaaaacaccaaacaaatcaaccctcgtcaattcaatcaaac

SEQ ID NO: 52310 - DNA, 1124 bp, Oryza sativa
  unsure (1)..(1124): unsure at all n locations
nnnnnnnnnnnnnnnnnnnnnnnnnnnnnnnnnnnnnnnnnnnnnnnnnnnnnnnnnnnnnnnnnnnatgtcttcatcagtctaatacaaatacaaaccatcagccttggaaaataatacaaatcatcaaacatccttcatctacacgaacaaaagacagctcgatgccttgatctcttagttttgaattacagtaatcattacaagttagactgaaatgtaagtcaaaaaagcatcataggagagtttggattcatatgactgagttttgagttttaggtcaaaataaaatggagaaaaaactaccatattgactacggtattgcaaaaaatgcattcttaatacctattatcagcaagatacgtgatgggagccaccatgaaaagggctaagtgcatatgcaacatatatacttaatgcatgttccacgttccttggtaaaaatacctttcttgtgtttctgtttagtatctagctatctaccacctaaaagcgtccagaatacataatggacagaagaacaatgtcaatttaatttctagacaaaaaccaaggacaccaaaaaggatcttacaaatgtaaaacgtcgaggaactaatgtgaatgtgaagaatgtaactaataacatcaattatcaactttttccaaaattccaaacacgatataactgataaccaatttacttgatgccagccacacatcaagaccatgaccagttgatggtgttcatttgtgctacgaattatgtaataaaaccgtctcaaataatcaaatatgttaggctaaccagttggtgatgtgcccattaggtagttcactattaaaagtggttattcactgaatgaatgcttgtgcgtcttttggtgaatgggagtaatcatttttctcatcctgatgctagaaaaacagtggtttgaacttcatgcataattgtctgatgtggaggttggacaatttcaccttgaaggtttcctgaaacttcatatttcagagaacatatttctcaatgggaaaaaaaagaaagaggaaaaaggactgcattctgcactacgcgctcaaattagtaatattacaaaggttgttcaaacatacataaaagtatggtagcatgtcatgttaatgt

SEQ ID NO: 52311 - DNA, 1510 bp, Oryza sativa
  unsure (1)..(1510): unsure at all n locations
gttgttttaactttttagcagaaatcatgttaaacatcaaactagcatgaaaagcaatttgatatttttgcaacaactttttagttaaaaacaactcatccaaagtgcatgtgtgcaaagcaaaactacagcaagagaagatctatttttcaaatcatgtgcagcattaacatctctaatttttgaaatctcattcattaaaacctcacaattttcacaatcatcatcattaggaataagagattttaacctatcaatttcagatttaagagattcaatgataaattcctgttttctatacttcttctcacactttttattttttgcactcaaaatattaatagcttcctcaaaagcactcacctcattatcttcatactctatgtcagattcaccacgcgccatgaagcaaacatcggagacattcaccatctgcatcacttagtggctcgaagacggcgcaaacttgttgaaaagccttcctaagattctccatcttcccccttggtatgaaccctttgacttgttgttgttgggcttgttgttgttggtcttctcaccatctttgtcttctcttttgcctctcccaagcttaggacaatgcgaacgaagatgatcaattgaaccacattcaaatcctaaccctgcaggaactaatgggatgtcaaaagaaacgtcatctactgactcggctaacaaggagattcagccagagaagaccgtgccgcaggagtaccgcgacacacgattgctgccattcccttagcgtagtaggaaaccgtcagtggacgagtagttcgctcattttgttgaagtgatcgaaaagatccacatcaacgtgccgttgttggacgctatgcaagtgccaacatatgcccgttatctcaaggacatactcaacaacaagagaccgctcccaacaatggaggtggtcaagctggcggaacactacagcaacatcatactccacaagctcccggagaagaagaaagatccggggtgtcccacgatcacctgctcgatcggggcacaacaattcgaccagccttgtgcgaccttggagccagcgtcagcgtcatgcccaaagatgtctttgacaagctcaacttcatggtgttggcaccaacaccgatgcgcctccaactggctgattcgtctgtccgttacccggcagggatagcgaaggatgtgctagtcaaaatacgggatttcttcatcccagttgattttgtggtgttggacatggacacggggaaggagatgccgctcatcctggggcatccattccttagcaccgcaggagccaacattgatgtgagaacggggagtatccgtttccatatcaacgggaagtaggaaaagtttgagtttcaaccgaggacagaacaatgctccatgtccagaatcaggtacgggccgaacccgcaaaatattcaagtggtcgaagtggagccaccaaagacgnnnnnnnnnnnnnnnnnnnnnnnnnnnnnnnnnnnnnnnnnnnnnn

SEQ ID NO: 52312 - DNA, 2387 bp, Oryza sativa
gcatgaagttagagtggccggctcggaaaaaaccgtcttccgcactgaaatcaaagaaggtgtggagggaaaagccaaagacgcccgctccatcccctctagaagaaggctcctccagctgccgcgtccaggtgatcgcgggacattggggtgagcccattgtaaaagttctgcaggatcagccagtcgtccatcccataatgaggcaggcggccacgtactcctgcagtcgtacccatgtttacggaatggatcatcccttgtctgctggaaactggaaattcgtccacgaagggcattggttttgcccatcaggaagaacttcgagaggaatgtcgtagagtatttatcccaggtgttgatagcagcacgattggcatagaaccactgcttcactcacccgaggagggagaacggaaacagccgcagcctgacagcgttaggactgactccctttatgttgtacatactgcatatctccaggaattgctgcaaatgagcatgggcatcctcattagccttgccacagaacttcaagtcgaaatccacatctcctatgttgacttgcggcccgacgaccacattgtcagcagcgaactcgcgaagagtcttgttggccataatcttgaaggtcggtggcgctggtacggttggtttctctgtcggtagagttttctgctgagcaacgactcgcggcctaacgctccggaaaaaagcttctggattttctttgaagttttccggcaggttgaaaccagtcatgaactaccctgtttacacgacaaaaagtgaaaacaaccaaggttagcctgcaaatgaaaatgactatacagaggtaaatataaagtattagtttaagtaatctctattatgaatcttccccggcagcggcgcttgaaatgcttgttggtatttcttaacgacattactagaaatataattcgcagcaatggcgcagaaacacttctggtatagagttcatccgtaagcgcacggatataccattgtagcatttcacccgagagtattctaagggtatcgtatttattttatcccgtgggaagatcatgtagagagaactcaactaataatttatatattacttgtgataatgatattctaagcaggggtgataatccaagggtagagtgacacacaaacattagtactcatcctcataataaataatctaagctagatggaaagaaaagagaaagagaatctattcctatacttctaatatacatagtatatacatacattctagttaactgatatactagctaataccctctatccgatgccctcctggtacttcgagaatccacccctgactgccgagttccttacgacaacccgtcatgaccatccaaccggggctaaatacggaggaataccctccccaggaaattaacttaggattatatataggcgcggagttatacccgtattgagctatcaccatcagtggcccacctctcatccgcaatatataaccccaaataatgatatcccataatctagacaccacgtctaaactaccagatactactctaatatcatcgtcatgacatagagtaattgcataagcaaacactatacccgcaccagagcatcttccacataagctagcagtatattcagtataacatcaaacataatgtaaagtaggtactcgtatagtcggaaagtattccaataccataaatgtatatagaagagtattctaatgaaagtacaaagcttacaaaagaggaaaggaaagctactagagccatacccgaactctttcgaagacttccggactcctgattcctattctaattctattccaccagctagatactactaaactaaacttgagaggaatgagagagctcttgcttgagttgtgtgttgaagtgaagagagtgagctccttatatagaggtaggtatgacggttgtggaaggggaattgtccgtagtacactccaaccgtcataggggtgcaatcttggacgtacatgccaaaccctggcctcaatggtggagatgggggtttggcctaaccccctgggtcggccgaaccatgggctggcccaaaccagcccatctttggttggcgacttcctctattgcttcactttgtagacttgtgaattttagcccaattcatcgtgtcaattttgacttcttggcccattcatacataagtctatctctcgacatcgttcgattgatttatcgtctatgttgatgtaattctcctccactttattgtcattttctgcaaacggttagtagacctaataatagtggaatattattattctaacaaacaaatgcattgcaagcaccactactctcctctattttggtaatattgacggtcgaaactgattgata

SEQ ID NO: 52313 - DNA, 843 bp, Oryza sativa
tagtattggggtttcagccaatctttctgatttagctacattattccctacatgtttgctttatatgctaaatctgccctttatattaagatcctattgcgctaaagtatattaggcttattgtttggtatattttgcttgtcttaatatcttaatatagggtagtatcggagtattagccgatacatgttagatctatttgatcggctatgctatgagtgtacatataatcttcatcttgaagtacttttaagcataagtgatttatacaatctcgactgactgttcgatctatcccaatcacttggtttaaatatatttcgagaaagatattatatatcattgatatctatagccgatcgagtagatttaactttattttgctttatccttcatagccaatctaacaccaataacatcggctcaatgattaatgatatgtcaacggcccttagccaatcggctatcgtttatagatttaaccttatttttcttgttttcttttcttgttgattgcaggatcaaatcaactggcacgtctttgaacccgaaagtaagatttaggacctgcactagagttaagtagatatcccaggcaagtgtgtgttttttgcatcaacagttcatcatcggtcaccgttgtcgttttgtgccttgtctcgttgtggtgaggattcctccctcgctgcccctcctcggcctctcggtgttgccaccgtacacgtcgtgccactgtcaaccccggtaccagtgtaatggtgttggcagtcgttcgtgcagttttcgtgtgcacgtgtggtgaccgttctcgtgtgcccgctcgatagctgcgtggtgtccatg

SEQ ID NO: 52314 - DNA, 1564 bp, Oryza sativa
  unsure (1)..(1564): unsure at all n locations
nnnnnnnnnnnnnnnnnnnnnnnnnnnnnnnnntgccaagtcatcgtcactatggattttttgacgagggatacttcaactactttggatctgggaagtctaatctggccagagtatgcgccccgacaaggtcggaaccatcgtcatcaacaattcgatctcttgagatcgaccaagcctcaagataagcggcgtatcgaaagatgtcagaccgtatgatgtcgaacgagtacgcaacaaggtaattggtagattggttttttaaattaatctactaatttcgtaaatacatccggcatgtatctacaaaggtacgcaatattttatatgcaatttatcgtacctattcagatcatacaacattgtcagatctataatttattatgtttacctagagcatgttttttatacaatatctattgtgcgagtgcttccgatgttaggccaactacggtctaatgctggggactcgctctgttctcttctgtatgaatcatgcttgtctacgatatacataatgcctggtatttaatttgctcgttatatcctgataatactataagattcatgcagctttttgagtacatactcgatattatctgctatatatcttgtcttccagacgatatttttcaggaacaattgagcacgtgagtaggttgtggtcgagtacaccccattatcgagaacattctcgacaaatgcggagttgtcgcacccaacctaccaacgaagaccgacgacctatctcatagcgccaaccatggctgcgctattcgagaaaaggttgttaacggataaattctcgtgaacgttgtcagcttgatcacccgacatgattgcgagcggacatctggatatgctataagttgggtatgtgagtcatgctggccacatgagatgcagatgtaacaaaccaactttagcacccctataggtgattgagaggctcctactcctggttctcgaaccagtaggacgtagcgatctctcgcgccttaacttctgatggtcgaggtacgactacggcaatagcgtagcggtcctcgcaccacgacttcagatgacttcagatggttgaggaacagctacgactagtcttcgaccggcagcgtagcggtcctcataccacgactccaaatggtcgagagacacctactcactggttctcaaccagtcaatcgtagcgatctctcgtacatttacttctagtggtcgagttacgactactatctggtcctcgaccaccggtgtagcgattcgcccactacttccaccgggaatgctattaggcgagcgatcgccctcgctcgcccagggcgatcagttttgcgcacccccccttccctccctccacctctccaccttgtttccttttttggcaccgcattactttcctattttagtaaatttatacacctaaaagttacacatctaaaagttagagaccaaaaatttataagtcaaaagtttatatatccgattcaaatttgaatttgaattcaaatatttatatatatatatataggatttctatacatctaaaagttatacaccctaaaag

SEQ ID NO: 52315 - DNA, 2092 bp, Oryza sativa
ccttgtcggatcatgtagagacaaatgaccatgtaagacctggtcatgtaagagttctcgccgtgcgtattaaccaagccatgtaatcggaaattgagttttccaacttcacagcagggggctagggtatgtgctttttcaatcaacgcaagtcaagggtccaagagccttatcctcgagaacgattctccaacacaaggctgggggctagggagagtgtatgactcaacaaactgactgatcgaagtcggtaaaagagaagacgctcgtacataaaacattggtctgtaaatttaattcattttcagttttccatacatattataacatgtcaccctttgagcgttcgctcgggggctatttctatttaatattcttttctaagtattgatttcaggaaattctattggatattgtcgaaggctccatgtctctatggttctataccaagatcgactaaggcgagtacgacgaatgttgacaaggctcagtcgcagactctgcgccttctcgatcactcgagaacggttggtggatctcgacaaggaatacggaatgaagagatggtgtacccgccgagataaaatttcttgacttcaatccaaattctcaattacagcaagacgagagacttagttgtatgctctgtactttcttggttgacgtcggagattaactcagacaaaccctataggtgcctgcacgaggctgataagggaagtctaacgttatctctgaactcaccgagaacagtcacgtgagctcgataacagttattccaaggtctgcggattgagaatatgaactcgttcatttgcattgaagtcgggggctactgtcagggttatggataccacatacctaatagtagttggctaaatctcggcaggacccaccacataccatgtcttatacggaaacaaccttcggatataggaggagttccggataaggaaagacaactagagttctacatggaaacgacaaggactactcggattgtatccatattggttttcctagttctacttggacaaggggacacatatgagtataaatacaaggcccctaggaggagaggggacacggaacaatagatcaagacacaagatcaacatacaagccaacatacgccaagacaagacgccaccggatatcgacatcagagatatgcttggactgaccctatccagtacctacagaggacgactgtagggatctagcgctgtctttgatctcctcgggcacgggttcgaggaggaagactaccctgttgtcgactacgtgatgatacttactccgctatgtcaacaatagttagataggctaccctaaatattgtactggtgtgattatggtgaataagagcaacgaccggcttcggccaacaggagtacagttattacctgacaattcaggggcccgaacctgtataaaaatccttgtccccatctcttttactacaatctcgcatatatcctagtaccaacgatccccatactatgtaaataccggaatcgcgatatcaaacgtcgacaccatgtaattagcaaaacatgcaattttatttgtaaaaaattataaagtgggttcaatatgctcaaggggaatgtgtacttgctcgaatcttcaaacaatccttcgaacactcatcctcgcgaacgcgatcttccgaaacggtggattctagacgctggcacgcaaaacgaggaaaagctctaataaaaaccaaataagtagtatgtgaaagtaaacaatcatgcaaatctcaattttagatgaattttgcaagatgaatggcccaatttggagttcgtatgaattagttgagaattttagaagttttgagccatttaaatgaatttctagaattaaacttgattttttgtgctattattaattatttttcttaaaggaagtcaatggttattgcatcagcagtggggcgggtgtggaccgagtccaccaaaggtgggccccactcgtcagggtacaaggggcagcaggccaccgtggaccaagccacggcgtcgatcggacggtcgagggtggccggtcggtatatccagcgaggaaggcaaccgtgcaagca

SEQ ID NO: 52316 - DNA, 1153 bp, Oryza sativa
gctcggtacccgatggcatatgatggatggacatcgtgtgggagagatcttcgcaacgggcttcacgaggtgtgcgtgcaagtgccggtgttcgctaagggaattgtaaagttggagtagtatatggtgctacagtacacgaggtactgtagcgtgcaggtatgcatgcatgtacggtgctgtacgtgtatgtgtgatcgatacatgcatggtgaagcatgtatgtgtgcatgactggttggccgagcagcaggagagcggctcggtgggcttcggtggctgttggcgacatgccaagtcggcccaggagaaagcaagggccctgctggcagcgagtcggtgacggtcacacgtggatttctggtgcgaatccgttttggatttctggtgcggccggttgtttgctgcacgtttggaaattgtaaaacgtatggaaactgaaggatggagtcctattgtgtataggagttctacacctactttgagtaggagtttttgtggtataaatagagagggagcgtgaggcttcctgtatcgctttagagagcaatagagttgagttttggtttagggtttcgagtttagtcgaaatttttgtaagaagtgctgttgttgcactttataaacatagagagaagtaataaagtcgtcatccactttaagagttcttcgatttgtatttcaccgggtttcggcggtctaaccggtaactcaccagtggtcagaccggcggcattgcggcggtcagaccggcgggagcgaagcggtcagaccggcggcggcaacaggtgcggcaggcgacttcagcgatcagaccggagattcaaacaccggtcagaccggcggcatccactcggtcagaccggcagatcaatctcggtcagactgacttccgttgatttcgagggtaacttttatttccgttaaaatttttcggtttttgggtataccaaccattcacccccccctttggttggcttagttcttgtgattcgatcctacaacagcggatcacgagtggacttacctcccctcgtcgtgatcgccttaacattttcaatggaggagtcgggttgccccggaatcctcccagattcatttgcagggactaaagatgccaactgagctaactgggtttctatcatcttattaa

SEQ ID NO: 52317 - DNA, 1166 bp, Oryza sativa
  unsure (1)..(1166): unsure at all n locations
actgagctactgggtttctatcatcttattaaagctcagttggttttgaaacgcggaagcaaagccatctagcttgacatttatgttttctaagaccttatcattggcagcaagctttttgcttagcgcatcagtggttttagcttgcgcaaaaacaagatacttcaaggagggctggttagagatgttggcagagggagcagcgaactcgcgaagagtcttgctgggcattgaattgaaggtcggtggcattggtacggctggtttatctgtcggtagagttttctgtggagcaatgactcgcggcctgacgctccggaagaaagcttctggattttctttgaagttttctggcaggttgaaaccagtcatgcactaccctgttttcacaataaaaagtgaaaacaaccaaagttagcctgcaaaggaaaatgattatacaaagataaatataaagtattagttcaaataatctctatcatgaatctttcccggcaacggcgccagaaatgcttgttggtatttcttaacgacattactagaaatgtaattcccagtaatagcgcagaaatgtatattatggttacagagttcatccgcaagcgcacggatataccatcgtactatttcacccgagagtattccaagggtatcgtatttattttatcccatgggcagatcacatagagagaagtcaactaataatttatatattacttgtgataatcatattctaagcaggggttatgataatctaagggtagagtgacacacaagcatttaactactcatcctcaaaataaataatctaagctaggtggaaagaaaagagaaaggaaatctattcctatacttctaatatacatagtatgcatatattctaattaactgatatactagctaataccctctataaacgatgccctcctggtacttcgagaagccactcctgactgtcgagttccttacgacagcccgtcatgaccatccaaccggggctaaatacggaggagtaccctccccaggaaattaacttaggattatatataggcgcggaggaatacccgtactgagctgtcaccatcagcggcccacctctcatccacaatatataaccccaaataannnnnnnnnnnnnnnnnnnnnnnnnnnnnnnnnnnnnnnnn

SEQ ID NO: 52318 - DNA, 6077 bp, Oryza sativa
  unsure (1)..(6077): unsure at all n locations
nnnnnnnnnnnnnnnnnnnnnnnnnnnnnnnnnnnnnnnnnnnnnnnnnnnnnnnnnnnnntgcttctcctttccttgggcggttgaaagatagaacagcaactagagcacaaatcacccaatctttattcaacttttattccagaagttttcaaatgattttgcaaaagaaagccaagttcctcatatgattaactcagtctctccaagtgtatcaatatgaattcctcaccatttttgcctttttgattcctactctaaggtttgatatgtggagctcggtagggatcaaacatggcatacttgcattcacatttattaccaaatcaaaaactcagactaaagaaaatgattaaacatactcaagatcaagatcgtgcaaagtgtgtgtgtgatataccctgtttccacaacaaaagtgaaaataaccaaggttagcctacaaagggcagtgattatacagtggtaaatataaagtattagttctagtaatctctattatgaatcttcctcggcaacggctccagaaatgcttgttggtatttcttaacgacattactagaaatataattcccagcaatggcgccagaaacactcatggtatattatggttacagagttcatccgcaagcacatggatataccattgtagcatttcacccgagagtattccaagggtatcatatttatttaatcccgtggaaagatcatggtagagagacctaactaataatttatatgttacttgtaataatcatagtctaagtaggggttaatataatccaagggtggagagacacacaagcagggagctactcattctcataaaatatctaagctaagtggaaagaaaagagaaagagaatctattcctatacttctagtatacatacatcctagttatccgatatactagctaataccctctatccgatgccctcctggtacttcgagaagccacccctgactgccgagttccttacgacaacccgtcatgaccatcaaccggggctaaatacggaggaataccctccccaggaaattaacttaggattatatataggcgcggagttatacccgtattgagctatcaccatcagtggcccacctctcatccgcaatatataaccccaaataatgatatcccgtaatctagacaccacgtctaaactaccagatactactctaatatcatcgtgatgacatagagtaattgcataagcaaacactatacccgcaccaaagcatctcccacataagctagcagtatattcagtataacatgaacataatgtaaagtaggtactcatatactcggaaagtattccaataccataaatgtatttagaagagtattctaataaaagtacaaagcttacaaaagaggaaaggaaagctactagagccatacccgaactcttccgaagacttccggactcctgattcctattctaattctattccaccagctagatactactaaactaaacttgagaggaatgagagagctctttattgaggtgtgtgagtgaagtgagaaggtgaagtccttttatagctgaactatgacggttgtgacggttggaatggtcggtaataccctccaaccgtcattggggcttcatctcaaccgtccagccaaaacctggatccaacgaaggcgagggaggttcggccgaaccaccaggttcagccgaaccttgggctggcccaatccagtccaatttcggctggcggcctcctctgctgcttcacttcgtagacttgtgaattttggcctgattcatcgtgtcaaatctgtgtgcttggcccattcatacacaagtctggttctcgacattgtccaattgatttatcgtctgagttgatgtcgattctccttcactttattgtcattctctacaaaaggttagtagacctaatactagtggaatattattattctaacatatttatgcatagcaagtatcactagttctctcctgttttagtaatattgacggtcgaaactgatcgataatgaccgtcacatgcagctacctctatctcaatgtcttcaacaaaaggtaaaacttgttatgatggcttgcgttctcgggattagtgcttccatctttatgatactctaatcttgtttatgtaattcgtcaagttatcatatatcttacataatctctagcaatatcgctatctaacccacaatcggctaacatctgttaatagagggcaaccgattaggttaaatatcgacgttggtttagattatataagatatctaccactctatgaaacttccagcggcttaattgtctagatatggtcttcttttcatacttaatgctgcatcagttgagtttgatctattaagtcgtgcttagaatatcaatctttagccctgccttctggttgccgattagggcagtatcggggtttcagccaatcttatctggtttaactatatttgctctatacgctccattgacaagttagatccgccctttatgtcaagatattattgcatttaagtatattacgcttctgtttagtatattctacttgttttaacatcttaacatagagttgtatcggagtactagccgatacatgctagatctatctgattggctatgctataaacatatatagtcctgttattaatatatatttcaacctaagtgattaatactgtctcggcatggcgaccgatctatcccaatcacttggtttaagtatatatcgatataagaactatatattgttgatatctatagccaatcgagtagatttagttctttattatctatttataaccgccgatcgatttacatatgatatcggctcaaaaataaatgatacgtcatcggcacctagccgatcggctatcatttataggtttaaccacggtttctttgtctctatttcttgttgattgcaggatcaaatcaactggcacgctaacacacccgaaggcgagctttggacctgcactggagttaagtagatctcccaggccttgtgtttcacgtcaacacgctcttggcacgcctggtgggaccaagaagaagttagcaagcaattcttcctcatggccgagaaaccaccgctgtcgccatcctcggctagtccaggcactgttaaggaaaagatccagaagttaggattgaccgacgtcaatgaaggaaacgtcgtgcccatcgatccagaaaaattcacacctgatcaaaagaaagattttgacgcgatgatgcagcaggcacgcaatcagttcttgaactcattcatgcagactcgcaagggaacacttgttcagaagtataaagtaaaggtagttgctgatgatcctgggaccagttcttctaaaggtgaagacgggaaacaagctccggatggctcggctcaaccgagtgacaaaggtgctacagatggttctctaggaagtcaaggtgacaattctcaaggagtccatggggttcaaggtgagggggtgcatggagttctaggtgatggtgctctggggttgcagggaggaaattttaatcaggatggcaatgcatcacaggagtttttcaataacttccaagatcgggttgactatgccgtgcacaatgctttgatcaatcaatctggggtgttagtcaatacattgtcaaatatgatgaagtcaatggtcgatggtacaatagctgaataccaagctgcaggcccagtttatttgcaaggaggagtatttccaaattaccgaccattgatcaccaatactcatccacctgttcaagcagctccttctattgcaccatcggctcagccgatggcaccagcatcagctcctgcacctaccgtaccaccttcggctccaggccaattgatcaatccccgactgctgataagagaatagccacaacacgctggatagaatgtggatcggctaacacaagaccaggttgcatcccatgtttttgcctcctcaaaacactgttgatccaacccagcagcagccgattcagcaaacaccaccaaggcagcaggttgtgcaacccatacagcaaacacccccaatccaacaagttgtgccaccagtgcagcaaacaccccgagctcaaagagttgtacaaccgattcagcaaatgccattaaggcaacaggttgtccagctgattcaacaacaaggttcaatgaatgcatcggctgggtttgcgacacctggtgggcggcctgtgcagcatgctacaaatcaggttgtcccagagcatttagtccatcatgtacaaccagatggcacggtgattccgcaagttattcctgaacatttggtgcgtaatattcagccggatcttcaaaattaccaggggggcaatttgaattatcaatatcagccaccgtcacctcatgttcaacaccagcaagcaggatcagctcagccccaatttgttcctcaatataaccaattcgagccgatgccacaacaacctcaagggacacctcaacagcggccatgggccgatttgattgcagatgtcataaaggagcagttcgggctcaggccgaaagatgctggaaatctatatcgacagccatatcctgaatggtttgagagagttcctttacctaaccggttcaaagttctagatttttcaaagttctcagggcaagatagtacatcaacttatgagcacagtagccgatttttagctcactgcggtgaagcatcggctgtggatgccttgagagttaggttattccggttgtctttagctgggtcagcctatacttggttttcttccttaccatatggatcaattaacagttgggctaatttaaaaaagcagtttcatagctgcttctatagtgggattcatgagatgaaattgtccgatctgacgtcgatcaagcaaaagcatgatgagccagtacatgagtatattcaaagattcagggagatgagaaataagtgttacagcttgagtttgactgatgcccagttagccgatttggcttttcagggtatgattgctccaattagggagaagttctcatctgaagattttgaaagcttgtcacaccttacaaagaaggtagctctgcatgaacaaaggtatgcagaggctaggaaaaattctaaaaaggttaatcatgtttgtccttatatatatggatcggatgatgagggtgatgattctgagatagatgcagtcgagtgggtaaggagtaagaaggttataccatgccaatgggtaaagagctcaggtaaagaggagaagtatgactttgatataaccaaggctgataaaatttttgacttgctactccgagagaagcatattcaacttcatgccagtcacacaattccatcggctgaagaattgggcaagaaaaggtattgcaaatggcataattctaggtctcatacgactaatgattgcaaggtcttcaggcagcagatccaagcggctattgaaggaggcaaaatcaagtttgacgattctaagaggccgatgaaggttgatggcaatccttttcctgttaatatggtgcatacagctgaccgaatagccgatgggagtcgtgcaaggggttttcaggtaaattcggctaatattatcagcaaatatcagaggaagtatgacaagcagcaggagaagcattatgaagaagatgatgatggttttgatcctcattggaatgaaggtatgaggctgccatctatcgaagactgtcctgggtgcagtgatattgctgagagttcaagccgatcatatagtaggggcaatcggctaaggcagacaagagttcctgttcatgaaagattgggtccagtgaatcaagacatagccaagaggacaatgaaatcaggaaaaatcagtggtgtccatctggtattttcacgaagaatcataagagaagggttcaaagattgaggaacagggagcacttttaggaggtcgaacaagaaattaaccattggctgaggaaaacaaagccgaggcaggagtggcgtgttaagaatcaggttcctgtagccgatnnnnnnnnnnnnnnnnnnnnnnnnnnnnnnnnnnnnnnnnnnnnnnnnnnnnnnn

SEQ ID NO: 52319 - DNA, 3838 bp, Oryza sativa
ttatgctaatgtgcattccttcaccatgcatcaatgcttgattcagtgcaaggcgacaagattgagattgtgccagccgacaggtcagtcaatgttgccagtgctgaattagctctttgggagatggatgggcttgattgtttatttattttggaaaagtttgggatggagattttctaaaagtgtccgattctgatatacagccacttgaagatggagaacccgagctattattttgagggcgtcgtagagggttcagatgtctacaacaaggacacggtagatgatctcgatgacaaacaaggacagggtttttgtcggctgatgatttggaagaaattgatataggtccaggtgatcgaccaaggccgacatttattagtaagaatttatctgcagaatttagaaccaagttgatagagttgttgagagaattcagagattgcttcgcttgggagtattatgagatgcctggactcagccgatcgattgtagaacatcggctacctatcaaaccaggggttaggccacaccagcaacctccgagaagatgcaaagctaatatgcttaaacctgtcaaggctgaaattaaacgattatatgatgctggttttattcgtccttgccgatatgctgaatgggtttctagtatagttcctgttattaagaagaatggcaatgtcagggtgtgcattgatttccgagacctgaataaagctatcccgaaggatgaatacccaatgccagttgccgatcagctggttggtgctgcatcagggaaaaaaattttgagttttatggatggaaacgcaggatataatcaaatctttatggctaaagaagatatccataagacagcttttaggtgtcctggtgcaatcgacttgtttgaatgggttgtgatgactttcagcttgaagagtgctgagctacatatcaaagagccatgaattacatataccacgatctaatcggctggttggttgaggtttacattgatgatgtggttgttaagtctaaagaaatagatgaccacatagccgatttgaggaaggttttcgagagaaccagaaaatatggcctgaagatgattccgacaaaatgtgcttttggtgtgtcggctggccagtttttgggatttcttgttcatgcgaggggggttgaggtgactcaaaggagtgttaatgcaatcaagaaaattcagcctccggagaacaagacagaattataggagatgattggaaaggtaaattttgttagaaggtttatttctaatctgtctggaaggttagagccttttacaccattgttgagattaaaagccgatcagcaatttacttggggggcagagcaacagaaggctttggataatattaaggaatatcttagctctcctcctgttttgattcctccatagaaagggataccttttagattgtatctatcgaccggtgagaagttgatcggctcagttttgattcaggagttggatggaaaagaacgagttgtattttatcttagtcgtcggctcttggatgctgaaactagatattcccctgtggagaagttatgcttgtgtctatatttttcgtgtataaggttgaggcattatctactatccaacgagtgtactgtcatatgcaaggccgatgttgtcaaatacatgttatcggctccaattttgaaaggaaaggttggaaagtggatattctctttaactgagtttgatcttcggtatgagtcgccgaaggcgattaagggacaagttatagccgattttattgtggaacatcgtgatgattaaatcggctcgattgaaattgtgccatggactttattctttgatggatcggcgggtactcatggttatggtatcggcctagttataatttcccctaggggggcatgttttgagtttgcttatactattaaaccttatgcgactaataatcaggctgagtatgaggcagtgctcaaagggttgcaactactcaaggaagttgaagccgatgcttttgaaatcatgggggattctttgctggtaataagtcaattggcaggagaatatgaatgcaagaatgatacgttaatggtttataatgagaaataccaagaattgatgaaggagtttggctggttactttgaaacatgtatctcgagaataaaatattgaagctaatgatttggcccagggagcattggggtataagccgatgatcaaagatgttaaggttgaaattgcagctatgacagccgatgattgggaggtatgatgtgcaccagtatttacagaatccatctcaatcggcttctaggaaattgagatataaggcattgaagtacactttattggatgatgagctttactatcagacgattgatggggtgttgcttaagtgtttgagtcccgatcaggctaaagttgcaatcggtgaagttcatgagggaatttgtggtactcataaatcggctcataagatgaagtggttacttcggcgtgcagggtatttttggccgacaatgttggaaaattgtttcagatattacaaagggtgttaggattgtcagaagtttggagcaattcagcgagcaccagcattggctatgaatcctatcattaagtcatggccatttagaggttggggaattgatatgattggtatgataaatccaccatcgagtaaaggacataagtttatattagtggcgactgattatttcaccaagtgggtagaggcgattcctttgaagaaggttgattctggggatgcaatttaatttgttcaagagcatataatctaccggtttggtattcctcaaactattacaaccgatcaaggcttaattttcgtgtccgatgagtttgttcagtttgccgatagcatgggtatcaaattgttgaattcttcaccatattatgcacaagctaatgggcaggccgaggcatctaacaagagcttgatcaaattcattaagcggaagatttctgattatcctaggcaatggcatactcggttggccgaagcattgtggtcgtattggatggcatgtcatggatcaattcaagtccctccctataagcttgtttatggacatgaggctgttttgccgtgggaggttagaatcggctctagaagaacggaattacaaaatgatttaacagccgatgagtattacaaccttatggccgatgagagggaggatctggttcagtcacgattgcgagcccttgcaaaatttatcaaggataaggagcgtgttgctcggcattacaataagaaagtggtacccaaagatttttcggagggggaacttgtttggaagttgattctgccgattggaactcgggatagcaaattcggcaaatggtcgccgaattgggaagaaccgtttcaaatttataaggttgtgtctaaaggagcttacatgttgcaaggactcgatggagaagtttctggcagagcattaaatggcaaatatttgaagaaatattacccaagtgtttgggttaatgcaagatcggctgatgttgccgatacatgataagccgatgtattttcatcgtcttgagatggccgatattgttatatcgctcttagtcgttttttccaattgtaatcggttgtggtttgccgatatataacagccgatattgttatatcgcccttagttgtttttctaattttatcaatgctgttgacattataaaattaggggggcacatatgtacaaaaatgaaagtgaaaatttttttagcaaaatcagaagttatgttaatcggcacagaggattgttaaaacaacagagtattaaggtatcttagccgattacaaaaaa

SEQ ID NO: 52320 - DNA, 15755 bp, Oryza sativa
  unsure (1)..(15755): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcattcctgaagttgtgccaggagctcaatcttgcgagcctcgagccaatcaatgttggatttgatcggactctccgaaagctgatcaagtttggatttctcctcatgcacaagctgacgattggcttggattgtggcctcaatatccttgcgctctcgacattcggctagtcttaatttggacttttctagcttgaattgatgttgctcaagatagaccactggagtaaggatattggctagctcatctgggattagagcttggatctcatgtagccgagtcctaattggcccacagtttaccaccaaattatctaatgatgacgcttccagccgatgagagatatcttcaagtgttttcttcacatcatcgggtaagggagctaaagctttgcttgaagtatcttcttctgcctcatcaagataatctctgatgtcaaaggagaaaagatcggctaaaacctgcagcaacaatttcggaaagagtaagagctgggtaaaatatagccgatctaattattgagacaaaggaaaacttactgggatagcagaagaagctggttgttcttcctcctcgatgtgatgactccccacggccgatggagtctggtcacttgacgattgctgtacaggaggagaaggaggaggaggaagctgtaggatagataagtgttatatagagtcggttgagattgattaagtaaaagaattaaagatatcttactggtggagccgacttgacaattgtcgctgctggttttttcttcacagcagttttcttcttctgcaaccacaaagtccatgagtaattaactaaagagggaggtaacttcagaagaagtcaaagagagatacttactcttctgaaatgaacgggggcaggagttggaggcgtttgcttgggtgaagccgatggtgttctttctgtgtcactcatttcagctacaatctggtcaatatcttcaccaatttcctcttcatccagagcttgttcaatagatggatccaaggcaggcagatcatcggtcggcttagttttcttgaatttggcctttttctttggagctaaggccaaggtactcacggccgatgatctggttttccttttcttgcctgcatcggctggttccctggttaggccgtgaaggagagttgaagtcttgggggcatggtagccgataacggggggagatagtccacctccattcggaattagtcctggagaatattcaatgttcctgccactgttactttggtgtggcggggaagagtcgattgtctgcagaacaagaacaagagattagtcaagtaataaatcggctaacaattattcaagctaacaatggtgaggtttacctaaggtatgacatcagggaatagatctgtcatatacatcgaagccgattgatgaaacaagtgcagcttccattcaccccaccatctgtcgaaatttttgcttctaaaccctgccaactcaatattatcaatgctgcccagagagggtcctggtaggttaagtagccgatccatcattagagtggatgcgatttctcctcagcactgaatcttgtcgacaaagaataagccgattgggagttgtcctaatccaagttgtctagccgagctcattgggtgataaaactcataggaaacttggatatttcttccttgatgaatgccgacaggaaggatgcatgggctgattgcggctgtaagaacttccctggatttttgatacttttcatgattgatatcttcaaatctaaagactgatggaagttcaagatctgctgagtcttcataaggaaaccaaactcgggcatctttcttaaagccttcatagaagccgcagaaccaatccttgagtagctcggccgatagctttgctctagcatcggttggtgtggacgcatattccccatatgatgtgcatctacgatgagtgcgttcttctccatcatctcctgcaatcggctctggcaatgggaactcagcatctgtcacagatggccgattgacgactttcatgaccattaggttcaaccaggtttgcagcagccaccattgtccacctgcaccaactactgagccaacggctatcttggccgatgcattgttcaatgtttcgtataagtagccgaggagaatcttgcctaagggaaattctttctttgattctaaggcttcggctacaaattgccagttggttgtaggaccacaactggatccacaaaagagaaatttttcgagccacattagcaagaaggctacatgctctcgaggagtaacagatccttggcccatatatgccgccacatagccagaccagccacctatgcttttggttctgaagtcaaactgatttttgctgttcatgctcatgggattagccgatgaggttacatctaaaccggtgatcatggtaatgtcaatcaaagttgtggtcatcggcccttggttgaacaagaaggcgttaatggtgttggactaaaaataagaggcggctgccattaagggctcgtcgttagctgagttggctatggttaggtcaagtgcttggccgattccaatctcatcccagtgtactttcttactagctgatacgcgctggtaccatgtaacccaagttttctcaggggtggttttctcaagagatggccaagacttgaaagtgtttttctagtggctcaggttagggttggctagcctcaaggggatcctattggtttcaccgatgataaaatcagtggggtcaagattgccgattggacccagaaaatagtgattttcatgcgacaggcttggaatcgcaactaggttggaaaggtgctgcaaatccaaagcaaccgagaagaagagagcaatatgagacgagaaaaatcgatttgctgttgagaaaggggatctagccgatggggacttacctcggcatactcagctgatggcgcagcagatgggctggcagaggatgacatcgctgtgggcggagatctcgccggagatgaagtcgcctggaaatcgctttgtgcgtcggagggatcgccggagagagagaaggcagagtttcgcttaagcggtgaaaacaggagtaacggtgtgagatttctcaggggcaacggttagtatttaaagcgcttgaataacggtcggaaaacggtaaagtgcgaaacttgctcggagtcgatgttaagcaaatccgaaacattaccaaatattccggacttggggggcatgtgttaacgaccaaatttgctaatatcagcatcgaaaaagaggattagatcgaagtggagtcgaaggtggagatcgattcgagaacagagaaagaatcggctggagtccagatcagctacgattaggatcggcaggatccgagtcagattgggttaagtgatacagccgattccgacaatatgacttgtatgcgatatcggttttgagttgacgtacttcatgatgattgccatagatggatagagtcctggggaggcaattgtatctattaattaggataatttatgtaaattccttagggataaatataggcaaaagtctgccgtagagacttatggtatcttagagcttgtttgagataatagtcgtgtccggtatggacatatcttgtaattcttgggtataaataaaccccgagccctatgtaatttttaaacacacacgttcaatacaatttcggcgcatcgccacccttttgcttttgttttatttcgacgagttcttgcttttgggttgagctgcatcggtttcgatcttcaacaaaaggtaaaacttgttatgatggcttgtgttctcgggattagtgcttccatctttatgatactctaatcttgtttatgtaattcgtcgagttatcatatatcttacataatctctagcaatatcgctatctaacccacaattggctaacatctgttaatagagagcagccgattaggttaaatatcgatgttggtttagattatataagatatctaccactctatgaaacttccagcggcttgattgtctagatattgttcttcttttcatacttaatgctgcatcagttgagttcgatctattaagtcgtgcttagaatatcaatctctagcctgccttctggttgccgattagggcagtatcggggtttcagccgatcttatctggtttaactatatttgctctatatgctccattgacatgttagatcttccctttatgtcaagatattattgcatttaagtatattaagcttctgtttggtatattctgcttgttttaacatcttaacatagagttgaatcggagtactagccgatacatgctagatctatctgatcggctatgctataaacatatatagtcttgttattaatatatatttcaacataagtgattaatactgtctcggcacctagccgatcggctatcatttataggtttaaccacggtttctttgtctctatttcttgttgattgcaggatcaaatcaactggcacgctaacacacccgaaggcgagctttggacctgcactggagttaagcagatctcctaggcctcgtgtttcacgtcaacagttacccggcggggataacggaggatgtgccagtcaagatacgggatttcttcatcccggttgatttcgtggtgctggacatggacacggggaaggagacgccgctcatcctgggctgtccgttccttagcaccgcaggggccaacattgacatgggaacgcagagtatccgtttccatatcaacgggaaggaggaaaagtttgagattcaaccgaggacggaacaatgctccatgctcagaatcaagtacgggccaaacccgcagaacattcaagtggtcgaagtggagccacccaagacggatagcctggtaaggttcatgcagaacttcctagagaaggaaacaacaatgcccaggaacccctattggaggaagtcggtaaaatcacatataccgcactgaggtaacgaaacatcactgtgccacgaccgcactgaccgttggattccaacggccgaaagtggggccggttgggcccactaggggttcgaccgaacaccctggttcggccgaaccggctaggcaacagtcggctgcctcattttttgaggcaacggctagtgggccccataggtcagttttgaccgttgtgggtgcactacttaagccaaccggctagtgggccccatttcaacacattttcattccccctccaaagtttgctctcaagttcattcaagcttttatagttttcctcaaattcaaatctttagtttcatacatacaagttgctttggtgaaactaaccggcgggtgatactcttgtcatttctaacccccgccgagttagcctgttcttgctccattgtgcagtatgaggaggcgactgtctcgtctgttcaaagggtcaggctctcaatcaagtcgtcatgacaagtctagtactcgttcatcagctgatgtctcaatggaagacgccgacgctccgcgacaactcctgagtgacgctgacctcgaccttgtcagtgatcgggagagacaagcctactacatgctgagcgaccgggagtatgctcacacgcgagtatactcaccggagttgctgaaaaagataggtatgcatgttgaatttcgttctatttggaaagatgttggttggcagagatttgctatggtagatgagcccggttcttgcttgcttactttgcaatttctgtgcactttgaaataaatagaagatggtatttcttttcgctttttccataaggagttcacactcacatggaaaggcttgagtacacttcttggttttcacgattcctggaaaatcgatctccagaaaggaatttctgggttcgagaaaaataggttttgggaagatatttctggtgctccaatttgtaagaaacctacaacgaatgatatccataatcctacacttcggctcatgcacaaatggattgctatgtctttgttccctagaagtgatctgtgacccattagggggatgaattaattatcatgtttgccatggttagaaagataaaaatttctccagtgaagtgtatgataaggcaatggttagaaagtataaagttctctgctcctgttgagtgcacttctctgattactcggatagcaaaagggctaggggtcgttagcgaccaaattgctcttatctcagccgctcgtccgcgtattgatgaggcctatctagtgcaagggcatattttgaaacatggagcagatggatctttgatatactttttccccggttgtacaaatgaaatcccgttgccaaatgcggggtatcatttgtacaactgccatgaactaaccattcccctgcagaccaaagaagaatctcatgcaggtggaacatacagggagacgcgcaacatgacaaggaacgaacaagcaagttcatcatcctcaacacccgtgcagatgtatgaggcaggttggacaccaactggggatgctccaggatggacccaagctccacgccatagcatcggagtctcaacctgggcaggcgccagtgaggaccggtggcatgcgcctcatgacatccactggggggacaaccaaccctcaaagtgaatggcgctcaagttcctcacgttgggacttgggtgaaattactaggagaatggacacccttgatgtgcagacgggggagatccagtacgacctcgcggaacacatagcccaaacgcaagaatggcagcaatctgctgatgctcagttcaccaacatcaacaacatgacgcagcaacagcatgatgaccttcaggcgtactttcgctttcaggggttcaatccttaccaaggaccctgagcgaaagcgaagcttgaggggagacctcgctctccccactgaggtaacttgtatcacattgcatatttcccttcccaattgcataattgctttccaattgcatcgtataaaccttgaaaaacaacataaaaaattgtaaaatagaaaataccaaaaagataggataggtttgagtcatgctaggtaagataagctagttctctttgttgaaatgatgaatagttgctctgttttatatctctgatatatgggttcttggtaaatgctctctcaaagattgaatataagtagccaacaattatccgggaacctgaggtaaatgagctgcacttgctaatctaagtctaagttgttgcgagatttgacatagtaaaaatgagtagctatgatcctgatactaatttgacttgaattccggatgttttgttttgcaaaatgataaattgaaagttcctcatttgatataaattcctaccagagccaaaaatgtgttatcatgataaaccatatacattttggttacttgctattccattgaactttgtcaaactcttgtgacttgtgtagatacttctcacgctctatgatcaagatcatacacccacatatatgcacatgctaaactcctacactgggagctaaggaatattccattccattttcatattaccaccaaaataaattctccatgctttgaagtgctttcttctcctaaaaagataattcgttttgaaaaaaaaggagaggagggaaaggcaaagttatgaaaataataataataataataaagttatgctccatcaagcatgagcatgatgttgtagccatggcctctcccaataaaagaaggatttttgggataagagagtaaagcacaaaggagaagcatttttcttttatttgtcctcatacaccgtttccaccatatatcacacacattttgcacgatcttgatcgtgagtatgtttagttatctgctttagtctaagtttttgacttagtaataaatctgaatgcaagtatgccatgtttgatccctaccgaggctccacatataaaccttagagtaggaataaaaaaggcatcattgggtgaggaattcaaattgatacacttagagagactgagtgaatcaattgaggaacttggttttcttttccaaaatcgtttgaaaacttccggattaagagttgaataaagatcgggtgattggtgctctagttgttgttcagtctttcaaccgcccaaggcagggagaagcagtgtctcgtgggaatcaggggtaagggtaagccaccgtgccaaagattatttaatctgagagagagtacatatacctttcacctgtatctttgaggtatgcagcatagtagcaactcctgatcaacaaccaagtcattgtttcctttcgtccttcactcaggacgagcaaaggttcaagtttggggggttttgttgacggtcgttatcgatcagtttcgaccgtcaatattactaaaacaggagagaactagtgatgcttgcaatgcataaatatattagaataataatattccactagtattaggtctactaaccttttatagagaatgacaataaagtgaaggagaatcgacctcaactcagacgataaatcaatcggacaatgttgagaaccagaattttgtatgaatgggccaagaacgcagacttgacacgatgaatcaggccaaaattcacaagtctacgaagtgaagcagcagaggaggccaccagccaaaatgtgggctggttgggccagccccaagttcggccgaacctccctcgcctccgttggatccaggttttgcctggacagtggagatgaagccccaatgacagttggagggtattaccgaccattccaaccatcacaaccgttatagttcagctataaaaggacttcaccttctcacttcactcacacacctcaagcaagagctctctcattcctctcaagtttagtttagtagtatctagctggtggaataaaattagaataggaatcaggagtctggaagtcttcggaagagttcgggtatggctctagcagctttcctttcctcttttgtaagctttgtacttttattagaatactcttctatatacatttatggtattgggatactttccgagtatatgagtatcaactttacattatgttcttattatattgaatatactgctagcttatcagggagatgctttggtgcgggtatagtgtttgcttatgcaattactctatgtcatgacgatgatattagagtagtatctggtagtttagacgtggtgtctatattacgggatatcattatttgatgttatatattgcggatgaaaggtgggccgctgattgtgacagctcagcacgggtattccttcgcgcctatatataatcctaagttaatttcctagggagggtattcctccgtatttagccccggttggatggtcatgacgggttgtcgtaaggaactcggcagtcaggggtggcttctcgaagtaccaggagggcatcggatagagggtattagctagtatatcagttaactagaatgtatttatactatgtatattagaagtataggaatagatttcctttctctttactttccacctagtttagattatttattatgaggatgggtagttgaatgcttgtgtgtcactctacccttggattatcttaatccctacttagaatatgattatcgcaagtaatatataaattattagttgagttctctgtacatgatcttcccacgggataaaataaatacgatacccttggaatactctcgggtaaaatgctacaatggtatatccgtgcgcttacggatgaactctgtaaccataatataccagaagtatttctgcgcctttgctgaaattatatttctagtaatgtcattaagaaatacaacaagcatttttggcgccattgccggggattatatttctagtaatgtcgttaagaaataacaacaattaggccccattttataggcaagagagagagccgaccacgagattgagtggaaacggtgccggagatggtggtgtcagcggcatcaatggcggcttttgaacaagatccaaatcctggcgattggaggcaccattcaagccttgttcggttaatgcccatgagggaggaattggagaggatttattccccacctattgtggtgtggaattattccccctcaatcccctccaaaccgaacaaggcctcaccggggaaattagggggatttaaagagaaatcaatgggtattaaaacccccaattaatttggatttaaccggcttgaatggagcgaatttgagggagagataggctagggtttatgggagagagaggaggccggcgggaggaagaagacgaccggctgcctagcggcttgggctgggcgaggcaggggtggcccagggcagggcaaggagaggcccgagagagaaggaagagaaggaggggacttcggctgcgggccgagggagaggagagcgactttgggccaggggagataatttttagtttttctttttaatgaactcttataattgttttgtttcttaataaatattttcggtgctctgaaaattggaataaaaattgagggctccatttagaccaaggaaaatttaagaaaaatactccgggccacaatcgaatttatcttgtacgcatgatgaatttatcaggccatgacaaccgacaaccgatgactattctaagcctaactccactactacaagagagaatacaatatgaaatgagagaattgctccttgaagttagtgttaaaactgaagaaggaaatctccttttataactctcaagggcggttgagtatgacggttatggaggttggtgcacccctaactatcattaagagtggttgtggagttgacacgtggaggatggggccgaggggtgccacccttggttcagccaggcaaaccgcctttccccaccgcctttggtcaggggatgataggtgggtcccttggtcggtgcacactctaagtcagtttagtatgatttgtgggcccataaatccgtgtgttcgcatgtgattcatcagaggtgtgtttctttgcggctcatttctcctttactttaatgtataattcctgcatccatagtatttctccaatacaagtgaaactacattatttataaatgatatgcgtgtaagaaatgttagttttctcattatttattatggtagttgatggttgaaattggtacttaacgatcgacaccatggggatagcttgtttgggatgctgacatggtgtggccatcacggatgtcgatgaaacagcgactgcgacgggttgaggaggtgggcaacggttctaatggcaccaacgagtcttgccaatgctcgcgcgaatgctatggatagttgaaagggttgtcgcgttgtgttcgtatggtcgttacaactgcgacggcaagagctcgatttcgatgaaatccgctagaaccaaggtgccatatatggccttgcaagattggggagcttcctagcggtaaggtaacatgattgcccgcttgtgctagaggggatgctatcctactatgtaacgccccgattttcgtttgggataaaaatcattaaataatgcattttctagaaattaaaaaaaagttaaagcaaattaataaagtgaaataatgggagaattaaaatttttcccttaaaagtcatggccgagaatattttgtaatattctttgtgccctaaaatactctccggatttttccgtgaattttcggagctcaagaaataatttaaatagcacaaagttcattaactcaatttaaataaaaagaaaaatgattaaaattccctctccttccttccttgggccatttttggcccaatcccgcccctcctcctcctcccgcagcccgttgggcttccctccacctcctcctcccgcagcccgctcgctcccctctccctccaaagttcacctaaccccctcatccctctccctctcacgccgacaagtgggaccgtcggacccacttgtcaggtcctcctcctacctccggctccccaattccaaccgtcatgccgccattgccgcctcacgcgccgccgattccgcgccaccccgccaccccccttcttgcccaagtggtggaaccgacccccaccacctcctccacctcttccccctctcttcccaaaaatacggcgccggtttgccccgccacgcgcccacgatgccgccccactccgacggccgttgccggccgattccaccctccacagccacgatctcgccactccaagcccatataaacactccccgcagcctcctctctcgtttcccgagctccccgcgcgttctcccgctcaccccacgccgagcccgtgcgtcaccgctttccggcgagctccggccgtcgctcctcgccgccctagccgccgccgcactgcgccgccaccaccatcggcatcgccgtgctgtgccgcaccccggcccctattccttttcccctctccacctcagaaacactgccgcaccgcgcgcccgagctccaccgcccgccggcgtcgtccagccgcgcgccgccgccgctatagtcgtcgccgcgctgcgccgccgccaccactagctccaccgccccttgccgcacatcggccgccactacacttccccaaatcgccaccgaaatcgcctttccaccaccacacccgagctgcctcctgccgcttgccgcggcgctcgaagccgcgtccggccgcgccgacaccccctccgtattcgcagtgtcgagctgtacgtcggccacccctccctcttcgcgagtcaccatcggaactccgtcccctctgctcgaggtgagcatccgtcgccccctctcatctccggccggcaactcacttcaccgtgagccacctctgtaacaactgaaaatttaattagtagtttaacgtgtcatatgttatgtttcggataaaattataggaatttcaaaaactttcttagaaaaaaaattcttcagatgattcttatgtttaaaatggctagaaatttaaaccttttgctagacttttgtttgggatgatgtcaatctttagctaccattatagggaaagcattttttttccagaaaacaaaataaccatataaccttggtggcgaaatctaagttgctgggttaaggaagaatcatccaatttttcaaatagtgctttgacgctaataaaatttaccaacacaactaaagacctactcaccaatatttttccttgcacgaatggaacgagaatataagagactaagccaactcaataccagataattcacgaagatccacctttctttttctcccttttagcttttaagccaagttgaaacctctttgtatttaactataatgaatgaccaatcggtaattttgtaactcatatttcgcttatttgataatctacccgatcacgcatagcttttggctagtagattaagtaactagtgattgtatgcttgtgtacctggttgtagtgtagtccaatttattggcttaaatgattttctttgtttggctaattggtaaatgttaaatgaatatagatactctgtaacaaatctaagcaacataaaattccatgaaggtcctcatgtcaattagacaacctaagatgaccactgtaaaggtttcatcattttatcaccctttttactacctcagatatatcagtcaagtatagtcacagtgattaattagaaacctaatcaggaaaatgaagcaactcctaaatgtgcttaaaaattgatcagaaggatataggttttataatttattcaaatactagattatttatcatgagttaatataatttttctagaatttttacacttagttttgacctcattgaaattcaatttagttctcagcataccccatttcacctttttgccagaattaaaatatttcgaatttttgagtgaaactttgaaaaatggaaactaggtaactcaagctatacacacaccagatcacccatttttggaattcttgtagctaggtcaaactagttaaccaggagagaaaattcctgaaaattcactaatttcattgtgtacctatgtttctagccttgatttatctgtcctatgggcccagttcgacttggccccacatgtcactgacctaggcccgctccatatctcctagaccacctcttgggcgtgcaaccccacctcaggaacttaagacagcaaaaaaaaccctccatcttcctcctccctttctattgccagccactttacgttcttccttaggctgagctccctccccactttctcccccaaattcttcttcaatcatccaaaaccaaaccctgcatgtcacacctttggatccctggggctctaggttttccatccatccaaatatcttgcacatgcatggccatttgagagagatcgggaaggaggaacagcaaggagctgcaggctgcgaggttgcagcagctggatgacacgtttcttttctgtgttggtaagttctttccacatccatggctccctacttgagttcctataatgccgacaatcccttctttcttcccctccctattggtcaccgattcaaatcttgagagcaaagagcagctacaattcatatttctccactccggcaacaataacccatgttcctttgagttcctctgttttggtgagttctcatgtctctacctcctgtagatttatgttcttagctttaggatcaagtactcacggtgcttttgtcctgcaagtagcgtaaggtgagttttgtattattcttccttgtactacttgatcgtgctctttctatattgatagtttgatacccttctccggtaaacccgtgtaccaggcactgcaacctcaccaaatgtaggatataaatgagctcacacctatccttcggcagccatcagtggatcatggtgatttgcattagtgattcgagtcgttgttgagtttgtcgcccctaagaaaattagggccagcctgctgcacctcgtcctttggtgagatttttcagcaccttggcaatttgttttctctcacacaaaaggacctcacaaagattgctttgccactgaactccaccaatagctagtagttgcaaaattctagaaacactgttcttggtgctttaggtagattgttaattagcaagaagcatggggatattcagaggaggatggaactaaagtcacttggtaatatctgagaaagagataactggagttacaatgtaattacactaaattcaagtgctaataattactgaactaaatcaattatccccccacatagcttatgcacctatatcatttctttcaattgtaagctatgaaatcaaatttctgctaaggggcagccagtagcagttccacttgtcacattaagtcaacgcgcatagttacttcattccaagtctaaattgggtgattcaaattgtattagaaccagtgaatttggctccttggtgtgatataaattttattcacgtaaggctgctaaaaatctcagtatatggttgggtctgtttgttctattttcaaaagttgccattttagtgtatatggctggttagttgtgtatctcctaagctagagcagcaaatgtagtttttatgtcaacttgtacgctgcc

SEQ ID NO: 52321 - DNA, 2008 bp, Oryza sativa
aaattctagaaacactgttcttggtgctttaggtagattgttaattagcaagaagcatggggatattcagaggaggatggaactaaagtcacttggtaatatctgagaaagagataactggagttacaatgtaattacactaaattcaagtgctaataattactgaactaaatcaattatccccccacatagcttatgcacctatatcatttctttcaattgtaagctatgaaatcaaatttctgctaaggggcagccagtagcagttccacttgtcacattaagtcaacgcgcatagttacttcattccaagtctaaattgggtgattcaaattgtattagaaccagtgaatttggctccttggtgtgatataaattttattcacgtaaggctgctaaaaatctcagtatatggttgggtctgtttgttctattttcaaaagttgccattttagtgtatatggctggttagttgtgtatctcctaagctagagcagcaaatgtagtttttatgtcaacttgtacgctgcccactgtatttatctatcaatttatagagcatgttgcatatgcatgtttatttgaatcttatttgcatatttgtcttttatcggtagattcagatgtttcggagtacgtggagcaagaacctgagattgagtgtgatcatctacagcaacaaggcgagcacctaagcatctagcacccatgttttacttaaattcctttggttgtgaatatatatatatatatatatatatatatatatatatatatatatatgcatttgcttagttaattgttttgggtgacatggtctataattaattggtgcatttaccttagttatatatagttgccatatacctattactctcctggttgggaatagttgggatgttttattcattatgcttagttttgcttagtggggatacaactatatggctggacagttttgttaattctaggatatggacaacttggttaatgggctaaaactggagcacttacattaaataatggttgatgaaatatgattgacttggacgggtggtagggcgatgatgggaggtatgtttcccctgatgcagtagctccgtctgggtcgttaaggactaaatattttgacgtctattcaagcaccctacgtacttaccacatgccgtatcatgggaccggcttgtttgattactagacccactgtgatcatttacgcccatcagagaaacgtgggtatttgggatccgcggagtgcttggttggccgatgtcacgcccagaaatttaacccaaatttctagactattttgcgtattaaatccctgtccaggaccagccagggtacacaaaacgacaagtaatatacagttccaaacgtaaataaagcgtaaaatacttacggaagaggcacttagtcctcacaccgaaacagaacgatagcagcggaaaaaggcgatcctagcggggcttcagctccactccataggcaaaactcaactggggtctgagccttggtcctctaacttcatcttcagctcagaagcactacacttctgaaaaagggggaataatagcaagactgagtacaaccaccgtactcagcaagccacaccaacgatgcagacgtgcaaggggatacaaggaggggtttgtggctatttgcataaaggcagttgtaaaacattttattgagcaaaacagtaaaactgttgagtaattaaagtaacattaaatctccattgatcaacgctataccacattgaacaggcccaaccaacccacctgaactacagtgtattgggtcgatttattaagatgggactaatcacggtgaatctggtcgaccgcccataaccgcgggcacggctattcgaatagttttactctgatcagaggtgtacagctgtacccacaagacacagccccacgacatgtttccgtgcgccgacatgccaccacgacataccggaaagaggccatgacaggacccttcgcataaccccctc

SEQ ID NO: 52322 - DNA, 7178 bp, Oryza sativa
tccagtggaccggcggtggacctccctgtggtcccggtccacggtggaccgatcaccttgacccgctgacgtgtggggctcgcttgacggcgccggcctctttgatgacgtcaacgcttaatcttttcctttgataaaataattaataattccacaataaatcattaataattgtataaatccatctaattcatccaaacttcaaattgggccattcaacttgcaaagttcatcaaaaattgagctctacatgtttgtttactcttcatgtactatttacttggtgtttattagagtttttcctcattttgagtgccaacgtgtagaatccattgtttcgggagttcgcggtcacaaggatcagtgttcggaagactcttttgaagaagtaaggcaagtcacacattccccttgagcattttgagcctaatttaaaaatgttttaccgtttgcaaataaagatgcatgttttgctaattacatgggaatagggtttacctatctgctcgtttgtgccatgtctacttgatatatgtcctttgtcaaccctgggtaataatttgactacctcatgttacttatgtgacctagctagaactatatgcttagccatgcttgattaccactagcccagttgatgggataattgcagtattagacctattagtatcttgacgagctgcgtgctcgagacatccggccatgtttcgttggtcgtaattatccaactaaaatgtgactgaatggtgggctgtgggtgcatggttttgctagtcgcgcccatggcaattaaggaccggttcgcgggatgcactagaagacatacagcgcttgccacaagctagaatgggtaattgcctgacttgaagtatagctttcctcaggctgacgcatccaggcaagggtaagcgtgatggagttcggatgggccctgtgacggcctatgcggctttctgattcgcttaggcacgagagaggactgcccgctgcctgttgaagagtgggggtgaaacctgaggtatggtgtgcttggttagagggggttatatgaaaggtcttgtcacaatcactcgacatggtaacgtgtcaggcctggcgcggtgacatgccgatggattgtgtcctgtgggtacagttgtgcacctctggctagagtaaaactattcgaatagtcgtgcccgcggttatgggcgatcaaccaaaatcaccgtgattagtctcgcccttaataaattgactcaatgcattggttagttcaggtgggatggttgggcctgttcaacgtgtagcgttgatcagtggagatttaatgttaccttaattactcaattgttttactattttgctcaataaaatgctttacgaccgcctttatgcaaatagcctcaagccattcttgaatccccttgcacatctgcatcattggtgtgccttactgagtacggtggttgtactcagccttgctattgttcccccttttcagaagtgtagtacttctgagctgaagacgaagttagaggaccaaggctcagaccccagttgagttttgcctatggagtggagatgaagccccgctaggattgcctttttccgctgctgctgctttcgtttcggtgtgaggactaagtacctcttctataagtattttacgctttatttacatttggaactgtttattacttgtcgttttgtgtaccctggatgattcctagacagggatttaatacacaaaatagtctggaaatttgggctaaatttctggacgtgacatactactacataaatgaatttttggatgagaccctctttaggttgcaaacgtaattttaactagccgcatctgcaaaaatcgtcctccattttcgcatacgactccttaaggggaccacacacaaaaatcgatgttcacagacgagcctcttaaggctccgcacgtaaaaataagcatattttttgcaggcggacctcttaaggggctgcaaacaaaaatatattttcgtaggcagacctcttgatgctccgcctaaactttgagttaactcctcattccctcttaatatttcaaagtttttcatccttatccactcatatttctctcaccttctctctctcacctcctgatgtgccctaacccccatcacatgatgatgagcacatcccagctacacttgacataaacaaggatgatggtttacgtcataagtcacatgaggaaaatgaaaatgacgtaaattatgttgatggattacgtctcaacaagaacgatcaagcatatcatggtccaattacgcgcagccgtgctaggaaaatacaacaagaggtgaactcactctttgctcaacttaatccaaattttatactacataaatgctctacatttgtattgctcaagtttacgcccgaggacatcatcactacggcaagaaggatgggttacgttgaggacgataagggttacgtcgaggaggaaccagcccatgccaaaccagtagctgtctacgctaacaagaagatggtttacgctgcaaaaggatcaacttccaaggcttgtgcgacccaaccagtcaactttctccatgcttaatatatatggttggaaagataatcaagtctagtttcacctccaacaaacggctcgtcatttcgacttcccactaaggagttatggacaaatcattgaagactgctcagaagccaaacagacgcgcgagtcttctcgggaattcacttattatgacctttgacctagcctatgtccagtaaactcccaagacttttcattctcatctaggagggttgttcctagtataaatatcccctatgttttatcatttagaagacttttggacagtgaaaatatgaacaccttttgttcagctgtgtgctaataaattcagagagagatctctacccctttgctcttgtgatttccttgtgagattacagaaacagcgttcgacgccccccaattggtgctcctggtcccttcgaggtttttccttgattgatttaaggttgtattggttggtaaacttagagtgtggttgggcgaaccctcgattcagactgccgtaatagagacggtggttggcttcgagtacgatcgtcaggttgcactgttatcttggctgcttgcagctagttatcttagtctctttgatgctagttattggttcttgatcctacgccgtaaagatcgggacatcagccctaccggggtcacatcatctgatatcagagttttcgttgtcaaaatatcctatctttctttgtgcgtgagttggtgtttctattcctgtggggacccaaaataggacttcctgtgtataagtgctagtctaggatcaagctagcacacacagaaacaaagataatatcacaaccaacatcacaaaggaaacctaatatttaatattaataatgactgtgataagccttatggctaaagtttacatttattctgccacgaagggcctaaggaaaatattaaagtaccagcggaaatatgataaatgcgtagtagctccattcaacttgccacaggcagtcaactgggactcacgacctattcctcgtcttcagcagcaaactcctcaggaaacagcgggaacctttcttctggaattgggggaattggaaggtgagtacatggaatactcagcaagcacacagaaatatgcatatgcaaagatgacaacaaaggcaatggctattttgcataacacagcaatttgcagttataaacaatttataaacaggtttaaaacaatagttataaataacgggtattaccaactatccatccacacaggattcgtccacacaggaccacatagctatattcattaacctgcacacagttcattcccagttttcacaaactacccctcatgagatatcaccgagcatgtccatgaccgcggacgcggctattcgaatagattaattaacactctgcagaggttgtacagcttgacccacaagatacatcgtccttttaacggccatgcgcaagtgtcacacttcaggttgtgtgcggccaaggagtctgtaacaaggctttttagaaactccgtcccaacactgccttcccccatgagacacctttccctcacatagacaagaaagtccccatggcgaacctaaactcctatcatctagctacctgggccaacagtgccaagactcagaatcctactgggccaggttcttcccatgagaacatgtggttgcacgttaggctcagatccatgacttatgaagtgaagtccttaattgaccaaggcaacttgccaaactacaatagcacacagctcaacagtaggctcacacagagaccatacccagcaacgatcacacagatacattaccacctaaccaggttcacactgaaccacccatcaccccggtcaaaaatgttttatccgcccgttgttttacacgttgcaacacatgctaccgaaaagatagcacacagccacacagttcatataaaagtgattataagtatatgattaatcaaaattatattttgcttgtaaaacaaccttgagcgggctaagcataactactctaccatgagttgagcccaatgttcaactcacaaatactagggagacaagatatcatgggcaatcaataattatcaaaggtaggataataataacaattaggtcacgctacccatcgatagtttataaacaaaacaatgcatgtattcaaaacaaaacatttcacaaataggttcaatatgttcaaagagtgcacttgccttgatcccaatactgtccttgcacagcgtcttctgaagcaaactgctcttccgctccaacgtctacacgattgcaaacgaaaaacaaataaacacaaagaaaaactaactaaataacatcatatgaaataaccaattaaaccaagaggttgagctcgattttagaagaatttaggaagaagaatgggtcgaatcggagttcaaacggaaaagttatagcctccggaagtttgaattcagggaaaatccgaggataaaagaaaagggaatattccgagaatattctctggatttttaatttcagaaattgaattaattttggataggaaaatatatgtgggcccactatcagtggcatagagtgtatgggtgaacttggtgtatgtgaactcgatgacgtggaacgacacgtggcgacataaggcgatgaggtggcactgacatggatggatctagggctgaggtggcataggttagggattatgtagatccaacggttgggatttgatctagggatttggacggctgtgattatttggagtttttggatggcaagtcccacacgtcagtgtcacagggaagaggacaagcagcagctgctccaccacaggcctgggcgtgcccggccatggcggcatggcgactccggcacagcgacgtcggcggcgttctccagcgacggcgcgcagctgcagcgacgagcagctacgtcggcaagagaaggcggaggcgaatccggtggcgcagcaccgagctccgggacgacgtggagatgacccatcaatgacgagcggcggttgccggagtggaggaagagagaggaaaacggcgcggaaggaaaagaggctcggcctcagggctttaccagcggctgcggtatggtaggaagatggtgacgacgacagcgcggctcccggcggcggcacggagcaacggcggcggcggctgctcacggtggagatggcggcggctttgaaaaaggggggaaaaggggcggtggccgacggtatttatagaggaaggagtaactagggttagggcgcacggcgcaagctttggaaaggcggcagctccgaatttggcggcgcggcttgcgggatttggtggcgcggccggcgcgggctcggtcggcggcggcttgggccggcgacacagagaggaggagaaggccgggccggggcggcacgtgggcttggggcttggcttccccaggcctgcagctcaagaaggagagagagagctggaggtagaagaaggtgggggaaaaagaaaaaaagaaagaagaataagggctaaactgcaaaagggtagaatagagaaaaagagaggaaggaaaaagggaaaaagacagggacttctctagaaaattccaaatataaagtatttggaatttttgggaaggatttagatttgaaaaggaatattggatttggatggaatttgaattagggattgagcttcacttccgaaatacaaattaaatccaactaactgcaattaagaatcacaaagcgaacaacgtaattaactaattaatcattttaaaaccttttgatttaacgaaattttcattaagctattttagacgaataaaccaaatgtgaattttcacaaataggcgagaagaacagaaagcgaaaaatcaggacgtgacaattccaaaccttttggatcagcactaggcattgaacttctagtttgaattgttacttatctttacaacaactagatttcagattgcttagtgtaggtttaccccaccaagctccacaaagaaaccatcgtttacgtcatcttggtcttttgttcgcttaaccatcacacttttttccaccacacatatacttctgtaacttgcaaggaatacataagagcttcggttggtaagagaaggtgaggttgtgacagtttccacatattttacaattccacatatattttgttttgccacttgtgttctaaccatgcaagaagatgtctgaaattaatccggaggattgtgttaccatggctcaatttaatgagttgaggcgtaacatggaggcaagacaagatcgaatggcacaagatgttcaaaatattttgggtcattttgaaaatattaatccttttggtggagatgcaagtgtgcacagtggagaagatgaagaggatgataatgatgatttgccctatcgttttggtcgcataccacggcggagaaataatgatgaagagaggcttggtaagctgaaattcaccattccaaagtttgatggtggatctgatctagaggcttatcttatgtgggagttgagggttgataaaatatttcacatccataattattccgaagagaagaaattggcatggcttcacttgagtttgaggattatgctctaatttggtgggagcaattgatgaatga

SEQ ID NO: 52323 - DNA, 1666 bp, Oryza sativa
aggattatgctctaatttggtgggagcaattgatgaatgaatgagaagagaatggccaagatgaaatgaaggctgcaatgagagcaagatttattctgaggcattactgacgtgatctttttgatagattgcagaatttgaagcaagcaagttggtatgatgaggaatattataaggagatggagaatgccatgatccgagctaatatttttgaagatgaagagcaatccattgcaaggttcatgtcagggttacaccgggatattcagcgaattgtggaatttcagtcatatcgtaatcttgtccagtgtgtgtatcaagctagcaaagctgagcattagttgcagcaagatgccaaggcaagaaagtcgagttcattcagttccgggttaccccaattggtaacaagtttacgccaagagccaatgtgaattgaggtaccaccataaactcgagtggtggtttacgctctaatgtttctagtttttctaatggcaaagaggctgtcatttctagtgtgaagagtaaaccaacggtctcatctactacctcaattggctctacttctaggagtcgagatatccaatgcttcaagtgtggaggccgtgggcatgttgttagagaatgtccaaacaatcgtgccattattgtgattgaacatggagagtttgattcagctagtgaggtgtaagaagatgttcttgatgatggaaatgaagatgttgttggaaaaaaggatactcaatgtgagtttgaataaggtgctgcacttgttgtgactcaagttctgagtgtacaacttaaggatgctgaaaatggacaaagaaacaatctttttcagacccgagctaaagtgggaggaaaggtgtgcaaggtcatcgttgatggaggtagctgccataatcttgcaagtaaggatatgtgtgacaagcttggtctgaagttgttgcgacacccacatccatatcatgtccaatggctaaatgatagtggagatatcaagattgggcatcgggtgaaagtttcttttaagattggtgaatatgaagatgaggttttgtgtgatgttgtgcctatgacagtgtgtcacttgctgctgggaaggccatggcaatttgatcgatcatcacggcattgtggtcgaacaaatcaattctctatcaagtggaaaggaaggaattttgtgcttaagcccatgacacctcaacaaatcatggctgagcatatgcaaaagagttctgaagttaggatagaaagtgagaaagaaagagagcaaaataaatttagtgacatccacaaatcggtgagcaagagccacaagccaaatatgagtgataaaaagaaaagagagggtgagaactttgtgatgttagccaccaaatcagaaatgagagatgtgagaaataatctggctcaagtactcattgtacttgtgtacaaggaagtaatgatttcagctaatgacttaacatctcttcctaatgttgtttctaatcttttgcaggagtatgaagatgtttttccaatggaaacacctgctggacttcctccattgcgtggcatagaacatcaaattgatctcattcctggggctgcactacccaaccgagcaccataccgcaccaacccacaagaaacaaacgaaatacaaaggcaagtacaagag

SEQ ID NO: 52324 - DNA, 2116 bp, Oryza sativa
caaatgggtagaatttattaaacatttccctatgttgttaagtataagaaaggtaaggaaaatgttgttgccgatgctttgtattgaaagaatgttttgttgaatcaacttgaggtaagtgtgttgggacttgagagtataaaagaattgtacaaagatgatcttgaattttcataaccatatgcaaagtgtcaccatggaaaaggttgagaaaaatatcatgtgcatgatggtttcttgtttcgagctaacaaattatgtgttccaaattgctctattagactcttattgttgcaggaagcacatgcctgtggattaatgggtcatttaggatataaaaagatatacgagctgctgagcgatcatttttattggtcaaggattagaagacatgttgagagatttgcgcagcgttgcaccacgtgccataaagctaagtcaaaactgaaccctcatggtttatatactccattgcctactcctagtgttccatgggaagacatagcatggattttgttttgggtttacctaggactaagagggggagggattcaatttttgttgtggtcgatagattctcaaaaatggcacattttataccctgtcatataagcgatgatgcttcccatgtagctgatttgtttttcagggaaattgtgaggctgcatggagtaccaaagaccattgtgtccgatcgtgatgtgaagttcatcagctatttttggaagacattatgggcaaaacttggaaccaagttgttgttttctacaacttgtcatcctcaaacagatggtcaaactgaagttgtgaaccgtacactatcaacgttgctgcgtatgatgatcaagaaaaatttaaaagagtgggaggattgcttgccacttgtggagtttgcatacaacagggcagtacattctaccactaacatgtgtccttttgaaattgtttatgggttcaaacctactgcaccaatcgatttgttacctcttccattgtaggaaagaactaacatggatgcttcgaagcgtgctgcatatgtgaagaagattcatgaaaagaccaaggaagaaattgaaaagaaggcgcgcagtaatactgcaaaggtgaacaagcatagaaagaaagtggtctacgaaacaggagatcttgtttgggttcatctacgtaaggaacgatttccataaagacacaaatcaaaattgatgcctcgaggagatggacccttcaaagtgttagccaaaattaatgacaatgcatacaaaatcgaccttccgggtgaatatggcgtaagtgcttcattcaatgttgtgatcttacccattttatggttttgatgaaacagagttcaggacgacttcttttcaagagggggaggatgatgtgccccaacccctgtcacatgatgatgagcacatcccagctacacctgacgtaaacaagggtgatgtaaacaatggtgatggttcacatcataagtcacatgaggaaaatgaagatgacgtaaatcatgttgatggattatgtctcaacaagaacgatcaagcatatcatggtccaattacgcgcagccgtgctaggaaaatacaacaagaggtgaactcgctctttgctcaacttaatccaaatttttgtgagaattttatactacctaaatgctctacatttttattgctcaggtttacacccgaggagatcatcactacaccaagaaggatgggttacattgaggatgataagggttacgttgaggacgataaaggtacgacgaggaagaaccagcccatcccaaaccagtagctgtctacgccaacaagaagatggtttactctgcaaaagactcaacttccaaggcttgtgtgacccaaccagtcaactttctccatgcttaatatatatggttggaaagataatcaggtctagtttcacctccaacaaacggctcgtcatttcgacttcccactaaggagttatggacaaatcattgaagactgctcagaagccaaacagacgcgcgagtcttctcgggaattcacttattatgacctttgaactagcctatgtccagtaaactcccaagacttttcattctcatctaggagggttgttcctagtataa

SEQ ID NO: 52325 - DNA, 4154 bp, Oryza sativa
ggcggtggccggcagtaatgcagcatggcggcgggcaattccgctagtcgaaggatgcgacggcggctccaccgcgctgatccggcggcagagagtggacgacccccacctagatccgacgacgggcggcggacgacgagcgccgcccggatcgggcggcggtggttagggtttttttgtgatttttatttttttttggacttttatttttgagtgcaaataacagaaccactcgcacgtgaaaatccgatttccacgtgcaggtgcgccacccacatgaacaaatagcgattttggagaccatttcgagcagacaggccggagttctgctcgtcaaaataatttttaacccgtctggaaaaattgtttttgtatggaattagttcaccggctgtccctcaactttacgtcaagtctgtatgacatccctaatccccaatataaaaaatcttcacccctaaattatacaaaaccgtgcaatttaggtcctatagcagtatgtatctctggttacgctaatttggcatcctagtcagtaaaaaaataaaaaaaattatggggcccacatgtaagtgagaaaaaaaatgtttggtctgtgttggtatttcttaacgacattactataaatataattcccagcaatggcgccagaaacactcatggtatattatggttatagagttcatccgcaaacgcacggatataccattatagcatttcacccgagggtaatccaagggtatcgtatttatttaatcccatgagaagatcatggtagagagaacttgactaataatttatatgttacttgtaataatcatagtctaagtagtagttaatataatccaagggtagagtgacacacaagcagggagctactcattctcataaaatatctaagctaagtggaaagaaaagagaaagagaatccacttctacatacatcctagttatccgatatactagctaataccctctatctgatgccgtcctggtacttcgagaagccacccctgactgtcgacttccttacgacagcccatcatgaccatacaaccggggctaaatacggaggagtaccctccccaggaaattaatttaggactatatacacgcgcgaaggaatacccgtactgagctgtcaccatcagcagcccacctctcatccgcagcatataaccccaaataatgatatcctgtagtctagacaccacgcctaaactaccatatactactctaatatcatcgtcatgacagagtaattgcataagcaaacactatacccgtaccaaagcctctcccagataagctagtagtataatcagtataacatgaacataatgtaaagttggcattcatatactcagtaagtattccaataccataaatgtataaagaagagtattctaaataaaatacaaagcttacaaaaaaggaaaggaaagctactacagccatacccgaactcttccgaaggcttccggactccgatttctactctattcctattccactagcttaagactactaaaataacttaagagaatatgagagagctcttgcttgaggtgtgtgagtgaaatgaggttgaggtgtgtgagtgaagtgaggatgcgagctctttttatagcctcccaatgatggttgtgacgtttggaaaggtcggtaatacccaccaaccgtcattggggagctatctcagccgtccaggagaaacctggatcgaacggcgttgcggggggttcggccgaaccataggtcgggtcggcctggccaaaaatcggcatgtggcctccgttgctctcctacacagacttgtcaattttggctcaattgatcgtgtcaattctgagttcttggcccattcatgcataagtctgatttgatgtcgattctcttccactttatggttattctctacaaaaggttagtgaaccaaatactagtggaattttctcttcttttctttctattattctggtctcttgtcttctttagcgagcgaggctgccggtggcagagggcgaagcagcgacgggcggagcaatgcggctgcaggctagtgaggcagagggcggcgggcgaacggggcagtgggaggcgagtacagcggcggccatggacaccagagccgcccgtccttatcggtcgtgcgattgctgcccaattccgacggcgcggggatgacttgggcgacgtgcaggggaccatggcaggcgtgctctcctacatccactatgccctccctgaccccccccctgtgctttgtcgccgtgctccactacgtgctcgccccgcatgacgccgttgagtgcatcagcgcccttcccgtccgcgcaccaacctggcacccgctctagcgcttcacactactgcctacctctacaaacccgtggcatatagcatcatttaatggtatctaataatctaagcaccacgcttacattactaaacactactctgcatgtctgcatatgacatggagcaatcatataaatgaacattaaaccaatacaatcgcatatctctagtaagctagctacataattattatgagacaagtatgaactaaaatcggtactcaaataattatgtaaatgaagtaaagaaccaaaactatataaagaagaatatttcattactgaataaagtcttacaagagagagagaagctactagagccataccggagttctccggaagacttgaagaactaagagactattctatctctactccactagcactagaacaaagtaaataaactagagagagcttcttgattgatccttcttgatgtgtgttgaaccggagaaggtgagctccttaaatagacttcatatgacggttgtgaccattggaattgtcggaaataccccgcaaccatcattaagaagcaaccctggacgtccacgtggaaggacgtccacgtggaaggccaggatcagaggcgacaatggcggtttggccgaaccctagcccatctggcatgtgccttctccggtgatccgcttgatggattctaaactcagtggtatggtggttgggccaaatggcaagtgttctaatgggtttgtgggcccatttatccataagtatgccacacgtcgagttctaattaattagacggttattttccattgtttcttctccatttatatgaaggtctcatgcatacaaatacattgccaagtacaagtggaaatagattattcttaatcaaatatgcatgcaagcaggctccactatccgccgctttgcctgcctgctccagcccctcgccgccgcccactgccgcgctcgccggccgttgcccccccccccctctaccgccggcgacctcttggcgctcgcccaccactacccccgccctgttccgttgagcaccgctgcttcacctgcctgctccagctgtttgccacccccgctattgtaccccgctctacggcaaagagaagaaagaaaaagagaagagaaaaggagaggaaagaagggatgcaaaccccacattatttattcatctcagttacatgcaggcccagattgctgattaggatgccatgtcagtgaaaccacccatatatactgctatgggacctattttgcatgattttgaacatttgaggggtaaacatttctggtattggggattagggatgtcatatagactcaacgtaaagttgtgggacagtaggtgaatttattcctttttgtactagtgtccaccactgcagtccatggtggcgtcaatttctacacagtggcacacgtacaacgcaagcagataggcctaatcgagggcgcaaacgtggggataggatttggggtggcttggggcgacacctagtggatggtcaaggatcgggctcgtgcaacagcaacgacacgccacctaggacagggcatgcctaggttaggcggctcgcgcacgtgctatagtggcgcggtcgccttgttgttaggaggtcataccgataccgtgcgctaggtagcctcgaggtcttctgggcgtagcagccagccaaccaaggcaaaggcacctcagcagcagtgtcgtgtggcccaaaacctatagcgagcgggcacgacaaccaggaaaagtgtgtgcaagtgggagaaaaaggtggggagggtggtcgggttctcactgtgtat

SEQ ID NO: 52326 - DNA, 3040 bp, Oryza sativa
  unsure (1)..(3040): unsure at all n locations
nnnnnnnnnnnnnnnnnnnnnnnnnnnnnnnnnnnnnnnnnnnnnnnnnnnnnnnnttgtgccatcatgttcctggtggatgtcggttcgggttgtggtcctcgcttgccccggcgttggccttgcagaccgaggttgcgcttagcagggcagctacgacgagcatgtcggcacggtggtggtgggcaagctgaggtgggagattgcgtgggaagtatggatgtgttcgacgcggtgggtgaggaggaaaggcaaggcgacgacgcggccatcacctttataggaggcttcggcgcgcggtcaaagcatgtagcggggctggcgatgtagttgttggccgtcacagcgtcatcctcgttcctcaaggtttcgccggtgaggtatgggacacacatcggttgggcggactaagaacgcacggagtggtgcacggtgagcttgcatggcggtggctccctagctagggttagagctcagcacaacaattattgacggcaatgggcatggttgttagggcgtatttcgttggagatctcatcaacagaaggagtagcattagtcccggcgacttaccggtggtggtggtcaactttcgtcggggcgtacgggaacgagacgaggggaggatcagctcagctcggcggctcgactagccagaaaatgccacaattgggcaactaagctggtccggcctagctcggctaggcgagaaggagactgaaaggaagagaaaagggttgagggattggatttagaattataagggagttcaggaagatcagttgggaggtttgggtctcggtaggctaggctagacccaccagggagcaagaatagacttttgctgttaatttcataaaatagttccttcatgattttgttttacataaaggttttgaaaataatattatttgactttcaatgataagcgtgggcagaaagagaaaaattcggaaagaaccagcgtgatgcaagttttcgcaaaaaacgttaaagccatgatttttattttctgaattttatttatgaaaatttcatggtgtaacaggtggcgagggaattgggagagcgagtgtgcctggacagggtagtttctcaagagttcctcgacatgataagtagtttgcttcgggttagattcaaatcaacctgataagtagtgtgctatgatgagtttctcaagaattgttgggtacacttcactatacgtacatacgtacttaaagtatgatttatcttttatatttgcactaatttttcaaataagacaactagtcaaacattgtatgtagtgaccactaatttggaacggaggtagtacaaaatattctacttcaaattcgatagattttcacaaaagtcttcttgtgagaagatgtacgagtgattgatagacaggatgtacctgttgctaattgacggaatcctccctaacatcggagacccagctcaggcatggtggagtgtcaaagcatccggccgacttgttccacgcttcaattccatccatccccacgagctgtctacattccgatccccatcccgggtctccatcccaaccaatccatcatcgaaaataataaaatcaaacacagagatagagagagagaagataaaaattacgaacacgtatgtccctactgtccaagatggaattaggtgggcaatcctaattattgtgcacttgatccagacaagtcaaacgaaggtgggagggaggaagcagcttcgccgtgccgaactacttcgtacgtactattactagtatttccaatcaacgccacgctgtccccaacgaacgaaacgaaatatacaactagtttccaaggagagcaatcatcgcctacatgttacactcggctcgtcatgtgcggatttaagccttagaacaaaaacttgtatatgttaggtgctagctggtgatcgcagctggttggtacctctgggctaagcttctctcaggagtccttgcgtgatgtcgtcgacggcgtacacgcggccgtccaagccaccagggccggccggagagcggaggcctccgcggctagccaaggagcttggcaggatcgagcccaagaagctcgggattgggctggtcgccggctgctgcctcgctctcctcacctacatctcctttgcccgccttttcgccatctactcgccggtcttcggtgcgccacttaattatttcttgttctcttcgtgtgaaactctctttttttttcatacttactgctacaaatttttcgaaattcttgttagagagcacgtccttggtgatgaagaacgcaccacctgcgtcgactcagcagaaccctgtgctggctcaacaacagagcaaagaagaggacgagaaagatgttggtgaagatgagacggaccggaaagtgccaagctttgcggagacgacagaaaagaatgaagaggaggaaacagtaacgaaaccatgtgaggcttccttttttttatcgctgtttagcacctcgagtggaaaagaaaattgaacacagaacagttttaatactgacagcatctatctttcagaatccgatccccgcataaaaaagcgtagctctaattcggaattcggttctctcgtcttgtaatttcgttcatgtaggagtttcatccatagtagtactaattaagatgctttgtctgtgattccgacagccggggacgaagctgaggccacaatctcctgcgatgagaacggcgttgatgagggcttcccatatgcgcggccaccggtctgcgagctcaccggcgatatccggatcagcccaaaggagaaaaccatgttcttcgtaaatccgtccagcgccggcgcgttcgacggcaacggggagaagaagatccgaccgtacgctcgcaaggacgacttccttctcccgggcgtcgtggaggtcatcatcaagtcggtctcgtcgccggccatcgtgccggcctgcacgcggacccacaacgtcccggcggtggtcttcttcgtggccggatacaccgacaacttctttcacgacaacacggacgtgatgatccc

SEQ ID NO: 52327 - DNA, 2568 bp, Oryza sativa
ggcaagatggactggatggccacaaacttctacgggcagccggcgcgcgacatgcggctccggtacgtcgagtattacgtctcggaggaggagacgacgctcaaggacaagtacccaagggaccactacgtgttcaaggaccccatggccatccacgcgcagggctggccggcgctcgccgagatcgtcatgaagcaggacgtcacggtgaatgtgacaagattcaagccgttcctgctcaaggcgctcgacgaattgcaggaataggaggagcgccgtttgattggttttgtgtgggcgtggctcgtccataagtgggatgtaggatgttttgattttatatttatattgtaatattgagttaatcaatgtaatttatttcgttggagattcatggtgtttgtcattcagaaaaatatgatttcttctttttggttgttgaatgtaaaagaaagaaagaaagaaagaaggaaaagcaatgtataaatttcagcattataaaaaaatatatatatacttcagcccaatttatgttcacacgactattataaataacgggcttaagtagtgttcttctttttggacacaaatgtttctagctatacataacggaggtcatgggatccccgtccctgaattggactgaatcgagatgttaacagtttcttactactacatctattctagaacgtagcaacctaaaaccgattttgatacatcataataccatatgtcaaattcaattataggttgctatacttaggagcagagggaggacaattgtcacacccggagattctgcttttccgtagtttctaattcaccaataaatcgtctacagaaattactttagttaactagaagaaaacccaaattaacaatgtatttaataatcgaaaatatcagggagaattttcttcgaattctctttttgctctaaaatcattacaaggacttaaccgaaatattcagagcatcggagttaatgatgttataaattgtcaatatttgaattaataatattttttctctcccgcctttcgtcgagggtcgtgccctattcactcccctcttcttctgcggtttcgttttgcatgatgagccaggtccgattttgttcgcggattccgtttctgttcttttcctaaaatggcaccgcatttcttttccaatttaggaaagttttttttttgacgtgaaacatgtaacatcctgatctttcgtttcttttaaaaacctattttaaatacaaaactattttcaaaatttggttcttatttgaatattagtgtttgtgccattaaagatctcaaatctctccttccaagtccacaaataaactcccagaataccaaactccacattcccttttacagtccatttacaatctttgaatccaattccaaattcctgattcaaattccaattcaaatcaactttgaaactcctaggaaaaataccaaaacttcctatccttttgggccatcaatcctctctttccctctcttcccttccttgggccagcccccacctccctctctcggccggcccatttcctccccctcagcccacaaccagcctggcacatctccctcttcttcctccctacccagcagccatcctcacgcgcacgccacgtgctcgacgaaatgccgagccggacgagcgacgcgtcgagcagcctcgcaccctccgcacagggccatgcaccgcccgagtcattccacacagtgccgcatcacgttgtgctgcgccgcgccgcaacgaggtttggatgagctcccttccttgccctagaagcccctccacagtggccaacgatgtcgacacccggccccatgtcgacgccgtctgcaacgccgctgctccccatccaccatatcgcctcctcgagctcgagcccagctgcagcaagtccacgccgcccgcgtgagtcgtgttcacgccgccgcgccgccactgtcgccgtcctgtgccgatgttgacatccgcctcgccaacactgctacacccagtgcaaaacctcgcattctcgccctccacctcccgtagtcgtgagtccacacattcggtgtgcgctgcgtgcacgccgcccacgccctccgcgtcgccactatgccaccacagtgccgccatatccattccttgctacttccttctcttcgaagccactgcaacaaaattgtcacttcctgttaaattcatcccgaaataaaaatcattctctaaaaaaaataatagaattaattaaaattcgaaaagaaattagcaaaccttaaaatgcgtacaagaaaatttcgaatgtggtccggaggatttttgttaaattctccttggtctaaaaggagccctcaaaatttacttgaattttcagaacgccggaaataattattaagcaacaacaacaattaagaaagtttatgaaaaagaaaactaaaaataatcctccttttcttttgggccaagtctagcccaaagttcccctcctccccctcggcctgcggccgaagtctctcttccgtccctctctttttcctttcccatctctctctcgggccgcccctccct

SEQ ID NO: 52328 - DNA, 738 bp, Oryza sativa
  unsure (1)..(738): unsure at all n locations
caatcgcccggaacggccgcgccatccccggccaccttccatggcaccggccgtgtttcccgtcgccgttccgccctctcctatgcccggctccctcccctcacctataaaatggaatcccctccttgtgttctctcgtttttgcctcttctcgagtcttataaaggtccctagccacctcaccgccgtcctcctctctctcccgtgccgccggccacctctaaccgcctctccctcttcgcccgtgcgccgaccggccgtcctgtcgccatcttcggccacgcagctgcctcctcttccccggtgtgtcctccgttttgcacggagaccaccggagacacattcctgccagcgtccagtggcgttgccaccattgcaccatctccanccgcccctgtcgtcgcgccagatcgccagccgacgtctccatcaccttccctggtactgcggcatcgacctccaccccggcctgccctcggtttcgtccgaagaccgccgccgcgcgccggcctcctcttcctcctcgttggcatccagtacctctcctccgggcggctactgttcctcaccggtgagtcagccgacgtcgccgtctcctcctccggcatcgcagcggcaaggtagtcctcgacctcacctcccctccatccgaaccccgccggtcttcgtcgtcgtcctctcgtcgttcccggttgcgctcgtcgtcggccctcccttcgtcaagccatgctcgttcgc

SEQ ID NO: 52329 - DNA, 9914 bp, Oryza sativa
tcactaacaaccgtcaacaaaaccccccaagcttgaacctttgctcgtcccgagtgaaggacaaggaaataaaaacttggttgttgatcaggagttgctaacatgatgtatatctcaaaggtataggtgcaaggtatatgtactctctcttagattaaataatctttcgcacgatggcttacccttacccctgattctcacgagacactgcttctccttgccttggacggttgaaagacagaacaacaattagtgtaccaatcacccaatctttattcaacttttattacggaagttttcaaatgatttttgcaaaagaaaaccaagttcctcatatgattcactcagtctctctctaagtgtatcaatatgaattcctcaccatttttgcctttttgattcctactctaaggtttgatatgtggagctggtagggatcaaacatggatacttgcattcacatttattactaagtcaaaaactcagactaaagtagataactaaacacactcaaaatcaagatcgtgcaaagtgtgtgtgatatatggtggaaatggcatatgaagataaataaagaaaatgcttctcctttgtgcagtttcttctctcaaaaatccttcttttattgattaggagagggcatggctatatatatatatatttttcaatatcatgctcatgcttgatagagcataactttatattattattattattattttttcataaccatgcctttccctccctttttttttctttttctctctttttttcaaaaggactttccttttaggagaagaaagcacataaaagcatggagaatttattttggtggtaatatggaaatggaatgaaatagaatattgctagctccaagtgcaggagtttagcatgtgcataattgtgggtgtatggtcttgatcacagagcatgaaaagtatctacacaagtcacaagagtttgacaaagttcaatggaatgacaactaaccaaaatgtatatggttcagacatgatggcacatttttggctctggtagaaatttatatcaaatgaggaactttcaaatttatcattttgtaaaacaaaacatccggaattcaagtcaaactaggattaggatcatagcaactcttatttactatctcataccttgcaacaacttagactcagatcagcaagtgcagctcacttacctcaggttcccagataattgttagctacttatttatttaacctttgagagagtacttacctatggacccatatataagagatataaaacagagcaactatttaccatttcaacaaatagaactagtttgtcttacctagcatgactcaaacctatcctatctttttggtattttctattttgcaaattttttatgttgttttcaggtttataagatgcaattgaaaagcaaatatgcaattggaaagggaaatatgcaatgcgatacaagttacctcagtgatatctccccccaagcttggctttcgctcagggtacttgctaaggagtgaacccctggaagcggaagtacgcttgaaggtcatcatgctgttgctgcatcatgttattgaagttggcgaattgagcatcagcattctgttgccattcttgcatctgggctatgtgttccgtgaggttgtactggatctcttctgtctgcatatcaagggtatccattctccaagtgatttcaccaaattcccaatgagaggaacttgagcgccatccacttggagatggaggcacaccacttgatctgggccgttggttatccccccattgtatgtcatgaggcgcatgccactggtcctcactagcacttgcccagcttgagactccgatgctatggcgtggagcttgggtccatccgggtgcattcccagtttgctcccaacctgcctcatacatctgcacgggtgttgaggatgataaacattctcgttcattccttgccatgttgcgcgtttccctatatgctccacctgcacgagattcttctatggtctgcaggggaatggttagttcatggcagttgtacaaatgataccccgcgttaggcaacgggatctcatttgtacaaccggggaaaaagtatatcaaacattcatctactccatgttttagaatgtgcccttgcactagataattctcatcagtacagggacgagtagatgagatgaaagcaatctggtcactaacgacgcctagacgcctagcccttttgctatctgagtaatcagagaagtgcactcaacaggagcagaaaatcttatattctctaaccattgtcttagcatacatttcacaggagaaactttgatctttctaaccatggcaaacatgataatcaattcatccccctaatgggtctaagatcacctctaggaaacaaagtcatagcaatccacttgtgcatgagcctaagtgtgggattatggatgtcattcgttctaggtttcttgcaaattggagcaccagaaatatcttcctaaaacctatttttctcgaacctagaaattcctttctgaagatcgattttacaggaatcgtgaaaaccaagaagtgtacttaatcctttccatgtaagtgtgtactctttatgcaaaaagcgaaaggaaattccatcttctatttctttcaaaatgcatagaaattgcaaagtaagcagacgagaaccaggctcatctaccgcagcaaatctctgtcaactaacagctttccaaatagtacgaaaatcaacatccatacctatcttttcaagcatccccggagagtattctcgtgtgtgagcatactcctggtcactcagcatgtagtaggcttgtctttccgatcatcgacaaggttgatgtcggcgtcgttcaggaaacgtcacggagcttcggcatcctccatcgagacattagctgatgaacgagcgctagactcgtcatgatgacttgacgaagagccggaccccttgaacaaacgagacagtcgcctcctcattctgcacaatggagcaagaacggactaactcggcgggggttagagtaacaagagtaattgcataagcaagcattatacccgcaccaaagcatttctcaaataagctagtagtataattagtataacatgaacataatgtaaagtaggcattcgtatactcgggaagtatttcaataccataaatgtataaagaagagtattctaaataaagtacaaagcttacaaaggagaagagaagagctactagagccatacccgaactcttccgaaggcttccggactcccgatttctactctattcctattccactaacttgagagaatatgagagagctcttgcttgaggtgtgtgagtgagtgagaaggtgaggggtttatatagcctcccaatgatggttgtgacggttggaatggtcggaaataccctccaaccttcattgggagctaatccacaccgtccagccgcaatcctgcatcaaacgatgccaggggggtttggccgaaccccctggttcggccgaaccaggggccggcccaacctggcccaaattcggcaggtggcctcctccgttgttcttcttcgtagacttgtgaattttggcccaattcatcgtgtcaattctgagttcttgacccattcgtacataagtctggttcttgacatcgtccgattgatttatcgtctgagttgatgtcgattctcctccacttttatggttattctctgcaaaaggttagtgaaacaaatactagtggaatagtattattctaacatatatatgcattgcaagcctaactagttctcctctattttggtaatattgacggtcgaaactgatcgctaacgaccgtcaacacagacgcagaatagaaaatgactaggagcatgcatctataactcatagaacaattagaaagccaagtgaaactcacctcattgcaacttataaaaactctgagatattgcattatcttaaatagtaatatatagatatgtcttccaaaatccaaataatgttattgcgtgtaaaaacaatataagttattagttaatacaagccaataaaaatattactgaaagtaatatatatagataaggaataaggtttagaacatacatggcatcctgtgtatccttttcatgacgttttttcatcttatgaaaacgattgacaattacatcattagtgattgtgcccaacatatccttctctacaaagcaaatgaggatatggctcagaaacttgtcacccatcttgttgtgcaaagcaaactctttagtgccttgttgtgaaaactattacggtcaccaacatgagtcaccaatctctttgtcttgttccaagaatagaaaccttctatgacaaatgcatcatacccatagtgattatcttttatgctgtccctaaacaaatagcaacataaacagtaggctttgtcatctttttcactatactctagccaattagacggattgaactgcctcttcttattcccaatcaacctatacagatattgaaaatcatcatgtggctgatatggtccccaaactaaatactttctccttatatcttcatgttgattgggataataatctgccatctcttccttttactaggatcccaaggaagcttgtccaaatcaattggttgaggcactgcaaaattttctctcggtattggtctagatgcatttgcactagaacttcctctagtggtgttcatagttgatggatttctaataaaaaacttgtccattatctttcctataaaatcatgagaaggttgattagatagagcacatgaggagggagacctagggctagggatccatccactataactattcacagggaagaggagtacttaccagggagggaggcagagaggacagcgagcagagcaccgctcaggtgctgacgatgaagagcgatcgaggaaggaaggaagtagcgatggcggtgaagatgaaccaatgcgggggaagcgcgatgaatgggcgaagaagaggagcggatgttcgacgtcccctcgactcacgcatgcgcgatggaaggaacgaaaactagggggagtggggttcttttttccaaatggactggggcccagaggtcatactactatgaatatacctaggagcataaattttgacatgggtccagggcccccatcgtgtgtacattaaatccacccctgcacgtattcaccggcagcatcattccaaccaattggaggtggcttaaacaaccatttgatggccttatgccagtcagaaataacacacataaacttcccatatcctattactccttccgtagccatctcataaaccagccccaatttgtactatcctccttctccacaattgcaaatgcaagaggtatcagctgattattagcaacataaccacaagcaattaacaatctggcctttgtacctccctgataaaaagcatgcatcaacacttattactggatgcaagtagggaatggcttcaatgcatggtccaaatacccaagccacactttgaaatgatcgccgcccttcctgattcatgggctttgacaaaagaacatattttgtacctgcatttttagcattaatagcatctagaaaatggattctctcttccacgccataatttattataagatattttgagcccataagaaccttcctaactaccgaaaagttgtgctattgctttctctcttccacgccataatttattataagatggcttcgcatttctatatctttgttggactagtgatctcgcgttttttctactcaattccaggtcatcctttaatgcatcacatatcacattagcaatcatagaagatgataactgagcatgatcaaatctatcagccggtgctcgacaggtgtgagcatagggacatttccttatcatccaacctgaacctatttttgttggaattgcatagagtctccacatgtagctattatcagtgcattcagctactagtttagactgactacttgtgctatacttgatttctgaatttttacatatatgaaactcgcctatagcaatttgtaggcgctcttttgaatcaaaagtctttccttgtgctagtgggttagaaaattgattcttacgtccaaagaaactctcgtctgctgttgtcttccacaacacagatatatcactaaatgctttataggattttgtccagatgcacgcataaaaggaaatgcattgacagaatgaacaactcgtggttctgggggactcatcatctgaactattatcaagggcagcatcaaaatcatgctcgttgtcatcatccagtccaaatttgtcctcaccaagatctgtctcctcacctgcatatgtgtcttctgcagcattgtcatcatctatagttggttgtgtttcgcaatccacattatcctggttgacaggtggagacaactgaactgttgttgaatgtataccatgtgctaaagtgggtacaacctttgcttgtgaatgaactctacctggctccaaagaaacacctaaaccatcccttccgagtgcctagttgatgcaaccaaggttgtactattaacctgacttgatcttgcttccgtagaggtgcatttgacataaagctcaacaacctgcccacatttcttctcaaatatcatcttccatcccctatcttcataaataggaatcaattgaaaatattgtggtccaggatttccgatatcaaatcgagattggatactcattggacaattatcctcagtgtacccaagggcttgaaaaatttcttttttgacttcctcaaaggttttaacctcaactgctggaaaagttatttttggaggaatattatattccgcacccttagctccatgttgtattttcccatcaacatacactagaacaataatcattttttctccgccaactctacaaaacaaaccaaataagttagcaaaacaagttatataaatattagttagataataatctacagatatatccattcatgtttaaaaaatgttgttttgcttagtaaaaatgtcaatgaacagctcataagttaagaatatgcagtaccgatccaactacaataacaaatgaataaattatgtctaattaagaaagtaaatgggctatctacaataaagcaaacatgtcaatatataaagtatgtatgaacagctaatcaatgataattatataaacgtatgcatgggcacctgctgttagtgatatgccctagaggcaatcatagagatgattgtatcatatactatgtttacatatttatccgacattgttccttgaaatagataactccttattggttaatgaatatgtgattctttcatgagactctttatgttgtttgttactatttctaaaggatccctgatcaaatatcatatgtggaacaaatatgtttatatgatcagcacatgtattaattgatgatcatgtctcatggatcatggtatagagataccaaattaataatatggacatatgttggtgaacatgttgttggatagacctaacatgagacactgcaagagccatatgtgttgtgtcatcagtgatctcatttagtgttggtgttgaatccttacatctaagattatcatggttctcaacatatgtagtagcttacttagtaactgctaaacgctactccgtaaatgggtagctataaaagtagttttcgggtatgctatgaaacatgtagtgggatatgaataatcaagatgggattttctcctcccatggagagatatctctgggccccttgatgttgcagattatggaagtgcatggccgtgccaaaggtgattgaggagtcaatcacaagttatataatctatcaacaggttcgagtgaatgattgagctattagaggatggcacatatctagccttgagcttaatcgatatcgtgaggcaaaggggttcatacaagtatacactagaggttcagccgatatgatctttatgtatgtccggtgggtcaatacattctgctaggggccgcttgtgacacgtggaccgaaaaggagttttcgggttacagccgagtatatatgaacctacagggtcgcacgcttaatgggccggaataaggggattggatagagatccaatatgagcttaattccgatagggatccgaataggagtcctacgagccttggaggcccgagtgatggatcctatatattcgtgagaggtgtgaccggcggaggcatcgcatcacgtgagaaaccctagccgtcacttccctccccgagcaaaaccctagccgcgcgcgggtgctagcacatctgcgcgtggcgttccgtccctgtacgtgtggataccggtagaggcgccgctggtttgcggtgctgatcggcgtgggagtacggcgaggagaacgcacgaggaggagaaggtcgagccggtgcaatcgactacttcctctacatcgatgcgcgctacttcgcgagagttcctttgacttctcagcgtcttcttccgctgcacagcgcgtcgagtggtaacgatctatgatctaatacttgcatggttccttgtttacgcgatagaaaattttgacttatgctatcgtagtctacacgtatcccaacacctgcatgttgcctcacagcggaaaatgcatgctgatcaatagacgtatgcatgtgtgatggaacttgcagagccgctgttgcctcacacggtgagcagccaacggacgcagcgccaaggacaccttggctggattggtggcactgactgatggtgaaatcgaaggcgctggtgtcgacagcgggagtgacgacgtacggagatcacagctaacacatacgacgatgtgccagcgaacggcgagcggcgaaccctaaacctctaggtcgatcgatttttttcacgttgtgccatcgacgcaataggttttcctttctataattctcgttttgttatgcatttctggtctggctgcaccaacaagctggtgtacgctgtttccagtagcatcgacatctggccgctgtttgaatgcgcgtccaggtctggacgctgttagaaacaccgtccatcctgttttgataaatcctccaaaaaaatactaataatttaattttaaaaatattaattattattaattaagccatctgatagccttgatacttttatctttaggaaaagttcacgttttgttttactagaaaatatatccgtacgttgcaatggataaaaatgttttttcagtggtacaaccgctattagagactaagcgatgaatggaaacattaggatcaatattcattataattgaaaaagttaatgaaaattgttccttcgttttgggcctaaaacctattattttcttccttttcagtaccaacccagtccgctacctccctctgctcgatctgcctttcttcaatctagcccacaagtggagctatgatgacggttgttatagaccaatttcgactgtcaatataactaaaataaaggagagctagctatccttacaatgcatatttattttagaataatctacttccacttgtacttggattttatttgagtgcaggaattgagcaaataaaataaagagaaaatgaaaaaacctcactcctaagcaagcttattgataagatgggcccacatgtcaggtataaccgtcccagaaattgtcataactgtcacaaccatcatagggatccacctgatagtgacccaggagaatttggaggcctgctgggccggcccaggggttcggccgaatgctggcaacgtcggttcaggctagccttacacgtggacgtccaggattgcttgctgaaggcggttgcggggcatttccgacatttcgcatgctcaaccatcaaaactgccgtataaaaggagaagcttattcact

SEQ ID NO: 52330 - DNA, 3847 bp, Oryza sativa
catgagtgctttgcttcgtatcattctacccatataaatgtcttaacccctgcttagactttgattatgcaagtggcatgtatatattattagcatagttctctcttaaaatcttcccttgggattaaataaatatgataccttggaatactccagggtgaaatgctataatgtaatatccatccgcttgcggattccttttgtaaaccatatatataccaggaccatttctagcatcattactgggaatttatttttctagtaatgtcgttaagaaataccaacaagctataggcccaggtcgcacagccgactgccgtcttcggcctccatatagtcctgtggccgtatggcagagccgatcttccccatcaaatctagccaaatcttttttgatctctcaaaatttgttgagggcttttgatccactcgatctcctctttccctttttcccgaaattggaacgaatccgcaaaattcgggatagaaatggctggacggccatcatcagcaactgagattaaatctagttaattaaaactaaattgaaaggggaaatcatgagacaaatgaagagggaggaatggggaatcaatttttgcaatcaaacggaggagaaaacgcatggggagatagatcgaagtggcaacagtgctaggttttggtctggcggcggcatgcaatgcataggatgagataaaaaaccggctaccggaaaatatcagataaaaaacatacaatttttttagtttctcccaatcagatatgcggtaagggcaaatcgcatgcgcaagggcgttgcgggcccaatcgagcatgcggaaaatcatgcgcgcaagggtgttgggggtccaatcgcggcagcgcgtgtgtactggaagtgcatgtaggctcctaattattttgatgattaatgacaatacgattagagaggactaacaattttatttaagtgaatgtgaaggattgttagtccgtgatgatttgtagcgcaatgcaaatcttaatgagtgcgacaaagtcgtgagttgcggcaatgatcaaaggctatattgtgtattttcattatttgggtcattaggaaaaccccacttttaagagggattatgcattgacatattagtaatgatgaatgtgctcaaaacaatttttaaaagtgtttctcctcagtttctgtgttctggaaattttcagagttgtctgaaaaaaattttcggaacttctgaaagtagtcagaaccaattttagcttctagaaatttttggggtttaccgaaagtgattttcagaatttccgaaaatgaccgagaagcaaaataagtttccgtaaatttttggacttgtccgaaactggattttggaatttccgaaaatggcagtgaaggcaaaattgtttctataaatttttggagttgttagaaatcgattttcggaatttccgaaaatgtccgcgaacctgaaaaagaacttctagaaatttaggaatttccgaaaatatccaaaatgttgttttggttctgaaaattttcggacttgtccgaaaagttttcggaatctccgaaaaatcttcaattgacttcattgtttcactgatctggaaattttcagatatgtccgaaattaattttcagaatttctgaaaaatgcaattattgtgcataacgggtagatctggtgatgtggctatatatagcccactctttccacttgtgagggctactgtactaattggatatttcgcgccgttggcttgttcgtcttaagattcagttttgagccttattttcttgtttcccctctccacccgggtttgatttggatttggtgtgtgtgtgtgagagagttgtgcattcgagtttgtgtgagtgcttgttgttggcttcgtgaagatttgtgagcacttgcatcatttccaggagttctttgcatcatttgttactcctagaggttgaggactcctaggcggctaggtgtaacttccgagccaccgatctatgtgtggttggccaggagaagttggtgaaggtcagatctcacctccgaaagggaagagataccaccagtggaaggagtgttttgtgaaacatcttgaggaaagggttagtgaagacctggctctttgtgatctcctgaacggagagtagaatcccctcaaggatttggactccgggaacaactcagcttgcaacaactttggtgatatccattttctcactcctctagctttgcttgattgtgccgctattggtctagttgctatctgtgctagcatattcttgttgtaggcagccaaatctagaatttactttgatttgcgcatactctactattttcggaaattccgaaaatccctgattccgcatttacttgagtttttgaattagcctattcatccccctctaggccttattgaccctttcatggacaatggactcaggcgcggcccgatcgctgtgtgcagcaaggggcgtgtgaaaaggtgcggacccaattgattcgcgcgcgtctcggataagaggggcactatggtgtaagaaaaatggaaagaatttgacagaaacataaaatttaaaccgattcaaacgcggatgatgtaccaaaattctagcggaaatatctttaatttttataatagtagagataacatcaaatgttaacggttcactataataggatcggaagttcctatccgtttccgtttttagcacttctgtcacttctcgatggtttgctgtcaatgttactcatctactttcgtcagaaaaaagggactcatctacacacgtaaaatggcatttgtacccctcctttaaataaagtatcatctatttttgtcacatccatcaatctctctcttgtcgccacacgccagtggcaaccttggcccgcgacctggtgctgcctgctccatccagtccccttgcttgtcgtgtcccctgccgcgccaatgattgtcgcttgccccgtcccattctctcgcttgcagcaactcggccctcaactgcgctctatcgctgcaccaccgccgctgccatcaggagcaggtgtccgacaacctccgtttgtcactataagcctcatcctctgaaatgaattttatttgcttgtcgtagatgtaagccctcatcaatttttcatgtgggaggagtattagagtagctagcagattaagctttccttcgacacgtgcaagacttgaatatcagttacaggaagttagtcatgtaaaaattgttgaagtgtgctgaatatatagaatgaattttgccatatggtgtcgagccaggcatgatgggacagatggcaatggcattgccgcgccaaatggaggtgggtgctggccgccgaatgccgcactagcccttgggctgactgtgagcagccaatttctgcaggggatggcaaggtgcagcagcggcagggtgtctggccaaggttgccgtgtgcgcgcgatggtgtgagagcgcagtcgatcgatgggtgctgtagcggcaggacgttctgtttatcatttgcttagatggaagtatgaaactattaactgggagctagtttcatatgagtatgagtttagagcatttgagatgacgtagagctctagcagatagtcagtctctggagatgtggaacacaactggccgccgccttcatgtggtttgattggtatgtctcaggctaaagttgattggcacgccgagtcccagcaatatatcctatgctccctactcgatgcttcgggtttcatattatgttggatatttgacttgatagggaaatgatgagattgcatgttttattgggaactcatccaactaaatatttatatttcacactgtcatttcaagtag

SEQ ID NO: 52331 - DNA, 1684 bp, Oryza sativa
aattttagttgatgagctagttgtccatcccatggtgaggacacaccaggatgtattcatggagtctccccatgcctctggaattgaatcattggttgcctgctagaaactcgagatctttccatgaggatattggttttgcccattaggaaaaacctcatgatgaacgcagttgaacacctctcccaattgtccacagcacctctcttggaatagaaccaatgcttcagtctcccgagtagagaacgaaaacagacggagcctcatcctaggtcactcctttgatgatgatggtgttgcagagctcaaggaattgttggagatgggcgttagcgtcctcattggctttcccacaggatggggtagcctgtagcatagtgatctgacctgtcttgatctcaaagttggcatccccaaagggtgctgagtaatcacagagggtcttctaagccatcggcttggaatttgatggtgcgaaaatgactggttcaggtgccgagaacctgatttgtggaggaacgacgcgaggtttgactcttctcgcaagtttctctagattttcaacgaaatttgtcggcaagtcgaaaccgttcatacactacctgttttcacaagaagaggaaacaaatcaaggttaacctgtttggaccaaggttcactaatcatagaatgattatgaatgtatataactaaatctttaacaagtgtcttctctggcgatggtgccagaaatgcttaccggtactttttacggccagagataaatccgcaagtgcacagatacggctgtagcatttcacccatgagtattccaagggtgtcgtatttatatttccgcagggacgtgatggtataaagatagagttcatacatccttaatcaagctataattactttacaatagtttgaacaatggttaattgataaatgacaatgagatagtgtgtcacacaggagattcatctctaataatgacacattaggcagtggagaaaaactatagaaagctaaggtccatatatatgtacttctatattaccaatgtttagtttacactaaatacatatatgcttacaaggctaggacttagtctaggcacctaagaactaccgagagaccactcctagttggtttgtcagcgtggtaatggcattttaccaactcttacgtcatacctggacgtggaggaatacaatggatggagaggactgccaccatctaccgcctacctcactttccgtggggcatactcgcatccaatggcatttaactaacctaagcaccatgcatatcttaataaataatttcattaattcccccgggactctcacccttcgaatgaacaagttagaactaatgcaactcgttaagatcattggaccattatcgtagcatagatcaactagcataagctagtgaagcacataaatgaagtataatctattcatcgaacacgtaactagtaaactatgatatgaactatgaacacaatataataaagaagataattcttttattgcaactatagtcttacaagaaaagtaaagtactaaagacatactggaatctatgagaagactacaggaccaatgctgcgctcaaataagctagtgtggcctttcccaaatgctagtgcattgatccccgtcccaggaaaagttggggtacacttcaacaatcatga

SEQ ID NO: 52332 - DNA, 1309 bp, Oryza sativa
atgcaagggggtacaaggagtaataatatagggttgagttttgaagcaaacaagcattcgaaacaattttagttgatcaaagccactttataactccaaccttaagtctaatcatgattattaatcaagcccatgaacccacacgaacatgccttaacccaaggactacgatgagttagaccaaactggcagccttgttgcgggaccccagctcatcccaagccaacctaggctaaccattctaggttttagttgattaaccaaattttaagagggaaaccactaacttgggtacattgtaggcttgcacataaccgagggcacggctattcgaatagattatactctaattagagttgtaaaactttacccaacaagacgcaatcttgacatcatgtcaaccatgaatcgtcgtacctttaaggttcgcgaaaaggccaagattgtgacatagttcttcacctatcctggccttgaacaaaagtaccgacccaactcctgcctatggctgggataggtaggttatgattgagccccaggacatcagaacatccttcgggagggaccacccggatgtccgtccagtgccatgacatctcgattatcgaagcacccgcccgataaccttcatttgtcttagagatatcctttacccgacttcatccatatctatcagtgtcctttcgttcatgactagactgagctacaaagtaagccttacccattagacatgtgaaagtacgacagtgctttgcaacagaggcctaaagaccggtccttatgatggccgaggatcgaccatcaaaaccctgcaccccgagcccagcttgaaaccattttggagattttgaataagggaaggggtgtttgtccaattccaacatgagctaacaattccataatgtctaggtgatagaatatacttcccaaagtctaagattataaagccagcaaaagttgtctagttaaccagcgaagcatctagctaaattcatactagtggagccatagatagagtatacattagttggggttttattttcctatggtgcgcaaggtgataataacaatagcaatggtaagactataacaaagattaataggaaaagctaagtaaaacaatgataacgcgggaatttaaataaagcggtaatacagtaattttaaataaattaatttcaaaatcatgggattcaatatgctcaagaatgatgtgacttgctttgctccgatagaacagtcttctgaaccttcggcgacgaacacgaaccatgctttgggaacgtttggaacgacaggagctacttga

SEQ ID NO: 52333 - DNA, 1135 bp, Oryza sativa
  unsure (1)..(1135): unsure at all n locations
cggcgtctccgccggtgggcgatgcttgagaagaggcagacgcgttcggactcgacctagaaaagaaggaagaggggttagaaggggganaggttgtggacaccccaagtattataccatcagtgtccaacgcgaccaccacatactgttggaggagtgggatccaaacacgcataaaaaaaagacactcatcctcaatgtgtccatgatcacggttgacaccttctactataataaccggaatgccgagtagtgatcacaagagataaccataagataacttgccaggctactccgtcatatgcccgtcaaccacacgaaggtggcgaccagaaaacaaggcataccccagtgcctcgatccaaagcactatcaccaattatctcaagcgatcaaaacccgttactcatgctcagctagtccccaggaatgcgactagcctcacacattcatcgcaagcaattggaacatcatcacaagtgcataaaaaggggttaagtacagcaagtatctggtacataataggatccgaggtcccatctaacagcacacaagtagtagcggaagattcaaacaaaagccagaagcacaaaacaaaagccggtggtgccacaaccccacaagggcaaaccaaccgggcaagagccaagctgaagatagcagaagatcatttactgccctcgccgcccccggcagaacagtgaccacacaggaagcacaattctacgctagagtcctcacctgaaagcagcggagcccgtgtgccgccgtcgctttggtccctgccgccgccgccgccagccttgtgtgcgcgctggccaggccgcgccgctcggacgcccccagccgtccgatcggccctggccgatctgggccgtccacgtggtggacgcgcacccgaggccacgtgtggaccatgtncaccgtgcgcccttcccctttgactcgctgacgtctggggcccgcgtgtcggcgccggcccgccctttgtgacattagcgaagtccatttccttttgtaaaataaataataattgtgcaataaatcgagtttaattctagaaattcatttaaatggctcaaaacttctaaattcatatctaattcatacgaactccaaattgggccattcaact

SEQ ID NO: 52334 - DNA, 6307 bp, Oryza sativa
  unsure (1)..(6307): unsure at all n locations
tctaaaagaacatgaactagggaggttgtcaaaatatattatgagcagaaagcaaaattgaaaatatttctcaaacataattgccaaagagttagcctcacaactgattgctggacatcacagcagcaagaaagttacatgattgtcacagcccatttcattgataatgattggaacttacataagaagataattgccgttttcaaggtcaaaagtcataagggggaagaaattgggaaacacttgcaaaaggtgttgttggattgggagttagacaaagtaatgacagtcactgttgacaatgctagtgcaaatgatgttgctgttagttatttgagaaaacaaatgaacaatttgaatactagcattgcacaaggaaagtacctacacatgagatgtgctgcacatattgtgaatttgattgtttctgatggtttgaaagtggtggacatttctatcaagcgtgttcgtgctgctgttaaattcataaaaaatggtacggcaaggttggtgaaattcaaggagtgcagaattggagaaggtggacagcaaggctttcttgaaccttgatgtgtgcactacgtggaactccacatatgatatgttgaaagctgcctgcacatatgagaaggtttttataaggtatgcagaagaagatttggccttccaaatagaattgcttggtgacaaaggtcccggcgttcctggtgagggtgattggaggctgcaaggaagacggctgactttctaggccattttgctgatataactctccatgtttcagcatcactaaacgcgactgctcacaactttttccacgagattgcagatatcaatattttcttgcttgggcgaaagaaaagagatcgagcgtaaggaatacataaggtagtcatggttatattcgagctagttgtgtactcaatgtcaatgcaattataaatttaaattaaattacagggccctgcaatgttatgttgttcgagtcaatgaaaagtgcatatataagggacagtcatctacaaatggatcagcactgaagagtgcaacggattaaacaatccatgcaatttactctcataatgagcttatctaatgtatacatatccattcattaaagctattcacatgggatgactataaaacatctctctcacctgctttcttctcgattggtttatttccttctaatggagcaaagttacatctctttcacctcctttcttctcgatggtttgtttccttctaatggagcaaagtttctgtttgctataagaagcacttgagctatcaattcgccgttattctgcacatgtgaaaaacacatttgttgagtcatcacataaattcaggcagcaaacaagagtcattctgacctgacatatgcagactgacacatacaagagataacaatttataattgttgccatgtttatctttacgatctgaatatgaaataatagaagattcagatgcattccttttttgaattttcagaaagtttaaaagaataactctgttcttttttttgaataaactgcaagtttgtttgataagtttccttgctatatacaaataatctccaatatgagatctttcatgatatccaaacctaaacaattaaaaatcagcagcctctcaattagctcctagaaaccacagtccagaatagtacactgaaacaacatggaaaacgttgctctgtttttcctaaagtaattatttagtaaaagcttgtactgcttcttctttaaacagtccacaataattggattgtcacatgctacagctaacaaattcaggggagaagcttcgcgacagtccctgaaagagaattttatggcagaaaaggaaaaagaaaatcataatttaccctgaaagcaaatgcagaaaagttattcttttaacaagcctgcttttcggcagttagtcagttactggccaggttttagttggtggaagtgcacataaagcttccaaatgcatacataggaggtgtattaatcaatgaccaactactatagctacagcctaatatatcccagaaagaacacaccaatcagccaatctcatttcaaaatgactgtaagaattcaagcatgaagataaatgccggcagtgatatgatataaaagtctttccccttcaatttgactacacagcaaatctatttcatcagaaattagaaagaaaacccattagatttaactgagaacaagtactatgccacaaatatgcggcggtgtgggagtggacgaccggcgaaggtcaatggcgaagaaccggatctgacagcaatgtggtgactggcggtggcggtgaatcgtgtacggctgatggagggaagctagtcggcaacacgagtattggaaaaagggatgagcggaacgaacatattcgagaatcaacctcgaggtcgacgatcggcgggcggcaatgggcgatcggcgggcggcgtggtcgtggtcgacggggatcgaccggccaggcagcgatggcgcggccgcggaagacggcagcgactcgtggcagtgtcgaatcgggctatgcagcgcgaccgtgagggcggcgaggcgacagtgatctagcgagagatggaacgcgatgcgaggggacgtgttgcgggcttgcggccttgcgggggatttggcggagattgcgtcattggaggggatggggaggaaatcgcggcaatactggcggcacggatgcggagtgggagagaggaaggtgtgggacaggcggatctgggagggaggagaggatgactttagatcgttggatgtgtgatatgatgaatgatgaatgagtaaaactatttgttgaactataaggtagactacggagagggctctgggtccacatgtcattgggttagtgttttagtctctcatctgagcacttgggtttctagaaattatgcataggttctgaacatatttttccatgagtgatacttctacagtttggaccctatgtttcttgctatttatgtgccaccgtccttcttcttcctccagaactaacgatagacagggagagggatggcagttcgtgatggttgcggccatggcgctacagagggcggcgtctctattaggagtaaggagatggtctagggactacttcaaagcttaccctgtggtgtggagattatgggtaccccatacctacacggcatggttatccgactggttataggggataacttatatctatggaatatgtaacagatcatgacttgagtattacgtttccctttatattatggaatggcctaaagtcctggtttgataagattgtaaagtagatttaggaaaccaataccgtattggttaaggtttctatcttgtaatcatgccccccctcctatataagatgggcaggaggccctctagggggcatatgagcacatatgatcgttagatctatactacacccggcggattcaaatccccaaagaggagtagggtattaactctcattaagagggtctgaacctgtctaaatccttgtctccgcatccattcacttttaggtctcgtgcgctacccccttttattattgccgaattcatgtttcgacatgtggctagttggggatgaggcgacgtggagaggtccggcgatgaggctctcgatctggcagtgagcggcgtcgacgacagcagtgctcgggtggatttttcctgcaactgattgagggtgtcgtcttagggaggtcctgggagtgtgatggcacgagggactgagctttagctcaccgaggcagcggatcgatggtgagggcggcggcagcgttgttctagccgacgcgaaggacgtcggagaggcgtcgttgcccctgcggcgttttgtctgaggacaagggtaaaatgggtttagtgagggatgctaagaaagatgacatgaacggtttctcgtgaggctcaccagagggaaatcaatggccacatgggctttccggcactgacatgggcgctcgcgttccagccatcccaagggacttacttccctgggtttgcttggaacgtgaataggcgagctaggagagagtgttggagtaaggggaggcttcaaggtggactttggacgcggtgctcgtgagctcggtctatggccttgtctctggctctccgttctcgagcagcgcggcgatggaacaggacagctgggtgtgtctggagctttgcttcctatccagaaagagtaatggaggaggagatttggttggggcgcggagatttggccggaacaacttcgtctactctcaatggagccgtaatcatgtgacgattggggagaatggcgcgaggtggacgatgggtatggagacacggtgtctaggcccacctgcagcaacttactacaacaaatctgggctactatgacgattacctgatgacagaacacatatctgtcataaacagaggctgtttatgacgactgttcacaggatgacaactgtttatgaccaaaccatgtatctgtcataatcagcgtcacagtatactctgcatgggctctatgacgatagcacgatgacaatagtggatcgtcataaaatatagaactattatatttttagaaacaaacaaaatattgttatactacattgctaccagaccacaaattgtttgtcctaggtggactcttcttgtctacagcaattctagtctcttattttaggatttaggattgaagtcatctctactctcattttatgaatgaaaaaaaaatcaaaattatggcgtttcattttatgattgattgaaaaaacttaaacaacagactaaaatggctataaattggtctaaataattctttgaaatttttcatgaattttcggagtacaataactaattttaataccacaaagttcatttaacttattaaaataaatagaaaacaaattaaaattcctctctatgtctttgggccttttttggcccaagtatttactctctccctccctcagcccgcagcctccctctcccttctcctcccttttcgggccgccggcccagcccttttcctcctcctttaccgacaagtctattttacctccctcctctcaattcaaataacttttcgcgtagtaaatgatttcaaatgaaaaacttgtcaacaacaaagttgtataacttatcaatatctacaacttttgttttggtcatttttctatataactttttttcaataatttgaattcgaattccaaattatgacaacttcaaatactattttcaaatagtaaataatttcaaatgaaaaagtcattaacaacaaagttgtataagtattaaatatctataacttttactttttcattttgctatgtgactttgtttcaataatttgaatttgaatttcaaattataacaacttcaaacaacgttttcaaatactgaatgatttcaactgaaaaagtcatcaacaacaaaattgtataactcatcaatatctataacttttattttggtcatttttttatccaacaaagtgatagtaacattgttcacagaaattagatatctctcttacagtttataaaaccatataagagatatgtaaattttatgaacaatgttactatcactttgtcggatgaagaaatgaccaaaataaaagttatatatattgatgagttatacaactttgttgttgatgactttttcagttgaagtcgttcaataataaaaagttctatttgaagttatcaaactttgaatttcaaatttcaaaatgtacaaataaagtcagatggagaaatgaccaaaataaaaaaaattgcatctcaatgatctgtacaactttggttttggtgacttttccattcgaaatcatttattaaccccaatttttgttcgaagttgtcaaattttgaaaattcaaaattcgaattgttcaaatgaacttatttgtaaaagggaccaatacaacagttgtagatctcgatgagttctacaatttttctgtttatgacttttgcatttgaaacataaaaatcaactaaaatcaaatttaaagttctcataagtttaaggtgaaatgtccattttgtccatgaaatttcgtaactaccctcacaccagggacagtttggtaattcgcataggattgcttcttatccatatactctgttctcaaaaccctagccaaactccatccatccactcacccgccgctaccatctactcactctcctcctccatccactgcgccgcctgcatctccgcccccagccacctnttcgcccttccccggctcactcccccacccagggaaggacagtggcgcgcggatcc

SEQ ID NO: 52335 - DNA, 2525 bp, Oryza sativa
  unsure (1)..(2525): unsure at all n locations
cnnnnnnnnnnnnnnnnnnnnnnnnnnnnnnnnnnnnnnnnnnnnnnnnnnnnnnnntaattcgcataggattgcttcttatccatatactctgttctcaaaaccctagccaaactccatccatccactcacccgccgctaccatctactcactctcctcctccatccactgcgccgcctgctctccgcccccagccacctcttcgcccttccccgcctcactcccccacccagggaaggacagtggcgcgcggatccgccgcctcccctcctcgggagcgacggcggcgcatgaatccagcggcctccgtcctcgggagcggcctggcgtgagcgggagcgccggcagcacgcggatccgcccgcctccgccctccggagcagcggcggagggcttaggaaggcgggagcgagcggctacggtggcggcggctgcggcaacgatggcgatggtggctgcaacaatgacgacgacggcgacagctgcgacggtagctgcgacgacgacgagcgtcggcgcctcggcacaggagctgtacgccgtcacggcggccagcgagtcggcgactaggagcactggaccagcaatggttgcgccggaatgccaaccaaaggtccagctccaagcgtcgttcactcatctgtctatgtgcacggctgacggctggtatattcagtgagtatttctaggatctctctctggtttggtttttctcttagcagagagtgagattaattaaaaagttgaaacctagaatgagtaaactcagttcagttcaaggcatatttttgtgatttgtatgcagagaattgagatcctgtgtctttacttcctgggtcaattagcaatgagtaaaaatgaagcgctgcaattaggaatgattaattatattattgtgaacaagttttttatttgactcaactatactatgacatgtgggcacacccatgacaaaaatctgacccttgttttctgctaaattcaaatgcgctgttaagtttaagtacactgggtttgtttgcttagcttgttcttctgatcgtatagtcactagaacaggtgctttactggtacaggtggacctaattacttttatcataattcatgagtgaattggaggcattgcacaactcaaattgacttgaggatcataactcaaattgacttgaggttcatagcttggacaagtgagcaatccatccaaggaaattaactaactgaaccaaagggtggaatttgatggcaccgcttcttttgggctttctgttttgcaatgggcttcctgataagttctttcaagaaaaatgcatggttaactaattatagttatgaagatgtttgtgcctgcccaaccgatcagagctgttgtttactcctttgatctctactatgtaccaaacttacctcatgcattcttcttgaaaaacaaacaccttttttttgttaatgttaggtgtggtagcattaatctgagctcagtttaatccaagtatatagatcatgatatctccaaggaagaaattttttctagaagaagtaggaagggaagctactgctgcatctccacctcagtctgtcgttcataaagtataaaatgtcactggtaaaagggaagcatcacctcctgagaagaaaggccatggctagcatctctctgactccttttgtaatccaatataatgtctgtcacagaaatatccctttaagaatgtaaataagatgtgagatttttactaaattggctataaacttgctcaaagagtacatgttctttaaaatcatgttccttagaaccctactcaactgacagatttgcctagcaaaaccggttactagtcagaagcttctgtaactctaatgcaatgttgtgatcctttcttctgatcctttcttcatctgtgttgcagaatgtgactacaggaatgagggcctcgggactgcaagatcaggtggcgctggtgagcatcggcgggtggacccctaaccagggcgtgctgcagccggccatcatcgtcaacccttccttctcgcgccacagacggggcctttgccctgggcggccatattgggcggcgtcaatgcaattgagcaaccgcactttaagtacagaactgaagccaatggaattgagcactactgaacaaggcaagtaacttggattcttgttcttttgtccttatatgtgctatgcttcattcatatcaagtgaaggatctttttattgacacatgtaaatgttttatgttaggcaccctcactggcagtagacaagtgcagctaagggggaagagcatgggcactgcaattgacagtgagcccactgcaattgatctctttaaggagttgcattgcagcaaaactaaaggttttagtgaacctgtgaagaaagctatagtaagtattaaactattacttcttctttccttcttttattaagtaccttatgcaatgaacctttatttatataataatgcaaaactgaaaccttgctttgattgctaggaggatatgcatgcacaggaaa

SEQ ID NO: 52336 - DNA, 1946 bp, Oryza sativa
aaaaaatatttgggccattgtaattgaaaataaaaaaagcccatgctatatgggccgaatgtgaattgccacgtcatttgccacatcacccgccttgtcatctgcaacatcacatgtcatcgtacacgtggcgttattcggttcaatttgttatgacgaatttgtctcgtcattcatcaatgacaggagaactatcgtcactgtatcaatgacgatgtcctttggcggcacagaagctggttagcgactcaccttctgtgatgacaaccattttgtcactgcgggtagtcagtgacaggaaacaggctgttatcttcataatgtaatcgtcacagaagcccagaattcctgtagtgttaattctaatggctaggcttcgtggagaaggcttggcgtggtggaaagctgagtggtattgttttcttctccaaaagaagacgcatgccacatgttcgacgaaatgcctacaaggacagggagagaggaagggaaggtgggaaggctgggtggtgaccagggctttcctactggctggataccggggccaaggaaggctggacccagtggaagtgaaatagggtagggtgagagaaggtcaagttgaattttctcaaatttaaatcacatgctcacattatctctttgaccagccatttcaagtgggttactccaaggcgaaatttttggcaaaaatattgtgagtagaggaggtcatgatgaactacatgaaggagaagcaaaggcagaggagttatggttttactgtggtagattttgaaagaggactaagtgatatgctttaattccagtttttgactggtttgactaaataatttgaggtgccaaatgagctgataaaataatgccaatttaattgagggtatagcataatgtatagtaattttgtgaattttttcaggatttttgcacacacatattaattattaaaattattccaagctagtttccatgcatatgaatgaaatgacggatgcatgaaaaatccaaaaacgagcaaaataatctcaaaagacagaggggaccccatttcactgattataatatgtattcaaggttttacaatttttgggtcaattacaacctaccccccttaaaatgaatctcgtccccgagattcgctaggcctaggaaaagaaacttaggaactcggttctaggacggtcctctcgctcccatgttgcttcgtcagcggtatgattgctccactgcaccttgaccatcttgattgtacggttgctcaagaatgcgaatcgggtattcccgataagaaagacagctgagagacatggaagacattgtgcacatctgagagttgtgatggtagctccaattgatatgctacttcgcccgtcgagcaagtatactgtatggatcgatgtaacggggagccaacttgccgtgcacttggaagcagcaagtgccccgcagcggcgagaccttgagatagacaaagtcacccacctcaaagctcagttcatggcggcgacgatcagcatagctcttttgacgcgattacgcttctttgagccgtttgcgaatcaattcaacatgttcttccgcttctttaataaggaatggtccaaagaattgcctttcacctacttcagaccagtacaaaggtgttctacaccttctcccataaagagcttcaaaaggagacatttggaggcttgcttgatagctattgttataggaaaactcggcaaatgccaagcatttctcccaattggtgtttaggacaacacacaagctccaagcatatcctccaaaatttgatttgtacgttcagtttggtctccaatttgagggtgaaaagctgtgctaagaaatagctcagttccaagtagctcatgcaaacttgatggcattatcggccttgatttccccagtaggcgtcgcttcaattcacttgatgaatttgtcga

SEQ ID NO: 52337 - DNA, 2723 bp, Oryza sativa
  unsure (1)..(2723): unsure at all n locations
cctcggtgggcggcggctagggctagggctaaaacaaaaaaaaatgaatggaaaaacagggggtgttctaacttatataggagagggcagaactaaaggaggtgcggccggtgggaggcacgacagagggggagagggagtcggactcagataggggaagagagggaggcgcgtgcacggcaaagggagagggggagcggcggccgatttggaggggacaggaggagaaaaaaaaagaaaaggattaggatagggaatttcccaaattggaaaagtatatatttatagcatagtaggagtctctcatgctgttttgtggcgaccccaaaaccctcgtgggtccggaggccacagtactatacctgtgtaacatgcaccagccccaggatacacaacctggtacacacagaacatcggtgatccaaagaagtctaataatattacattgctgggatagtccttacataagttgccatcgtggacagaccccagatggacaacgacacgacacagaagataataacaaaagcgacaacaacggagtggaagcgaacagcggaaggcgacttaacgactaaatgctagtctaggcacctatgcgactaacttattccacaggcatggtttgggaactaggcccgaaaccctaaaagtcttcatagttggcgtgctcctgaagatactcctcggcggttggatcatatccttcttcttcatcttcaaagcctaatataattatatataaagcaagggtgagtactttcgtactcagcaagccataggaaagatgacatgtgcggctaccaaaggaggataagggttttatttgcgaaaactagccattgctcaaaaggtttctttttgcaaaactctagtgtgtcaagttttaattatcggaaagaggctcatgcctcaatccattccacaagttgctttgtaacaacttgtcacaagtaattagtgaatatatgttcttctaccaacaccttagatcttctcttgcttctccaacttttgcacttgtctccacttgacttctccacgagccgtctcaactcagagcacaatgagccgtctcagctcagaacaccacgagagcaccacaagccgtctcagctcagaacacctctcgaccaaacagtccaactcctattcacactatgatgccaatcgacattccagatcacacggacctgttccaaaccactcaggtttgccgtctgccacacaggctgagtctggaaacgatccccatcccacaaaccaatttcacaaacgtttacaaacaacactacgctaagagaatcaccttacattcgcccttaatcatgggcacggctattcgaacagtttaattaaactctgcagaggttgtacgctttacccacacgacacgaactgacaccggtcacccgtcggcaccgggagttcgctacaaggtttttccaaagctggtccattaaaaatccctataccacatagtaggccgagtctcatgacaagcatcaggcagtctcagccctcgtctactcagggtacactagggacgctcctacacctcatcggtaccgtatcgccacaatagaggcggggccactcacgaccatagatctcatcaaacacacacaacttcgtctcctcatctccagtgtcccactactactggcatacaagataatcaaggactaactaagtactttttcaggggtatcccataatacccgtgtggtcgcatagtaagatgcttggatggaattcccaaaggaatcggtccttaatgacaatacatagccagccacacaggcttagcctacatgccatcagggtttgagaactagttttgcttcgcaaacacaccgacactgaccatcaggtttttgaatagttgattggaattccaagtttcccacacgacaatacattcgtggcatggctaagccaaactaccttgatgctcatacccataaggtaagacgtcgacgcgtaatatgtgaagctatcaaggacatgtcatccaatatccaacagaatataagtgtgactaatcggtaggtccatcggatgcgttcgcaaaccgaggccgaacagtttaacgtgcaacctaagcatgcacatttacaaacaacataattttgcacatataggaagcaatatggtcaaaggtggcttgccttggtcctgtggaggttcttcctcgacgagaacagcttccggatcgtccgcgggatcggcaactatacgcgaaagagaaaaaaacacaagagctaataaagtagctcaaacaataagatactatactgccattagatagatctcatttttagaaaaatcatggaagtggaacggagtcaatcggagtcacggtttaggatatatgaattttcaaagattatatgaatttatgggcaaggggaaaagggatttcttctattaaaaaggaatactccgagggaatatccttgcgtggcccgctgtcagtgacacgggaggagccggcgcacggcggacagtgtccacaggggcgcgacacagagaggtggtggactgggctcgtggtccaccggccggtgcgcgtggggcccagccgtcatagagccggctcacatggaccgagtgtacacacgggtgcaccgagttggatggatacggtgggacccgtatgtcattannnnnnnnnnnnnnnnnnnnnnnnnnnnnnnnnnnnnnnnnnnnnnnnnnnnnnn

SEQ ID NO: 52338 - DNA, 3843 bp, Oryza sativa
cctagaagttcaaagtgtatttaatggaatttgattcgggaatttggaattggattcaaagattgtaatggactataaaagggactgtagactttggtattctgggagttatttgtggacttggaatgagagatttgagatctttaatggcacatacactaatattcaaataagaaccaaattttgaaaatagttttgtatgtaaaataggtttttaaaagaaacggaaaatcaggatgttacaaacataccccccttaaaagaatctcgtcccgagattccgctgctaggagaacagctctaggtgctcagctcaaagacgatcttcgcgttcccatgtggcttcatcttctgagtgattactccattgcaccttataaaactttatggtcttccttcttgtacaatggtcctttccttcgagaatccgaatcggttgttccttgtaagtcagatcgtcttgtacgctgattgcctctaagggaacttgctcttctgggatgcggagacatttcttcagttgagacacgtggaacacgttgtggacatctgtcagtcctacgggtagatccaattggaaggcaacttctccacgtctggcgatgatgtgatatggaccaatgaaacgtggtgccaatttccctgccataccgaatcttttcgttccacgtagggtgatacccgaaggtacacgtggtctccttcttgaaactcaagatcccttttgcgattatccgcatagtcttctggctggactgggccactttcaaacgttctcgaataatcttaatttgttcttcggcttccttcagaatatctggtccgaatatcttcttctcatccacatctgtccaacagagcggggtgcgacacttgcgtccatacagggcttcattggaggccatttgtatactggcctgataactgttgttgtaggagaactctccatacggtaaacagaggtcccaagtacctgcgaaatccaatgcacaggctctcaacatatcttccaatacttgattcactctttcagtctgtccatctgtctgaggatgataagctgtgctgaaattaagattggtgcccattgcttcatgtaacttcttccagaagtgggaggtgaactgagtaccacgatcagatacaatcttcttcggggcaccatgccaacaaactacgttggtcatatacaactcagctagcttcttacctgaattggttgtcttgcagggataaagtgggcaactttggttagtcgatccactattacccacatggagtcataacctgcaggtgttctaggcaatccggttatgaaatccattcctatttcttcccacttccattctgggattttcaagggttggagcaatccagctggcttctggtgctctaccttaaccctttgacatatatcacataaggcaacatactcaacaatatcccgcttcattccagaccaccaataatatggcttgatatctaggtacatctttgtacttccggggtggatggaatatgcggattcatgggcttctctgagtatcaggtcttttaattccttcttgttgggtacgcaaatgcgtttaccgaacaaaacaactcctttttcatcaatggaaaagcttatggctttatctttcttcatattttccttgatagtattgatttcttcatcactttcttgagcttctctaatttgatcttctagggttggctgaaccacttaggtcgctagggttcccggcttgaccaggtttattcccatcttttccaattgttgacggtcgttatcgatcagtttcgaccgtcaatactaccaaaataaaggagaactagtgatgcttgcaatgcataaatttgttagaacaataatattccactagtattaggtctactaaccttttgcagagaatgacaataaagtgaaggagaaatgctacagtggtatgttcgtgcgcttgcggatgaaatctgtaaccataatataccagaagtatttctgcgccattactgggaattatatttctagtaatgtcgttaagaaataccaacaaccacacaaacatgatacaaaagacacatctttattatatcgataatatttacattattacaaattcacttcaggcctgacaatcaaaaataaacagcagcggactagcgggcctacggctccatcttcaaaggcgctcaactagggtataagccaggactccacctaggacttcttctcaaagcttctcttactgaacggggggaaagatagagcaagaatgaatacaaccacagtacttagcaagtcacaccgggagatgcatgattaatgcaagggggtacaaggggtaataataggggttaggttttgcagtaaacaacatttgaaagacacttagttgcccaaagctattttgtaaaaacgatcctagagctacacaatattattaatcaaggccgtgaacccacatgaacctgcctaacccaaggcttacgatgattcaaaccgaactggcaatccgacctgggtcctagctcgtcccaagccaacccaggccaaccattccacattttagttgttaagcaagttttaagagttaaaccactaacttgggtacattgctaggcttgcccataaccgagagcgcggttattcgaatagattatactctgattagaggtgtacatctttacccacaaaacacatctttactctgcattccaaggccttggaacgcgtcgtaaacatgtcacataacccttcacccatgctagccgtgaacaaaagtaccgacccaaccttgcctacggccggtatcccgggacaggcaggccaggattgagcccctagcaacaggacctagaccgggtgcaccacacacataggggtgagaccacctgcgtactagtctagtgccacgacatctcgactaacggacaccggcccgtgtagccttcatttgcctagacatctcgattaccgagccgtaactcgcgtagccttcatttgccttagagatatccatcgttgcaacgacttcatccatctctatccgtgtccttttgttcaggactagactgagcaccgagttaagccttacccattagacatgtggttagtacggtagtgctttgcaaccgtactttgtagcagaggcccgaagaccggtccttatggtagccgaggtgcttctagcaaaaccatgcacctcgagcccagcctaaaaccattttgggagttttgaatagagggggaaggtgtgtgttcaattccatcacaagccaaccattccataatgtccaaatgatatgagaactcccaaagtctaaagttataaaaccatctagtgttgcctaattaatcagcgaagcatctacctaaattcatactagtggaaccattaatagagtacccactagttggggttttgttttcctagggtaagcaaggtgataataaacaatagcaatgatacggctataacaaggattgatagatattgctaaataaaaccatgataacgcgggaatttaaataaagcggtaatgcaataatttaaatcaaaatagttttataaactaggattcaatatgctcaagggtgatgcgacttgccttgctcagagagaacagccttccgaaccttcggcaacgaccacgaactgcgctttgagaaccttcaaaacgatagaagctacgcgaagcaccaagcaaagctacaagcctaaaaagaagcaataccaatacataaaaagaaagcacaaggttctttaggttataacaaacattaagagacttgaacgggtcgattcagagttcgtatgaccaagatatgatcatccaaag

SEQ ID NO: 52339 - DNA, 6835 bp, Oryza sativa
tatttaagaagctcactctcttcatttcaatacacacctcaagcaagagctctctcattcctctcaagtttagtttagtagtatctagctggtgaatagaattagaataggaatcaggagtccgaagccttcggaagagttcgggtatggctctagtagctttcctttcctcttttgtaagctttgtacttttattagaatactcttctaaatacatttatggtactgggatacttcccaagtatatgagtacctactttacattatgttcatgttatactgagtatactgctagcttatctgggagatgctttggtgcggttatagtgtttgctgatgcaattactctatgtcatgacgatgatattagagtagtatctggtagtttagacgtggtgtctagattacgggatatcattatttggggttatatattgcggatgagaggtgggccactgatggtgacagctcagtacgggtattcctccgcgcctatatataatcctaagttattttcctggggagggtattccttcgtatttagcctcggttggatggttatgacgggctgtcgtaaggaactcggtagtcagggatggcttctcgaagtaccaggagggtatcggatagagggtattagctagtaaaccagttaactagaatgtatgtatactatgtatattagaagtataggaatagattctctttctcttttctttccacctagcttagattaattattatgaggatgagtagtaatgcttgtgtgtcactctacccttggattatcttaacccctgcttagaataagattatcacaagtaatatataagttaatagttgagttctctctatatgatcttcccacgggataaaataaatacgatacctttggaatactctcgggtgaaatgctacaatggtatatctgtgcgcttgcggatgaactctgtaaccataatataccagaagtatttctgcgccattgctgggaattatatttctagtaatgtcgttaagaaataccaacaaagctatgggtagttggagggtaaatggctggtttggagtttggatagcaggctggctggctagggtttcatttgattaagccgatatcgaggtaggacgaatattggctggacaaaatatagattttgaatttagatgaatttaggtccaacattcactggaatcggatttacggtttaggagatatgggctcctaaagaataggatttgaattaaatctagaaaatacggaaaggtactttttatgggcccacctgtcagtctttttcccttttctttttctttctcttcttcttcctcccgtctcttccttcttcttctcttccagcacaggcaaacagggaggatggggaggaggggcgccggtggtagagcggctaggaggtggcgactctggaggccagtggtgttcccgagcatcgcgcatcctgggagggtggtggccggcagagggagagaagggtatgtccggaacgggctaggggaaaagcttatctccggcggcaaggagaggtggtggtggtggcttatttcgaagggggaaaggaaggggaagtggggaaatgggtttgcctcgtcgaggcgaagctagtggcgcgagggttgtgccaatggggcaccggtgagggagatcgaccggtggcggcaatggccggatatggagaggagagagaaggagctcggagaactcgatggtgtggagggaaaagaggcgacctcgccagtatttataggcgtcggaggtcggttcttcaagcggttcgcagaggagaaagatgaggaggatacggcgccggtggagtggagaagaaggagacggcgccggctgtggcctgtgattggtcggcgacggtggcggcactactttgcggcgacggcaaggcagcggcttggcgtgggcggcaagttgacggtagcgacggcatgggaaagaggacgacggcgccggcttttgctttcttagcggcgacggaagggagttggcggcggcgtgcgcgtgtgcaacacgtgcaccagcaagaggaggaagggcggctcggctggaggctgggccgtcctaggccgaagaaggagatgggccaaaaggaacaatgagaggagtttcggcccaattacaaaaaggaagaagtctaatttgaataattgatttggattgctaggttttgcaaagaatttgaattcggagagaattcacaaaagagatatcttaatttatttgagtgcaatatttggaggtggagtttgagggaatttatttggaagcactcaaataggaagagaaactaataatattcctcaaaatatttttggtaatatacaagggaattaattgaggggaatagataggatttgaattctaaaattggtattatgtatatttgtggttaaaaggggaagttgagtgaagagtataaattggaattttcttagcacaagagcaattactcacaatatttgcaataatactattcttgtgtcgaagaggaaatcaagccacaaagattaaattggtggctagatccaaaggaggaatttggatatttggattgggaatcaaaggatgggtttaagatcaaaggatgggctaacaattaattccaataaaattggaattgctttggtttaggttttagcacaatataggaaggtttcttggaccaaattcataacagtaaaaagggtttttcaaactaaatttaaataaaggatgttttaggcgaaagaaggttttagattaaaaccaaatcaaggaatatttcaagataaaattttaaatgaaaatcacaaaggcttttgaatatcaaagagggattttatgtaggttagctttaggaggtctcgctaattataatgtcctaggtttaaagtggttattaaaaacataagacccgacatgatgcaagattagaaaatagtaaattttcagaatgttacattcagctacattttgtgagcaaagtcgatgcacgtattcaggggcggactgttggtattttttaatgatgttactagaaatataattcccagcaatggtgccaaaaatactcatggtatattatggttacagaattcatccgtaagcgcatggatataccattgtggcattttacctgagagtattcaagggtatcgtatttatttaatcccgtgggaagatcatggtagagagaacctgactaataatttatatattactcgtaataatcatagtctaagcaggggttaatataatccaagggtagagtgacacacaagtagggagctactcattctcataaaatatctaagctaagtggaaagaaaagaaaaagagaatctattcctatacttctagtatacatacatcctagttatccgatatactagctaataccctctatccgatgccctcttggtacttcgagaagccacccctgactgccgagttccttaggacaacacttcatgaccatacaaccaaggctaaataaggaggaataccctccccaggaaattaacttaggactatatatacgcacggaggaatacccgtactgagctgtcaccatcagcggcccacctctcatccgcagcatataaccccaaataatgatatcccgtagtctagacaccatgcctaaactaccagatactactctaatatcagcgtcatgacatagagtaattgcataagcaaacactatacacgtaccaaagtatctcccagataagctagcagtataattagcataagatgaacatattgtaaagttggcattcatatagtcgggaagtattccaataccataaatgtataaagaagaatattctaaataaagtacaaagcttacaaaagaggaaaggaaagctcctagagccatacccgaactcttccaaaggcttccagactgcgatttctactctattcctattccactagcttaagactactaaactaacttgagaaaatatgagagagttcttgcttgagatgcgtgagtgaagtgtggatgagagctccttttatagcctcccaatgacggttgtggcagttggaaaggtcggtaatacccaccaaccgtcattggggagccatcttagccgtccaagagaaacctggatcgaacggcgctgcgggggttcggccgaaccatgtgtcgggccggcctggcccaaaatcggcaggtggcctcctccgttgctctcctatgcagacttgtgaactttggcccaattggtcatgtgaattctgagttctttgcccattcatacataagtctgattctcgacatcgtccaattgatttattgtctgatttgatgtcgattctccttcactttatggttattctctacaaaaggttagtgaaccaaatactagtggaattttattattctaacatggatatgcattgcaagcatgactagttctcctctattttggtaatattgacgggcaaaactgatcgctaatgaccgtcgacaaaacccaccaagcttgaacctttgctcgtcccgagtaaaggatgaatggaacaaagacttggttgctgattaaggagtttctactatggtgtatatctcaaaggtacaagtgcaaggtatatatactctgtctctgattaaataatctttggcacggtggcttacccttacccctgattcccacgagacactgcttctcctttacttgggcggtggaaagatagaacagcaactagagcacaaatcacccaatctttattcaacttttattccagaagttttcaaatgattttgcaaaagaaagccaagttcctcatatgattaactcagtctctccaagtgtatcaatatgaattcctcaccatttttgcctttttgattcctactctaaggtttgatatgtggagctcggtagggatcaaacatggcatacttgcattcacatttattaccaaatcaaaaactcagactaaagaaaatgattaaacatactcaagatcaagatcgtgcaagtgtgtgtgtgatataccctgtttccacaacaaaagtgaaaataaccaaggttagcctacaaagggcagtgattatacagtggtaaatataaagtattagttctagtaatctctattatgaatcttcctcggcaacggctccagaaatgcttgttggtatttcttaacgacattactagaaatataattcccagcaatggcgccagaaacactcatggtatattatggttacagagttcatccgcaagcacatggatataccattgtagcatttcacccgagagtattccaagggtatcatatttatttaatcccgtggaaagatcatggtagagagaacctaactaataatttatatgttacttgtaataatcatagtctaagtaggggttaatataatccaagggtggagagacacacaagcagggagctactcattctcataaaatatctaagctaagtggaaagaaaagagaaagagaatctattcctatacttctagtatacatacatcctagttatccgatgtactagctaataccctctatccgatgccctcctggtatttcgagaagccacccctgactgccgagttccttacgacagcccgtcatgaccatacaaccggggctaaatacggaggagtaccctccctaggaaattaacttaggactatatacacgcgcggaataatacccatactgagctgtcaccatcagcggcccacctctcatccgcagcatataaccccaaataatggtatccgtagtctagacaccacgcctaaactaccagaaactactctaatatcatcgtcatgacatagagtaattgcataagcaaacactatacccgtaccaaagcatctcctacataagctagcagtataattagtataacatgaacataatgtaaagttagcattcatatactcgggaagtattccaatccccataaatgtataaagaagagtattctaaataaagtgcaaagctttcaaaaaaggaaaggaaagctactagagccatacccaaactcttccgaaggcttccggactgtgatttctcctctattcctgttccactcctttaagactactaacctaacttgagagaatatgagagagttcttgctgagtgaagtgaggttgagagctccttttatatcctcccaattgttggtatttcttagcaacactactggaaatataattcccaacaatggcactggaaataatcctggtatattatgattacagatatgatccgcaagcgcatggatataccattgtagcatttcatctgggagtattcgaagttatcgtatttattttatcccaagagaagatatgataagagagaactatactaacaattcatatattacttatatatgtcaaagtctatgcaggggtcagttcaaagggtagggtgacacacagaagaaagaactaagaaccactctcactaaaatatagtctaagaaaagtatcattcatgtacttctagtatacacacatctttagtctatacttgctagtatacagtcatgcaaccaatacctcgtacccagtgtcctcctggtgtttcgagaagccacccctgactgccgagttctttacaatagaccgtcataaccaaaaaaccgaggctaaatacggaggagtaccctccccaagaaattaacttaggactatatacacgcgcggaggaatacccgtactgagttgtcaccattagcggcccacctctcatccgtagcttataaccccaattaatggtatctaataatcgaagcaccacgcttacattactaaatactactcta

SEQ ID NO: 52340 - DNA, 828 bp, Oryza sativa
tgtagattttgatgagactatccgcagggaatttagatgaacatgatgggtgagttatcgtactttttgggattgcaaattaagcaaacacctcaaggtacttttgtgcatcaaacgaagtatacgaaggatcttttgagacggttcaagatggagaattgcaagccaatttcaacaccaattggttctacagctgtgttggatcctgatgaagatggtgaagctgttgatcaaaaggagtatagaagtatgattggatctttgttgtatctaactgcttctaggccagacatacaatttgctgtgtgtttgtgtgcgcgctttcaagcttctcctcgtgcttcacatcgttaagcggtcaagcgaataataaggtatttgaatcatacacttgagtttggaattttgtattctacttcatcttctatatgcttaagtggatattccgatgctgattttggaggttgtagaattgataggaaaagtactagtggaacatgtcattttcttggtacatcattgattgcatggtcttctaggaaacaatctagtgttgctcaatcaactgctgaatcttaatatgttgctgctgctagttgttgttcacagattctttggcttttatctactttgaaagattatggtcttacttttgagaaagtacctctcttttgtgataatactagtgctatcaatattgctaagaatcctgttcaacactcacgcacaaagcacattgatattcgttttcactttttgagggatcatgttgagaaggaagatgttgaattgcagtttttggacacaaaagtgcaaattactgatatt

SEQ ID NO: 52341 - DNA, 765 bp, Oryza sativa
ttataaatgctctatatatatgctttattgacttgttattcctcaaatagctttaattgctcattgtgaaatagagaataaaaatatgaaaaaaatgaataccgaatccttggaaacaggtcttgacgataagaacgtattcgatgtgagcaaaataatgggtgtcgaatccttggaaacagtcttgacgacacggacgtacccggaataaaagagaaaaaaaatatgagcaaaaaggctcaagataagaaaagtccaaaaaattctcttggttattttgtgctcaaggttatttgagaaagagtgataaatgcaatatgaatttttgattgttgattcaagcttaattgtaaaatttttgtttcatggttatactttaatgcatgcttgttatattatagatgggtttatcttctttttattgcaacacatgacttgatatgctatatgtatgctaagctcttgaacattaatgagcataattcctatgcttgatgaaatcattgtcaaaagggggagaaataattgtaaaaatttttggagaagcaaggtgaatttttgaggagttgttgagaagagcatgtttttaattcaattgggaatttctttcttttaaaagggggacaagttttcttttggatttttgagcacgatgtgtacatttgtatgaagtgtgctttttaccactttcgtttttatttttccaaacaccaaaacattttttataagtttgccaatgtgttcatcaagggggagattgtgaaa

SEQ ID NO: 52342 - DNA, 832 bp, Oryza sativa
tcgtcaaagtcactctcctcatcatccgagtcgtcatcatcatcgtcgtcgtcatcgtcttcttgagcaaactcagtcgcagatgccgctgccagatccaagtcagcaaagacctgagtgttgtcaagccctatgataacatgctacacccatgaaccatcatccaaaacaagaattcagtatacaccgaagataaaaattcagaaccaagaacgaaaaccggggaaaaaaaagggcgtaatcgtcaccgcagtcttgtcgtctcccatgatgctctccaggagggcgtcgtcgttgtcgacctcgaagtaaatatctgatgagagcagattgccacacatcacagcatgcagcttcaagaacaaaattaacagtgtctccagcaaaagtcacagagaaggagctaagctaagctagctagctgcatcaaagcatcagctcaagcatccggttttctcgcatacctccgttctcatcggtgaggtaggggaactccggcaggatgatcctctcgtgcacgccctcgtcgatcagcgtcgagatcatcaccgtcgccttgctgttcacctgcattttgttccactgatttcttggtgaaagcttgaagaagagtgatggttggttgtcaccaggcaatggccgtccggccggttgcgttgtgtaacaaaaactctgctttcttctaatacattgacgcgcaatctttttgcgcgttcacgaaaatgaagagagtgatggaagaattttatgaaaaaattttcagataattttgtgttatgtgtagacctcgacgatggttcgtgcggactcggcgtcagtgaggtgggcgggc

SEQ ID NO: 52343 - DNA, 2021 bp, Oryza sativa
  unsure (1)..(2021): unsure at all n locations
ctttctttagacgtgtacctttacttaattatacttaatttggcgcagtttaatttagctttgcgtggaatataataaacgtgattaatggtgatcgatgctagaagataaatggaattaatgattagagaatatgttcactggagatggaaatatcatgggaattaattaagctcaccgcgacggtgattcccctgaagacgtcgagcgacacgaggcgctgccgcgtcgtcgtcgccgcagcctcgccgtcacggccgaggacgcctgcctcgacgtcgtcgtcggctccctccttggggtattcttctcgacgattgttgccgccatggacgctgctgctgctgctgatgcacttctccgtcgtcgtcgtcatctccattgatgaattcacaagctagctagctatagctatacttgatggcgatcaatcgttagttgttgccgtcgatttggcgatgagcagcagctgcatatatatatacagagaagtgagctctagctagtgttgcattgcaaggtcactctatactgtagattcgcctttctgtctccatctcaagaacgtatgggaagttgtagtgctacacatacgtggctttttaatttgtgcgtcactcacccgcctcacgcgtgcaaatttacagtcccctctgctaatttcttggttttgttgttcaggacgcggatgcgtaagtgactgaaaaatcagaaaaatatgttccattgaatttgagtaggagttgagtaggagtgcgcctcgtcgcatgaccagagttttcactttcgattttgctaaaaaattcgactatttcagtagcattgaaacccccgaaatttgaggattttcagccctttttagaccaaaattatttaaaattttaacataatttaactaaatttgaataaattttaaccaaattaaaaaaacgaaaattttagacgagataatgatttgccgggggtccgaaatttcgaaccagagttgcattcactgcacgagacccattaacattaacaagaggcggttttgtctttttcgacgaaaactcgaaaactaattaataaaaggatcgagatgaattcagctaactagacagtttgatggggataaatatcttttaggcgtgattagggttgggaccatcggtccaattgctgtatctaatatcaaaatcgttaggtcactttggcatggttttgttccagttcaaactggactcgatcgggaacatgcatgtcagcatgttatctcgcccgacgatatctactcagcattagagctacattttgtccaaatcagccttccaactttactgtaattgagaacttagcatctcagtcttaaaatataatatttttaacatactcaaacatttttaactatgactattaatagcaaaaaaaaaagattaatcatgtaaaattaatgttactagaattaaagaaactatcataatatgcaactttctttattttaaacatcttacatttataaatattgtttgttaaagtagtatctcgaagaccatgtagaagtcctagaaaagcttatattttgaaacggagggattatacaataagctctctgagttctactactagtaaaaaaattattcaactattcagatgatagtataaataaatactacttcgtacctctgtttttaatatatggcaccattaattttttatatcatgttttattttaaaattttactccatctgtcccaaaaatataagcattttggactctgacacggtctccgagatgctaatttgaccaacaatatctagaaaagtaagaggttttaaataaaaagagttcatattgtgatagtttgttaataataaatctagtaacatcaattttacaggataaatcttttttattctttcgttattaatagtcaaagttaataatgtttgacttgtcactatgctaaaaatgtttatattttgggnnnnnnnnnnnnnnnnnnnnnnnnnnnnnnnnnnnnnnnnnnnnnnnnnnnnnnnnn

SEQ ID NO: 52344 - DNA, 2947 bp, Oryza sativa
  unsure (1)..(2947): unsure at all n locations
cggacgtactccctccgtcccacaaaaaaagaaaaaacctggtttccgtgtccaacgtttacccgtccgtcttatttgaaaaaattatgaaaaaaataaaagacaagtcacgcataaaatattaatcatattttatcatctaacaacaatgaaaatacaaattataaaaaaatttcatataagacggacagttaaagttggacatgaaaacctatagtttgtctttttttggatggagggagtaatcctctattagtttctcatcaatactagtagtacgtactaccgctagtccgctactagctaaccgtgcctctggccttttaagcaatactccataagcaaggatcattaatacagaacatcacatatgtattgcctcatatgtaccggttcagaatttctagccatacaattggtcaaagttgagattctttagaaaaaaaactgatacatacaatggtgccactcatatatgtatttctaaactaattttttcatataaagttggatgaagataaatatattaaaattgtagagctaaaactttgtaggtgatgactttttatttgagattatttagatgtgcgaaaatctgctattaagtcacggatctatttggataagtgaatttttaaagttttcaaatgacttatgatgaatacaaaatctatataaaagttatagatcttgtcgatatctacaactttttggttgacaatatttttatttgatcttgtctacgatatctaatatgtattataagcttcatatataagagtagtcaaaagaataatatctgcaactaaaacaacaaatgcttaattcgtgaaatggtaaggaggcttcttaggcctcctttaatggttgagctagtgcactagctcatgcttgtccacctcatacaagagatagcaaaaagtctacctttccaatagattgtctcatagcacattgtttaaaatgctttgggttccacaattcctctcacattttctttaggagcttagctcttgaagaagagatagtgtattctctctccttatcttctctttcttccacatcagacaaaaactgatgtggagatttatgagctagctgactcatccttgttggaggaggccttatggagagaggctcggggttcatgattcatcaagtcttataaaccgcatgcgtacatattttaggagaaaaatcgtgagttgtgggaaccgaagcgtgactacatataggtaaaatacaaaataaaaaacaggtacacccatcgattctaaactacaccctccgtctcaaaaaaacccattcctaacatcccaaaatagaaatagtagagagtgagaatacctaaaatgcccttaatcattgaaaaaagtagtaagagtgataagtatataaagggtattgaagggataaaacttctcgttttacgtgctgatggtagataggatgatagaagttggttttttgtgggacaaaatttaaactcttttttttttggaacggagcgagtagacactaataactaccagtttcagaactagtactaactaatatccctcattagtgccctttttatggtgttggatctaaaactggtatctataaaggatttagaattagcactggtaaaaggatgtttgtactaatggttcacttatagatcattatcgcgagcagtcccatatgttagtttgtgataatggtcggtacgacaaggattttttattagtaaatacatgcttccaagctaagcccacatattagacatgaaaagtaccaataaccaagttcacgagtaagcccgcttacaccccctacttttaaaaactattggccgagtccatttatatctctcgtccaaatatccatgtgaagagttttacagattagtacataaaaagtatcaatatacgagtttacgagtcagcccacttacactcctacttttaataaccattggccgagtccattcataactcccgtccaaatatccatctgaagagttttaaattgttatactgaatgtgtccatatactcgttctcctatattcattgaacgatcaaacaatttcatactaagtttgtccccatcatttggctagttgttgtaatccgaagttaacaactccctgcaagtgcacgcgggtcggcaacctatatatgccgacaatcaagaatgatacaacccaaccatgcgatggtgctggtgacgaaggctaattagcatgcatctccactaaatcctaacatcacacaccacattatgatatctagctaactcttgcacacacatctgcactaatcagcaacttcctaccctcgtaccatgtacttttcaaatggacaaaaccaaaaagggcttagctcttaatcacctctcattagctggtaactgaacatactaacctaaattgttaggtacacatgagcatcttgcaacttactccgtactatagtatcttctaccgtcatcgttcctgtggcaaattgctgaggacaggatgagatatttaaaccggggggagatcgatcgatcgctgggattttgatctcgcctgcctggacgcttggcgggtgcgactgcttcttcttgtttagtttttgaggtaaacgacatggagataagctaacttagccatggagggctgcaattaatttggcggtgatggtgctaatgggtggttaagggttttaatttgggtcgtcagaagaggcgattgctgatgctgatgccttgcatgcctggctggttgggccggtttgggtttggattttggtcgtttgggcgattcgggagccgtttatcttttgcttaaatttagccaaaatgtcctgcctaatctcttttgaaagaattgtttacgaactataaacaaaaaactgtnnnnnnnnnnnnnnnnnnnnnnnnnnnnnnnnnnnnnnnnnnnnnnnnnnnnnnnnntt

SEQ ID NO: 52345 - DNA, 1185 bp, Oryza sativa
  unsure (1)..(1185): unsure at all n locations
gagatatttaaaccggggggagatcgatcgatcgctgggattttgatctcgcctgcttggacgcttggcgggtgcgactgcttcttcttgtttagtttttgaggtaaacgacatggagataagctaacttagccatggagggctgcaattaatttggcggtgatggtgctaatgggtggttaagggttttaatttgggtcgtcagaagaggcgattgctgatgctgctgccctgcatgcctggctggttgggccggtttggcgtttggattttggtcgtttgggcgattcgggagccgtttatcttttgcttaaattttgccaaaatgtcctgcctaatctcttttgaaagaattgtttacgaactttaaacaaaaaactgttaacagtttggcattcacctgacaaaggaatgggagcccaaatcagcattcctaccacagcaacactggaacattgtcatattcccgtgttcaattcgtctctataaataaagtcgttgttatgattcaatagatgttataatacttgaatttcagtgctgctacttgcgacatgatggaaatcgtgagattagcatgccatgccccccaccccaaagaaatgaattagataagcaaatgggtgaaaacgaaaggtcaaagtaccgtagcattctcaaaagtgttttcaatgtggtatggcatcaggttgcacagggtctaacgatgagaacataaacagagtttgttcttgtttgtcaacactaactacacatttctcattcaacatgaaaatcgcatgcaagatctgatccgaatgaggccacataaatatctatatgagtctttcaaaccccatttagttttaaaggggagattcatgagctagcaattatatatacatttctcaaaatcttacccctcaaaatttcacttgacatgctgatggctttgatcacatgcggacatgcccacatataacttaggtaatgaactcaaaatttgagacagaatacagatgaatgttttgtacatcgcacgggttgtgaaaagagggtgtagagagctataaaattcacctctgacctcttcgttcccagcttcccaaaaaaccagaagatgttggagtatgccacagnnnnnnnnnnnnnnnnnnnnnnnnnnnnnnnnnnnnnnnnnnnnnnnnnnnnnnnnnnnnnnnnnnn

SEQ ID NO: 52346 - DNA, 1678 bp, Oryza sativa
tttagttaccaaaagtttttcttaaaacatcacatcgaatctttagatacatacatggaccattaatatagatttaaagaaaacctaattgcacagttaagggggaaatcgcgagacgaatcttttaatcctaattagtccataattagccataagtgctacagtaacctacatgtgctaatgatggattaattaggctcaaaagatttatctcgtggtttccaggcgagttatgaaattagttttttcattcgtgtccgaaaaccccttctgacatctggtcaaacatccgatgtgacacccaaaaattttcatttggcgaactaaacaggctagtaacttccaaagttagaagtttggtttgaaattggtatgatgtgactgaaaacttgtgtgtgtatgataggttgatgtgatagaaaaagttgaaagtttggatctaaacacaaccctttttgttctaaaaaaaactccatccatcccataatgtagcaatcccagatttgtagtcctaggatgggtctcatcccatcctagattgctacattatgggacggagtatctttttattttaaatattttaatataaattaagatttaagtaaaaaattactatagtatccttattaagtaatatatataagttatgattggattttggtagttaaaggatagtataatagaaaaaaattaaacgaaaggagagacaaatgaaataagtagtacagtactttagagtaacacatattttaaggtaaaatttaaatagtagaaagataactattttgggacagtggtaacactcacttccttggtttttaggggctggttggatctatacagaggttgccgctatgtgccatatttttatgtttgcctaaattgcgattaacaaaaggacactgttacaatacattctactacaaacggtgtggtaggatttaaatctaactatcgatttttatgagtataaaagtattttaatctatacgcactatcaaatgtagggtgtgtttagttcacgctaaaattgaaagtttggttgaaattggaataatgtgatggaaaagttggaagtttatgtatgtaggaaagttttgatatgatgaaaaagttggaagtttcaagaaaaactttagatctaaactcgaccgtaacagagtacaatcaaatcaaatccattggatctaataataaaaaattagatggctcataattatttataccttagaaaacccctgataaaaagcaaatcacaaaagaatattgtgcctcacattttcaaattgatgacatatatgctggaatcctgctataaatatagctaagtacggctaggaatgaattaaagaattaaaatggtatgataaacttagccaatgtttggaagtaaaccaaacatccccttaccatttgcatggcacctttaatttggctgtctcgttttataattagaaaaaccaattgcaaaatctgccgatccactaccgtctagtagggatgaaagtggttcggatactttccatccgtgactttgaccaattttcagattcggaaaaattcggtcggaaatatccggaatttctcggattcggaaacgaattcggattttttttctcggatacgaaaacgaatacagtaagggtgatatccgacggaatcggaaaacggtcggaaa

SEQ ID NO: 52347 - DNA, 1175 bp, Oryza sativa
cgagctctcttagagtttttgcttgtcttctggccagaatccttatgagattcagttttactagttttctttgtcccatttgcaggttcttgaagaatctgtcacacagaaaattaatgaaacacaatgagttcgacttcttagtccaatcatcaacatgcatctgaactaatacatgtgtgcaccgctgcaccctcaatccaaactttaaacttacattgtctaattccgtcgaaataaaagacttgtaagcatccaaagctttcttctgaagcttgagatcttcttctaaagtccggcgaactccttgtaaagtaatagttctgcattgctttcatattgtgaatacatgctgaagctgactagccaaatgcaatatgagcaggtaaagtggacatcgaacatgcttttggtggcagcaagcatccgtatggcgcagaatccaaaatttaaaccagaataaagtaaaatgctgaagtaacatgattggacatacttaggaagtaaccacatccttagggggaaaatacgatggtacgatttaagtattcttacaaaatttcttgccaaatgtccaaataataaagctagaaactcagatattctagaatagactctttaatatgtgtcgtttataagtcattagcacctaagaattcatctcaagacgaacacatacaatataagcaaattcctatatttccgtttatcgccaattggttcataactctaaagaactgcatcacatatgatcatgtcctatataatattggccgcacaccactcttaacaacaagaatgatatgttttaagaacatataggcaattttctttgtaaaactcaacagtttcaatcattatgttccaaatgtatattcagatcagtgcacacaactgggctcctgttcatttttagacggtctacattaagaatgactcaatggccttttcttttaccagctaagacccatatcccccccccccctccctcggcatggccccccacaaatttgtcactcagaattgtataagtgaactagcacgcaacgaaatctccctgctcaccgcttgcatcacacaatgggagcaattatctctactttcgtcccttattcatatgtttcaccgcaagatgtggaacaactaaatggtttctctattattactcaatcagg

SEQ ID NO: 52348 - DNA, 1183 bp, Oryza sativa
  unsure (1)..(1183): unsure at all n locations
nnnnnnnnnnnnnnnnnnnnnnnnnnnnnnnnnnnnnnnnnnnnnnnnnnagagagcaattaacttaagattgaattggacttatcccttaagtaccagtaggaggatatgtccaaccttcttatatgttactccctccatcctaaaataagcgtggccatgagtttccatatccaactttaattgttcgtcttatttaattttaaaaaaaataaaaaatataagtcaagcataaagtactattaatgttttataatctaataataatgataatactaataaaactaatcttaaaaaatcaaataagacggagcgatcaaagttggacacggaaactcatgcatggttacgtttattttgggacagatgtagtactggtatttgagaatgaagaaagcaccatgcaaagaacttgtaataaagaaaaggaaattaatcatcaaaactaaaattaagagcaaaagggaattaaacaaaagctatatgtatgcatcctttttttttatgattcatttgcctaccctttacgttgtgcgtctacaaacgtcactcacttaacgcgtaattgagatcgtggacgaaaagatttagcgtgtagtagattttcttttggagcgaagggcacgagatgtgtgtgatgctgtctgatggatccgtttagtttgtgaggtcaacagtggaggacatacagtgcgcattttggtacgacatcattgttctctcacgggcgacctgaggtgaaaaatctatgtcaatgtcttatctaagttctcatgatgatctctctatatgtagatggaataatgttgtcgtacttacgtggaagtgtactatgtgtagtggtggtttgtccaacttaacaatattcctagtcgtgctataattttttttctttaattagcaatgccacgattgtaacttagcatcgcttttcaattgtaggtatatgccccacacacgtcaaagattcgtttattgcatattaagttttcctaagtttggccagcattttactataaccacatttatggaccatattccctacctaagatttggttttactactaaggttagtcatcaaaacaaacacccttttatacgaacgcgcgcggaccatatagttatnnnnnnnnnnnnnnnnnnnnnnnnnnnnnnnnnnnnnnnnnnnnnnnnnnnnnnnnnn

SEQ ID NO: 52349 - DNA, 736 bp, Oryza sativa
aataccaattcaaaccggtccttaaagtttgcatgtgtcagctaacggtgccctgacgctagctgccacactctagcatgtgcagtgttctcacaaattcagtcacaaattcaatgcgtacagccaggctctggaattggataccccccacatatacgtacgtacatacacatacgcaatacagtacgtacgtgtacgacagatcagtgccgtccgtttaggtacaaatacatttgcatcatacgtacacagactgtatttaatttactcctctccggatcagatgttaggtatatgtagctagtagcaatacgtactcgtgtacgacccatatgtacgtacatcaacttgcatcgcaaaatggagatgggccagtaataatttgaagtacgcaccggtactaaagttgaaagaacaaattctgttcagtctggaaattaaaaatcaaaatcgatcttagatacgtatagtacgagataggaaaagtctctggatcgatcgaattgtccgataaaagctaggcaaaggtatcgattgatcgttggatccaacgaactggtttagtaacattctttcttttttcggatggtactcttaattaattcgaattttctgtgtctgaattattctgcttttgctacgacaaaaggatcgaataattgagaccgaaatcgatcgatcgatcgatcgaacgaacatggcgtgagacgcagatcgcactaggaagaggaggaga

SEQ ID NO: 52350 - DNA, 1029 bp, Oryza sativa
  unsure (1)..(1029): unsure at all n locations
nnnnnnnnnnnnnnnnnnnnnnnnnnnnnnnnnnnnnnnnnnnnnaactcggcgtcaagacgagggacccaaaatggacttaccccctcgttaaccatgggaggcgtgcaacgtggcgccatggctacggaagtaacggagctcgcttggccaaggtgacgatatgtcatcagagcctggcgtgcatcagacccgatgaagtcattgaaccgagcattgaggcactggttgaaccatggtttaaggttatgtacatttaatactcccttcatcccgtaaaaagtttatttttagctctttccatttgttccaaattaagttcttttttaagtaatcattgcgtcggagtttatgaaagtaaggaataattgtaatgggagtagataaagtgggaaataattgtattgggatttaataaagtatgggtattttttgtctttttggttttgtattggtatgtataggatgagtaaaaaataagcttgttttgggacagaggtagtattttcttattattgtagtagcttgcttagcctggtggtatgtaagtaaatcctctaacctaactactcccttcgtttcacaatgtaagtcattctagtattttccatatttatattgatgttaatgaatttagacttattaaatgtgaaatataaatgtgagaaattctaaaaggacttacattgtgaaacggatgataagtagtaaccaaggatcgattcccatgactcctcgaagcaaaccgagccggtaagattttctactatgcgcttcccatgcggatccttggagcaaaccgagccggtgaggggagctggtttggttttttcgattgaaccaccggtccggtaagattattttatatctggtccttgccatatgtttaaatcctactttatatatgaagtgcctgaatgttccaagtagaaatagaattgtcgccggccggacatgtgtatatnnnnnnnnnnnnnnnnnnnnnnnnnnnnnnnnnnnnnnnnnnnnnnnnnnnnnnnnnnnnnnnnn

SEQ ID NO: 52351 - DNA, 1000 bp, Oryza sativa
  unsure (1)..(1000): unsure at all n locations
nnnnnnnnnnnnnnnnnnnnnnnnnnnnnnnnnnnnnnnnnnnnntgtgtcatggtattactatgctgttatctcaatagcttctcagcttcatctctaatggtttgatcatccatatcactagataagcacatgcgtttcgattaggggaaaatggtgggcagtgagatgaatcaatagattctcaaaacaccactctactggccaaagaaagtgctcagtaaatcatgtacttaatccccctgtcttctggaataccactggtatctggtggcaaatgcaaccagccacattgaccttagtgatactactgctgacttgtagcacgtgtaagcaatgttcaaaggatcgtcgcccaacatgtcatggtaatagtagccagtgagcacagcgtgcacaggtgcacccagggcatgcatcattgctttgatctcctgacttcaatcataatcgtacggaatggctaaaatctacgagactatggcatgctaaaagaaagtgaacggaagttctgaatagattgaattcattggataaatctttaggagttctccaaatggtacctacgcatcatctagactacccaatcagctcctatcgcccgcatcaacttcaagactacgcaacaaataaaagaaaccagagatttctccattatactaactgatggtttaacgaagtactgcacttactaacattaagtgtgctaatagcatagcacgctagatatttatatttataataatcagctaaaccatctatccaaagatgatagatcgaacaacagccagaagcagaatcaaagtttcatttccattaaacaagtctgtattacagtacatcgcccaacaaaattactgtaataataatcagattagcatctctctctctctctcattttttttaggtgtccttcctacacaataatcctacttactaaacacaacacaaggaaggatacgaagaggagaataacaaaattaaagacgggggggggggg

SEQ ID NO: 52352 - DNA, 881 bp, Oryza sativa
ttattcaaaaacttttataaatattattcaaaaacttaattagtagtagtaaatttaacaatgaatcaaatgataggaaaataattaataattacttaaattttttaggtaagacgaacagtcaaacatgtttaaaaaaatcaacagtgtcaaatatttggtgacggaggaagtacgtaaaaacaattccaactcttattaggtttaatcctagattggcactactttaaaggcaaacacagtacatgcccaaacattcagtggcctctatatgcgcatttgattcttttgacatttggcatatgtgtgcaagtcacgatggtgtggtgtgtgagtgtggtgtcgttgagtatacatgttcaaataataaaaaagctatgcttgctaaaattacaccaggtaattatatcacatatatatttcgctagatctcggaagaatttaattaaacatgaagtacaagcatgtcaattgtcaagaatatataccctgaccattttctacaaatttaacaattaactatttcctgtaactaaaataacaatgatctcaggtagcatagtcacagcttggttaattaattattatatatcatcatcatgatgggcgacaattgtttttagaggacgaagtccaagtctatctcggtgttcttccggatagggcatacagtgtattaagctcttgcccttgaacgaaggatagtatgatagcattagattagacttacatattccactaaataaattaaagtgatggcctagctagctgcctcttgggatagagacaatctctgtcaagaatatgcttgctaacaacaaatcaaacttggccaccactacttctacttactcctacatcatagaactattccatatgct

SEQ ID NO: 52353 - DNA, 3705 bp, Oryza sativa
  unsure (1)..(3705): unsure at all n locations
nnnnnnnnnnnnnnnnnnnnnnnnnnnnnnnnnnnnnnnnnnnnnnnnnnnnnnnnntttcattggaggtgatgagtgttttacactttagtgcttggttaattagtatagtgatagatatatatgtagatcttgatatagaagagattccattaattcaagttaaattcacatgtagtggtcgtgtatatctgtagtactcatttcgtcccaaaatatatatgctatttctagtgttaaaagtttataaaaagattggctatttcttcacttattttctcatgtcaacgagtcacaatcacatctcccgtatttactctagacctagctatgttctcattcccaattacaattccttatttgattttacttcacttcttaatcttcctgaaaaactctagagtgtttatatatttaggacataaaggagtaggaagtgactaattttttactccctccgtccctaaatatttgacgccgttgacttttttaaatatatttgactgttcgtcttattcaaaaacttttataaatattattcaaaaacttgattagtagtagtaaatttaacaatgaatcaaatgataggaaaataattaataattacttaaattttttaggtaagacgaacagtcaaacatgtttaaaaaaatcaacagtgtcaaatatttggtgacggaggaagtacgtaaaaacaattccaactcttattaggtttaatcctagattggcactactttaaaggcaaacacagtacatgcccaaacattcagtggcctctatatgcgcatttgattcttttgacatttggcatatgtgtgcaagtcacgatggtgtggtgtgtgagtgtggtgtcgttgagtatacatgttcaaataataaaaaagctatgcttgctaaaattacaccaggtaattatatcacatatatatttcgctagatctcggaagaatttaattaaacatgaagtacaagcatgtcaattgtcaagaatatataccctgaccattttctacaaatttaacaattaactatttcctgtaactaaaataacaatgatctcaggtagcatagtcacagcttggttaattaattattatatatcatcatcatgatgggcgacaattgtttttagaggacgaagtccaagtctatctcggtgttcttccggatagggcatacagtgtattaagctcttgcccttgaacgaaggatagtatgatagcattagattagacttacatattccactaaataaattaaagtgatggcctagctagctgcctcttgggatagagacaatctctgtcaagaatatgcttgctaacaacaaatcaaacttggccaccactacttctacttactcctacatcatagaactattccatatgctaattgaacatctcattaactggtcaatatgcaactggtccacgaaaactggtcaatgcaataaattatctggtgcccataaggttaatttagtggtcaatttctgacattaactttaattactcgtcactatagtcagccattagaataggggtccaggtgccccatcaagccggccatctagaatagtacacaatgcaagatgatctgctgctgagttaactgtttgacctgacaaactataaatcaataaccaaaaaaattaataaaaaccacacaataaattcagtactcctgctaatcgatctagtagaagtttactccatcatcagctctctacaattgttaggaaacaataaaataattaagaggactgatagaggatagcactttaatgagtctgaacacacacctccttcaacctcttacatgtttgagctttggagcttccacacattccgagtccccctacgacaaaaggagcgaagcagcggtgactaaggctgtgtttagatccgggttgtaaaattttggcgtgtcacattgaatatacggacacacatttaaagtattaaatgtagactaataacaaaacaaattagagaatccgcctgtaaaccgcgagacgaatttattaagactaattaattcgttattagcaaatgtttactgtagcatcacattgtcagatcatggagcaattatgcttaaaagattcgtgtcgcaatttacacgcaatctgtgtaattagtaattttctcgattatatttaatactccatgttatgtccaagcattcaatgtgacagggtgaaaaattttatcagtggatctaaacaaggcctaaaactagagatggcaacgggtgaatacccatcgggttcccttaccaacgtacccacacccacgtataacaaacaatactgcttcaatacccacacccgctctcgggtacagaaatcccccatacccacacccgtgtgggtgatgggtacccgtcgggtacccatacccataacaccaacttacagctagggagttggctgcaacagttcaggggaaaagcaaatcgtagcgtgagctctgaggcgatgatggcggggatgacagcggttcagcgcgaacgcgtggtcgcatggaggcgtcaacagcgacgcgtgtaggcggtgacggcagcttggcacaggcgcgcgtggcgtggagctgaggcagcgatggatgatcggctgcgtgggctcgcggcgcggaggcagcggccaccgtggcaaggaggccgcgacgctgcgtcagagaaggttcaaggctgcccccttaatccttaatttggatcagatccagtgaggcttccatacctccaatgcttctgcggtctgccataccgagagaggactgggatgagactatgagaggattagagaggacaggaggcggctgctagctggatgcctaggtgaataaagttagggtttctcctttcctatacacagggagggagtctggagtgtttccatctagcaattggtcttgggccaggcacatattgggccaaatatcaaagatgggctacgtatatatacattgcatataagccccacgggttaatgggtatggggacaaggaaaacggacccgcacctgctccacccgatgggtgacaattttgcccgttaagggacccatggggataaaaactgaaccataccctgcccctaatggagtaattacccattgggttccgggtttcggggccccattgccatctctacctaaaacaaggatgaggaggaagtattactcagtccgatgactaaatcgggaagaaaaagatgaagtggcactaaagatgtctagtggactactccactctagaaacacagtttctatagataaaattttaagttaaaatgacatttttagggttggggggagtatataggattatattagagccgattaaagatgttgagttcaagtcttaactaaaactagaaaaataaaaaaagtacattccacgtggatgcatatttgatgctagaactagggagcctcgacgtgagaggaagggattgaggcagtgagagatgctgaagtataattaattaagttaccagctgaaatggctgatgcaagtaactcaacttacaataaactgctctttagctgcaacttagaaatccttatatttcagttagctatttctagttacgaatctggattatcactaatccaaatttgtagaaaaaaaacacccacattttaaaattgctaaagtgaggctgtgtttagtttttaaaattggtgagaagcttgagtat

SEQ ID NO: 52354 - DNA, 925 bp, Oryza sativa
atcatattagaacgtaccagcttgaattgaaacctaaaattttagaggctatgtacggtggttgcttagcacgttcctgcataattaaggctgggttcggcacctatacttctcaacttaccttccttgtttttcacgcacacgttcttaaactaccaaacgatatgtttttttaaaatattttataggaaagttgattttaaaaatcatattatttttttataaaaaaaatagccgagtcgctccattttacgtatgcgagagattagctcccaacatcttgtaaagaacactgcctaaatacatctcaatctcaaatggagcctagaccctagagctattgcacatgaccatggtgtctccttttcttacctagcatacaatgcaagtaatcgcatatgcacaactaaagccaacatcttttgcttcatctcttctccttcatcttcctccttcgtctaattctccattatataatttccttttagtaatccgtcctaaactgatcctaatctatctcctccagattaattaatggctatagctatatatacctacgcaactagctcaacatgatcaccaactagccaatcacatcacaagaacacaaagaacactaacaatggacatcacggtggccggcggcgccggcgacggcggcgagaggcggacgtgggtggtggaggtggagaggacgctgcacgacgcgcccgacgcggcggcggaggcgtcgcggtggcggccccactgcatctaccgcgtcccggcgtgcatcaaggacctcaagccgaaggcctaccagccgcaggtggtgtcgctcggcccctttcaccacggcgaccccgggctggcccccatggaggagcacaagcgccgcgccctgcgccacctcctccgccgcgcggcgcgcccgctggccaacttc

SEQ ID NO: 52355 - DNA, 1077 bp, Oryza sativa
  unsure (1)..(1077): unsure at all n locations
aaagaacctatcataataggcaactttctttattttaaacatcttacatttataaatattgtttgttaaagtagtatctcgaagaccatgtagaagtcctagaaaagcttatattttgaaacggagggattatacaataagctctctgagttctactactagtaaaaaaattattcaactattcagatgatagtataaataaatactacttcgtacctctgtttttaatatatggcaccattaattttttatatcatgttttattttaaaattttactccatctgtcccaaaaatataagcattttggactctgacacggtctccgagatgctaatttgaccaacaatatctagaaaagtaagaggttttaaataaaaagagttacatattgtgatagtttgttaataataaatctagtaacatcaattttacaggataaatcttttttattctttcgttattaatagtcaaagttaataatgtttgacttgtcactatgctaaaaatgtttatattttgggacggagggagtaagtaatatcttttcttttgttgtggcttgatttatcactaaaggaattttaagcaatactaatacttatatttttaaaattcgcacaaaactttgaataagacattaagacgaatgatcaaaattgtaccaaaagttaacatagtcatatattaaagggttaattagatctatgccattaaaattttactggttttgaaatatatcattgctatttgcgtatttgtaacgatgccattgatacttgtttgaaattttagtggtgccattaagatacgtatttgcatgtattggaagaaaataccctcatcttctacctctctcttctcttatcttccttcccggtgcttcttgctccaccggccgccgttgcagctgccactcgccgtcgcgccaccgcttgccgctgctgccgctgcttgccgccaggcggctccgccaagtacatcctccagttggagcacgactaccctgggacgacgannnnnnnnnnnnnnnnnnnnnnnnnnnnnnnnnnnnnnnnnnnnnnnnnnnnnnnnnnntt

SEQ ID NO: 52356 - DNA, 1754 bp, Oryza sativa
  unsure (1)..(1754): unsure at all n locations
cagaaagagtcttgatgtaattcggaggagataatttattcatttggtaggaattactagctaaaataaaatatatgccacatgtcctttttcttccatttatccatggggtagaatttttagattccagttttgtgtcattgtagattgatttttatgtatcaatctaccaaagtatttcaaaattctttagacctgttgaggaaagcacagataagagaagcactgtaggagcctctgaatatttggatggcaatcgatacaaataagacgtgccagcaagttcagtagtcaatttataatccagagaacagcaaagcaatgtaacattagatggtttgtgtgaaccaaattgtacacaaattcttcttgagcgagtcagtctcaagttacactagtcaagtagtcagcatcacctgaaaaaccgaaggctctacgggttcatttgttcagcaattcctgaaggagtggtacatgaagtggggaaacgaaaaggatgtaaccacagataggtacatatttccttctaacagcaggatctatgaaggttaggaaaacatatgcccacaggcatttccaaacacacaaccttaatgctgaaccatggggatgaatcttgtacaacttgattactcttgagctgttgcttgttcagaagattggtcaatatgctgcgaccgcacagatgttggtaatgatgtcacaaactctgctatcagctccgagagttcatcatacgcatcctcctggaattccaaagtaatgagaataatattatcaccatactctcattacctcaatttgcaacttagctacacaagaacttcatatacaccaatgcatgaacataaatggagacttaaaatagcagtaatgatgacttcctgtatagaagtacctaaaaaactggctttagttaaataaggatcccttatagcagggaatcaacacatgatatgagaataatatgggcagccaaataagtgagaaggtgaattattcagttagctggtcttgatgtttgcaatgagacgatgggtgttgagtactgctccgttctagagattatttgcatccttagccaatggacacctgatgcttgtgctactaattcttaacaaaacatgatggatcatggtgagctgtatcagaccagcgacattggtatgatgcatagtaaatcactagttaacttaaagtagagcttgaaggccaacctgcccaagcaatcttgcatgactgtctgtagtttgaacctttacatcagctaagctatacattcagcacaaagctaaacactctttacattttgaattgattatgaaaaagggaaccatcacactgacctgaggccattggccacccggaatggtaaaagaatttggcatccggcaaagccgcggccaccttttttcccttattggatcacctaacaggtcaaggaaccggccacaggcccattaatggccaatttcttcctggcttcaaaaaggcccttcaatcctttaggataaaggttttaattagagcctttcaatgattcaaccatggaatcctttttcccttcaattggaatcgccgcacgggggggcctaggcgcaacttcggggccaatttccgggggaagaacagcggaagaagtcccttgaacaatgcgggcaccggcaccaccatgctccccannnnnnnnnnnnnnnnnnnnnnnnnnnnnnnnnnnnnnnnnnnnnnnnnnnnnnnnnnnnnnnnnnnnnnnn

SEQ ID NO: 52357 - DNA, 1483 bp, Oryza sativa
gatccttggagcaaaccgagccggtgaggggagctggtttggttttttcgattgaaccaccggtccggtaagattattttatatctggtccttgccatatgtttaaatcctactttatatattgaagtgcctgaatgttccaagtagaaatagaattgtcgccggccggacatgtgtatatacgggttattggtctttgtaaacagttgcaagacttcaatgtaggactatgtggataaaaagtcaaaagacttgattgagaaatactccattttatattataagttgttttttatttttttttcctagttaaacttttttcactttggtcaagtttatagaaaaatataacaacatttccaacacaaaacaatcatattatgaaaatatattcaacatcactaattttgtattgttcatgttgctaaacttttctataaatttcatcaaacctacaaaagtttgactaataaaaaagtgaaggtgacttataatataaaatagagaagtactatatatctacaacaacaaagaaacccatttatgcatactagaaagataaatatatggtataattaattatatgagcgataatatgactttgtgtgacagtttctttgtaccaataaatatactaaatgagagttctaaccatatatagggacatatctatacgatactctctttggttttttatatagacatcgaacatatgtttgattacacatcgatcttattcaaaaaagtttatgtaaatatgaaaaatttaaatcatacttacaacatcattaacgagaaaataaatcacaacaaaataaatgataattacataatttgttaataagctaggttaatagtcaaacatatataaataaaaacaataacgtcttacatcaaaattcagaggaagtactacacacatatcaatactacttctcttgtggaaatgccattgccgtagacaatgaatcacgtgatccacgtgcctgcaggacgatgttccttcctttgggcacaaacctagcaatttttttttgttacatacaaattaattaattaaatgtgatactatacctcccctaaactctactccatcttttgcacacgatctcaattgattattgtagctagggtatgcaacattcccaacgatggagaaattgaaggccacagcccacaacattccacgagatcacactgcacatattcctggcttcatcagagcaagctatccaggccagcttagctgcatatgcatgagccggtgtaggccattgtcctatggtatctcgacctctttacgtaaagcctttcttcagaacttgtgatcgaccgtccgtcttgcagctgtaaagaggaaaaacagatcatcaacaaacacaatcagtttgaccataacgtacaccacccatttatcacagtaattcttcttaacattcaccagctttaccttgtttgtactacttcctccgtttcacaatgt

SEQ ID NO: 52358 - DNA, 797 bp, Oryza sativa
ctatagggcgaattcgagctcggtaccccacaatgtaagtcattctagcatttttcacattcatattgatgttaatgaatctagatatatatatatttatctagattcatttacataaatatgaatatgagaaatgctagaatgacttacattgtgaaacggagaaatactttgcagtttgcaccatgtttctagctagggctgtgtctaaacatttgaggccctggtgttaaaacctgtttagaaaataatattaaaccaaggagtaattgaatatcattttggactatgtatagcataatcaggtgtagaccaactatttcacttgatgaccgtaaatgtaaaaataaaatctctagtgctgattgaaacgtgtgttcacttcgtcgtcatgcataaaagataccggtatttgaagtggttgtcattatcatctaataacacttgttagagcccagaaaatttgcttatttcaaacgagataagtgaagaaggaagagacagacttataaaatggtctgagtttatatatcctcaaatcatattagaacgtaccagcttgaattgaaacctaaaattttagaggctatgtacggtggttgcttagcacgttcctgcataattaaggctgggttcggcacctatacttctcaacttaccttccttgtttttcacgcacacgttcttaaactaccaaacgatatgtttttttaaaatattttataggaaagttgattttaaaaatcatattatttttttataaaaaaaatagccgagtcgctccattttacgtatgc

SEQ ID NO: 52359 - DNA, 3563 bp, Oryza sativa
ttcgctatttcacttgcataattttattttgtgtgtttttggatttttcgtccatacgttcttacatcaagattcgtgttcttgtacatttaacttaggttcttacatcaatttctacacttaggctgtgttcgggagtgagggtttcccgacacgcaaaacgaagccacgtttaacgtgcgattaattaagttttagctaattttttttcaaaaaaatagatcaatatgatttttttaaataactttcatgtagaaactttttgtaaaaaatgcaccgtttaacagtttgaaagacgtgcgcgtgaaaaataagagggaggggttgagaacccctgcaaatgcagccttttgtagagcactcatgttcgttgagaccgagaggtccagtgtacgagtttcggtaaactctacgtcatccaaaatataccaactgcatcgattgcagcttaccagttaaagctaaaatttaaaatttaaaacttaatttaataaattaacttgaggcaaagagaaaaagtttcatgctacaatctagctaggagtataataatctagcataataatctacttgtttgtttcagcttacttctaataatccagattataataatcctaagctgaatcaaacaggttctaagttaagttcagcctaggtttgaaaacgagaattgaatgtaacgaaatcatgacacaacatataattagcgaaaaatgtgtttcattttcgatataagtgtgttcaaaatgagagtttaaagtaacgagacgagatcgcaagtggatctagtgggtggtgcatgaaaaaaaatcctaacctaatgcatatatactcgtttttaatatagtatgatgtatatttgatccgtttatacttttaactttgttatattctttagggtattttaaaacaattatataagttgaatcatcaatataaaaattctagatatgtcactagatgagatgactaataactggcgaaattgtgtgctaatttagtgtagagcacactgtacatgaattgcattaggcagcttgtcacgttatctaggtacgttcacctcatgagagatttgctttctcattgcaccgtgatgcaaagcaaaaggctaattaagttgcatataaagtagtatatctgaaaattctttccttgttgacatcacatcacaactatcaaagggcactctttatctttagtgcaacattgtttgactaaagcataattaactactcgatgtggtagataattaaaactaaaccatatataaatatcagcagacacaacatcagaactaatcatgaccatgtcagggtttactatttcactatgcacaaatccgcaggggatcggaaatttcaaaatatttttgtcaaaatagaatttgaataaatcttgaacaaatttaaatagttttcgctaaattcaaaaaaaattcgggcggaatagtttcaaaattcccagaattttaaaaattttcgtactgaaattgcaaaccatggcgatgggattggaccgatatttccgaaattcctgaaaatacggaaatttcattacagaagtatcaaaccattgtgtaggtggaccgttttcccgaaattgcaggtttaccggttgctctgacaattgcagtttgatgttcaaagcttaccattcgaaatttccaaattttgtttcggtctccctggatacattccgaaatattgaatcctgatgaatgatgatgcatgcatacgcaacatttcggagtgtacctaccagttgctctgaccatttcgcttgtttagtctagcaaaaacttatcaaatttaaagaaatttgtttgaagtccaaaattgaccgttcaaaatttccaaatattatttcgaaatctttttgattgatccttgcacatggccagaacgaggaccacatcaaccggatggtgctgcgcttcctgtcgccgtcggcgcggacgccggcgctggggacgccgctgggtcaccacccgctggacgcgctccggcggagcatgctgcacggcgagtaccagtcgccgcgctgggggcacggcgcgggcgcccgcgcccaccaccgcgacatcatccgccccgccgcctacgccgacgacggcggcggcgacatcatccgctccgccgtggagctctacgaggccgggatccgcttccggcgcgcccgcaccgacagcctccacgacgtgcggttccgccacggcgtgctcgcgatgccgcccgtcgccgtcgacgactccaccgagtacatgctcctcaacatgatggcgttcgagcgcctccacccgggcgccggcaacgacgtcaccgcctacgtcttcttcatggacagcatcatcgactcggccaaggacgtcgcgctgctgtcgtccaaggggatcatccagaacgccgtgggcagcgacaaggcggtggcgaagctgttcaacagcatatccaaggacgtggtgctggagccggagagcgcgctcgacggcgtgcagcggcaggtgaacgcctactgccggcagccgtggaacatgtggagggcgaacctgatccacacgtacttcaggagcccctgggcgttcatgtcgctcgccgccgccatgttcctcctcgtcatgaccatcatgcagacggtctacaccgtgatgtcgttctaccagcaggcggaagggggcggcggcggcggatcggcggcgccgtctccgatgtgaatggatttgtttgtaattggaatggtttttggagtttttggagttggggttttcgatctctcgttgtttgatttgggagtgagggggttggcttatttgtgttgtgttgtgggtgcctcttctaattccactgatgattatttggtttatattttacatgtttttcatgcatggcttgatttgattaagagcatgttaattttgtcaggtttgaataagtaccaattccacttgtcactaacatgtactacatgctttatgcttataggacatgctagggataaaggctgccttcttttcagctatttgagcttagctactcctcgatttccgttacaacgcttttcaaacgattaaaccgtagtatatttcacgtgaaaattttttatatataagttgttttaaaaaatctaataaatttacccatcaaatatttatatattaatacttaattaatcatatactaatcatgttctcgttttacgtgcaactaattagctgtttctaacgcagccaaaaagtcacaaatagagagcactgaggagtggaacatactcagttaattttgttttataatggaaataatctacatctacagcttctgccataaatctgttcagccaatctattatattattaaaagaatagaaaaaggagtctccacgttcactctcatagcctagaaattctcatattaatcggagaaaaagaaaaaatagagtccatatagaaatacaaattagaaatagatgaaattcgaaattaaaaaataataaatattagaagaggagactagagtccatatagaaatacaattaggaaataccgaaataactgaaattcggaatta

SEQ ID NO: 52360 - DNA, 4382 bp, Oryza sativa
  unsure (1)..(4382): unsure at all n locations
nnnnnnnnnnnnnnnnnnnnnnnnnnnnnnnnnnnnnnnnttacaaataactaaaattcgaaattaagaaaacatgggaagaagagtttaaagtcaatatagcaatacaatttagaagtaactaaaatttcaaattaaaaattaaagaatattgaaagatgtgtttagagtccacatagaaatacaattaaaaataataaaaattcagaaataaaataaataatattggaagaagagtatagagtctatataaaaatacaatttacagaaaattcgaaattaaaaaaagaaatattaaaagacgagtctagagtccatataggaatatatatgtaatttacaaataactaaaatttgatattaaaaataataaataactaacacgtatataaaatacaatatgaatattacacatcagtagttttgtaaagttattgcaaaatttaaaattatgttgtcattttaatatatttgaataatataatgagaaaacatatatgctattatatgagagaaaatataattatgctagccgtgcaatctgcgcgtgccaccatgctagtttaattaaagacaaaatatgtgccttaatcttcttctctgactggagagtacacttctgatgcaaatgtatcatgggttgccaaatcaagaaaggtaagtagcaccataatttttctagttggcatgccacacttccctccccttcctcgtctcgccaccgccggagcgcgtcgccggaaaccgcgcggcctaccaggatggcggcggcgagtctcctatccctggtagcgcggctgtctctacgcgaaggggcagcgcggaccgtcgggaaggccgcacggcgacgaggcgttgtggcggcagatccagcaccgccaccgctggatctggcacccccgcggcgcagcgccggcgtcgaggcgcgggaggctgcgtgcaggcgcggcgtcgtagcgaaggcgcggacgacggcgacagcggtggaggcgcaacaggcactacggcggcggaggcacggcggcaggcgcgacagcggcggaggtgcgggtggccgtgctagccgtggaggcgtgggtgaccctcgcagttgcggaggcacggctattgttgctgggggcgaacggttgtggctgcctggcccgcggctgtgcctggccagcgagtggctgaccggcccggtggctggtcagcggggccggtggccggccggcgcggtggctagtcagcgaggccggtggccggcacggcgaaggagacgcggcttgcggccgggcggcgcaaagagtgctgccggaggccgtgtagtacaaggaggagcattgcaagctggcacggcgtgagaaggcgtggccggaggccgcgatgcaaggagacacggccgaggccagcgtggcggtgttggccggagcggtgaccgcgcagcgggaggtgaggccagtggaggtagagcccggtgaggcctcgatgagtcggcagcacgcggagactggccggcgcggggcgcatgtacagtggtgcccacgtgtcggcggaggttcagatggcggtggagcaatggtgcacagttgtagatcggcaggtggtggacggcgggtgaaaacctagggcaacgataatgttcgagcgtcgttcccctcctgagggcgttgtcgtgccgtcacaaccctcaagtgtggctgtcgggcgaaagcccagtctcggttctctttgggaccttgacggacggcggcagcggtgtttcgtcgcttctctccttggagacgtcgtctaggcatccccttgccaaatccccccaagcaattggtgcaagctctctctagattcatatcctcttgtgtcggcgtcctagcttctgcaagttgaccacgtcagagggcctagggaagaggagaagttccattcttctctctgaccctccctccctaaatcccaaatacttggatagagtggggttttgtgttggctgtaagggtaaggttttaggcgatctcggctgtgttctattgttggcttagcggcggtcggttacgcttagcggcggccagtccggtgctagccttctcctggatccgtgtttggcgctgtcggtgtatgggtggtgatatattttttttcgtttttctagttacgaccttttagggttgtaatattgtaatattttcctactctatcgatagaacttcgtcgttcaaagaaaattctttcctccaattaatctgaagggattggatcagatcgatcgacccctcgttcataatcacttcaatctagtatctgcagctggttgactttattgattttttggccttgctccatttctatgccattccgtagaccattttttttaaaaaaaaactaaatcaacagtagactacctaacactgcaaatgatgatgttgtgcttgcagcttaattatcccctctcatgaacttccggaagatatatattcatcgatcagcctcctattccaatgagtttcagctgttcaaagattaacagaaatatatgttatgatgcagtccaagtatctgaaattaaattcccaaaaataaggaaaacattaagaacaaagcaactgattagtactagtggtaattaaagaggagttttgtgatcacttacaaggttgttgctgggctctttccagtagaatccctgaaccagtactgggataacgttgcatgctacgagaacaaagatcatcagagcatgcttgcccatccactccatgggaagaactggcctcttgtaccctttcacatccacctaacaaaacgatttcatgttaattattaatcgtcaaaacagctgtcatgcttaattaccaaagggcacaataaattaaatcagggattctgggtgtccaatatagtagtaatttctgtatcaacatgcattgagttagtctctttttccagtcaggaactgaaagcaggtagccacacctatctattcaagagtacttcagttctaattaatacatcctctggttttaatgttcaacgctgccgacttttggatataagtttgacaattcattttattaaaaaatttatataactattatttattttatcattaagtcctttctttgacagaatatataattttctgctacggagcccgtaaagtatcacttatattttttatactcgtataaaatttttgaatgaagtgaatgaccaaacgtatatttaaaagtcaatgtcagttaagagagagagagagaggagtaattgttactaaccagcaggtagatagccacgaagaataaaccagcagtgccagtggtgacacaggtgtagctcaggctgtacagtgatttgttcatgtgcagacctgcacacatatatgagtgttaatagttcattagtacaaatactttgccttaattaatcacatatctggccttgattaagaattattaattaccgaagagatgaagagagaagccaagagtgagcaagcacaatgatagaatcgaccatcgcttaatcctctcattgtgcttctgcatgcatatcgaagttgattatatcatgattaagtccataattaattatcatgttactgaaaaacgcagtacaagtttccccgacggctcaaaggaggaaatgccgtcaggaaaatgattagttaccttgaaatggacaattacatggccaatctggagaccgattaagcatgtcacaatcgccatcaacgagctgcacattttgtatgtgtccatttatatataaacaggccagcatacaacatttaggatgcatttatgctgtactttttatgatttaaaattcaattagagaactatataaaaaaaatctgttttgttcacctaagaagcccttcaggatcaaatggagcttcacaccatgatggggcattaggtggaagagggccgttgcgtggagaggccatgctgcattgctgcaattgtcaaaaaaaaagaaagagaactcgaaattactcccaatatcttagagggattggaatcttctcacataaagacgtgatcgctgatatgtaggccccaccacccttaaacccacatgtcagggatcacgtactcacattaggtgggaagttatgtgagatgaaccctctccatcttagagacacaaaaaaaagaggaagggaggtgcctttgcgttcataaaaatttatggttatttgctttttagtctccattacttagtttcattcatcatattctttgtacaacatttgtccaatctctaatagactatgtgcatagacgaaaatgatacacaataaaaaaacaatgtaaaaatgatcagtgctgcataagaaaggtacaacaagtccaaatatcgtgataatcgcaaccttagtttcctccatgaaaaatattgtt

SEQ ID NO: 52361 - DNA, 833 bp, Oryza sativa
  unsure (1)..(833): unsure at all n locations
gtaccccctccgtgcaaaaagaatcaacttctgacaatgtatctagacaagcatttatctagattcatccatagaatttagttttttctcgaacggagtagttcttaaaattcatctgtctatgtcaacatatatgtacctctgttttcagataaacaggatgtgcatagagatgctggattccaagaacagaccgatcaatcatgccaacagcattgcaacctggccctgtatctcctttcactccacatttcacctgcaaccacccatccaaaagcaacattttataaaagcaatcaaaagtggatttctccatttcagataacaacaaacagaagaaactaaaacataggagagtttcttaagaaactaaaatataggagaatttcttaagaaaaaaaacttaccagaaaatgcttcacagttgagtccggagatgtgacctcatactcccaatctggcacgtgcaaaccatacaaaatcaccaggtacgtgaccaccagaaccaaacccacaaacctttgcaaagtaaggaaaaggacaacatgtgatgtaatgcatgagaaatttcttaagtttaagatcagttaacaatagctgataaattagcaagttgtgtaaagtgtgctcacatctgatgatggtatcttgttattaacatagagccagagccaatgttaccgccactactaaccctccttagccagatttcgcaaagcgccaccactaagtaggctattgcaatcctctgcgtcaagtgtgtaaaatatcatgtgtaaaaagctcttatatattgctnnnnnnnnnnnnnnnnnnnnnnnnnnnnnnnnnnn

SEQ ID NO: 52362 - DNA, 3815 bp, Oryza sativa
  unsure (1)..(3815): unsure at all n locations
nnnnnnnnnnnnnnnnnnnnnnnnnnnnnnnnnnnnnnnnnnnnnnnnnnnnnnnncaccaaaaccaaacccacaaacctttgcaaagtaaggaaaaggacaacatgtgatgtaatgcatgagaaatttcttaagtttaagatcagttaacaatagctgataaattagcaagttgtgtaaagtgtgctcacatctgatgatggtatcttgttattaacatagagccagagccaatgttaccgccactactaaccctccttagccagatttcgcaaagcgccaccactaagtaggctattgcaatcctctgcgtcaagtgtgtaaaatatcatgtgtaaaaagctcttatatattgctcacagtagggactgtttggaactttgtgtttgtacctgtagtacacccattaaccgaattttgcgaatatcgacaccataggtaagttcatggatgccatggaagaagccacctaacatgatcattccagtgggaattcaatagttattgtgctttatgctatatatgtggatgatatatgcttcgtacacctagatggttagatcccatatctatggctttatttcattcaattcctagattgatcccaaccctataagaatttaccttgcaatataaggcccacaatgaagagttttacagccctaagcatggcctttttggttgctaacattttgtctggcactttctgcacaaatcatgaattaaccagagttaggcggtttccgatttaatttgaatgatatgcacattactatttggttactataccttataggcaaaagctaaggagaccccaacgatgaagaggaagaaggggaagacaaagtccgctagcgtcacgccatcccatggagagtggctgatcgccgggacaatgccaccaacatcatccacgaggatcataagctgcaatattgtaggtgttttttagcatgatctacagacgatatatatagtaataactttaatcaataagttttatttagggcccttggaatgtaccgataggtaccaaaaaaatatcacaattttgtttgtcatttggggagttcaaaaagtagcaagaattatgggagtacagtaccagatagcacatcacttagtatctccaagaccgtaaaatgtataaattaactatatgtcaactaggggaaaaagctagtgtttcaaaagaaatatcttctactccaggtaattaactaaggtgttcatgcatggaaggaagtggactggttgaagatatactgtgcaagtactatatatgattctttttttctcagatcaaaagggcaaagccctattccatttcttaatttatggaaacaaaacaaatgttgagagcatatatatatttagaggtacctgtctatctttagttaaaataacgtaagatatcataataaaggtttgacaaacttcaccaagttgggaaagttcagctttatggcttacatatacttggttctttaacccaagagaaatcaatagaatatatacacatgtacatatgcatgttaatctattaggtgtaggtacacaaaagtatttaggtttatatttatgtacataatggattaatatattgatatccaccggttgccaaaaaaactcttattagttctttgggtggttcaaaaaatacgatggggctccacttgcaccgttttttctcaaaaaaaaaatttgatgtgggaattttaagtagatttttagtcagtttctgacctagcatggcaacaagaatgggtaatgaaaatggtgaacgccccccccccccccaaaaaaaaaagaaaaaaatcaattaaaaaataaaataagctatactgcagattttcagaaaaaaaaaaagctatacgagacaggccaaagattttattccctatggcaagggtcacggattgaaggtggaagctagtcctacaagtatgtcgaatattagctagtagctaattggtttattataggtcattttctatttagcttatcagccgaagcgaacatttaaatattaaagcttaattttagagttaattttaatattttttcaccaggagcttttaagtcacaaataacaaatatataaaatatttatgcatcaaattatttttttaagttgctaataagtattacgacttataatcaatggtagacgaaacgatgtgactattagttttttttaaaaaactctcttcccattaaagaaactatgtcaagcctccttttggaattaatggaggattttatagagatttttgtgggaattgaactacttatgtgaaagtcatacaaaactaataaattccaaaggagtcctaagtcatttgttattgtagtccatacctaatacatcatattttgagtaaaacataatataattcaaaaaatatcgaccgaagaaatggaaaatacaaattgcttacgatacaaattggatccaacgcgaggcgacctcgaatggccgcctgggtttgtcaggcaaacacacaatggattttgaatgtttttgttaattagaagcaaaatttagcaaaaacttttctctatgtgccaccgctagttataccttttttttaacatgtgggtgaattgccatgcacgtatatattcatttaggattaatcgtgtccaagtatggttgacaaacagtctaacacaacggctatatatatataaatattgttaccctctctctcctaaaatatatgacacaattgatttttcacataacatttgaccattggtcgtcttattaaaaatttagtataaatatgtaaaagtataagttaatattataattttattttatgataaaacaaatcactgcaaaataaatgatatttatataatttttaataagataaatgattaaatattatgtgaaaaatcaatggctttatatattttaagacggaaagagtattaggaattcaccgacgaccgcgacgcggctaagaaaaaaaaaaagaggcacccaactttctgcatggcgcgaatccggccgtccatttcggctggagctcgcgcgcgaagccacagccgttagttaattaagctggtagtgataccgagcatatatatcttctgttttatcctcttcgtgcccctattcgatcctcctgtgatggagaagcaacgacgacacccctcgtggatgataatagatagacagatatattatgccctcttcctctatcacaattctatagcattattctcctccacttatatctgatatgatatgatatgatatgatgtgataagcgctgtgcttaatcatgtcaacatgtcactggcttattaattactatattagtattactttctttagacgtgtacctttacttaattatacttaatttggcgcagtttaatttagctttgcgtggaatataataaacgtgattaatggtgatcgatgctagaagataaatggaattaatgattagagaatatgttcactggagatggaaatatcatgggaattaattaagctcaccgcgacggtgattcccctgaagacgtcgagcgacacgaggcgctgccgcgtcgtcgtcgccgcagcctcgccgtcacggccgaggacgcctgcctcgacgtcgtcgtcggctcccttcttggggtattcttctcgaccattgttgccgccatgacccctgctgctgctgctgatgcacttctccgtcgtggtcgtaattttcattgatgaattcacaagctagctagctatagctatacttgatggccaacaatccttagttgttgccgcgatttggcgatgagccgcagctgcatat

SEQ ID NO: 52363 - DNA, 1316 bp, Oryza sativa
tattttttatttttcaaggtctgacttttaatcctctgtaattaaaccccaatgatgtaatttaaatccccttaatcaaactaggtcctggcggtattgttttatgttctcgctcagttgttctgatatagaaaccaagttttttataaccattttgcatctgaaccaagagtctgagataaaatgtgtgatgagtataaaaaatggcaacttggaacacatagttgatgagcagataattcttacatatagtacctccttattctgcattgcttgtctgcatggaatatggactaacaagtattccttcggtaaaaagcatggaacctacaaagatttttactctatgctgtgtacatgtggaatgctccaaaggttattctaacaatgtttgaggtaactgctttcgctcactgtttagggcttctgtaactgacagtgatccccttttagttactatgcacctattttgtcctcacatcaacaatctttgtattgtagaaggaagagcccttcaccttccccaagacggcgcattagtcgttctccatctcccaggcgacataaaagtcggtctccatcgcaaagacactacagaagaaagagaagtcggagtgtcactagctctccgattaccaaatctcaaagtcctcctgttgcgcgtgggccagcagagaataagaatattgttgataagcaaggctagaagaagaaaagaaaaggtggggagtatctactttgctatgcggagtctgcataccatctacaaaccaaactgtttactatttattcgcttccctattcctcatttatgttgacagcatgctattcattaatcaacatttttaacatcctgttaaaattatattcatctaactgttgtttttaccagaatatatcttgaggtcagctctattggcaatctgtgctctaaatacattatttaagttcttttatgaagaataatgttttttttaaatgaccttcttgattatttaatctgcaaaacttttctttaatgaaacgactgcacgtcttgcttccaaattgttatggtctcttgttatccttgcatataattgttggcttaagatgttgaactctagctctgaagaagtcatctatgatgagcaaagccatcgcactagatgatttttctgtgtaaattctgtgtagtatgcatttaatgtctcctctttcccaccaaggcagttttccccatttgttatctattatgaaattgtattacattttgctgctactttgattgtttgttaagggttgccatgcaacatatagattaatgagttgagtcc

SEQ ID NO: 52364 - DNA, 3007 bp, Oryza sativa
  unsure (1)..(3007): unsure at all n locations
nnnnnnnnnnnnnnnnnnnnnnnnnnnnnnnnnnnnnnnnnnnnnnnnnnnnnnnnnnttatccccatttgttatctattatgaaattgtattacattttgctgctactttgattgtttgttaagggttgccatgcaacatatagattaatgagttgagtccatgatcctggagatgcccaattctctattattgtaaactgtgatgttcttgttctttctggaatttctttggggcaaggaacttaacagtgaaatagaggcttgcatcaaaagaaccaaaaagagtaaaagagggtaatttctaccagttctattgatgactttgtggcttagctttggttcgttttctgttttatatgaaaacagtatattcttcactatggacctctctgctggttggcaaatctgaatccgtttgttcaatccattaggttgcattcttaaaaggcatggagttaaatttccatggtggtttttcaaagtttactttggttgatgctttcatagacgtagtatggtccaatgtggggctgtaatttgtcatcattccagttatgtcatcacatgtggcatgtgatatacctgtcataaaaatgcgtttaatattgccatgctttcaccaagttgtaacgatacactattgcataattgctttgaagtttgttttgactagattgaagatgtgaaaatatgatctaattggaatactgaaatgtctacatgattagctctaaacctgccacaagttacttgacattcttctctacaggcttttctgaaggaagctactgctatagttccacttgttatatttgatgatgcaattggtgatcctttatctactcttgaccagttttgatagttcattttttggatctggaatcgtactagaggtatgcctgaaatgcattagcttgtattcagaactatgctgatgaaggcatagttgatcatagatagtgttaaagattgtaaatctgcggttttcttttggctgcttttgtttaccattaagatttgaagaaggtgccaggcataggcaattctttctttcccaaagtagacttcattaacttgtctcaattgcaggcgccaaaaagaagttgagctcagactattagaggaggaaactgcaaaaagagttgagcaagctattaggaaacaagttgaagagagtttgaattctgaggaaatcaaacatgaaatacaaagacggattgaggtagggcgaaagaggatacatgaggaggtattagtccaaattgagaaagaaaaggaggcagccctggttgaagctcagcacaaagcggtaaatgtcctgtcgctagctcatcttctgctctttgacattagaacattatcccattcatgaaattaaaagatcatctggagatttttccatgatcaatacaggatgatgggcagagggtatgataggatatttgaggaagactataatcatcgatcctttatctgttgttcaatgctcaattgctgagtggttttcacggatatttgaggaagattataatcaccgtgcttttatctgctgttcaatgctcaattgttgagtggttctcacaatactgctgcagaattctctcaattgaatgccctcttattcttttcttgtcgacgcaggaacgcgaaaggaaagagcgggaggagctagagaaaaagctcgaggaagagcggaagaaagccgaggaggctcagatgaaggaagcaatggagcagcagcagaaagagctggagcggtaccaggagctggagaggctccagaaagagagggaggaagccatgaagcggaagcagatggaggaagagcagcagaagcagagccagatgaagctgctgggcaagaacaagtcgcgcccgaagctgtcgttcgcgcttgggatgaagtagatgaaggaaattagtgccttattatttagtcgatgtgtattttgtaacagtctatctatgcctgaaaacatcatctctcttgctggtaaatcgtttgcagatcgtgggcaagaagaaagctctaacaatgtttactgtactacacaagcctgtggcaacctgcaagttgtaattggcttgggcattttaccatctcatctcaagtgtaagctgacgatttgttaacagttcagaacctccgaacctaccgaatgggttctacctctacccatatctatgccttacggacatagataacctagtgggtacctgatgggtttttaataacataatgaataatatctctataaatagataactgaagtagcaacgcaattaactagcatgcgcgaggtcacggcgacggcggaggcgctccagttcgccatggacgagatgggagacgacgacgagcgcgcgaacaaggcggcgctcacgttcgccctgctccgggcctgtttagattgttgctaaaataaaccttaccaaatttgttaaaattttggcaagttgtcaatattgctaaagttttgacagaatttcttatgtatttactaaatttggcaacaaactaaacaaagatatttattttgataactttaccaaaaaaaatgatatggttgaaaattgcatcaatatgaacagcccctccatgagaacgcgccttggcaagcactgcggccttgcgctattcacctccaacatgaaccgctacggagacatggccaccaaggccacagataaaagtagatttatctgatattttgaagcaacttttaaatagaaaatttttacacaacacatatcgtttagcagtttgaaaagcgtgcgacgagtatctaaattttcatccatttcttttagaggaaacgaagggtaccatggattttaaaccgcattaattcacatatcctaaggttattaattcacatatcctaaggttgtgtttagttcacaccaaaattggaagttttgttgaaattggaacgatgtgacggaaaagttataagtttatgtgtgtaggaaagttttaggctatgtttagttcacaccaaaat

SEQ ID NO: 52365 - DNA, 1628 bp, Oryza sativa
cactcaaaagggaggaaaccccctaccttttcccagcaacccagcagccgttctgatcagttctcactcccctccaggcctccactccaccctgtcggcgatcgagccatccatccaccgatgccgcccgcctccgccgccgccggtgacggcgcggcgcccgaccaagagccgcccccgagccccccacccccgcctccccctcccccgccgcctagaccggcgccctccctcgcctccgcgctccccttctggttatacctcaccgccaccgtctccctcctcgcgatcctcctcccccacctcctcccttcctcctcacccccaccccctctcccctctctcctccgctcccacgcctcgggcggcagcgtcctcaagctccatccgggccccgacctcttcgccgtcacctccaaacccaccaccaccgccgcggcgcaccgccccgctgtcctcgtcctccccggcctcgccgccggatccttctccttccgccacgccctccgctccctctcctcccgcggcctcctcgccgcggccgtcgacctcccggggcagggcatgtcgccgccctgcgacgcgccgccgccgccgcctccaagcaagagcgccttccgcgagatcatggaccgcggcgtcttccacgccttcgagcacctcgtcgagacgggcgaggtgccgttccaggagcccgccgccgcgccggagccgccgtcccacgccccgctctacgcgccccacgaggcggccgcgtccgtcgcccgcgccgtggacgcgctcggcctcggcgccgcgccggtgcacctcgtgctccacgactccgcgctcgtggccggggccgccttcgtgtcggccaacccggcagcagtgcggagcgtcaccctggtcgacgccacggccgtcctgccggcgttccccgtggcggttctcggcgtgccggtgctggggagcatggtggtccgggtgccggcattgttcaggggactcctgcggctgtgctgcgcgcgggagatgggcgcggaggtggccgaggcgcaccgtgcggcgatgcgaatggaggggaagagggatgcagtgtttgagtcatggaaggctctgaatcagagctttgatctgaaggagtggaggggctctttggaggcagtgaggaaattgccgatgatggtgctgtggtcgggttcttggactgataggtggatcgatgaggggaagaaggtggtcgcggcattgccggatgccaaattcgtctaccattccggtggtcgatggcctcaggtcagtgtgatggtttcctttttcataatcaattcaaaatgtagagagtgtttagcattgtgctgaatgtatagcttagctgatgtagaggttcagactacagacagtcatgcaagattgcttgggcaggttggccttcaagctctactttaagttaactagtgatttactatgcatcataccaatgtcgctggtctgatacagctcaccatgatccatcatgttttgttaagaattagtagcacaagcatcaggtgtccattggctaaggatgcaaataatctctagaacggagcagtactcaacacccatcgtctcattgcaaacatcaagaccagctaactgaataa

SEQ ID NO: 52366 - DNA, 1941 bp, Oryza sativa
  unsure (1)..(1941): unsure at all n locations
nnnnnnnnnnnnnnnnnnnnnnnnnnnnnnnnnnnnnnnnnnnnnnnnnnnnnnnnntcttgctgtatcctaggaaacagaagttcgtgtatttgcttctctgcaccaaactctgaagtggcctgcagtgcagaacattcggaagcacatgaggatgaaaattcagataaaatctgttggagtggttcagctgagaatgtaagcagttttattcgtcaacgcatagatgctggtttcctccttgtagaaaagggtactggtttcctgcaattttgttcatactgaaagctgatactgacctttgcagggaacgcaaatctcagtgtctgcacttgtgttcctgagcacactctcaagtcaaacccaaggcagtccactccaatgacagctgcctcctgtggaaatattacatttacagtgatgacccaacattagcaggcattgtacttcctccataatgttcagcaatctgaagaaatttgtacctctatttggatggccttgcacctccagcagagtgatttcagagcctggcttatcttgtctccaccagctctcaagcgcgatattatgttcggtgcagaatgcgcaatgatatctggcctagctttccggtattcccctatctttacctttggctacaaggaattcaagcatgaaaacaattttactaaatagaaattcacagtacattgttcattattcatagactgaggataaatagaaataccatatcaaaatgaaagaactatacctcagttccatatgcagtgatcagctcaatgctcagaacctcaaccttgaaaaatgtagcaccactctccttgttatctttccgtggttcatcatctgtacaaattacagaaacctgtcaaaatcctatgttccagaaatcctatgaatataagatacatttctgagttcatagcaattgctacttgataaatgccttgaaaccatggtgctctcttcagcaaaggctggtctcagttgaccctcaacaacaaggcttgcaggtggtctgtccaaccagtctatactagacttggttgaggtctgcacgtacaagtgaagaacatgatgcttgaacaaatcatggcaactaaaatgacagatgctaaaattctgagtcagatacctctgcaatcatccttgcaaagtacaatggatggcaggaattcatggtttctagatctgtccatctaggcagatcttcgtcttctccatcctcatcgccatcgtcgtcatcgactgcaaacacaccctcctgcaatgttttcagagatgcagcagtgtcaaggaaaatccaatcaccaattgcaattggcaaagtaatcaagaaccctgaatttcctgagaaggatttttcatcaccccatcaaagtcatcgtcaaagtcactctcctcatcatccgagtcgtcatcatcatcgtcgtcgtcatcgtcttcttgagcaaactcagtcgcagatgccgctgccagatccaagtcagcaaagacctgagtgttgtcaagccctatgataacatgctacaaccatgaaccatcatccaaaacaagaattcagtatacaacgaagataaaaattcagaaacaagaacgaaaaccggggaaaaaaaagggcgtaatcgtcaccgcagtcttgtcgtctcccatgatgctctccaggagggcgtcgtcgttgtcgacctcgaagtaaatatctgatgagagcagattgccacacatcacagcatgcagcttcaagaacaaaattaacagtgtctccagcaaaagtcacagagaaggagctaagctaagctagctagctgcatcaaagcatcagctcaagcatccggttttctcgcatacctccgttctcatcggtgaggtaggggaactccggcaggatgatcctctcgtgcacgccctcgtcgatcagcgtcgagatcatcaccgtcg

SEQ ID NO: 52367 - DNA, 1749 bp, Oryza sativa
  unsure (1)..(1749): unsure at all n locations
gatggggagaggaggaggaggaggagatagttatttgtggagaagatagtttcccagcgcgcctctcacttcctatccggaactgaagctttgacgcgaataatgccacaggatgagaagcggagcggcttcgcttcttgggccgagttgggccggcagttgttttatctgatggtacaagtctaatttctatcctattttgaccaccctccaccaaacttttgaaaccggtgtcatttgactctctgagcggttttgagagtggtttttgctgatgtggctcgctgatccggtctaaccagctgactcagcatgtaggacccgcatgtcagtgtcacattttcatctccctctctttcttttctcttttcctcctctttctagcccggctttgcaaggtggtcggcgagcatgctcacaagagccctttcccgccctcccggagcaggcgagcagccacaagctcggctccaccagtgaacgagcatccctcctgtggttagacggaagcggcaatccagattcgtatgatcctagcggatgcggagcatgatggtggtcaatgttgatgacgaggctgttagctcagatagggttggcaattcaggctcgggtactagcaacgctcacgaccagatgaggtgactggaataggtgagggatagggcgccgatgcccacaacggtggttgactccatgaacggcgaactagagcaggtgaggatgaggttgtcgtatgcctcaaccaccacgctccctatcccgcgaagaggaggagaagcaacttcagtgatgaatcagatcccacccgcaccgagctccgctcctctgaccgccatgagctctaagaccacctctgtcgccaccgtcagcgtagaagaaagttggagctgcttcgtagggccgtccgaggctagaaaattttcttctttttttttaaaaaaaatcaaaacataaaattttcaaatcagggttcagcggttttcttagtttttgtgagaaccatatgaaaactacttacaaatatgttcaaatttggtaaaaatttcaaaattcaacttgaatttttgaggttaaccgagaaacactctgtttgtgttctcaatccaggaagtccggtttccaaaaaaccaattgattttcagcgtttttgtaaacctagggactgcccggggaaattttgtgatatcatacaaattttcctagtagccttagagactaatccagctgataattcgcggtgataatctgactttagctttctcaaaaggttacagaggtagcaactttgctccaagcaattgttccctccaatcaaattttacgacaaaatttggtcaaatttttactaaatctaacaagtgcaagacatcacgatagtagtgtttttgaaagacaaatctctacacatataattattttggctctgttcattccagggtgataggggagattgagtctcgttttccacgcgcacgcttttcaaactactaaacggtgtgttttctgcaaaaaaaatttctataggaaagttgctttaaaaaatcatattaatccatttttgaaatttaaaatagttaatacttaattaatcatgagctaatggctcacctcgttttacgtatcttctcaatctcttcaattcccttctcctcaaacacaccctttgtttttatacgggcaannnnnnnnnnnnnnnnnnnnnnnnnnnnnnnnnnnnnnnnnnnnnnnnnnnnnnnnnnnnnnnnn

SEQ ID NO: 52368 - DNA, 3328 bp, Oryza sativa
  unsure (1)..(3328): unsure at all n locations
aaaattgtcaacaacaaagttgtataacgcatcaatattacaacttttgttttggtcatttttctatatgactttgttttaaccgtttgaatttaaattttaaaatatgacaacttcaaacaatattttgaaatactaaatgatttcaactgaaaaagtcatcaacaacaaagttgtataactcatcaagatctataacttttattttggtcatttcttcatccgacatagtgatagtaacattgtttataaaatttatatctatatcatttggttctataaactataagagagataggtaaactttgtaaacaatactactatcactttattggacgaagaaatgactaaaataaaagttgtatgtcttgatgagctctacaacttttatgttcatgactttttttagctgaaattaattacagcttcaaaaatattatttaaagttttgaaattcaaatttttaattgataaaacaaagtcaaaagaaaaaaatggccaaaataatagcagtaagaacacaataacatgatagagcatgattttagaaacatttaggaaaaaaaatcatccaatttggagttcatatgagtgagataaattagtttcaaattttcaaattttatttttgcatacggcttcttaagtcacccgtgtggaaaaatcaatttttccatgcgggtccttaaatggtccacaaacaaacaaatgaaaaaaattcaattctgaaaaataactactcaaatttttaaaaactttcaactgaaatgttcaacccaaaatttaaaatatttaaaaaattttcaaaaatttcaatgtgcttacgaaaatttcagtgatactcattaatttatttgtttcatgataacataaatttgtatggaaagtaaacaaaacattttctatctccccttgcccttataaatagagataaaatttgagaatactgatgttttgtttttgaaaactaatggctatatcgtttttagaagcttattttgtggggtcttgatattttgataattattcgttaccgtattcatttcgattcgtattcgctccgtatctgtattcgataatattcgattccgttttcgtatccaggtttccgattccgatttcgattccgagaataaaaaaatgaaaacgaatatgatagagctagattccgaccgtattcgatccgttttcatctctactaccgtccctttcagctgacataagtacgtcatggacaaatttctgcatcagttccatgcgttttgcttgcgtgtctgcaactccaaatgtcacacatgcatgcactacttcaacagtcagatcgatgatccacaggtccagacaaatcgatcgagacaaaacaaaattaaagcaaatacgaaagcaacgacgtcatgcatagtagacatctataccaattcaaatacgtgcattttgaattcttccggtgatcatccatcttggactatataataatacaaacaaaaatacttggtctcttgtgaggaaaacaatacatacatctatccatctgcttacgtagatgataggtacacaacgacgataagtatatatacacgaactcgtcctttgaatatgaagtaacccccgtttgaaaatataagtcaagtatatatagataatcttgactttactggataacaagaccatgaaaataatttaaaattttgcgttttgctagtactactctattgtatacgtatattgattgattgattgttcaaatttgacctcgacttcttggagttatataacgtttttttctccattggacgtacggcttgcacatgttacagcgacatctgtatgggacaactactattcatatacatattgtactatactatgcatatacaatttaaaaaatgaattaatcaaaagaattgaaaatgaagtgatcgaaacggatcgactgatcgagatggctacgtacattgaaagctacgtgcatgtaaaacgacgtcgtcgtctttgtgaattgtgacgaaacggacggagatggagacatgcatacatttaagtcataatgtttattagcaaccaacaaacaaaacttttgtatacttgtttttaaccataattaatattaaaacggagtaatatctaatacatattggttcgcaagtctttatacgtatcgaatttagcagccgacactaacttatagcacgaatgatataagttatcggtgtcggtcctacaaccagttctaatatttaattagtctcccgtattagtcggaagataaagagaaaatgcttatatttaaccgatacatataggaacgtccttcattagagttctatgctagtttgaaaatcaaaatactacactacacgaaagtaaataaaaaatcatcttaaattaagatatactaatattcaatttccgtcagcatctgatgaattgaacggttgtattcttccccctccttttccaactcataaactcagtttttcgtacgacgataacttcaccttccgaacatagccataggccgtcaacgtgttcgtctccatgtactgaaagcgtcatgagtcactgtgtcaatacaaaagttggagtaggtttgcttggtttgatcttttgatgcttctcgacagttccaacaccggtttcccaaaaattcagctgtccatatgcattttccatcttccaactagcgtgaagacaatttgctgggacttgctcgtatgaatccaaggcgtgcatggtcagaacttcaacgtgtgtttccgtgttcctctctatctgcccagcacatatatatccatggttatctagaaaaacatgcacatcactctcgttttcatcattcgaaaataatatgaataactagtattctctcatgtttcaaacttatcaacttaatttctttgccatcatccaaaaaataaaaacaaaattatcaaccataccctgatgtccactaatataacgcacatatgcaggtggatttttaacaggaatttagtgagattaagcggatgtgctgtcggtttccgtctcttaaagtatgtgttaggggactattcgcgagagtgtgagtgtggtgttgcgtgtgtagtgatctaacgtgcaatcttaaaaataaagctcactaatgtattttgcctaattatcttactattttctcatgaacttttaagaagatttggatgggatttaggagctagactgcctagacttggctccgtcctgtttatagacatttggatttgaacactaataatggtgtcannnnnnnnnnnnnnnnnnnnnnnnnnnnnnnnnnnnnnnnnnnnnnnnnnnnnnnnnnnnnnnnnnn

SEQ ID NO: 52369 - DNA, 3855 bp, Oryza sativa
tgatttttttggcagtcaaaaatacccaccaagtttagtcattatcttggcggctgaaattaacgcggctatgtagaaaccaccaaggtaaagtgtattcttgtcggtctagaccgttaaggttatatttcttagctttccaaaagtttgatattcttcatagttttcttggcggttagaccaccaataaaactttcccttatggttaacagtcaagaaaatctggatttccctgttaccttagacttggtggtttttgggcgctaaaaaaattacggattcttgtcatattagaaaaggaaagcaagtgctttcagacgaaatttccctgccaatacttggcaaccaaggagctaagccatagttagcaccagctggaactcactgatgacttgattcatcaacaaggaaaatgccgtggtctttccattgatttggctaggtggtggtcaatcaagcagctaacgcgtgcgcatgcatttgccggtatcatcaaacacacaatggcgtggactgactgtgtggatcaagcgtgtaatccttgacccacaccgagagactgatcatatcgatcgatatgatgatccgtatcatcactgctactctacatatcggtcggttgatcgatcggttggtccacacccacttgtctcctgtatgctcctcctcacctgcaaagatgcatggaatcagcttagtaataatcaatcgccagcagcagcagcagcagcagcagacagtgcgtgtagtagaacagtagaggcgttcacatcacgtcgcatgtgcaggtcgtcgtcgtcgtcgtcgtcgtggtggtggtgaatcgtccactgctgatcctgcagctagcctcactgtccaatgtccatccagctccagcatcgtccagccccagtagcgccctgtaactgtacagtaatggacaagaacaaacagtacagcagtgtcctgatcttgagagaggttggggtccatgaatgcatgcatatgcctctcgatcgatccatggcgatcgacatggagcaatccgtgtgggctcacgggagctgagctagcggctggcaatggctaactttcagggaattgaagaggaaagccaaaaggcaaaaagctaaaccctaggacagtggcaaaagcggctcaccttgaaatagattattaaagggattactaacgaattatatacttaattatataagtaaatgaaatattttgataaataaacttaacaaattaaatagcttccaataactagtttaaggctgcgttcggacgagggggttcccatctcctctctcgtattccgcgcgcacgctttttaaactactaaacggtgtattttttataaaaagtttatatacgaaagttgtttaaaaaaatcaaattgatccttttttttaaaaaatagctaatacttagttaatcacgtgctaatggattgctccgttttccgtgcgaggagatgagtcccaaccccatattacgaacacaccctaaggctgtgtctggtagcttcggttgaaaacttttctcccgcacacgtaaaatagagtgagtagagtgagttattagtgcatgattaattaagtatcagtaaaattcactttaaaaatagaataatattattcttaaaattaactttgctatatttttttttaaaaaacaaactgtttagtaatttaggaaacgcgtggatgaaaaacgacagtactgtagatgttgtgaaaggaaaagaaaaaaaaaacgcagcctaagtacattaaaagagaaactttcttttcgagaaaatgtgattttttgaaacatgaagcaaacacttcatttcaacaatccaataaataatctgaaaagcaacttaggtcaagtttagttctaaattttttttttcaaactttcaactttttcatcacatcaaaactttccgacacacacaaacttccaacttttttgtcgcatcgttccaatttcaaccaaacttccgattttagcgtgaactaaacacacacttagcattggtcggagtacaagtacaaccaccatctaaggggcaggactggctactgtgcggcattggcatcttgcttgtaccatggatcgatcttgccaaacattttctcctccatcacctgcatatatccatcgatccatccatatcatgcatgggtactgtacgagtagtacgtttgctgctgctaccttttctggttgtccatggccatctctctctgttcatcacacgctagctaagctatcagctggttagctatagtcatcgagatgatatgtagtacagatggatcgcacgtcaacttttgcatcgttgtgccggtctgatggggatcgaatatgtatgtgtcgatggtcagttcgtcacatggtcggttctatagcttggttgggttggccgcctgcctgcttcgttggtttgcttgtggttttctttcttgtcagtgtcggaaaaccgagacttctactagaaagttgttcatcggtgatttcagatttaacatgtggttttgttaatttattgtgtcggctcaaaagaatagtacttactagtactagttatcatctttcccgtggagttcccaacttctccaaaagagaacacgcctaatacttaattaattattcagtaaaaagtttttgcaaaaagtttttttatagctaatacttaattacttcctcattttcatattataagactttctacattcatatatatgaatgtggacaatgatatatgtctagtttcattatcatatatatatatatatatatatatatatatatatatatatatgaatgtgggcaatattagaaagtcttataatatgaaacggagggagtaattatttagtaaatattaagatttaaaaagaagtaaccataataccctctattaaatgatgtatggttgaatgtaggtgtgaggacagaggttgacacaagtacacatatttcgaaaatgctatgcatatgatttatgtcattatgtgtacgattgctaaaggatgaatatacatatgtttcaaaaatgctatgtatacgatttatatatacgattaaatgatctatgcagccacactaaactattttctctatttataaatataagagattattttaaatttttgaagagattaaaaataaaaggaaaatactatatgcctcttatataagggatgttgagagagtgggaattgtcggggacaagatattaggtgaaaattaagtcctaagtggttaattggtagggaaagttgtactatataatattcccttgtatttattaacaaattttgaatcctaaaatctcttatatttacggaatggctaaagagcatacgatattttttaacacaaaacttttgaattgttgaccgtcagattgtttcgagatttgtgcgcgagggagaaaaaggcacagccagagtcgaacacatgaccggttagatgcatatcatcattgctactcctagccaataaggcgacatgtcgtttctattagttatgtacgagttacatattagttacagcgtaactacaataaaattgtaatcacacaatagttattgttgaaagtttgttttaaagaaaaactatcaaatgttcatatagctacataactatatggtccgcgcgcgttcgtataaaagggtgtttgttttgatgactaaccttagtagtaaaaccaaatcttaggtagggaatatggtccataaatgtggttatagtaaaatgctggccaaacttaggaaaacttaatatgcaataaacgaatctttgacgtgtgtggggcatatacctacaattgaaaagcgatgctaagttacaatcgtggcattgctaatt

SEQ ID NO: 52370 - DNA, 1475 bp, Oryza sativa
  unsure (1)..(1475): unsure at all n locations
aaaaaaaatcaacggcgtcaaacatttagggaaggcggcgacagcaactatcccctcctggatccacgctgatccggcggcggcgggagaaacaaagcggcggcgaagggtgggcggtgggtgcgctttttgcctttttttttattcagatttttgttttcgcatgcgaacgacatgcgtccccgcacgtgaaaagccgattttcacatgcgggtgcaccacctgcatggaaaatttagattttcacggacccttccggggcagacgggccggaggtccgcacaagaaaatcacttttggcccgtctggaaaaattactttttactggtgtttctaggtttagtaaaaatttcgtttgagcaagtttaataatagagctaactatgagtttatagtatatattagagttaacatatacaatagagaggctataaggttatctatattttcttcttttctctgaatctctcacctgtgcatttaatgtactaggtgaaaccccgcgcattgctacgggaatttagtatggtaataaaaaaataacgtataagatagctagataacatcagattaagtaattaatgtggtttatgataatttaaatttaaataatatgtagaatggtgatttaaacgtaaaaagtaaggtggtgtgactttatggaagaagaaaagtagagagatagtttggaccgtagattaatcatttaaagctaaaaacaattgatgtgatatgacttaattagaggaaaatggagaaagataatttggaccatagattaatcatttaagcactaagtgatgatgaactatataagtatataggatatcataaaacataataaagatatacattgaaacatgtgaattatgttggatgataatttaatatgtttgtatttgaaaagctcttaaattataaaaactataaagatataacatgtttgtatgatgtttaaatgtgatgattgttagtggatgatgatgtggcatcttgttaattagtggattagtggatgatgatgtgacatctttgcatgctaagcttaaggaattagtgggagataactttatagtaagatatgatgataatttaacatgtttgtatttgaaaagctcttaaattataaaaactataaagatataacatatttgcaagatgtttaaatgtgataattgttagtggataataatatggtatcttgttagtggatgatgatgtgacatctttgtatattaagcttaaggagttagtgggggataactttatagtaagataggaatcatcttaaagtgtgtgaatagctcttatttgagagacaattcttctcattttttgaattttctctcatttacataagtttattgtttgcttatagtctactattaaacttgctcttaaaagagattgcaagnnnnnnnnnnnnnnnnnnnnnnnnnnnnnnnnnnnnnnnnnnnnnnnnnnnnnnnnnnnnn

SEQ ID NO: 52371 - DNA, 2595 bp, Oryza sativa
  unsure (1)..(2595): unsure at all n locations
cgtaattgcaccaactcatgaagaagcactcatggttctaacaccacacagtaataagaagaggttctctcagctatgagccaaggacactctctctctatatataaaatagtatactctttcaatttttttacactagacctcatttattttaatgtacaattattgctagagctacctattctaaacagatgcaaaataatttcatataacctctcgccacccaccggcgatcactttccccaaatcatgggttcttcgtccctactctccatgttgtcgatggaattgtcgctatggatccaagcctcctcctctccctcccccttaccatggtgacaccattgcccaagtctttcttagctgcagtaacgacgataaagtcctccacggccggtatggcgacttcccaagtcctctacgacaacatattggtggtggcttgatttgcttaaacaatagatctactcgctagagtccttcactagtatgatctgctccatgatggttgttctcgtccgcggcgatagtcagacttgtctggctatgccatcaccttcctcattgggtgctagatctccgtgtgccacccatcttttctccgtcacctctccttttgaccctctaaactaccaaatctcttcgtggaccatctactctcacttgaaaccattttttgggcctgtttggctggagctcagccaaacagtttcagctccaccaaaactgggagtggagttgggtggagctctctcacaaaatatactagagttgtgaagctgggtctagacagctctacaactccactccagactcaactcctggagcaatatttaggagttggagctgtaccgaccaggccctttctctacgaggctaggcatggctccacccaagatgatggctctaccttcaacgtggaaaggcgaggacactcgcccattcaccatatagagcatgcccttgtgtggatgtcctaaaaagatgggcggagcacctcgcaacactgccaagtggagggagaggcaatgctggcggtggcaaccattggaaggagaggaagataagaaatggggcaaccttataaattggtatgggaatctatgggagcaatcttagtcactcaaaattgatattttaaaaagagtaaacaaacaacaagtagacggcccacgtgtaaccttccttatatatcatactgtgcacggtgcaaggatctcatgcttccaagtaatactagtgcgacttgcttatgataacgagaatgatatagacaaaattaatggtttgatcagcaatttctggcaatggccttcaactacttccagcctgctttaaattggcacggcaaatgttaagccatgatggccgtgctgtcacagtcacaacggagagaagaattgacttgatgatagatcaaaaggcaaaatgctaagctaagaaaatggtttgaaaaataagtgctaaacctgagatttgttttaatgaaaaagaatgctggaccttttgtcttgtatatgcaccaagatgcaggaagtagagaaataaaacacttcttcattatcttgataatataaccatgcaaagatgatcattcgtatgagggatggccaccatagcatgaagtatcgaatctgaacaatgagagaatatatggattgtgccgatgatgtcccactggccaatctgataaacctgcaatagtatgtatatcggtggttaggttagtcataatgcatggccgtgttaagccttaaataaggaacatggctccgtccaaatgagcatcccatatttttcgaccaaaaaatgagagaatctcatgtggccggttggctgtatgggagatctacagtgcagtaagaacattcatggttgcaaccatccaggaaataaatgtgacaccatgcccccatgtggtagcattaggctatgttatagatggtggaaaaattggtagtttagagaaaaagttgatagtttatgtgtgtaggaaagtttttgatgtgatgtcatgaaaagttgagaattttggagaactaaacacggccttaagcccttactctgatcgctatgtgagcatgtttgtagcagaggtgatggatctcccaatagactggtcactttttggtcactgaacgctcaagtgaaatattaactgtttgtgaacaggaacgaatttttcatgttaaatctgtaaatcatcggtggaaataagcagaatgcattctagagcaatttgtcatctcgaagctagtgttaagataaataaacaatatgccctctagtaaaatattctaaaacaatatattaaaaaatagagtacatgctgcaaggaatattattcgtccttaatgttgttatcaaaagatgaccaggtagatactccctccgtcccaatttaagtgcagccatgattttccgtgcccaactttgatcgtccgtcttatttgaaatttttttgaaaaaaatttaaaacgtaagtcacgcgtaaagtactattcatgtcttatcatctcataacaataaannnnnnnnnnnnnnnnnnnnnnnnnnnnnnnnnnnnnnnnnnnnnnnnnnnnnnnnnnnnnnnnn

SEQ ID NO: 52372 - DNA, 1519 bp, Oryza sativa
atatgaaaactaataacacctagagcaaattactaatttactggagtaactactccctccattccataatacaacgcaatttgggtttgtcttagagtcaaatttgaccaagtttacaaaaaaacgtggcaacatctacaaaatctctctgtcaataaaattatgtactacagtatgttttcttttgagtctctagaaatgctccaaatagaatttcttaccgagcactagagttcaagttccacacttccacgttggccggctgttcagctgcttcaaaacccttttgaaagtcttattatgacaccataacaaaaatattcccttcttacagcacacagttaactatgtgtaaataaagctttcgaatagccgatgacaaatagtagcgatgtacttatctgaatattgaatccatcaccaactggaaggctagaaaactgacttcagacagcgattactgttaaaacaaatcttgcttggattgtttgtaaatatcatcttctgtgaataacataaagtacgcatggtttaggtttttagcaataagcaaacatgacatatccaatcagcaacagtttttaagccctaggttaatataaagaatccaaatatgccatgagcgagggagtaacagaatataaccattgccctaggatcacaagaatagacttttggagcttgatcgttagggaacaaaaataaaaaactgctctttaaattaatcgatgtcacttattcactctatgcaacaatcacttagatcccctacatccatctcagtatcatctgcaagagcgccatcatccatgatatcatccgaatcttcacttttgacatccaatatagaatcagtagcaccgctactatcatcattaccaaacaaatagtcctctgaatcagacaactcggcaaatttaccaagattcttgatcctccctctatagctggtaagttgaaggactttttccttccacctcaccaatgggcacttctctattaattctgtcccatcataagactccgtcaagaatacgctaaaccgcttccccctctcagagacataaaagatgccataatgcttcagaagcagtctcatcaacttctgcggcataacaaactcacgacggaaatgtgtgaggtgatcagtcaccagcctcttttccaacgtgaagttcagtatctcatgcatcactgcaactgccctcttgtcaaactccggcgagccaggagtcaatcctcctggttctgcataaggagataggtatgttgtcttctgaaactgctcagtattgccttttttcacataatgatgaacttttccgcggaatttgtagtaacttgtaaaatttggtgggaacttcatggggaatgatagtgagagctctcctggtggactggcaatgtcattagcatttgcatcaccagtcaatgctgccgtctttttctcgagctcggtgactgcccagtttggattccaagagacaagctccaggtaatcgccgtcctccaacctgac

SEQ ID NO: 52373 - DNA, 1812 bp, Oryza sativa
ccttcttgagcgtgtcgatgacggcgagcaccttggtgagtaccttccaccgctccgtggccacctcgagcgcgtgcacccgcttcttcttgctccgttgcctcacgctgcggctctgcgtcatcccccgggcgagagataactgtgcggggcagcagaatcggccctggccctggcgctggcccccgcagcggagcagctcggctaggcaatcccgcaaacacgtggtgcgcatggtgtcccgaacggccggaacaagcatacgcaggagtaagacgatggtacgaacgcaacgggagcaggaagcggcggaggacggcagctatcggcgcttctagccggcggcgagaggaggaggaggccaggaaggggcggcgggatggccggaaagaggagcggggaatcaagcggagcacgagcctctacaactgcaaggacagcaatggcgatgcttaaaattagcccatgtgtttggatagaagatctagcccgcagccttattaggcttgttagtttgggctaatccaagaaatattttcaaggaacaagttgtaatattatttaaattaattttgtagttattgctaatacattataaaaaaattaacaactaaaattcaaggctaatatcactttaaaagacaatatatcctatatttcgataaggtaaagtacggtctactatattttatagaggaaataaatgcaagtatatataccatgttattattgtatattttaataaaaaaatgtataaaaaggcatgtgaattataaaaatacgaatataaaaggtgatgaacatattttctgctaaaacaaaatttactatttacaaaagttgatgagaaatgttcaaataagtatgcaggttgaaattggaaacggtaattgaacatagttgatatcctatatttttataaaaggtaaaacaattagtagcaagaatgaacataacaaaaatcattttctcctaataattgtgcaaatttttacaacttagaatgtagtatgattttacataagtttcatggaaattcaactaatttatataaaatgttatgaaatttgcactacttaatagcacaaaataatatacacgggctataaattgacgcgctaattttctagtaattaatgtaaagaacccctaataaaaaatgcataattttctgatctaaaccatgccgacacggtaaaaagttaaaaaaaaaaacattagccttgagcccttgaagcagacacagagaaggcaagaatgaagcaatggtgatggagtgcgcactggaggccggagcagagccgtgccgtctactcaggactcgtcgagcaggagggagagggacccgactccggtgcgccgtcgccgccgtgaggggcggccgcgcgccgggcctactggcgcctgccgcagccgcagagtgagaggacgaggaggcgaggggcggcggagatgagacacaagcggagcggcggccgtccgggcgcggtggtgcgcctctcctctgtcgtcctaaccctagcgcctgtggtgggcttttttttttgtttgggccgggccaaaatccaggtggtccaaggactccccgcccctgtgatggaccgatggacgtacacaggggctatagcatccacgccgggtaatgacctggttgccgccttgccggcagcccggctagggtctgtttgagggagctttagattctgagaagcagctgctgggtagccagcttctgagaatctagaaaagctctgaaactcagcttcttcagtttctggcttcttagttaatttatttttcagaatctgtaac

SEQ ID NO: 52374 - DNA, 6118 bp, Oryza sativa
  unsure (1)..(6118): unsure at all n locations
gcgcgcgccgagggaaaggaagagggtgagagattgggagaaggcggcagagaggaaaggggagaagctgaagggagcggaagagacccatggatttgtggggcccatagcggaagaccacacggcgacggcaccacaactggtattgttgcactgtagagcggaggcggatagaattttcctgtatatcgcatcggatagacctggagactcctgggtactattcgcctgtagcacctgagatgcccctcccaaaaactataaattctacagatttgccactcttacgagtggttctaaacgatttgttacttgactctatgtcatagacacataagggcccacatgtcataggcagcgagtgacaaattcttaattgccacaccttaaaagtggcaaataattaaatgtccttagtcgacgacgacgatggtagaaaatgtttgggttgccagaaaaaaaagagagagtagagcttcgcattctcctaagtccatgaagaatacacaatcttgtaaatgttttatacaacatctcactatcatgttgtgtctcagttatgaagaggcaaattgaaaaaaattgtgaatacataataggtctatttcgttatccttttgctacagctgtgtgggctataactacaagccagtaacggtggtttatatcttgctgactacaatcacaacaacgttttagcatcacctaccaaataggcccaatgtaaaaatatgattcggttagaaaaaccaacctatgcaaattatggtgcatgttcctcgcatcattcttgctaggcctcaacagcaaagagcgaaacttataagcatcggttattgtctttcttatgtcataaaattctatcgatagaacacaggtagtagcccaatgaatgcatgcatagctagtttgtcagattcgtagctagaaaataactacattttttggatggagtaccaatcataagttaaccagctgcctcagcaattgagagttgaacgaattttgtaaagaacgcccagaaggttgggcaaattacattttgagaataggaatatgaaagaagagctaaaaagaaaaagaaaagaccatcaagttcttgtctcggccaaatctaataggaaagagaactagtgttgagctgtagaagatgatggggacggctaatgggcgatcgatccccatctcactgtacactcctctccccccttcctccctcccctttttttcttcctactacaccataattttttttaaaaaaaataaggggaaaaaatttatgtatagaaatattatatataaaaaaaaattgaattcaaattcaaattggaaacgggtacgtaaacttttgacttataaactttgggtctataaactaatatttgaattcaaaatcaaatttgaatcgggtatgtaaacttttgacttataaactttgggtctataaactttaaatgtatagaaatactatatataaaaaatatttgaattcaaattcaaatttgaatcagatataattcaaattcaaatttgaatagggtacataaacttttgacttataaactttgaatctataaactttaggtgtataaactttagatatatagaaatactatatatataaaaaaattgaattcaaattcaaatttgaattgggtatataaacttttgacttataataattcgctctacaaactttaggtggataaactttagatgtgtaaactttatgcgtataaacttaataaaagagaaaaagaaaaaaaacaaaaacgatcgccgccagcgatcaatcgctcagtaggactttcggaagatgatgcctaggctcgaacatgtatggggcttccaagaatgggaggttgaaggagttttggcaagcaaagataatatcagtcatatcttatatatctctcactggaaacgaaaaagaaaccatcaccgatgcgggaagcttgtaggagaagaattgagcgatcgtcatgaccttcttttcgtttggatagaggacaactggacaagtcctcaaccccaagaaaatcagctgaactcccaacggtaggcgttgatggagaacccaacaaccaccgtccatgaagtcctgcatgcctatcaagtcatgacaagaatagccaaatgcccgtaacctcttgagttgcataaagaaaggaaaaggaagaagaacgaaatgaacagaagtacaggtttaacccaactagcctgcccctactagggaccaaagaaatcctatccatcattctcccatcacgtgacggtgagccaccgaaatcacaaagagggacataaaggttggggattttcgtggtgctaggaggttcgcaagagctccataaaagaagagttttcagtttgttagtactttacatttgtatgtgtagtttgtgtaggactatgggtaagctagacaaaaaaaaaatccacggtaggaaaccatgaaagcaagagatcatatatcgttaccacttaacaagcgaagcaatgggacgagagtcagtcagattagccctgtccagcggatcatagatcatttagaaataataatgtatcaaataaagagtcctacgattaagtcacattcttataaattaataataagttatctatttcacaaaacagaataatactttattcatttcattataaacatagtatatactctatagtatatgatacaattcgtctctctagggcatatagctgatagtttgcgtgctgcagctcagcttgcgtgtgtgttgattgtgttcacgtcaatttgttttccaatagtaaaggaatcgctcctgaaaaggaggataatgcctactagttacaaacaacaaggacaaggcccagttttgcccttaaaaccttaaaataggattaaattgacctacagaatcctttacaagctacaaattcttcagatattagaatacaccaaaaaatgtggcaacagcaaacagcaaaaaaagtactcctcctatcaggccaacctggaaaattgtacattcatgtaagtgaaatacccaaaaacctaaaacacaataataccgagagcattaactattaaaccaaaacaagaaaccaagttaattgtacaaaaaacttttaccagcttctcagataggtagttggcaaggaatgctcccccaacaattgcaaggaaagttgcaaccaagtgtccagctatggctccgcttgcgacaccaaaaggagactacaaaaacaaagacatgttttttttatggtaatacaaatctaaactaaattatacatatgcattctgttgccaagtccaaaacaaacctgagcagcacctaacgcaattgtagccagcatagagcgatctccccattcctgccagtaaaaatcatttggtgagcaataaggtgttagttcactacgccctttgttaaaaaatagaacagctattttgtttcgttcaaacaagactttgaccaaccaataacctattagaacataatttttgtgacacaaaatttatgttattagattcatattcggagtactttcgtatgattatgcttttgtatggcataaatgatacattagtacagcaatgttagtcaaagccttattgtacatgggaatcaacttactgcaaagaaaacaaggctgaaagacttccaaaggacctcaagaggactagtcaactttttagccacctgccacaaagtagaaacaaccttcagttaaaaaaaaaaaaggtgaagagcagaaaacttattttgatacttaagttttgccaccccccccccaaaaaaaaaaaaaagaaaagaagaagatggttttaataaattctcaagagcagcagatgcaaatgttccaaatatttagttggctactgcatgcttccagctttgcagaaagtaaatgcaaaagcaaaacatttatatgatttgacaaaaactcttcacagaatcaacattctgaaaaagcacaaccttctccttgacaagctcctcagcctcagccagctccccagattcagagtttccctgaaggtttccatttgcattatctggaagttgccatgcatcttttattgacttgaaaccaaaaaatgccaggagagcaatcgcagcatactctcctataggtagtgctgcaaaaaaaaataataataatcatgtatcaacaagtatgtccattaggatatcagagatacttatggaaacttccaaaaagtaaacccaagtgcagaaagaatgccaaatatgagtactagaaattacatagagatattgccagagaaagcatagtagtttatacttgtttgaaattgtgctggtacagactgaaaaatccttccaattataacactcacaatagtcattagggaaagagcagccattgacccaagtaaaacctgttcacaaaattacacaggcacataaatgttagagtgactagccaaagggagacattctctaaaataaaaatgaaaattgagggaaaaatatatttctctaaacccttaatataattcagttgcccggcggagaatcttaatataattcagttataggtagaaaacaagtctttagtttttcttaaatgacaaaaccatcattttgaggttgtatcttttagttcggtagtgacattttattattaatcgttttttacatggaagaacatattaaaagaagagagcaacactgtgaagagaaaagaaacaactcaaataattggacaataacttgagacagatctaaatcaccatgcccaaacgtaccaatgctctctgatattgcatcgcaagaagtgcagcaatgaaaaatgtctgcaacaaaagaagggtcagcgcaacaaaatttctttgcttgcccaaacatattaagcatatagcataagctttacagaatggtaaaaaaaaacaattcttgaacatagctccaagctaggagaacactgaagatcatgtagctacaactaaatgatagtaatacaaggagaaaaataggatctacagtaggtatgactccaaaacagtaaatgagtaattcactatgaagataatacaaatccaatttgactgagttgacactcaagttgtaaagccttgaaatatcataatttaggagcataaaagtacataaaactacttactgcttagcttcatgtatagaaaacaacaagaaggtctcatcatctatcaaattgcaacaataaatactgtgatgtagcatgggaaagaaatgaaactatagacatttggttggacatagcaaatgtggatgacctatttatttcagaaatggagcatcagaatgaaaactctaagaaccatagaatccagacttcataattagtcaaaagaaggtaaagagcatctgtaatgcatctagaaggataaggcaagagaaaaagtcaactttaatggactgtataccttatccccaatctcagatacaaaaatcagtgtaaatgctgccgtgaaacctgactttgcaagcatcgctacaactgcagatggttgtcctttaaagaaaacaataaaagcggatgccagagcacatagaagtagcactgcagcaatggattgagggtaacgagatcctgaaggtggttttgttctgccaaccaaagccaatgtgcagtttaatgctatttagaagagattgggatgaagattgagttaaacatagtagagtataggaactcacggtttgtttgaatctctggtagcagaactatccaaatgttccccatggctacctgcttcgccaccttcatagcttccagctccaacatttacattggatgtctgcactctaacattgtgccgtattggtctcaaccatggtaacctacatctcactgttaaaataaaactatgcaatcaaaatagtataacgatgcctgtccaaattcaaacaagaaatcttacaaaatggagtcattatgcctgaaagtagcaagggaagatggttttaggtggtggcatgaatctaaggctcctttgacattaaaatgaattgcggatgaatgtgtagagttggaatccataacaaacaatacgatcaacttcatcaacgagtttcacaaagannnnnnnnnnnnnnnnnnnnnnnnnnnnnnnnnnnnnnnn

SEQ ID NO: 52375 - DNA, 1847 bp, Oryza sativa
  unsure (1)..(1847): unsure at all n locations
tttatcttggaatttgcaatggcatagtaatccaaagcccaccaaattatctctcctgtgcatacaataaagaacctatctaatttttccatcctacacaacttaggagatcgataacctgaaatcggcaaaacctgatgctagcttgaaacaacaattggggtctaaaacttatcataggctaaacatttacatttattatgaatgcaacgcccataattttgggtttctctatgccactatggcactatctgaaacattttggcccttcctccatgacactatctgaaattagactaggggttgtttagattgatgtcatttcaaaccataacattttttggtaaagttgtcaaaaatgtgcatctatttagtttttttaccaaactctggtaaatacataagaaaccctgccaaaacttggcagtattgccaaattgccaaaaattggtaaagtttattttggctacaatctaaacaagacctagattactgtactagtaaggatgccacatatgtttgattgagccacattgactgactggcctgatcatcaaccatgcaagaagcgttcgagcacaagatccctgattattactctagtggggcgtgagagaagaggaggaagggagcaggacatagagatgcccagaccttgtccttccacgaggcaccgccgccgcagaagcagcggcggccctgccccatcctcgcgcctcctgctggcggctggcactgcgacgccgacggaaatggccgttgccatggatcgaagaagctccggcgtcggtgacgtggaggaggaggagcaggaggaggcggcggcagtgggaggggaggcgcccgcggtgggggtagagggtgaaggggaagncgncggcgtggggggagagggcgaaggcgctgagccggcgccggcgacggcgacgagaaggagaggaggcgggcggcttatcggcttcgggagttcggtagcgcacacgtgccaacagttcttcttcttcgtctttccttttccttttttttaaaaaaaaattattaaatttcagagaatcaaagattattataggctcgaaattacatgaaacaacataatcctccgttccataaaaaaaattgtagtaccggatatgacatattcgtccagattcatagtattatttttcatagtattggcatgggcggcttatataacttgggtactatggtcatattccaaagttaactttgctaacgtagtagcaatttttttttaaaaaaaatggttatcttatatggttaaaacttttatacaatggatcaaagatttttttataaatttaagatttagttttagaatttattggtatagtgtatcgatgaataattggtcaatggtaccattttgtgaaactctgctcacataatacttaggttatatgccaagtaattattggtatgcatgttgaccattattttttgggtcatgtaaattttaccttcgaaatgcatgatgcatgaaaagttgttagaatacaataaactaattagcgcagctaagctggcgatgtaactaagcacacgtgcgtgtggttgcgcaggtgcgccctactcaatgggtcttattggtcgaagaaggtataggcattctttttcatattataattgatctaggagagatggaaagttatctaaatctggtatttgaaagtaaaattttatgatagatactttttcaatatagatttatttcaaattttaaaagtgagtaagctttcaactctaaattttaatttttcaattcaaaattttaaagtattctacccaaaatatttcaaactttttaacctaaagtacaaaaactttaa

SEQ ID NO: 52376 - DNA, 1608 bp, Oryza sativa
  unsure (1)..(1608): unsure at all n locations
actgttgtgtctagggattcaagtgggtagtcccgctatccacataaaaacccgtttgctagtttatttttcacatggtagtacaaaatttagaagaaaaaatgaagtagaagtaggataagtgggcaaaaaaagcccgcttgcatccgtggttgtgccatgtaatgactgttgccaaatgtggcttttgtgctagttaactctagttgccaaactgatgtgtgaaggctttatattgcctcacactatgcccaattgttgctatgctggttaagtgaacctaattatgtgctgctatgctggttaagtgaacctaattatgacttattctgctataaagattttcagacttgtgtgatccaaattgtgtcaactattctttcctgagattgaatttatccctgtcgattgttatgtgaagccaattgtgctacccacttgttatgacagacaaacacatattctgctgtaaatgaatcaaaattatgtcatgccatataaaaaaaatcaactagcacagtttgtaacatattcttgccaaatactcattgcattcataatgcaagttgtagctgcaaatactacaacgtgcagttcacattcttgataccatcacagatacgacaagaacacagaatatgacaacaatcgagagataaaatctctcattctctaccctagtgtttacgtactaattttctctgcattctcacaacccaaggctttgactgactccaactattgcctggcagcatcaagctctctgctcttctcctctgcattcaacctctcttcttgaacagccaaaaccagatcttcattcttcttgctcattgaccaaaccaaatctcgcaagtcattcaacaaatctcacatataagtggttgttggcccatcaaaccaagaaaagaaattgcatctttgaagcatctaggcccctgttgttagttttggtaattaataacaagcactaattgtggactaaccgttgtctttgagctatatacatttaagttaggttcacatcatgtgtgcgcatggatgattatcgatggattaaaattgacggcgcaaagcaaaaggaagagaagacggtaaactagtgttttcattttaaattgatcgaggcgttgggcgatcaaaattgtgctagtttatttataggtttgccgtactattaagaggggtaatgatctagcaaagatatgattttaattgccacattaggtcattatgcatttagacttgtgctcacatttcacaacacacacaaccactttgtattcattgtctcggcctgaccaggggcagtggcggtctgacgggcgtgccctggccggccccaagtcggcggtctgaccggtgcataaggccggtctgaccggcgggaccggcggcacttgtgcggtcagaccggccccctggaggccgggatggtgttgctcggggtggccaatacagagccgacggagccgtattcggtcagaccgagctgatggcggtctgactgagccgaggctggtctgaccggccaatcaactgtggtnnnnnnnnnnnnnnnnnnnnnnnnnnnnnnnnnnnnnnnnnnnnnnnnnnnnnnnnnnnnnn

SEQ ID NO: 52377 - DNA, 6652 bp, Oryza sativa
  unsure (1)..(6652): unsure at all n locations
nnnnnnnnnnnnnnnnnnnnnnnnnnnnnnnnnnnnnnnnnnnnnnctcacatttcacaacacacacaaccactttgtattcattgtctcggcctgaccaggggcagtggcggtctgacgggcgtgccctggccggccccaagtcggcggtctgaccggtgcataaggccggtctgaccggcgggaccggcggcacttgtgcggtcagaccggccccctggaggccgggatggtgttgctcggggtggccaatacagagccgacggagccgtattcggtcagaccgagctgatggcggtctgactgagccgaggctggtctgaccggccaatcaactgtggtctgaccagccaagccaatggggctctctgacagggctacaatggctagttttctagccgttgcagagtagcacggtctgaccggccacatacctccggtcagaccggcaacacacagagttgggggatttcgcccccaacggctagttttggttggtgagagtataaatactccccctccagcagcaacgggcctctcttggtacccaattcattgcatacaccccttgcatctctcacacacccacttgagctttgtgttcatccatctagtgtgtttgagggttgattagccaagagtcaagtgcattgcttcattgtagagctagtgtggcacttgattgatcatgttactcttggaggttgccgcctcctagacggcttgtggagaagttgccctgtgacctctccgagaagattgtggaggaggcccggtgccggtttgtgagttgtttggagttcaccaccttcggagtgaaggaagaactacctcgagtgatcgaggcttgggtagtcctgtccgtgggctggctcccgccttgcccacccctttacgaagggggcgtgcggtggcttcgtggttaagtggtggagttgggctcgcctcaacggggagtaggaaaccggcgagtttccgaacctcggtgaaaaatctcttgtctccttgtctcatttgattgtcgcatttacatttgtgtaatttacattcctagagacatacttgagatcatatcaccctaggattgcaaaactttgacataggagtgtgatttactttcctagagaattaattgagtcactatcaccctaggtttgcaaaacataacttagttgcttagttagacttaaccctcaccaagcctagcaacttagtttagttttgattaggtgtcttttagtttttaaatcgcctattcacccccctctagtcgacatctcgatcctacaatcctacaatccccaaccacatacttcactccccgatccaaatcaacccaccaaatgtgaccaaataggcaacttacccagacattgtgacatttgaagtaccgatgcctagggttttcgatgctccacaagatccaccacgcagccttgctgccacacttgcacatcacggtcggctggtaatcaaatggcccaaccctatacaacatgggagaagcagatggccaatgggaactcgccaatgacgagtagctcctcgaactagccatcgctgacacaccgctccccatgttgccgccacgtcgccatccccgcaacctgcacctttgttgtcgccaatgtgtcgagggctagtgtttttatggtgtggttggggattcagcttgcgaagaacacaaacatatttaactatttaccactcttacaagtgacaattaaagatttgccactagaccccacatgtcatagacacatgagggcccacatgtcatacattgtgaatgacacatcttaaaagtggtaaatggttaaatgcacccctactcaacccctcaatcgacgtgttggctcagctagtcaatggggtcaaagatgccaggtcggatgaagctacctcccaacccacctgagaagttgatatgcattggtttttggagttggcgggttttacagttaagcgatgtgattcaaccagtagcataaattgagggatgcacaatagacttgttccttgtaactatatcaggtatggatagttagattttttttttaattttttgaacttttttagcttttaattttaaaactaaaccctttcaaaatttatttccaaaatctgaaccttttggccacgctagtccgcttggcgtgacaaagcaacaatggcacgccacctgcagcgggcgtgaaagttttgtcctgcgacgccagcgagagcggtgtggccaaataacgctgccacgtcagtgggagcggtgtgacagtattgttttgccacgctagtttggctggcgtggccgtgtggccaaaaggttcagatctttaatataaattttggatggatttatttttaaaattaaaaaaattaaaaaggttaaaaaataaaaaaaaatcagatagttatggatccggctccagccaaacccaacccaactcggcccggcccggcccggccgatctctttacctattactccgtacgcagcattctccctcgtgtcattttcgtccacgccgagacgagacgagacagtcgggcgacgggacagcagctgcagcctgcactgcagcacagccgtcagccgcctccccaacctcccgccgccgccgccgccgccgcatccgcatggagcccgacgccgcagcggccgcggccgccggcgagagggaggcggagatcgagaaggccttccgcgcccgcctccccgatttcaggaagcagccagagtgagcgcgtccgccctctctctccctttccctcttccaccccccctctctctcaggctgtggtcggctctcccgcgcgggatggtttggtctacgcgggcgcggcttctagggttcgttcctgtgtctttggctgcctgcctcgcgtcgcgcccgggaggttgttggcggtggccctagggtttttcggcggcggcagctggtgcacgcttgcggggggtttggtgtccgctttttgggtttcgaaccggggaggggtttatggcctggttggttgtttccaatcttcgattttagttcgggattcttctgctgctgcgggtggtcggcagggttgtgaaggagaagcaagggggagtgatgccgattcctagggtttagtgggggggagggaaaccaacaatttcgtattagcaggtgtgtgcaccaaatatttctgttctacctccaaattcgtcaggttctagctaggatttgacaaggtggtacttctgatttcagaaatgttgtgatttcagaaatgttgctgggcgacggttggttatttagttgcgcagggttctgaagaaccacgtgtagttgcagccttgtattcagcatttcagctatttaaggataataatggctgtgcatcagatttcttgtgtctctctaggtatttaaacctgtaaggaagaaatgaaaagggtttggcgatatgtgagtgataaatgtatatagctgctgcatataaagcatcctagggttgcattctccctaattttcacgcaggcaggagaggtcgatgctttcttctaattactagaaattcgaaccttttctgctctctagatctcttatattggtcaactatgaggaatgacaccacatatatttttctttcttttcagctccttaaccctcgaaggtgtaaggagagcactggagaaggacatgggcttggagaaacattcacttgacgcccataaaaagttcataaagcaatgtgtagacaaggtacgggtggacattaatgtatatggggtttggtgcagtgcaataattaggaaaagaagaacatttgtgcaactaatgtttttgctgtatgaacctgggagctgtacaattttggaatttcctagtgcaatagttaggaaaagaagaacacatttgtgcaactaatgttttctctctatgaaccagggagctgtataatttcctagtttaaactcttgactcttcacttccaacaaaaatagaaaccactgataatatcttgtgttcaaggccaatttttgacttttcaatcgtctgtggaaactaagtaaacataagtacataacatattttgtcaataatgcggaataaatgtttgctatttaaacacaccgctgcagaaacaattactcctgcttgagtgcattaatttgtgcaagtgattttgtgatgcactgtttcagttttcatatactccctccgtcccacaatatagctacctttaggttcaaattttgtcccaaatataactacctacaatatgtagaaagtaacttttaccacactacttcccatgctacccctagtaggccatatcatcccatcaaccctcgagatccacacccacccgtactattcttgattcccgtcacctcaccatctattaatgagggacttttagacctttcactccaatccagaattcctcaaaacactcctatgtagctatattttgggacggagggagtacattagcttggggagctaacatgtcagcatgcattacgattgggcgtttgagctgtgcgaaaagaatcagttgaacaatcataaacatgttattgcagaagcaaaaaaatgagtatgttaaccattggctctgagtatctgactagtaccggtttctgttgttacagcagtacataccaagacaagacagttggcattttaaagattatattgtaattaggatcctgcatgcaaatctcaaatttggtagtttatcatggttggttacgcatcttcaggattccttgtttagagatggacagatggcttcttagtggtcaactcaagccatcctccatctatataaggatgatatggtattatgatgtattttatgttggagcaatggagtaacaaaagaagataatccgaatatcagttttgttgtgttctcttctcttggcctgctattgtgtagatctagtccctcctaaccaagtcccgcattcacagagcagcattctacctcaaatcatcactgtccaatgtctctttaacgggtgttggctcatgttgtgaactagttcaacatcagttgccaattctgatacaataaaagaatgactagagtacaaaacaagtatttacctaaccagtatttctgaagatgaaatatattaagctcacatgtgttgatataatcttttcctttgaggaatatatattaaaatcaccattcacaagcaggagccacaaggatctctttggaacttagacactgtagagactagagagaataattgagtctgtccttatatttgttacaattgtgttatggaaaccaaatgtcttgatatttcaagtgtcaagctgtttttcttgaacctctcttcacccagtttatgcaaattggtaatgagatcctttaattcagatgaataattacctttatttaaacttctgaaggtcataaaacttgttcagttgtcatttatactttatattcccagttggaacctgttagcttgtatttgggaactttcaaactttattgaactctgatttcagtacagtaatactcattttttcctttttctttttggctaagcacatcaacaggttttttctggttctgatgatgacaatacgaataataatgcaccagagaaggatgaagctaaagatgaccgttcttctaaagaagaatcagaagatgcccaaccaacatctgactcgaacaaaatttcctccaatgctgatgagccggtggcaaaatccagtgagacagatagagatcaggagggagacaaagatcatagttctggcagtgacattagtgaagctacgataaaaaatgctattgtcaaaagggcctcatattttagagagaactcagagtatgtgtcctcaacttgccattcttaaattgtacttatcattgaaacttaatagttaacatgcactccaaattatcatgtgtcagattgatcagcgaatcattgtacttgacaacttgtagagttgtagtctcaaaagcctcttgctctggaatgtaatgaaaccttgtttttttaaaaagaaatatttaaccccactacatcacagagcagatatctgaaaagatactatcatgttattgtaattttttgacactagaaaacaaaactggaggttggggcagtaaaatgagtcaaccaaaatatagtcaaccttttgtgacctgattgagtaataatagagaaaccatttagttgttccacatcttgcggtgaaacatatgaataagggacgaaagtagagataattgctcccattgtgtgatgcaagcggtgagcagggagatttcgttgcgtgctagttcacttatacaattctgagtgacaaatttgtggggggccatgccgagggaggggggggggggatatgggtcttagctggtaaaagaaaaggccattgagtcattcttaatgtagaccgtctaaaaatgaacaggagcccagttgtgtgcactgatctgaatatacatttggaacataatgattgaaactgttgagttttacaaagaaaattgcctatatgttcttaaaacatatcattcttgttgttaagagtggtgtgcggccaatattatataggacatgatcatatgtgatgcagttctttagagttatgaaccaattggcgataaacggaaatataggaatttgcttatat

SEQ ID NO: 52378 - DNA, 1503 bp, Oryza sativa
agcaagcgtgaagcctgtttgataaaggagttggaggatatacttgaaaaagaaggattgtcaacaaacccctctgaaaaaggttcatttgttgttaaattgtttacaataacttgtgcgggaaaagttcatttgttgttaaattgtttacaataacttgtgcgggaaaacttgtgttgaattgttttctattttttctatacttctatgggtaggattaggatgtttggtatcacagtcatcattcaattttctcccaaactatgaacactacataaggtgtatgtgcccaataataagttattactgttaaatgcaatcttatgacctcacctatttctctcttttttttagttggttcatttatgagtggcatataaagctgcgtatatatggcgtaaagcatacctatataattacttgacacatgttatgctttctttgtacagaaattaaagcagtcaagaaaagaaaggaaagagcaaaggaactcgagggcatagatatgagcaacattatcacaagttctcgtcggagaagtacatcgaatttcatacccctgccaacgcctaaaatagtagctgatagtgatgaagatgacgaagaagacgcagaagatgacaatgatgaggaggtgaatgtggagggtggagatgaaggtgacaatgatgttggaaaagctggcgatggatctgctgatggtaagattcaataatacatggtatttcaatttcactgtcaccagctagtcatttataatctcattagttattgcatccaggggaatatccagtggcatttacagcatgttcagtgttatttcgcattccaagcgattccatatctctttttctcaataaaatccatatgcttctgcagatgctgagcacgacagtgattgattcttgcggtttctaaggtggaagcaggcaattctgaccatgcaagttcatctcatgttgatttggcctagacgcctagttggctgtccgtgcgtggatggaggcagttgttcagaagtttaacttatgagtttattctgttattcgaaacatattctttagctctagcgttggtgaaacattagcgcagatgattcttgtagctcccatctcattattatgtataatatatatcaggtttgttatctgaattttcgatcgtgtattcctgtagactctagtttgaaagcggcgtgacattcctgtatcggacagttattttattagttcatcacttatagtgttattttagaggaggaattcagcttttttttttactatttcaaaatctatttggtatttttttataattagcaaggttcacttaatattaactattcgctcctggtagcaaagtttcatattgtgatctgataggcttacttggaaaatcaaacaaagttctcaaaccgtttgatttaattaaatgtaggttataggatatcgaaatttaattacacagtgctacatcagtgtagtaagaatttgtaagaactgtgta

SEQ ID NO: 52379 - DNA, 1078 bp, Oryza sativa
  unsure (1)..(1078): unsure at all n locations
nnnnnnnnnnnnnnnnnnnnnnnnnnnnnnnnnnnnnnnnnnnttttgttttgttttgtttttgttttttttttccctcttgcctgtactgattactgaaattcagatttttcttgttagtgtttcttagcattaccttgtgtgactttttcatgatataggacgtactctttaggattaccttgtgttccctacatatcggtatatcaagtgtatgctggaggattatatatttcaaatataacccagttttgaacactgtgaaatcattttttctgttctttttgttgtgacaggcacggatcaaaaagatcatgcaggctgatgaggacgttggcaagattgcactagctgtacctgttttagtatgtaagttttgacaacagcctgtgctacttctttttgggtattgatgtagccatgtagtatgtaaacagttgtgttatcgctccattctctctaggggttggtacttacaaaaaaatgcaatcaagaaagcattctgccaaaagtttgtcttacattcagtaagctgaactagcgacaagtttgctctgccacatggagaagaacccaactcgcctttttatgccaagtcactggtcacatattttgacatcggttgttgcccattagaaaaataatcgttttgcatttcatttttgtttcactaactaattgatacacattttcttgtatgataatatatgtgttttggagtaccttttttggtttgttttgcataatgttacagttctagttattgccatgataaagcatacaacctgagtgcctgacattctgaatttgttctttacgtgcagcgagggcccttgaattgtttttgcaagatttaattgaccgaacttacgaaattacactgcaaagtggtgcaaagacattgaattccttccacctgtgagttctataccactgcacttttaaaattttactccgcattatgattttgtgcttttatggagtgatgtactgtttatcctttcatgtttttgtgacctatgaaaagcttgtgttgagnnnnnnnnnnnnnnnnnnnnnnnnnnnnnnnnnnnnnnnn

SEQ ID NO: 52380 - DNA, 1190 bp, Oryza sativa
ccgaatgaggccacataaatatctatatgagtctttcaaaccccatttagttttaaaggggagattcatgagctagcaattatatatacatttctcaaaatcttacccctcaaaatttcacttgacatgctgatggctttgatcacatgcggacatgcccacatataacttaggtaatgaactcaaaatttgagacagaatacagatgaatgttttgtacatcgcacgggttgtgaaaagagggtgtagagagctataaaattcacctctgacctcttcgttcccagcttcccaaaaaaccagaagatgttggagtatgccacagctaaaccatgtgtttccaagagtatagcatagcaaactccaacttgaagaacggtcattggcctcgaggatactgacccactcaaatctgagcagctactagtctgcagagtgaccttgtcccttgcagccgctatgcaaaaggagaaacagactccaaaccaggtcttttgcataataggcaccaaacgacctcctaatcccgctaaaagataacggatggaatatgtggagatcaaacctttggtatcagcattgtgatatacccgtaacgccagacagaagctccacacggtctctctttagatcctcatgtgagcagtgagctctccgggatcattgacagctccaaaatcaacactattaatcgcggcagttccatccgcatgaggtagtttcatcaaacacgttatgaagggcagggcatgggggcattccgatggctttctgcaaagtccctgacaatacgcttaagggttcttccgcctttcccttgcatgtaagcatggttgtttctgacattatcaccagtcctactgtgaagatagtctgaggctgcatcatgaagtacgctgagccataaaggaactatcatctcagcttccccttgccttaggtactctgagggcatagatttcacctggacaagattggaaaaacgttagcccatgatggtgttgcaacacgtcaaagttaagcttcatgcagaaaatacattagtcggaaatacttttcaaatgaatataacacgtcaaaacaccagaaggtagctcaaaatgttcaggtgtcaacagtacttgttactagtccgacatgacaacaatgtctgcctacaatcctacatatatggattaatggctagtatg

SEQ ID NO: 52381 - DNA, 4119 bp, Oryza sativa
  unsure (1)..(4119): unsure at all n locations
agtagagcataaagtacatttgacatgagaccttcaccgcagcgtgccaaaatttgagctagcaccacaccaggtgatccatcagaggggtgctctcgagattctagtgcagcagcgaggctaacatcaagaaaacctacatgtgtcatggcaaatgatcaaatgagcacaaaaatatactaggtgctacacgatgtttcaagtgcaatagcttgagctgaatgctgaagcatatgtcacagtaacagattaaggtatgtaaacggtatgaacagtgcagcaagtacaaatagatcttttaactccaaagggattataagtgtgatgaaaagaataacgctttctaccaccaactcacattacagtgatacactagttccaacagacataataatgtaacaaaccttatccagaaagtagctgaaaaggcatccatgactttgcaggggaaaaacactaacttgacatgattgcttaccagtagaccacaatccaagcattatttttctttgcatatactttatcttctcaggggaataaatttctttaaattaaaaaaccaacaggcccaataggacattatcctttttgctgaaatgaatgagcagtatgcattcattgtttcccctttatgcaactggctaatttactaacattccatgacaaaaaaacaaatgctctaagaaaaaaggtgttcaattgataaagaaaaaaatatatacataaaggtggatagatatcctcacatgacatatatgacatcgcagcaagtgctgctcctcggtgcattgctgtagagcatatagctgccttttgaaatgacaactcaagcagggagccagatgcgacaatagcttcctgatgatatatgcaatcaacacagataactactatcagactcactatccatatcatgcagcagcaatgaaccaaaacaccttaacatataagacacaataaattcacctttgggcagcagcgaataaatgtggatgtaaagtttgcataggcttcaacaagatcaggttcttgatcacatgtgtaagaagaattcaaagtagatattgaagctgcggagctaagtgcttcgaaagttctgacacataaagcaacatattcttccttgtgaccaaattcttcaataacactggcagctgaaaatgtcgttgatgtcaaggcagtgtggagtccacaaatatattgaataagatgctgcagtagtatcttagtgttttaagcctatcttgtgcattgttttgtaaatgtaaagctacaaaatacttcaaaaattatattctaagagcatgggatggtggctaaaaatatatcagaagtacatagcaaaggcaggtaaatagcagctattgatgtccccaaatgctttaattaaaggcaaacctatgtagatgggattaatctattcctgtgagtactagcatatgtattactgtgatgtaggtagtaaaccacaagtcaaatgtacatgtaaatcagcaactgctagcatgttggtaaaaatactagcaagttcattgtagagttgaataacagaaagcaaattacatatgcacacatgtaaaccctcttacctgttcttaagaagcagtcatgcctttgaaacagtaagaaatttgttgataagcattccagaactttaggtaacaaaatctggaagtgttgtcctgtaaaatgcaattgcttgatcagcacaacgatctaatgctattagtcttgaaattttgcattgcaggtatcatttaacttaccacaagaatgtatggctgaagaaagagaacgacatgcagctgcagataaactaacattctccatatgagatgatcgggaaagtctttcaagaagtggccagaatataccaagaagaaccaaaaccgtgtcatcatcaatcagactagatgtaattgatgtcgccaaatggccaaatagagcacccatcctgaaaaaggaaacttcattttcatttgcttacattgtagatcacagcatgtttctaattttcttccacggcatccaaaaatccctcccaaaatacaatatccttaaaaataggttcaaaatgactggttgttacttgtgttcttttatctgtcaaattctatgatccggtcaaagcatatcatattgttttttctatagcttgccataaatgatctaagtgggaggatgtaaaagtatccacctttccaagaaccaaataactcccaactaaatggtaaagccatctttttattaaagatcacatcaacatcaaccaacaggagatgcttctccacttgctttgctctccttttgttaatctagaacaaagtggtttcatgtttacagtcaatttttcttccgcgcagctgactctagatagcatttattcatctctattggctagaatgtagttggtgatactgcacagctttcactggatagttcaaaaagtaatatgattggatacttatacatcaattgaatatatttatgctggcatgttcttttgatgatcgccccaaaagcaaatactcgctttctgcacaactttgtacttcaagttgtagttattagttaagttatacttcaattaaatatcattcaacatgaggctttgcatagtttatgactttgaatagtctataatatgttgacacaacggaaaattgcaccaatattaatcaaatttatattatttacagtacaaaaaactatttttcttcaaactgctaactttagtaccatttcgttaacatgcttgattcttgaattagtcaagtgtagtagtatcattgaaaagtgtggaagatacaaaaatatatatattgctagaaaaaatggggccacaaaatgtaagaatgaaagaacttaaaggctaagcacctgtagagaccatggacagcaaggttcaatgcttctgtgtaagcagctggattttgacgcagagattgatctctgtctatgtcaatctgtaaaggacagcaaaaagacaacattaatagttttagatgatgtcatggtcaaattcatgaatgtgtccatgcagagttcatatgcaaccattaaaaataacttgagaatgtttcacatgaaacttcatggcatcatagtcctcgaaatcccatcaactaaataatgtttcgactaactaggaatgtccacagatagaagcaaaatataatcttacaagcatttaagtggacaataaagcatctcagaacacaaatgagaaaattatgaagtagagttcatgagcaaccattgtggactactggcttgtgtactggagtgcatatcaggaaaatgaatcctaaacaaattcattggtgtacatgttggatgttgaaagttgggacatgtgcacctgtaaatatatgcacaagaatatgatcgttatgtgcaataaaaaaaagttgcagtgcaatgggaacatgtagattgtcctactcatacagtgaatcatattttcacaaaaaaaaaacgtggcaggtgcacatgttcaaatatgctgtgcatctaggaatgtttggctaatttataaaagcgtacaaaccacaattgagattcacctgatatatgatgccattagtgtactactaaaatacaaacattcagatgcaaataaacactggcattgctgaaaagcaacagagatatggaagaaccattaagcttttgtcaacaaagttaaaggttcattcaaggacttatcatggacacagctaatacaaaggttcataatggttctctagatgatatcatggtgataaagataataaaatatcagcaaacattccgggctcctttaaaatgcaagaattttacaggaatttcacaggaattagttccacccatgaaattcctctgtttcaacgaaagcccaaggctgaactagggagagagtacatacaagcttctccactgctgtgtagctggaacaaagtaaccttgctagtgaacttttccttaactctttgtcaagaacagaacataaagcatgtgtaattgcagtaatgatctcttcctcatcctctattcgcagattccccgcatccatgnnnnnnnnnnnnnnnnnnnnnnnnnnnnnnnnnnnnnnnnnnnnnnnnnnnnnnnnnnnnnnnn

SEQ ID NO: 52382 - DNA, 4197 bp, Oryza sativa
  unsure (1)..(4197): unsure at all n locations
nnnnnnnnnnnnnnnnnnnnnnnnnnnnnnnnnnnnnnnnnnnnnnnnnnnnnnnnnnnnnntcacccattaagatttgctgtattctgccagtatttttttctcagcacttgcctagtttactcatagaacagcaatcataggaagcatattgagtgttttaccaaggataggcatccattaagttcgctgtgtgctctgctggacagaatgttcacaaaatgcattatgattgaaaaatcgaaggggcttccatcttgtaaaattgtgtcagcgacctgaaattcagtaacttgcaagtaaggcgtagatttaacatgctggttccttgcatgcttacgtgcaaccagacaaccacacaaagacaaacaagcacgcatattttcaatcaacaaagaaacagaacaagagaaaatttaacttgcaaagcaacaaggcaggagtctgaaacacaagcaaaataacaatttgctcaagatagagttgatagacagccatatgttattaccaagtttgtcaaaagctaactgtccaagatatttgcatagtaagataggcaattttctatgcatgtaattgttctgcccatacattgtctcaagtggcaaaagtttttgtggtcatagcctcataggcagtattgtgaactagggctttctgtggggctagtgtacaagcctaataaacccatcagtaagattattcttgccattatgcacattatactttcatatttatatagaattacagataagcgatcaacctatgggctgacaacttaagtgacaacctatgggcgatcaacctaagaatcatcaacaccttcaaacaggtggtaacattttgggcacctgggtgatattaagcgacacaaacttttcagatctcaaccttgataagtatcaacataatggtctaatggacataatgatgaaattgcatttccatcttatctagtagtaagcaactttactgaatgatcttaattatcaacaagtataccaaaagatatgaggcacttaccatgctaagtgcatacattcgaacttctacctctttccaaggaattgattggctagccaaaccccatccaccagaaaaaagctgcatacaaaaacatagttcaaagttaatcgccataatggtctcactaggggagtgtaataaaatcatctaaaataattgtcacaaaaggggctcaaaagtatcccacgtatcaagatattagaagcaatatgtagaagtttaataaatcgatttcaagaccagcacatagggcagtataaatattacagaaaccataagggtatttgtttgctgcagcaaataccaagaaggttcagattttcagaaccatatggtttatttctgtgttttctatttttagtacattcatatatatatgcaatagtatagttgtaaatagtgtttatttggaacaatggtgcataacatatctacatcatactattgcatatctagcttataaatacggttattggatgtctaaagataccaccacttctgcaaattacaatcttttctccccagacatggaatatgaggaatctttcagcaataaaccacataccttattaatatatgcaggagcacctagaagcaagcaaatatcaacaagaagctcctccaagttcattctgaactgtgctagtccatcaggtatgcataattccccatcagtgccatgttcatcagtgtcaatctatggtttatcagataaaacaaggcattaaaaagtggatggatttacaaatttgggtttaaatgaattggatataccgaaaagcaaaattggaatttctactttagtgtacagataaggaactgcaaccaatctgaattctgaagtataaaaattgtgaccacatgcacaattttgtaagatagtactttcagttgatcattagaaaataaataaatgaattcatgggaaaaggagaaaaaacctgagcacgaaaaagaagtgcatcaagcagtgaagaaaacacaggggaaaatatctcttgtgcagcattccttttttctgtttgtgcatcactatcaagtataaaatgtgctaaactgcacctgcaaagtttcaacgcacaagtataaatacttaattgactacagacatgaaagaaaagttagtagtacgattttagctctactctggaagtacagaatggaatattggaattcaaatctgcacacttgtattatctaatactccctctagtcattttttttaactggagggagtagttgccttatcattgatgcttatatgatccaaaaatatatgtaaaagcatgtgttttaactctcaatgagattgcaatgaggggaccatgacaagaaaaacaaagtcagacatagctagaaggaccataggcatatcaggttacagtgtttttattaaatccggtcctgaagtatggtaatcacaagtcctttgagaaagtttgtacgtagattccagtcgaacaccaaaaatcttgtgatactcctagaccttctaaaccccccacacgaccacaaggttacggaatatgctcatcagcaacccagccatcctaaatttccacatagacaagatgcaggaatacatcgcaacacaaacataaagaaaataatacgggaataatatgtttccgaaaaactaatacttgtaattaatcagaagaagagcttgtgattcatgaaaatgaaacaaagcaaagacatagacattattaccaaaattgcaaggttgaatctgcaatctcccaatcatcactagaaaaggctacacatctgtgttgaggataaaactcatcaggatcacaacaggtaataaagtgaactgaactatagaatagcatcatttgaaacattgaaacgtgcaacttaaaaactcaaagaaaagtaccacaaacaattcaatagattgacctcaaaagtgcatcggcaagagcaagtgcttgaacactcccttctgcaaccaaagcaggtgcctaagaaagttcaacggttatcagcttatattcaacagtctcacacttagaaaacaatgcaatgtgattatgcatataaggtgtgttctatttcacattggaatttctctcaggttcattctctgagccgttactaaaatgctgatttcaggaaatacatgacagttaattcagttatttcactaacttaactacagtagaggtctaatattcacttcaacttgatagtagaacaatgaatggaggaatattttgagtaacagaaatgcaacatagataggttgcaaatatgacactgcagtacaaccaccaggtgagacaacttactgcctgaccaacttcacacatcaaacaaacaagaccagcaatagtcttctcgcttctgttggcaagagctggcagaagaagagcttctctaatatatggcattttacttagaaatgcctgaggtagatcctacaaccaaaaagtggcacgcatcaagattagtggaactgtattgaattaatcaacaaattcaacaaggggaacagcagtcatgcttctagtcattgtctgagaaaataaatgaggagcaggacgggcattgcaactcttctagtcataatattcacatcatgtagatatctgaggcaaaatataactacattaactagcagcttaggttgaacattattaaaatgtaaactgaaatgaactctgatttagtttaatcaaattggtgtcttgacacaaacagaagagagcaaactcaatcgtgcaaactattccatggcaaacctcaaatgttacattttcatacaacagaaatgcatgacatcaaacagaagattagggccaaccgataagtgacaacttgggacaggctaagtgactaacaagtccaacagtccaactcaatcgaaaaagcatgcagccaccagatagaaataagttactgatcatcagttggctgcagcaatgaagtgaggcactatgcagcaatcagaacttacttggtgatgactgacaagctcggtcataacctctacggccacatcaaacgagaaggacaccttcattagtcagatgacaacaaagcaaaatgtgaggacgtgaatgcacaaacttgtccttcaaagtacacttttatgagcttataaagnnnnnnnnnnnnnnnnnnnnnnnnnnnnnnnnnnnnnnnnnnnnnnnnnnnnnnnnn

SEQ ID NO: 52383 - DNA, 751 bp, Oryza sativa
attagagggaaatcaacgacgggttactattattttgcgaggtgaaggaatatgtgtgattggttgtgatagttttggccttggaaacgtgttttttcagttggataatcgtgttaacatttggaggagatatgggaggaatagtagaaaggtcacgggggtagcgtcgtgggttgaggttatggttgtcgacgcgagcatttggatggcgtgcccaaactactagtagctagtagctacccagcttctttgttctgtcatctccgaaacattgttgatctttggctgtgtttggccccgtttagttacccaaaagtttttctaaaaacatcacatcgaatctttagatacatacatggaacattaaatatagatttaaagaaaaactaattgcacagttaagggggaaatcgcgagacgaatcttttaatcctaattagtccataattagccataagtgctacagtaacctacatgtgctaatgatggattaattaggctcaaaagatttatctcgtggtttccaggcgagttatgaaattagttttttcattcgtgtccgaaaaccccttctgacatctggtcaaacatccgatgtgacacccaaaaattttcatttggcgaactaaacaggctagtaacttccaaagttagaagtttggtttgaaattggtatgatgtgactgaaaacttgtgtgtgtatgataggttgatgtgatagaaaaagttgaaagtttggatctaaacacaa

SEQ ID NO: 52384 - DNA, 1466 bp, Oryza sativa
  unsure (1)..(1466): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnaattgaacacagtaaagaacagaggacattcgtatagcaacactcacagaatactaagaaaaaactaatcaattatttatataaacatcaattaaagctcaatttaaagatgaacaaataataaatagagtctgacagacatatttagacccataagcaggatcgtccgagtctaatttcaatttggaagacataccatccatattctcctagagctcaggtaaaaataccacaatattatcaacttgcagtgagaagcatatgccattttcaaattggttaaaaaaagagtgaaaatttaactttgcttttgtgttaaaaactcagattttaagttaattaatttgaagacaataatacaaagataaccagatttgatggaaattatagtagataaaaatgaaatcattctttgttccagaataattcatcaaagacactgctatacttcaatgaaactcaacacaagcttttcataggtcacaaaaacatgaaaggataaacagtacatcactccataaaagcacaaaatcataatgcggagtaaaattttaaaagtgcagtggtatagaactcacaggtggaaggaattcaatgtctttgcaccactttgcagtgtaatttcgtaagttcggtcaattaaatcttgcaaaaacaattcaaggggcctcgctgcacgtaaagaacaaattcagaatgtcaggcactcaggttgtatgctttatcatggcaataactagaactgtaacattatgcaaaacaaaccaaaaaaggtactccaaaacacatatattatcatacaagaaaatgtgtatcaattagttagtgaaacaaaaatgaaatgcaaaacgattatttttctaatgggcaacaaccgatgtcaaaatatgtgaccagtgacttggcataaaaaggcgagttgggttcttctccatgtggcagagcaaacttgtcgctagttcagcttactgaatgtaagacaaacttttggcagaatgctttcttgattgcatttttttgtaagtaccaacccctagagagaatggagcgataacacaactgtttacatactacatggctacatcaatacccaaaaagaagtagcacaggctgttgtcaaaacttacatactaaaacaggtacagctagtgcatttttgccaaggtcttcatcagcctgcatgttctttttgatccgtgcctgtcacaacaaaaagaacagaaaaaatgatttcacagtgttcaaaattgggttatatttgaaatatataatcctccagcatacacttgatataccgatatgtagggaacacaaggtaatcctaannnnnnnnnnnnnnnnnnnnnnnnnnnnnnnnnnnnnnnnnnnnnnnnnnnnnnnnnnt

SEQ ID NO: 52385 - DNA, 3067 bp, Oryza sativa
gggcgaattcgagctcggtacccttcttgattgcatttttttgtaagtaccaacccctagagagaatggagcgataacacaactgtttacatactacatggctacatcaatacccaaaaagaagtagcacaggctgttgtcaaaacttacatactaaaacaggtacagctagtgcaatcttgccaacgtcctcatcagcctgcatgatctttttgatccgtgcctgtcacaacaaaaagaacagaaaaaatgatttcacagtgttcaaaactgggttatatttgaaatatataatcctccagcatacacttgatataccgatatgtagggaacacaaggtaatcctaaagagtacgtcctatatcatgaaaaagtcacacaaggtaatgctaagaaacactaacaagaaaaatctgaatttcagtaatcagtacaggcaagagggaaaaaaaaaacaaaaacaaaacaaaacaaaacgttcagtaatcagaggtctcaaaaaacgcagttcacagtgccatgtcacatggaaaggtctcaaaatagtaatgaagacgggagtattcagctaaaattcataccagcactctcaaagaagatagttctgtgtaaatttgaaattctggctgatgcccatctcatgacaatttgagcagtataaaacgtagaacaggttcccagcagacaatacagctcacgatatatgccacacaagtagaactctactgcacaagaactccagaaactgcccgagcaggccataatccatttcatgcctccagaaacagtgcgatacaagctcgcgtgttgaggagatctcatgagaaacaaactacaagatgagaaatccagccctctttacacgcatcctggaagcagctgcaaccaattgcagcccatcctagctagctgcctgctcagctttgcacctaccagaactaattgctcattcatctcgccctcgaattcaagaatcttttccctccaccaaacccaaacccaaacccccagtagaaccacttgccccaccacctcgaaccaccttcatccaccaacgaaccgaaagaaaactcaacgagagtgagtaaaaataaaatttcagctaagctcactggcgaggcaacacagacaaagagccccccaccacaacctgctctcgattccgaatccccacaaccacccggcgacgaagcgcgaccgcacagagagaagcgcaagtaccccgccggtcaacggcgatatccgccgccgccgccgcgagatccgcgcgcgccgaccagatcggatcacgagccgccgccgccgcagcgcagatcgaggagaggaaagggaggggaggggaggggaggaggggctacgtaccgcggggaagcgggtgcccagcttcttcctcatcttcgtcttcctcctcgcgttcgcctccgcctccgctcctccacgctatcgcagtcgacctttttttctccttttctttttttttttggctcgatttttttttctttcttttgggacgcttcggtttcttcttttgtttttttcttcttgctgcgccaccacgagagtcgagaggagaggagaggagagcacgcgcgggcggcggcgacgtctcacgatccggatccgacccgacacgagaggcgttcgtgcgtgtcatgtgtgcggcgactgtgttcctttcgttcgtcagcacaaaaggcggggcccgggttggcgggatcgatccggcccgttaggcctggagaacaaggcgattccgtgtgctttggggcccaacttggcaatttaattctttttatgcaaggagaaataatccgtacatacgaaaatttgtcttacccagcttctcttttttaagaaccacgttacagtacacaggcactcataccctcataaacaccttctagagactaggccaatgtatcttgaagttgacaaaatcaccatgaatatctcactatcgatagttatgtcgcctatcactaaaagaataattatggtaaatacgaacactcacattgagtgtagaacttaaacccgaatagactgattccaccacaagtacccttagagcaggtacaagccaactataaacatatcgagaagataaaaaagtagagaagagcgacatgcaacatatttgtagccaactgcagcacagactccaaaacacaatgtgtgcatgacagatgggaccatgaattaatagtgtagtacatgtttataagtaactattatataaattagctattaaatttaatatagataatttggagctagtagctaagtatactattaaacttgcttttatagtcaagaaaccttagttgactatgctcactttttacacagttcttacaaattcttactacactgatgtagcactgtgtaattaaatttcgatatcctataacctacatttaattaaatcaaacggtttgagaactttgtttgattttccaagtaagcctatcagatcacaatatgaaactttgctaccaggagcgaatagttaatattaagtgaaccttgctaattataaaaaaataccaaatagattttgaaatagtaaaaaaaaaagctgaattcctcctctaaaataacactataagtgatgaactaataaaataactgtccgatacaggaatgtcacgccgctttcaaactagagtctacaggaatacacgatcgaaaattcagataacaaacctgatatatattatacataataatgagatgggagctacaagaatcatctgcgctaatgtttcaccaacgctagagctaaagaatatgtttcgaataaacagaataaactcataagttaaacttctgaacaactgcctccatccacgcacggacagccaactaggcgtctaggccaaatcaacatgagatgaacttgcatggtcagaattgcctgcttccaccttagaaaccgcaagaatcaatcactgtcgtgctcagcatctgcagaagcatatggattttattgagaaaaagagatatggaatcgcttggaatgcgaaataacactgaacatgctgtaaatgccactggatattcccct

SEQ ID NO: 52386 - DNA, 1266 bp, Oryza sativa
  unsure (1)..(1266): unsure at all n locations
ctataggcgaattcgagctcggtaccctttaacaacaaatgaacttttcccgcacaagttattgtaaacaatttaacaacaaatgaacctttttcagaggggtttgttgacaatccttctttttcaagtatatcctccaactcctttatcaaacaggcttcacgcttgctctcaggagccatctttgccttccgatacacagtaggtgcgatactagttaaaaataaacataagtcggtaaatttatcattccgaaaatccataaaactgcattcaagcatgcagaagtacctcattccacaagatttgattattgacttcagccgttccacccgtttcccgtaagctggagctacttgtcgttttttctgcatattgagatataaacaagttagccaaaattatatttacactaatcatgcagtcaagaactcacacaaaataccttattatcttcttcagctgatgaatttgaattatcttcttctgatccactccgctctttacttttatctaaatcttttttggcaacctttttagcctttgaatttgacagttgtttctccactgtagtttttttctgcctttttacagctttgcccttttcagcctttttcttttttggccttgcatcctcatcactgtctcccctctcacaatggctatcatttatttcagaagtatcagagtcttgacgagctctcttagagtttttgcttgtcttctggccagaatccttatgagattcagttttactagttttctttgtcccatttgcaggttcttgaagaatctgtcacacagaaaattaatgaaacacaatgagttcgacttcttagtccaatcatcaacatgcatctgaactaatacatgtgtgcaccgctgcaccctcaatccaaactttaaacttacattgtctaattccgtcgaaataaaagacttgtaagcatccaaagctttcttctgaagcttgagatcttcttctaaagtccggcgaactccttgtaaagtaatagttctgcattgctttcatattgtgaatacatgctgaagctgactagccaaatgcaatatgagcaggtaaagtggacatcgaacatgcttttggtggcagcaagcatccgtatggcgcagaatccaaaatttaaaccagaataaagtaaaatgctgaagtaacatgattggacatacttaggaagnnnnnnnnnnnnnnnnnnnnnnnnnnnnnnnnnnnnnnnnnnnnnnnnnnnnnnnnnnnnnnnnnnn

SEQ ID NO: 52387 - DNA, 746 bp, Oryza sativa
  unsure (1)..(746): unsure at all n locations
nnnnnnnnnnnnnnnnnnnnnnnnnnnnnnnnnnnttactcactctcgttgagttttctttcggttcgttggtggatggaggtggttcgaggtggtggggcaagtggttctactgggggtttgggtttgggtttggtggagggaaaagattcttgaattcgaggcgagatgaatgagcaattagttctggtaggtgcaaagctgagcaggcagctagctaggaatggctgcattggttgcagctgctttcaggatgcgtgtaaagagggctggatttctcatcttgtaggttggttctcatgagatctcctcaacacgcgagcttgtatcgcactgtttctggaggcatgaaatggattatggcctgctcgggcagtttctggagttcttgtgcagtagagttctacttgtgtggcatatatcgtgagctgtattgtctgctgggaacctgttcttacgtttatactgctcaaattgtcatgagatgggcatcacccagaatttcaaatttacacagaactatcttctttgagagtgctggtatgaattttacctgaatactcccgtcttcattactattttgagacctttcatgtgacatggcactgtgaactgcgttttttgagacctctgattactgaacgttttgttttgttttggttttgtttttttttccctcttgcctgtactggatactgaatttcaaatttttcttgttagtgtttcttaccattaccttgtgtgac

SEQ ID NO: 52388 - DNA, 3787 bp, Oryza sativa
  unsure (1)..(3787): unsure at all n locations
nnnnnnnnnnnnnnnnnnnnnnnnnnnnnnnnnnnnnnnnnnnnnnnnnnnnnnnnnnnnnntaattaggattaaaagattcgtctcgcgatttcccccttaactgtgcaattagtttttctttaaatctatatttaatgttccatgtatgtatctaaagattcgatgtgatgtttttagaaaaacttttgggtaactaaacggggccaaacacagccaaagatcaacaatgtttcggagatgacagaacaaagaagctgggtagctactagctactagtagtttgggcacgccatccaaatgctcgcgtcgacaaccataacctcaacccacgacgctacccccgtgaccttcctactattcctcccatatctcctccaaatgttaacacgattatccaactgaaaaaacacgtttccaaggccaaaactatcacaaccaattcacacatattccttcacctcgcaaattaatagtaaaccgttcgttgatttccctctaattaatccgatcgaaatcgttcgcagttcacacgcaccacgtcatttatttcttgatctactactagcagtgtatatatgtggcccccgacccctcgctgcatcgtggccgtgggagtacccccaatacacggacacacagtagtacggtgtgatgccgttgcctacgcacggtacagtccaatacagtaatgcatgtttcccgaaaccccagctacgtactgagccactccttgatttccatcggttgtttgttgctgattataagccgtaacagcttattactggttaaaaatttaatttacagataaaatttttatatatttttatcacctattagaaacgtcagaaactgatgttgaaaaaaaaactatgttaacaaaacattaaaatcgactacagaattaaattttaaaatataaattttgattccgacttagagcatcaccaacagtctattatctatatgattcccaaaactaattttgagggattttagtccaaaacagcttcaacagatcccttactcttctacccgagttttgaagttccatttcccaagttcctcgctctgtttatatgcagacacgaaagtcgctcccaatcacgcaatcccgtctctctccttcgttcccgcacgtgggagatagcgatctttctgtgcgtgaaagaaaaaaaacggaattttctcttggtagtttaatagaagggcccacttttaatttgtgggattgaatttaggctatctgttggagggatgaggtttttcacttcctattttcagtttaggaaacccaaaaatatttttttaggagaaaattatagataatctgttggtgatgctcttatcacgtataatctctccccaaaaatttgtttttggttttctaaactaaaaataggtagccagaaaacagatcacaccaagagaaaacctaaattttatcccaaaaattaaaagtgggtccttttgttaaactaacactagatttttccgttttcgtctctctcgcgtgcgctcgtggcgctccctccacgcgtatcgcagtccccccgagaaaaatctggcgcgattaggattcggataggagatctgttggaggtattttttttcattaaaatttcaaaatattaggatcgggaatgtaataagagaattgttggtgatactctaagtccaaaagaggcctctacccactcagggtggtcgcagttcgccagttcccgtattcgtatgtatgtgtgatgatgcttctacgcgcgcatgctcctacgccacttctaccatgactcgatcagctagcgtgatacgaaaacgttaactcctaggcatagccacagctagcgatgcaagcggactaacctgcgaaaccgcttatagattaaattagtgagtaacccgtaggttaactactaatttaatttataaataggtttatgggttgacccacttgtttttctacgacgcgacaagtccacggattaccttttatttaatatatataaaaaataaataagtagcttcgcaggtcggtccatttgcatctctgccacaggctaccgtactgtcgattacctatacgtaggcttgttcttaataaaaaaacgctatacatagtagtccggccttttatcttggcaagagatctaggctcccatcggattacctattcagccaaagaaaaagtcaaaatttaaattttcaaatttaattttgatattaattttaagatattttcaacgcagtttttttttcagtattggcttttaagtcaacgagaacacatatataaaagtttttttaaaaatagacaaacgatggagccctacttgacgtgctaatcttcgcctactccacgtgtggctgccatctctgcttgtgaattttgtttatatattttaattttttaagtttaatagtaaatccttttaaaaacttattttcaaaatcacttggtagcgttatttgatcctgctgaactggctattttaccacgttagatgggacaaaatatttattgaaaataagttttgaaatgttttattttaattaaataaaaaaatcaaaaaataattaaaaaaatctctgctcgcggctccacgatcaactcgtgcatgtacgtactacgtgctgtgacatgatgtgtaagtctagtactccgacgcatggatccactatgcttgggcctactaggagtgtacattggcacggctctagctgtagcgcccatgggcagatgcaatgcaaagcacctgccagctcaacagtattaccactgtacgtatacgtcggactagtataatgtacagtacgtacacaggttcatagccccggactcacgtgcagaccaccaccacgagtacgtacgtactccctccatccttaaaaaaaaaaagtacaacaaaacgtctaatattagtttggttttttttcggaggaagtatatctcgtgcctgtaacagtagtatgtttttaaccttgtccacggaccgttagatctcctccacgcccatccaaccgagcgatcacggccatcccgtccacaacacggtggcccgtggatttttgccgaacacacgagcgcccacgtgagcagccacgcgcgggccgctcggggcaggatgtgtgcgcaacaaaccaagagaaaaatgcgtgcgtacacgcagatgcgccgcgcgcgcgcgcgagacgacgacgacgaggggggaagcatcgcggcggtggggggcgaggcttttacgctagtacgacgtacaccaccgcgcgcgcatgagatgggcgtgggctttggctgttgcgggggtggggggtgtggctcggtggtggacggacacgctagggacccgtgcacatgcatgcctgccgcatgccacgcccgaaggaaccccaagtccccaactgcctttctagctaatcatcccaacaaagctcaactaataataataatcaacgatcagattattatattagtactccctcagtactagtaaataaagtcgttttgtacagcgacacggtctccaaaacacaactttaacttgttgtttctataaaaatatttattgagcatattttttaagcataatttttacattttcaaactcaacatctagatagttatttatgacttatattcctaagatttaacttaaacattgtcttaaacgactttctttacaagtacggaggaagtatgtgcgagtcctatagtgatgttttttttcttccctttcgaaatacggtataaacgaaggtannnnnnnnnnnnnnnnnnnnnnnnnnnnnn

SEQ ID NO: 52389 - DNA, 3090 bp, Oryza sativa
  unsure (1)..(3090): unsure at all n locations
nnnnnnnnnnnnnnnnnnnnnnnnnnnnnnnnnnnnnnnnnnnnnnnnnnnnnnnnnnntaataatcaacgatcagattattatattagtactccctcagtactagtaaataaagtcgttttgtacagcgacacggtctccaaaacacaactttaacttgttgtttctataaaaatatttattgagcatattttttaagcataatttttacattttcaaactcaacatctagatagttatttatgacttatattcctaagatttaacttaaacattgtcttaaacgactttctttacaagtacggaggaagtatgtgcgagtcctatagtgatgttttttttcttccctttcgaaatacggtataaacgaaggtactcacaacactgtgtgttcgctcactcctatgaacacacatgctcattctatctttacgagcacatcttaaaaactaaaccgcgatatatcttaagattgactaagtcaccacgtacgcctcgctgttgacgggtacgccatctatcactaaaagaatagtgagctgtgaatgatgttcttttctataataaagataagccagcacacataaactaccgtataattaattaagttttaattactataaatttattaaatatttaaaaataatttctatacagaaagttttcgcacgaaacgaaaagtttaataatttgaaatacatgcaactaaaatcgatgcaaaatctatatcttggtttcaaaaaaaaaacaccatctacgtatgaaagagaatcatcaaattagtcttctagtacattgttacttaatcaaggaaaaaaaaacaaaaacaaaaggtgagagagaaaaaaaaaatcatgtgcatatgtgctcgcttttcaggtccggatccagcaatgtcgccaccaaatcctgcccccggctcggctgcctcagatgccgctgcaccaccgcatataataataacaaaaaaaaaaaccatatcccgatttcatcgatccatccatccaaactggggccaaatggccaatactctaatcacaaaattaacaatcctaattgctccaaggtacgtagtacaacagtacaggacgcaaagcgatgatataacgcccgccaggtcatcctcgcacccttcttcacttatcacccccagatcacaccaaagattggaccggatttgtttagtttaggtttcgattagcttaacgatactgttccattaaacaaaccaatcaaccaattaattaattaaacatagatcagcagcagcagcattagcggtggcggaatctgggcccccgactggtttgactgaccgctctgttcccgtctccggtgggcccgggcccaccgtgctctcctccttgccggccggcccacgcacgcatctgccactaaaacaaaagagaaaaaaaaatatagaccagagtatataaaataaaaaagaaaaaggagaggtgtcacagcaaagcgaacacatgaaaaagcaggcaaaggatttttctactccttttccctccaaataaaaaaagtcaagtcatgcgtgtggggccacacggcgatcgacccctcacgtgggccccacctccgtggttgcctcctcgttcgccaacctcccttgaacgcagcagcatcaacaaaaaaccaagaaagtgacacttttaatatctttacagatttttctttttaatatcctttggatttctaaactccaaaaaaatatcattattattattattaaaaaaaaggtgaggttagcagcggtggtgggatgactgatgatgaggagtgatgagcagtggagaaaaggcaagcaagcaaaggtggacaaaaagaaaaggaaaggacgaaaccacctcacctcatctcatggcgtttttgttatctgctccacctcctccaccacccccatctgctttgattccatcaacgccacgatacaataattactccgtattactctctctccctgcttaatgccgcactaacccttttttttctaatctggaccggcaagctagcctgtgtggtgtgatcagcgcctcggaaagcgacgctcgcagagatccccggatcggattagccagctctccctttttttttctctatcaaatccagagagacacacacgaaaaaaatatacaaattcaacagtttttaaacatgtgcacatgcactgtgctgccacgacggaggtggggcccacatgggcttttcgggtgtgtcttggtcgtagggacatgcgaggattagatggatggatggatggagtggtggttgtcattattgcgggggttacttaattaattaatttggtcaagcggtcaatcacctggtttagcgctaacccttttgtttatccattatattatttaatattttaatattntgtctcgtgtgcgagtgatcgatgcttcccaccaccatccatccatgtgtcacccctcctccgcttgctttatatagcccacgcgcctccctttcctttgccttcgtcttcgtcttcctccagccacgccattctgtcgcctcctccacttcttctccttcgccatggctgtgcaggcgcagtatgggggtgggatggcggcggggatgtgcttgccagaccatgaggtggaggcgcagatgcgggagctcggcgcgatgttctcggcggcaggtggtggttgctacaacggcggcggtggcggcggagggtatgactgcgccgccgtggtgagcggcgcggcgcagagcgagctgacgtgcaacaacggtggtgtttgtggtggtgcggtggggatgggggtgggggcggggaggaagcgggagagggaggtggtggagcagtatgcggcggtggcgtcgtccgcggcgctgctgccgatccccgggatgatgaaggtggcggcgccggtgagccggttggtggagtcggggatgacgtcgacgagtgggaggtcagcggcggcggtgggggatgcgctggtgtcggagctgtgcgcgcagagcgcggagatcgacgcggtggtgcggatggagtgcgagcggatnnnnnnnnnnnnnnnnnnnnnnnnnnnnnnnnnnnnnnnnnnnnnnnnnnnnnnn

SEQ ID NO: 52390 - DNA, 1277 bp, Oryza sativa
  unsure (1)..(1277): unsure at all n locations
nnnnnnnnnnnnnnnnnnnnnnnnnnnnnnnnnnnnnnnnnnnnnnnnnnnnnnnnnnnnatctcgctaactccagatgagtaatttagctagacatagattaggtagggggattagctgaattgatccagttcgttttgttcttttagtattagggtaaaaaaaatgatgacatggttaaattcaattggcgttttgtgttcatcccctctctgtaaaattaccgctcagtggaaaatttcaccgtgtcctcttttggccttccgggtcaagaaaagcttacaagttgtaaaaaaaaaagtcaggcatctgattgtaaaaattgaatgcatggccctttttttaccattttatttattactgtcaactacttatcccattttccatgggaaaccaaactgttcgagatcaaatttcccatgaaaaacggaaaaaaagatttaaaagaaggggggttaattaaattgtgccgttacgtccggaaaaggtgggattctttcggtgggtgaggcggcagttttttttgcatccgggcattaatcaccgcaggattaattgtactactgtacccaaatcggcacggtttccgaggcggattaatgagatgcaggataaagatatccacatgaatgcacccagttcagtgtcagggggtggggtgggttggatacttggattggatgactggtgatgtgaaaagatacccccagccacgggccactgcactactgcactgcacagctttgctgtagctggtggtactggagttgggagtagtagtagacagcgagattggcaatggcaggaggcatatgcatttgccttttttttttcttttgggttttacagtacacacctgacatctccttgtgcttcaccacactgcctttgctcagctttcctttccctttttttttttgtgagtaggagtgctagccggatcggattgcttcatctctttgaaaataagtacagtactgaagtattactactccggacaaatagtacattttagaaatacacgcagcagaaatgcggagctgggagcatgttgctacttctatattttagaacgggtggttatttattaagttcacttttcaaaatgtttgattcattttcataattaagcagataaaataatctgtctctctctctctctctcgtttggttgttccgactagtagtaataataataataattctacagtaggagtaaannnnnnnnnnnnnnnnnnnnnnnnnnnnnnnnnnnnnnnnnnnnnnnnnnnnnnnnn

SEQ ID NO: 52391 - DNA, 2358 bp, Oryza sativa
  unsure (1)..(2358): unsure at all n locations
nnnnnnnnnnnnnnnnnnnnnnnnnnnnnnnnnnnnnnnnnnnnnnnnnnnnnnnnntttgctcagctttcctttccctttttttttttgtgagtaggagtgctagccggatcggattgcttcatctctttgaaaataagtacagtactgaagtattactactccggacaaatagtacattttagaaatacacgcagcagaaatgcggagctgggagcatgttgctacttctatattttagaacgggtggttatttattaagttcacttttcaaaatgtttgattcattttcataattaagcagataaaataatctgtctctctctctctctctcgtttggttgttccgactagtagtaataataataataattctacagtaggagtaaaacgggagtagtaaaggtttgcagcaggccttactggcctcctcttttctgcttctgccgccgctgcatcatgtctgacagaagcaacaacaacaaacaacaggcaggctaatgtgtctatctgttctggtagttttctttcaccgggaaggcagcagtgtgcagcagtgggcagtgggcaccaagctggaccaaagcagtacactcattaccacagcagcagtggcaggcagtgcatttgtactaccgctagtcctacaattgggtcgagatccttgcaacttttttgaatggagtacgagtaccagcagtctcacagcagcattggggggttgggttggtcggtgtcttcttcctcgcgtctcatcgcatcgcatgccattggaaagggagaaaggatggagaagaaaaagaggcatctgctgcgtttgggtcgtgttgctttcgctcattgaggtcaatgactcgagatgcttgatttttcacattttggtccttttaaaaacttatttcgcaaatagacccctgaaaaaacttatcccagaaatagtcctttttggggcgccagagtggctggcgccgtcatccaacgggacggcgccaacctctctagcgccgtcctcctgccaccgtggcgcacgcgaaccgacgtggcaggaggaggctggcgccgccgcctccattcctttttctctgtatggagttgcaacggtgtcatttttattttattttttcggatgtttttttatactcagtatcacgatacaaccaaccacaaaaaaaatttaaactcgaactaccacttaggtaagtctgaaaatatctagcataccacttagtctactttgcaccttcactaaaattagaccataactcctttagtaaaaccctttgatcagcatgttaaacataatgcactctaccactatatgaaattacttaatctaattcaaaatataaccacatgaaatgacatatatataagttaaacagtacatagagatgcaattttttatttttatttcatttttttatatttttttcacactaaggagaacataggaaccaactgtataaaaaataaactcaaacggacaaaatatgtgacatgtagaattttccaaaactctaccgaaacggacaaaatatgtcatctattaaaataggcgtaactttctcatacgggctcagaatcaggcaaataatatatgcacggacatctacagaaaatgatacatccgattctccccatctacgccgggttcggtgatattaaaacctccaaatttcgcttgcaagattgtgttttcgatgagagaagtttttcggtggagctttggaaaattccacatgccacatatttcgctcgtttgagtttattttttatatggttggttcctgtgagttcctaagtgtgaaaaaaatatcaaaaaaataaaataaaaataaaaaagttgcacatctctctcctctgcactagttcggaaagagaggagaggagaggaaaaattctacatgtcacatattacgtccatttaagtttaatttttctatggttggttcttgtgtgtccctaagcgtgaaaaaaatatcaaacaaataaaacaaaaataaaaaatttcgggggggaggggcgccagccactctggcgcactccccctagccacctcagcatcaccccgccacgtcggcagggggacggcgccaaagaggctggcgccgtcctgttgaacgacggcgccagccactctggcgccctaaaaaggactatttttgggataagtttttttaggggtctatttacgaaataaattttttaaaaggaccaaaatgtgaaaaatccagtgtggaggtgaggggcttctctggcttttctcttttgcagccagctgctggtgcttgttctttttcttcttcttccatttgtgaggcagatgagagaagaatcaaggaagccaaccattgatgg

SEQ ID NO: 52392 - DNA, 7216 bp, Oryza sativa
  unsure (1)..(7216): unsure at all n locations
ggcatcctccgaccaccgcgcccgccgtttcgcatcatgggtaggggccacggccagaagctctcgcttcatggccttgaggctccggcgagaaacgtgagcgcacgctcccccattgacggtggcgacgatggccccgggctcctggaaccccaggtcatcgtcgccatcgtcgacatcaccggtggtggccttctgcttggcctcacctcgccggttgccggcgggagccgccggggccttgccctcacggcgctcctgcctccgctcctcctcccacttcctcgtccgctcagccaaacttttgaccgcgcggcaatccgcgaggtcgtggagggaggtgttgtgcacggaacaccacttgccaaacttttgaccggccttcttctttttgtcgctcgcaggcctcccctttcgggtggcccgcgaagcgccctcgacggcgaggacgtgaccctcgtcgtcggaatgggccgacctcttcttcttcctcctgtcccgccgccctgaccgagcggcggtcccggaggcggccggagctgccacaccggaaccggaggagttccaggtccaggcctcctccttgcgagccacacggtccgcgagctgaaaaagctccgcggtggtctggggctccttggaggcgatcttctcgagcatgcggttgtgccgcacgccccccctgaacgcgtagatcaccgcgtgtgcagggatgcatggtatggtgttgcggacttgacagaaccgctgaacatacgagcgaagagactcatcgtcccttcgctgcaccgcatgcaagtccgctttttcgcctgggcgcggatatgtgccctggaagttcgtggtgaactgctggcacagatcctcccaagagtggaccgacgcgggtggcaagttcattagccaaccccgcgcctgacctttcagggccatgggaaagaaattcgccatgaccctatcgtcacccccggcggcctcgatcccagtcgtatagatctgaagaaactcggcggggttgacgcttccgtcgtatttttcggtgatggtgggccggaaccttgggggccaacggacgttccgaaggctcgccacaaaggctcgacagccggcaccgccaaccggggacacggggggctggcccctgtgcccgaaccgaagtggcgctccggacgaggaggcgccctccattgcgtgggcagcacgacgaccattgcgccggcgctcgatactggggcgggtatccggccccccacgcacatcttcttgggtcggaggcgttgacgagggaatggcggacgaacggcgggaaacggtcgccgctcgccgggcccttccgcttgacgacacggagccggtggtagcagcaccagaggtcttggtggcggaggaccgcccaccggcgcctatgcgctgctgcgccgtcatgaccaagtcggccacgtcatccagccaacgtcgggctggagtctctggatcggggacgatgggcgggtgacgtaagagcgcgccccaagcctggagcgcgccctggggcgtgctaccatcgccgtagacgaggaggcgacgctccccgtcttggcgtaattctccatcgcccgcgggcggtgaagtcgcggatctttcgaccccttcgaacgcctcctcccgcccaagacttcggcgagagggggacggtggagtacgaactcgacggcgcgggttctgctccccgtcgtcaccgctagcgctcggagagaggttgtgcgccactgcccgttcggccattgggccgagcgggagaagcttggcgcacacgaaagaggatgagggcttagaaagacacacgcgccccctacctggcgcgccagatgacggagcttggggctcctcaccgggagaccgcgcaggcccccctttgctggttcggccgggggcgctcagtgaggttctttgccctcggtctggggaaagttcgcgagagagagaatgcacaagacacgggcgatgtagacaggttcgggccgctgagaagcgtaataccctactcctgtgttctggtggatctgtgtatggagaagttacaaagagctggggagcaagagagttcaggctctagaacccctctattccccccctggctctcgatctgatcccatccccttcttcggtgggtaaggtcttccttttatatctcaaggggaaaccacatgcaccacttctacctactcttcttttgggtggggacccaccctatcttgaccaaaacttggctcgcatcttcgcctggaagctaaatcatagcttgtccttgagtgaggcccagcgccgtcactcgcctgacataggggatcaccctgtcattccttcattaatgggcggagattgcaatggctgcagtccgaatgacccttcgatgggatgggtcatacctacctccactccgccggatgcagatgcaacgtgggagcacagtttgtcttccgatgacgtgaccggcatcagaccagtcacagaccggtcattcttgtccaccacgtgtcagtttagcatgccgcacgtctgctcttctttatacaattacttccttgtaatggttgcgatgaagcctggcatgaacctagccgggactgacgtgccaactgcaggagttagcacgccggccccggctagggacgagttccaggaggctctcatcattccgacgggacggggcgaggcgtgtgacaggccgcctgttgccacctaacccgcgatctgaccggtctgtgaccggtcacacactgcgaccggtcacggaccggataagcgagcgcgctgcgctgcattaaatgcggcgtggcgcgctcgtccaaactgtaataaatgcggttaggtgagccccgctgtgttcacctaacccatacacgtggcgccagaaccacagagggtcggggcgccccagccctcggggtcgaaacgggagcggcccgacccctcggggagacggaggaaggggtggccacgtcaccctcgggcccgaccccccccaagggggtcaggccacgtgggtgaccgcggctgcccaagcctctagtcatgatactcccggtctcatgtcaccgacaactgtggtaggtagtggaaatatttaaaagtttgaaatttttgttcaagtttttgtaaacttggttgggttacggggctccagtgacaaactccaccttttgatccaggcacaaccacacagcctggtagctccaacatatccaaccccttttctctctcaccattttttttggaaattgtttgttattatttattttttttaactcaccacatttccacataactctgccgcatgctcttgcacataccatgttttgctaaaatgctaatacaatcaactagaaggcattttctaacataacacgtctcttgagttctacttggataaagtgacacctagagagtatgtaagacatcacctcctagaaagagaggggaaaatctttcgaatgatgaaacagataagtcatcccaagttgacactaggagaaataccgagtcatttccacattgctaagagtcattgctaggagtcccgttgacttagactatactagattagggtcttcaccttatactattgagtatttatagtagatcaatacatataaacacgatagattgctattacccattaggaggctcgatttgtataaaaaccattacctcctacttcatagctcaccttcgcgagcatccttgtactgatcaatccttatatctgtataaaccattgtctcctacttccttattatatcttgatgagcatcctttactgtccgactatacaaaatcaatactatagtcatgccctaacatgttagcaaaggtatcatgtgagcatctctatgacatgccacatcaaatattggattgatgctaatacatttaactagtttatggggggtataatatgtattttttttaagtttgtggacaaacataactcatgtttatttactcatagaactttgcatccacgattcacccatccataaatcacactatggatatgacccttggagtcaaaatgcccttgtttcttgagaggaataagtctatttcgcatccctcatcttttatccttgatcgaatcgcctcctccaaccgcaaaatcgggtataacacatcccccatctttgaaaaccggtgcaaatcaactcattcggtggtgtcgaagtagttttcataggtggggctcacatgacaatgaggtatggcaaaaatatatggccccacctacaaaaaccaatttcgaaaccattaaaggagtcgatttgcactagtttttaaatatgaaggaggtgttatacctggttttgcggtttggggggatgggattgatcaagggtacgagatgagggagttaaaatagacttatttctttttgagaaacatcaacaggagaggaagaattatacttgggccggaaaaagtacatctaaggtccctcatcttgtcatcggattacaaaattatcccccaatcgcaaaaccagatatatgggatccctcaacttataaaaccgggtcactttgggtccctagacggttttgacccggttttatccgacgtggcagctgagtcagcatgggtcccgtatgtcagtgtgtccactttatcactccctctttttcccatctctcttcatcctctcttctctcccttaggtcccgttcttttctccaacaaagagttggatgaagattaagattttcgtggcacgcttttcaaactgctaaattgtgcgtttcgtgtgaaaactttctatatgaaatttgctctaaaatatcatattaatctatttttcaagtttgtaataattaaaactcaatcaatcatacgttaatgccacctcttttgcgtaaaaaacttaatcttcatctattcatcttcgggagaaaagaacaccacctactcggttactctctctctctctctcaatattctttgggcaggccgacccgcgggtgcgaggtggaagagaggaagggcggccgatgctggggcggcgacggccaatgcgggagaaggggagacggtgtctcgtcctaccgccacaacgacgccgtccattccttcctccttgctaaggcctctggctctgatttcgtcttctcccttctccgccgcatcctctcgttctccccacccgccgactccctcttccgccaacgccgtccactcctaccctcctccgccacatcctcataacctcgccagcggatggttgaagatgaagtggctggggtcggatgccccgcggtcatcccgcgcggcggtacctggtaccgcccgagctcctccagcatcgcctccaccgtgaccaacgcacgcgccgcggcaactccgcgagacacatggaggaggtgatgctcgcccacaccaatgcctcctgcgagtttagcatcatcctcgacgcccgtctccctcccctcccccactaccgnncgaaccccacccggacgacgcgcgaccattagaattttcgtggaccacccattgtgcagtgccagactttgaagtacaacatgaagtcgagggctgggagaggctttatccctgaggtgctgaaggtgatgtccctggtgtaccactatatttgagtagcccttatcaatctagtgtattttttgtaccctgggggtgtttagatccaggggtgtaaagtttttgtgtgtcacatcgagtattatatagggtgtaaaaaaaactaattacagaatccggcagtaaactgcgactctacgagacgaatttattaagcctaattaatccgttattagcaaatatttactgtagcaacacattgtcaaatcatggagcaattggcttaaaacgtctcgcaaattagtcacaatatgtgcaattagttatttttatagcctatatttaatacttcatgaaggtgtttaaacgctcgatatgatagggtgaaaaattttgatgtgtgatctgatcagggcctctgtttggttaaatctgaactgtttgcttgtagataatagataagtaactttgtcttgtcagtagattagaaacccccttccccttctctaagtgttgaatgccatttaaatttggattaagattctagtttcattgtctaatgctttgagtgtgttccggccatgattagagcaggtacaatagcatgctataagcgagttataaacatattttaaagagataaaggaagagagagaagagcagcggactacggatctatagccagctgcagcacggactctaagacttaatgtgtgtatgacaagtaggactatgtattaatagtatagtaagcaactattgtatgaattggctattatattggctatagataatttggagctagtagttgactatactattaaacttgctcttatctgtagaaaaaaaatacatttgcatatgtaaatttatatttgtgttgatggtgttctcctataatcataggctgcgaacatcccgaagaagtatactccgaccattggaatttccgtggaccaccgccgcaagaaccgctcacttgagggctccaggctaatgtctagaggtttaagacataggccttgtttagttcacgaaaagaaaatttttgagtgtcaatgtttaacggatatcggaatgggttttcggatacgaatgaaaaaaataatttaataacttgcatgaaaaccgtgagatgaatcttttgagcctaaactaattcgtcattagcgcatgtaggttactgtagcatttatggctaatcatggactaattagacttaaaatattcgtctcacgatttctccctaaatgtacaattagtttttatttttatctatatttaatactccattgtccagagattcaatatgatgtaaaaatttctggggactaaacaagggcaaggtatggctgcagtttgttgtccctgactccttgtatatgtttatcgaaggtattgtcttctagatctggttttgagcttgattgtgctagctcttgtgtcaggctggtgattccactgccgaggagcttgccactgccacccaggtccagggtgattaattacatgcctattgctcgcggtgagaagcgctcggttgaggctgtgaaggtcaccgatgagatgaaggcgttcaaggcctacgctaattaagnnnnnnnnnnnnnnnnnnnnnnnnnnnnnnnnnnnnnnnnnnnnn

SEQ ID NO: 52393 - DNA, 2282 bp, Oryza sativa
gtcaccgacagtagcccccggcgttatgtcagtgtgatcgcccccctcgagggaagcgctcgggcgtgacgccactccttaggcctggtggcaggtggggccgatttctacaggcggacaggaacccagcggtcgcaaatcgcgcgcatcggcaagggaaaccgaccgacaataatgagcggcctcttcaagaccgctacattattcgagtagcgcgcgaatcgggatgagccggttcatttcacctggagagatgatgatggcgcttcggtcggcgagcgtagtaaacgcgcgcacgatatgtcccatctcgactgccacggccgcacgtccgcctcgtgcgccgcaaacgggcgagtgggattagtggaggcgtgggcgcgagaaacgagggggcgagatagtgggcgcgggaagcgaggagccgggcatagcgttggcaagggtataaagacgccgaggaagagattcgtttccttcctctcgccattatttcccttgccttcgccgcttgcgctctaactcctcgtttcctgtgccctacccttgccacactcactcgttctcaagctcctcctccgccggcgtcatggcacggggctccgcaccgctcgatggttgcgtgctgccgccttcccgcatcgtgagcgagaggcaggccgggctgccgcgccgattcatgccggaatctgccactggccgggaggtggtcacgctgggtgagggacgcccggcgccacactacccggggcggtccgtcttcttcctctctttcgcaatggcagggctagtcccgccattttcttccgtcttcatggatgttctggagctttacgatctccagatggcgcacctcacccccaacgcggtaatgacgttggccatcttcgtgcacctgtgcgagatgttcatcggggtgcgcccatctctccggctgttccggtggttcttccccgtacagccggtgtcgccgccgtcggtagtcggtggctgctacttccagccggggggccggcgctgaaccgctacatcccttgcgtcctccgcaaaaagtgggacgactggaagagcgactggttctacacccccctcgccgacgaagcgcgcctccgacttccgagccagcccccggtgcaggcctccagctggcgggcgccggtagatctgggagacggctacgacgccgttctttaccgcctggcgagtctgcggtcccaggggctgacgggggccatggtgtacggcgactaccttcgtcgccggatcgcgccgctccagcggcgcgcccggggcgcctgggagtactccgggtccgaggactacatgaggacccaccaggggcacaaatgggattgggtccctgaggacctgaggatggtggtccaacgggtgctgaatctcagctccgtggaggcatcccttatcccccaaggtgtcctccccctctgcagcgatccagatcgcgccagcatcctgtccatcatgcaggcggtcggggcgtcgaaggagcgggctcctcgaggccacgatggcgcgggcgggagccgcaggggggaacaatctaccccgggagggggtcgtgcttctgggccccgcgacgggggtccggggggcaactgccctgccgacgcccgggggaagaggaagcaagagggtaccccttccccatctcctccccgagggggcggggcggtgcgtgccagcagcaggcgcccggagggtaccgcgccgacgtcgcagcccgaggggggcgaaagaagaagcggctccgcaagatgggggagacggaaccatgccggggaaacctcatctctcccccaaggtggtcgtttagccgacctccccgcaggttcgtccccgcgcccactgcggccgtattcattctcccatcccccaaggcgagtttttactcacccgcttctttttgtcttctggtttttcttctgcttcagcgagatcccgtcgcgcccccctcgccattccaagtccggccggtctgaggtcgaggagacggcgaccgcggagactcggaggcgagaagctgaccggcgagaagccgcggtccgcctccgggaatccgaggaggctgtccaggaggccgtccgggctcgccaggctgaggaggccgctcgggaggaggctagactccgccgggccgaggagtccgtccgggaggcggagacggcacacgcacgccaggcggcccgccaagcccccgacccgactccgcctgaggcgacgacgacttcggaggccacccacgacaatgccgcggggggtac

SEQ ID NO: 52394 - DNA, 1413 bp, Oryza sativa
  unsure (1)..(1413): unsure at all n locations
nnnnnnnnnnnnnnnnnnnnnnnnnnnnnnnnnnncatgccattactcatcagaattcagaacgatggtcatatttctaactagtttagcatgaactgtaatacatattgcaggagagttaagcacacattcttgtcatcaatccgtactaggcatgaagactaattgtcaccaaaaccaatattttcgttaaaaaaccctgtttcacttttaccgggttttcgaagtatgtaaactgcgtaaaaacacccattgtacaccctgacaatttcagttttttcctgtcattctacaactgagagcaacataaaactgcatttccggcatcgactgaaaattctactctatgcctctaaaaccaacacactgatcttcgctcgatttccctgagcctgtcagaaattcagcatgaaaggattcactgaatcaatccctcctccgatgcctatatctcctacgtcacgatgcatccggatctgggaatgtcaaccgatgatccgctgcagtcatagcagagaaatatgcagttagacagtgcccaaacagtactactcctgcaagtaaaaaaaacagtgcaagcaattctgcaaatgaagatactactcggagttcccgtctttcgcactaagcactggacgatcattttcacaacaaattgaaactaccatccttcatatatgcaaaccatctgctgttgcatgataataatcagaacaaagtgaaattagcatccattctatatgcagataataagaactcgaaatggtttcagacaatccattttaggtgacagacccaccacaacaatagttctaggccagatcacacagtattaacataccatttagctactactaattcttcttatctacatattcagataaaatcctattcccaagaaagcatagtacaccaattgcatacaattttcttgtgacgcctgacttgcattccatcaacagaaaattcctcacatttgtcagcaagtaaaaacaattcctactgcaatgttcacttctgctgttctactacaatgttcttcagaaaactcctaactcagcaagtaaaaacatgactgcattttccacaaacagtgcactgagaactggaaaaatctacggtgctgagataaccaaaaggaccagaaaaggagatatatgccattcagaacaacataaactatgttcagaaaattcaggaacatgcatatcgaaatcgaagctaggctgcttaccttcgctgttgcgcctgagagcgacgatgtgcagggtctcccggctgtgaggcaggttgatgagcagcggggtgagccgcccatggcggccggcgcggacgcacatcgtgatggcgtagcccacacggttctcgagctcgtttctcaagagctgcaccgaacttccttggtactgaaac

SEQ ID NO: 52395 - DNA, 984 bp, Oryza sativa
cggcgcgtcgcaggggtggctggtcaccgtcgacgaggcgcccaacctccatctcgttctcgtcaaccccatcaccggcgccacggcggcgctcccgcccatcaccaccctccacaacgtcgagaggttcacgagcaaaaagggcaagacaagatacagggtgtacgacgacatgggatacagcgaggcgtcccttgagtactcgccggcgcatgcgagggaatgggtgtaccaccaggtggtcctctcgcgcagccccgccgaggggagcgcatgcgtcgcgctcctcctgcaccggccggacggctatgtctcgttcgcgcggctcggcgacgagcggtggacgccagtcgcgtacccgggacaggactgctccaccggctgtcgccacgccatctacgatgacgccgatggcctcttctacacgttgcggtacgacggctccgtctacgcgatcgacgtccctcgcgccgcggccgcgttgtcgccgccggcgacgagagaggtcatgcggagtgtgacgaacgcggacaacggcagcaagtacctcgtcagggtgccatgttccggcgatctcctgcaggtctggaggttcgtcgactacgacgacggcgacgaagtcgaagaggatgaagacgctgaagattaaccactcggcaccaagcacctgcagatcttcaaggtcgacggcggcgagcagaagctcgtggaggcgtcggcggcgagcttggaggatcatgtcctcttcctcggtcacgggttctcggcgtgcttcccggccgagcacttcccggcgttgaagcccggctgcgcctacctcgccgatgaccacgaactcgtcagcgtgagtaagcattgccggcgagacattggcagatgggacatgaaacacaggtcagatggaaaggctctccggaaaaaaaaacgtggcggcgccgtctcagccttggctcaactggccatctcctgtctggatcacgccaa

SEQ ID NO: 52396 - DNA, 2144 bp, Oryza sativa
ccccaagtccatcctgaccaccccaaccagcctcttcatcccggtgacaatgccacaatgcccgccacgccggccaacgtacaccgcgacctcgaggtaagacccatgagctccgaaacaccccggtgccgacagcgccttcagttcagattcgtcgagggagaagacggcggcattggtgtgtggatcaaggttgaactctgaataattgatcagagggacaggagctatctggacagggaatcctcggagccggatctcgcagtggaagctccgggccgccttcctcgcattcgcaccggggagtttcagaccaagctgtccaactgaaagtctgacaaaaatctggggatccattcttcgtgtcactgaagattagctacttccatggcacatgctgaaaaattcacaaatcattgaagtcagatataatttgatgtaacaatcaattgtaggaaaagaaatgaattctgcaaattagcactaggtgtgcagctgatcttaaaattcttccaatagtagtgtatggtatgacagtatatgctccaagtgatatggaactatgaaaaagactacatagtagcaaatccagaaagaaatgcatagagcatgtttcagtatcagctatgtgctataggaatggcacatgaaaagtagcaacattgctgttgcatgaagatatcactttcagattccattcaaaaaattacatcacttttacccttgtaggtatgaccaaattctacagaaagtaaaagcctaactccgtagccagattcagctcatcacttcaaaatcataggcttaaagcgccagatagaagctgattgcattagattagaccatagccaaattcagctcatcacttcaaaattacagatcacaggcacaatttctccatctgtaaccaagttttattaggtccacctaatctaaggtttaagatcagccaaaaaaaaacttaaaagtaaaagaactaattatttaggaaataaaaatgatttacttagtaagttagctgttttttttttctcaactcaaagtagattttgccagcatttggaattagcattcagacatgtctttaatcgtgattttgatctaatagaaggtacagttcaccttaaacattccccactaaaaaaagaacacgcaactgacgcctagatgcttgcctttcccccattttttttgtgaaacctttgggatccttgacaaaatttaaagaaagatgaatgttgatcaagtagcatattcttcccctttgacaatccctagtgcaagcactaaaaaaggcaagcattgctaatgccactcaacacctcttagcttaaacaactgaaagggagaagaaaggaagaaagaaaaagaggcatctggtgctttgcaatcatgccattgagtggttatcaatggcaattgccaatgccattagcatgccacctctgttcaaagctcctgtcatcagtcaggcactgacagtgtcactgcaactgcaaaaaaaaaaaaaaaaggcttgtgcaaccaaagaaaagcatccaagaagagcagcatcaatggcgcggcgcgacataagctagcccgtgtgtcgcgaaaaggggcggcggccatggcagcaatggtggtgcatgggtgaggtagcctattatcagaattctccctttgctcccatttctttaaccctccaagcaaagcttcctcctctgtcgtatgatcagcgtgcaaagtggagattccaaaccttcctctccaccaacaagtcctcctccggcgcaggcacgccacgccacgccacggcgtggacaaggccgagcacataaggcggccgccgccgcagccgcagccgcagccgcagccgcagcaaaagcttcgctgcatctcacaatgttaagcgcggcgaacggcggcggcgtccaccatgatcaccggggtgattacccccccgaccagcggtacggcaacggcggcgaggaggccagacaacagcagccttcgtggcagccgccgcgggaccaggtgacgcaccacccgcgggggcggagggcgcaccggtcgggcccgctggagtggacggcggcggtggtgttcacggtgctcgccgtggtggtgctcgtcgcggcggtggccgtgctggtggtggtgct

SEQ ID NO: 52397 - DNA, 883 bp, Oryza sativa
aagcccaaatccaagagcagctagctagctaaccatcaaaagaaaagatacttcatctttcttgctccaatccaagttctccatggatttctgatgtgatcaagattcaagaacatgccactgcctttcttggattaattcttcctttcatccttcctttcttcgttgattcagttcatgtatagattggtcaagaaaatgacaactacacccccaatttgtacaattaattagattgtgtaattgatttgaggtgtgcagattaagatcatagtaggtcctaattaaggggaaagaaagggtagtggaaacagtctggcatggtaaagtaaaaactgattaggaaaagatgtagtcttgttgcaagattgaacaagaccagtgacttcttttcttgcaagctttgttgcttggaggaaacaaattccatggaggggaggaggaaaggggcaaaaggataaaaagagaacaccatgaaaagaagcaaagctactcctatgtaggaaggaaatgtgcttttggtaatggagattgtggccctagcgccatgcatgtgcttcttctcctcctttccatcccttgatccttgtcatgttctttcgcttgcttttgtttcaaggattatctagaagaataagtgaataataaccagtctcagatcccaagaatctccaactcatccattattcaaccacttctctctgaccggatacatctttgatgtagaagttggattgattaattatccttatcggaataaaaatcctctcaaccactctcaagctcaaacgacacactaggaagctaccaatacatttctatgtaaccaaaaaaaaaaaacgaccaatacatatacatacatcaacatcatgcagtatatact

SEQ ID NO: 52398 - DNA, 1761 bp, Oryza sativa
tagtagttaatactgtgtgcctctagttaacgactattgttgctaggcacaactaaaatgcatggtctaaaaccagttcaggcgtttatggtctgtttaacttgctctgaaaatgatcatatcagtagttcagttgtgaagttcaacttgtttcgagtgatacttttacttgcaatagttgtactgcttgtgtatcatactgtcaatgatttgtaaccgcatgattcctttgctatggctgcagcggataatcaattgatattcccaagtgtcagtgaaattgctgtcaaatggatcaaggcgaaccaagattgatttagtgaatccttttgtgctgaagttttgacaggctcagggaactcgacagaagattagtgtgttggttagagacatattgagtggaattttcagttcagccgattctggaatacagtttcatgtttgctctcagctgtagagtagctgaaaaacctcaaattgtcagggtcttcaatgggtgtataaccacggtttacgtactttgtgaacagggtttcctgacgaaaatatttgtccaattagtattcattcctagtatggattgatgacaagagtgtgcttaactactgaaatatatattgttcaagataagtgaactctgatgagtgttctgaaatctgatgcatggacgcgacatgctatgtggaatcaagttagtagtatttcttgttgttccggtgatcaccttaaaccaatttttagatcagcaaggaacacaagagagttcttgaaaagttaagagcacatcaatgagtctaggacatttcactgttagaatgcagatttcttgacatttttgtcatggctaagtttgctatactagcacaatttattttatgatttgtattgtggggatgcaagccggctacagtagtggagaaccactgaaatcaacttgaaagtaacaaaatggcatgcagctgaatgcagcgagtgtgacttgagagctagttcagacatcgttttttttttcatggaatcactgcaccagtcgatcgaggccgcactctgacttatctgcatttgttcgtggaagtcagacatgcatttttgatgaacttctgcaattataactattactgtaagaaattagaaatgtgcatgattatgaattctaatgagtgatgacagtaactgaatgttatgagttctgaatcactggacccgatcgattagcaatccacggcagctagttctgtaaaatgggtcgattgaatcactggatcctcctaattgtgtaaaaactaacagcttgaaaggattgaacagatttgttttgtttgcagcagcgatcagaagttcagaactctgcattttgtatatgagcaattctatggttcttgaggaggtactatgagataccaaaattttagtgtaaaattttggtactttatggtacctcgtagtacctaggtatcaagaggtaccaaatttgcaatagaaaaaatggtacctccttaataaccgtaaaattgctctttgtatataagatttgcagagtccactgaaatgcaatcccgaacctgcgccgcgtcatttgagcaaattctgtaccacgaaatctgctgcactcactccctgtggtcgggcccacccgtcattgactacggttgaccaaagttgaaacggggacccacctgtcagagagcgacctgcgtcttctcgcgacgccttcaaatgccaccgcctccctcggctaacaaactcttccacggctacttg

SEQ ID NO: 52399 - DNA, 1916 bp, Oryza sativa
  unsure (1)..(1916): unsure at all n locations
tacccataaacatctggggaaagtttcaggtggaaccccctctttcagtgaaaccatggaacctcaactgagggtgtgtttagatccaaagttttcatccaaacttcctacttttcccatcacatcaacctgtcatacacacacaacttttcagtcatagcagagaaacgacacagttagactcaggcagtgtggtacaatcataaaagcaatagtattcttgagagtaaaaactgggcaagtaattctgcaaattaaagatgctgaatttcacactaaacactggcatgatcattttcataacaaattgaaattaacattcataacatatacaaaaaatattttcctcaaatgaaaatatacagaaaataaagcattgaaggtgtatgagaccattcatttcaggtatactggagacaatgtcaacacatcatttcagctacaattctgtttgtgtacaatattcagataaatcctactcacagagggtattcccaaagtgcatacaattttgtcctgatgagtcctaaacttgtgttgttctacatgcattctcatcaacagaaaattcctcagatgagtcctaaactcaagtcaacagtatatttcgcttgtgttctacaatattcttcagactagtcctaactcaagaatcaaatgcaggattgcatttttcaaaaaattccacaacaagcacaaacaatctacagcgatgcactaacaaacaattacccgcataattgttcaacaattactagcgatgcgttcctttgacagcaaaattcagaatctacagtcatgcactaacgaaaagaacctggagaacggaaacactgccagcatgctaggctgcttaactctggtgttcagaaccacattaacagtgttcagaaaattcagaaagagatcgaactaggctgcttacctgcggtgttggacttgacaaggacgacgtgcagggtctcccagctgcgaggcaggtactcaagtctctgacccatcagcatcaagaattgccacaattagaactcaaatcgatataatctttggcgcaaacgagttcaagaatcgcaagaagagaggggacgaggaggaggagctcacatggcccatggccgggatgtctcgcctgaagagagttgtggggacgggaagcacctcccactgcatcnnnnnnnnnnnnnnnnnnnnnnnnnnnnnnnnncgcgacgccggcgaggcacgggagccacctctcgttgacgcgcaggtagcgcgcggtcgtacttgtcgtgcagcaggacgacgccgtcgccagccgccggcgcccagcccgacggcacgccacatgatggcgtcgacctcacctcctccctgtcgaagtcgcgctgcccggcggcgggccagaagcagaagggcgcgcccagaagtggctgatggcgtcgggggcaccgagatagcggccgtaggcgccgcggaggagcacgtggcccgggaggaggacgccgtcgccgccctcggcctcggcgttgatcgtcttcgctggcgaggaggtacctgccgacgctgccgtccacccgcgaccgaagccggacggactccacgtcctggaatacctccattgctcccgccgccccgccggtggtcgcctcgcgcgcgcgggcgctcgcgtcaccaagcgggctcctctcctctcatcggcgacggcgaggcgtgggcgcgtggcgtgcggaggaagacgagaggaggagtttgttagcgacggttagagctgggacatgggccgttccgggctaggcacggcccagcgtgcttcgtgccaaatcgggccgtgccagcacggcgttttcatggacgccgcccaagcaccggcccaatggcccgatgggcctattcgtgccgggccggcacaagcacggcgcatgatggatggatga

SEQ ID NO: 52400 - DNA, 2500 bp, Oryza sativa
tatgacgggaactaattggtctacattggaaattctgcttatcttgtacggataccatgggaagccaaaggagctaaagatgacatgggatcttatgcaaggtctccctcatattcgacccaaaagctttatactagcaattgaagcatttggaaaggttggctccatcgatcaagcagaagagatatggggaaagtttgaatcaacaagaaagccgaagctgacagaacagttcaattccattttatcagtatattgtaggcatggtcttgtggataaagcatcggctgtgtttaaagaaatgagagcaaatggttgtcagccgaatgctatcacataccgccacttgacgttaggctgcttgaaagcaggtattgttaaagaagctctgaagacgatggatatagcaaagaaagaagttgtcaccaagaaggtgaaaagttcaacaccatggttggagacaactcatatgatacttgaaagctttgcagaaaatggcgacttggtaaatgcaaagagagtttttgacgaactgaatgaatcaaagtactgtaggaattcatttgtgtataatacccttcttaaagctcatgtaaaggcaaaagtttatgagccagatttgttaagagcgatgattttgagaggagcgatgccagatgctgaaacatacagcctactgggattgatagagcagttcaagacataatgaacctgtacacaaactagctattgtagctgtgaaggagtttgaaatgatatatactgaactgagccatacaacaaccggtggtaacatgtgaacattttggcacataatcattcaatattccaattgtcatactgatggtatcgctggtattcatggtgcatgatcagtgtctgaagatgagcacaaatcattgctgaagtgcaggcctcgcagctacctttgttatcctgaacatctagcacaaggtaaaaacattaattattccaatatcttaaatatgttgttgcccaaggtaaaaacattaattatttcaatatttgaaacctgtttttctactatgtaagaagcatataagatgctaaactaggtcagctgaatcctaagaaccagatgttgtaatctaacatttttttccccacaaacccccacacctaaacattgcaggtgatgtacactgcattttcaaagtaggggaatagtgcaaaggaaaaattgcatcagatggaggacaaacacttccaagcaaacaaaggtagtcaggatattacaatgaccactgcttagtggttacacaacatgttgcaggtttcattgtgctacttcaaccatcttcacacctcggccccctgaaacacacatcgacctggtgtttttaatgtgcaaatgacggaacgagatataaaggaaggcaagataaccattataaagcttaaggaaacagtgctacgctgcccaaatgctggatacacaaggagtaccaacctccatttgaatggcagcaaatctagcagcatgcaagtctaacccaagcagcttgtgctctgagcatctgactctggagcaataattttaagataaatgcctgataccgagacatgtatgttgtagctagttgcatagcaccaatctgacattgttcttgtacaaaaagaatccatgcaaagaagttacaataaacagtggccatatgttccatatggtatcgagtcagtggatagattattagcagagactgatttcgtcaagtaatttcatttgcatcctgtccgggcataatcaatgtgcatcctgttgcagaggctggtacattgacaaggtgaccttcaaagagtaattcgcaaacaatattattatggagccatggggaatatatatgttttttttttgccaaaacaaatgttcagatgtacctgaaatgtaaatgattattgacaagtatacaattggtttatatgtttttgatagcttttacatttgcaacaaaatgttagttcatgacacacaggaactgattatgccccatgagaggttcagatcaaggagtctataatctgtcaggcctcaacataacatgatcttgtatgctacagtattcatttatggaatgtcactgcaaaatagacataaaaatacatcttaaaatggttaacaataacatgctgacacaaacttgaccacctgaatactgcaagttttgctctcattcaaaatggagctgcaatcagaggaaaacaaaggaagagacttgtacctgactctgagtaccagtgattttctgaactctagttaacttgtaatagtcatagtgtcaaatttaaattgaaaagcataatgcattggttcctatcttcgatctcaacagtacaaatctagctgaataaaaggatacacatgacttggctccacaagttttgtgagtttcagtaccaggaatcacaatagcataaaggtacatggtgcaaccagaatatctgaaactcattatcagaaacagatatcatgtcagaaaat

SEQ ID NO: 52401 - DNA, 1888 bp, Oryza sativa
aagaagtgatgactgatgactatgaagtgaggttagaggccaatatatagggttgggcgaatttattacttctaaccttggaagatttagatgtagggtatattaaataaatgaattaatgatttctaactttagaatatttagatttaggttattatataggggccatttattgtactcatattaaataccaattcttggttttttatttttttttcttgtatatcttatttttattaaatgttttctaacttcgtggttgccacgagttaggtgttctatgaggtggttgccactgaaaaccgaactttttggtaaccacgaaacttgaagaaaaacatttaataaaaagatatacaaaatcaaagataaaccaagagtattgaaatttgattagaatccaataaatgactactaagatgtaagatgtagatactgattttgatttacgatgcatttaataacgcaaatctaaattctctagtaagaaaatcataaatcttttcaagttgaaaaatcataaattcagccctagcctgtataatggtctccaagtctcacttcatagtcatgaatatcacccaaatagtatatctattctgaatttgttgagaaaacgcatttgtgataccctagccccgagccaaacctcatactccctctgtttcacaatgaaagtcattctagcatttcccacattcatattgatgttaaagaatttagacatatatatctatctagatttattaacatcaatatgaatgtggaaaatgctagaatgacttacattataaaacggaggaagtacatcagagcaataagtctgctcctgacattaccatcgtcattaccactgtctttcaaagcaccaaacttctataagccactcagatggaaatcatttaataaaaaaatacaatcagagataaaaaccattattactggtattcgataagaatctcagaaatggtttagatttacaatgcattattttgtaaaatgccctcaccatactctatccgcaaaccaaacctcatatacaagtccacttttgctattattaatggggtcgtttgacggtcaaggcacagcatgctgcgcaacctcgagcaaccgaacatccccaattaccattgctgtttagggaggcgatggtaattgggaatgtttgaatgctcgaagttgcgtagccaacgtaaacattataggtatttctattcaatgataagatttagattagatttaccatagatttatatatagctcataaaagaagaatagcaaagacaacaaaaaaggcaaaaaacaacagtaaatcagcattgtagcatatccaacctatataaatcatgttgagacaattggaatttttttctaccaaaagaaaaaagaggaaattaattgaggatttgcttaccatatctaacgattttgataagaaggatagatgcccctccccttgatgaggcctctgcaaagaccatttcctttgttatgcttatcatcatcgaacctatcaaatccgcgttgaaagtaaataccttttacctcgagcaagaaagtatagagattgttttcttgagaatacctgagaactttcatctacaagtgttctttctctctattgaagcctctacaacaatattaacgatcatagacttaaaaagtgactctggtagcccatggtaactacagatctatggtatatgatgggggtgggggagatacgtgcacatatgcaagaaagaatggtaaggttacatagtagcaacaatggcttctagcgtaactatgacggacgactgcatctatatataggaaagagtgaaatggaagatcacaaatagcactggcgtcttctatgtgggtaaccacatcgacacatata

SEQ ID NO: 52402 - DNA, 4027 bp, Oryza sativa
tattttctttcagataatccagtcactacttttaacctatcaaatcctacatggtcctgactgtggattggattggattgtttggatataacacatggacattggaacttgtcatttcataaagggatagaaggtccaagtttagtatggaataaagggtgagttgagttagacatttcacatgaacttgactcataatttattttaattttattttttcttgtgcactggtaaacatctactactgctattacctgtactgctagtcctctgaaaatgggagtagaaaggttcttcaggacagacaacacacaattggcatgaagggcaggtgtaacagaaacagatgcttctgttgctgctgatgctgcatctgaatgattgtgttctatcaaccacggctataaatctctctctacctgaacccaactgcttcacagtttacatctagctcttcagattaggtactagcttcagtgttggatatgctgtgcttgttcaggcactggaagtgagaattggaggaaaacaaactgattgctggttgttgtttgcaacagtgtggcaaacaatgttcagcttgtttttcttcaatatctcaccttcaggttgattgcttgatggaatactttagttgagcagcacatgaacagattggcagctagtgttgggttttagcagctaggaccatatttatatgtgccatttgaaatgaggattaaagggaactgaaccattttgatgaatatcagaaggttcagtttcctctaatatctcgccttgaatggcccatccggaaaatagctatacccatcatatatgcactaaaatgtaggaatagaagagaaccagtttgtggccctcccaaattcttccttttattgaattctttgatttttgctgaaggcgcatatcaacctctcttttctcaaacttacagaattttatccaccaactcttttttgaatatcgtgtggaaaagcctactctttgccaccaagctcatttgaaatggtaaacataggttgagtttagaaaagtattttatttaacatgatgataagttttgaacaaaattcagtgccaattacaaggattaattcattaaacgttcagaagtttcaatgagttcggttataccatacttcaaacttgtgaagattttggagttacaccaactctaatatcatctaacatgataagaaatttttttgccagccttgtcagttttaagcatcttatttatatgtaaatagaaagaatacatatttagaacacggtaaaaaatggctcagaacttttaagtgttgctctattgatcaagctaaatcatacttacatatatattacagaataattgtaaaccttgaaggaaaaacatcatctctctgtttcctgattgccttggtcataacacaggcatagagattttgatcatgcatctccctaatgtcacaaaatgtacacgtataattactttcatgtgagtggcagtacgccttttgaaggatgtaccctatgttttctgagtatatacaaccgctgtgtttgtggatctgactcaaacaaaaagcccctcaactcaataatcctcaagcaatgcctccaaatttttcctcctcgcagcatgcttcagcttctccattgcgatgagtcctacttgcctcaccctctcccttgacaacccgaatctgaggatcatttttcaaggccaaatattataaactaataaatataccaagaaactattatgaatagtttgataataatggaaaagttttagatttttttttatggcgagcaaacttgactaggcagttgaacatgtacaggaccttggtccataagagctgaagaaataatacttactgtctgctaatatcctcccatgtatggcattgttttcctatgccatgatataaccggataatgtccctctcacgctcgttgagagttgagtttaaaagcttgttgacttcttcctggtattagtagaatgtttatagttaaagcacattcaatgattctctaaggacataaggtaatgaggtctggtcatccatataccagtaccaactcagagctataatatgtttgtggagtcaacttttaaaaacaaaatgcttggagtcataatgatcttttgtcttgtggatggattatttccaaaaataaaagaaagaacaggattatggactagtagcaattagtgcaattatcttctggaacaaatatctctgtggttaccttgagataccactcctcaaatccatgccatggatcatttgcgacattttgatcctctatgtactgagaacaaggaaagggcgaaaaaggtttaatctcgtggcacatttcaaaattgaaaatgtataatggtgtttcaaagtagctatatagctgcttacactgtgcagtgtctctccaggtaagccgtttaaggatggaaatgcttgttgatccaacgaaagaaccttgttcacagcctgtatttttcaaccagtaaaaatgtctgtgacaatgccagaaatatcaaaggaatttaacaaaagaagttccaccgagcaagatgaagatatattacctctgtagcattgagtactttcttttctgatatgttgagtgaccctgctatgttctgagaataaccaccaaaaggttatagcaaaccatcagagacgcgacattcaaattatataatctttttcaaagaaaaacaaaagtagcatggttaaaaatacaatagcagcaactagaagtactttgcagttcacagaactgaaaaccatcataaaggttggcaaactgtcatacctgcgtttttaattttaattttaaaaataaaaagaaacaatgattaaaatacacaaagaaaactgcaattgtcaatattttgtaattcatggaaacagaacttgccaaatttttattttgatagtgcagtatgccttacttctattgttggagcaattccttgaacttccaactcatactttgcaccacgaatcgcaatcatccgctcgtgcagataatttggaagcctgtatgtttttgaagttttaactaatactctagaaacaccctggtatcgatcgaaacagtgaaataaggacaatgtatcaggtatcgattgagttaatctctgactgtaattctgaacttccatacatttgcctgagcacaggatagcagagaactcttacctggcgtatccaccagtatacataagtggaaattctaaagcccctggatgcatcaaatttttcgatcccacggagtaaccctatcagaccaccctgcaaaatgtgattggatcgcaacacgttactacatgtctcaagcacacaaaatcctcctagtgtgtccaacagatgattggactgaacagactctgttagaattgcaaaggcagctgaattaactgattccattacctgaatgaggtcagccaactcaacaccaaggttatcatacttctgggcaatggaaatgaccaaacggaggttgctcattgttagcatctcccttgcaagaaacgactcgtgcatccttgatcgtagctcgggcggtgatatcttcagcgaatgcgccagctgtttgtatgagggctcatttcccagcttctctttcagcctggttcaacaatggaggaacaaaccatcaggatcaagaaagctaaaaaaaattatgaagaaatggcatacaaatgcaaggtcactgagtgcaatgcagaatagcaatttgaatggccattactgaaaaatcatacgaatcaaatcacttaaatcatttgaagtattttggtgaatttcatacaccgatcaatcgatcttcactccgaagcttaagctgacgatgaaatgtaaacaatatacttgaacagtttcaatggttttgagaggaaatgataattcaaatgaaggattgatcatttcatatttgcagtgtgtggcaatggaggcatactttgatctttgctgctgcagccagatgccatccttgatcttgtgggagaggtggacgacct

SEQ ID NO: 52403 - DNA, 2266 bp, Oryza sativa
  unsure (1)..(2266): unsure at all n locations
atccccttaatccaggggcccgtgccaccagcgacaggtacaaacaactactccatctatctcaaaataaacttaattattagacttttatgtctagcgtttaactattcatctttttaaaaaaaccataaaaaaattttaaaagataagacatgcataaataaagtattattcatattttatcatctaacaataataaaaatactaataaaataattttatataagacgaataaaatatattatttgtctctacttctcctaataactttttatagacggaggtagtactcaccgccgagacgacacagtccaaagcacaacaaaagatcgcctcttctgaaagaaaagaggagagcctactcgttccgtccacacgtcgcacgcccacacgccgcataaactactcgtaaatgctcttttttttttcttttttctttgtctctacttctcctaatagtatgaaaactttttatagacggaggtagtactcactgccgagacgacacagtccaaagcacaacaaaagatcgcctcttctgaaagaaaagaggagagcctactcgttccgtccacacgtcgcacgcccacacgccgcataaactactcgtaaatgctcttttttttttcttttttctttgtctctacttctcctaatagtatgaaaactttttatagacggaggtagtactcaccgccgagacgacacagtccaaagcacaacaaaagatcgcctcttctgaaagaaaagaggagagcctactcgttccgtccacacgtcgcacgcccacacgccgcataaactactcgtaaatgctctttttttttcttttttcttttccgtctagaaacaggtccttcgctttctcaactgcaggtgagtctaaaaattctaaaatttggagtagctctcaacagtgaagtgggatattttaccgtcttaactgctactgaaacaagtactactccgtcaataaataggaggaatttttgctatgcatttttccttatttttaatgacggcattttattcttagagcaacaacaatatatataatgtatatagaaaaaatagcccatataaataggacccacatatataagcttaactattgtaacctttacaatatgcatagataacaaataatattaggaggaaagagggagtagagacaaataacatattttattctctatgggcaaaccatatgcttatggatagcttttgttatttctttgctatagactacttccacaatgttgttgggtggctgaatgaaatattgtattgcttatagactacttttgcacaacactgtggatgcccttattaccatatcacctagttatattagtgagatggcaaaagagtttttcatattggtttataatcctctttcattccttattgcagataaatacaacactatcaaaacgggttagttatctccttaaaataaaggtttgagtgccattacgaagtattttgattgattttaatagttgggagaggctacatgtttggttttacaggaaggggctgatttctaccgcattaggaaaatataactgtagaacaagcatttactagaaagctgctatttagatattgggctaaaacatctaaggctgcgtttggcagcaacaccaaagagagaaaattgttttgtttttcgcacgcacgtttcctaaactattcaacattgtgttttttaaaaagttgatttaataaatcatattaatttgtttttttaagtttggaataattagtaaacaaataatcatagttaatcgttcaccttgttttgcgcatctgttcaatcttctccttttctcttctctcaaaaattaatttttaagtctaaaatatttaatacacaattaatcataaaatatttaatacacaattaatcataaaatatttaataatcataaaatatttaatacacaattaatcatacgctaatagttcaccttattttgcgtatcttttcaatcttctccttttctcttctctcgagcacaaccttagacacaggtttatcctcaaaagctgtttatttatggaacataaggtgtacttccttaggtcaatctaagcggtaatgcgctttgcaatagatggagttttctcttctatcgtggaggttaatataagttatatcataggttcagtttaatgttatggaaaatagcatggtcttcatacgtgattataaaataaagtgtgtgtgnnnnnnnnnnnnnnnnnnnnnnnnnnnnnnnnn

SEQ ID NO: 52404 - DNA, 1591 bp, Oryza sativa
tatctccgtttccggcctaccgtttttattccgtttccgaaaaataatatgaatagggaaatggtttagcgtgtttcctgacccttttttatccctacgtgtgaatgcacgcacggtttcatggcacattggcacagacgttttgcaccccaagaacctgttcaaacgaacacggttccagccttccacacgacatggatgggatggacggttggatttcacaccccgagacgagacgcccacattttcaaatttcaaaattcgaatcgccgtcacaacggccgcaactccctctcaccaccaccttttcatatataaactccccctctgtcccctccccttccaatccattccccttcccccaaatccaccctaccttgccgcgccgccgcgacaatccatagagatcatcgagagaggagtccaccggagccatgaggagcggcggcgacgtcaggtccttcttccggcagcagaaggcccacgccgccggcggcgtcaagcccaccggcggcgtctccaagaaggcggcgctgccccgccaccaccacaagcccgcgtcgcagggtgcttttctcctcccggtttctcccgcccccgaaactgttcgatcgattgcgtctccgctgattcgattgttcggtttttttgcagcgacgccagatcgcgccgtcgacgacgcgaggaggcacgtcgagaaggcggaggaggaggaggggcgggagaggatggctcgggagttcgacatggacatgcggtacgggccctgcctcggcctcacccgcgcccagcgctggcgccgcgccgccgcgctcggcctcgccccgccgcccgccgtcatcgccgtctgctccgacgaccagccgtgcctctgggagggccgcgtctagctctagcaccaacacccgatcgaccgatccgcttccagaaagttctagtagcttgtatgtgttttaagtaggaacagcttctcctctgcttccatctgccacgcctcgtggtgcttgcatcgacagttcatttcaaaccgctgcctgatgagtcagtgatcggtgccatcttgtgttcttattatctgaaatttatgatgttgttcttctcccagtcggtatgatctatgagactatgatgtttatgaaccatggcattttgattggattagtacaaactctaaaatcatggtaaattaatccaaacatttcattcccctatctcgattgttgcgggctgtgtatggtatgcaagatagtatctcagattctgatgccattctcccagttagtatgatctatggcgtcttcattgtatcagttattacattttgattggattagtgccaactctaaaccatgataaaattaacccaaacatttcattccccccaatcttgattgatgtgtataacaaacaagaaatcacacacaattgaatcgttggtactgggaaaaggaagcaacaattgcaactcacgattggattaacagatctttctttgcaatatatcccaatccacaaatcctgttattacattacaagcacgagtacaaaggcaataccgaatcaggacgaacgaacatcggtacacacaaac

SEQ ID NO: 52405 - DNA, 2216 bp, Oryza sativa
tccccatctcgattgttgcgggctgtgtatggtatgcaagatagtatctcagattctgatgccattctcccagttagtatgatctatggcgtcttcattgtatcagttattacattttgattggattagtgccaactctaaaccatgataaaattaacccaaacatttcattccccccaatcttgattgatgtgtataacaaacaagaaatcacacacaattgaatcgttggtactgggaaaaggaagcaacaattgcaactcacgattggattaacagatctttctttgcaatatatcccaatccacaaatcctgttattacattacaagcacgcgtacaaaggcaataccgaatcaggacgaacgaacatcggtacacacaaacatagcattagcaatgtcaaatgtccttttctatgtctgatatctggaacagtaaggtctactatgccagtaatacagtgtttcaagtagtctgattcctcgatcgtccatgtaaagaactcgctatccgttccgtccctgtattcttctcagtatggaataatcgattcgatgagctcctggagtggagccagctccttcttgtcaatcaggccaaattcctgcaccacataccaaaaggccggaaacaaatgaattttgctttccccagatttctatgaaccaagagcaaatatgagataaatgtaaacaatcctggtaatgagtttacaatctacaaacaaaagagacttacagttgtaaacagaatgaagtgcttgaagcacgtgttaagatgggcctcctccttgaggctgacaatcttctgaaaactggagtgatatatgtgggcataaacacgaaacaagcgcttgaaaattgtctttacaacctccttgaagtttggcgggaatggtgtgcctggtaaaggaattaaacccatatcagtgtcatgagttgtgtcaaaattggacaaatatatgagtagtgcctgcactatttctaaggtacacatgaccattccaacatcaaatgtttgtgacaaacaatgattaccaagcttttggggaaatatagattcatcatcaagttggccttcaatccagtccattaggaactccacatattttggcgctgacacttctatcggcttctttatctgtacaccatcagcccatctgtactcatatctgcataaattccatgtttctgttgttactttgttatgacgtgaccaatatatttaagtaattctgtacaaaaaatgaatcaggggcttgttgacatgacaactccactttgtaataggtggatataatacaaagtcactttataataggtggggtataatacaaagtgttcttggaaatttttgttccaaaaaggacccatcatgcttgtccatttagtcaatgttctagcctttaattatatcaggacaggtggaaagaagcaaagcactgtggacaggctaaaatggacagattcgaacatccttacctgaaaattccagaaaatttcctaaaattttgcttcggtgggctggtccaatcgacgcgatgcccacgggctggaaagtggaaactggctgcctcatcttgggctgggccgaattttatcgagaagattagacacgagtatgggctttgggcccagaactctccccaagcgccgcatctgctcccgagttttccgcttccgcaaagcgggaaaacgaagcgggaaaccgggcaaatacctcccatttcttcttttttttttttttgccttcgaaattcctctcatttgggggaaaggcgtcggcggcgagagagcggcggcggcgaagaagaagatggcgtccaacttctccttccctccgttgacgccggagcagatcgcggaggcgctgcacacctacggcctcgcccccaccgccaacctccgcgcggaggacatcgccaacccgcagccggatctcctccccgccgtcatctccaacttcctcgccaccgtcgtcgaccccaccgggtgcgtgcgcgcgcctccccctcccccctctcgccggcgccgcccgctcggtgtttgtaattgttgggtggagattttgcagcgccgacgacctcgacgggcagctaggattcgacgcgctggcgtcgctcgacaacccggagcactacatggagggcatccgggtactccgcctccacaagagggccagcgctttcctcgagtccatccagttccccgggtt

SEQ ID NO: 52406 - DNA, 4929 bp, Oryza sativa
  unsure (1)..(4929): unsure at all n locations
gtttcacctggccctgtagtattaggccaaattctcttctaggtctgagtgtccgactttctgacttcattatataacttgcagttctatattgtgttggttagaaatgtcagaagcgtccaggtcaaatagggatagaaaccagaaggtttgcagctttgccatttggacaagacgatctttgtgtataattggattgaaaaatagtttggaaaacccatttacattgtaacacactatcatttactcttgacatatgttaagctacactgaaatggttctcgctgacatgctgaaattttagatatgcagaaaagacgatttctcactaaacgccttgttattttctttatacagattgccaaaaatgattttgagttggtgaaactagcacaagaaaattccaagttattgccaaaaattgttgagtccccagaaaagcttcaggttcgatctgttcctcttttttctctattgccgctggcaggatggtcagtcttgtttaaatacctgaattacttcaccacaatcatagatggtttgtagtgatcgtgtgcaatggtttttgtcctctatatgtttagtttttagtgctgatctaggttttttttttcacataatctggtattaaagggacatttggatatttaccattctaaaactcttcaaaaagtttgtgagaaattgaaaaacaatgtaaatactattatttttgcatgcacaactgacattcttccaatgccgtagaacttcgtatttactctgtatattatttgttcattaaaaagttgcagttattgccagatgctctgtcttgattctcgaggacacactttcactagtttaatactcctcgcttctattcaactgctatttggaaatatatgcatatatttgaatcaatcagatcaacactttgttcttctaacagcatataaattatctttataagcttgcatcactaattttggattttattctgtattacagagggcccttgaagagaagaaaacagctcgtgctgaattaaagaatgctgagaagatagcaacgcaaagtgtacaagagaaaactgccactttggagatatacagtaaggtagtcttgttccactcttcattacaaaacaccgaaggtagaaggtaacttgtatttgccgattggccgtaacaatatctagcaaatatagggttacttcatctgtttcatattgattcaatttcctgatattccactgtattgtttggatcatctgtttgttgcggttgttggggctgacttgttgcaagagtggcacttggctacttactactgttccttgtgatgcttgacctactgatccattaataactgcagatgctgtctccattttgcagggttatgaaaaattgtcgaagcattctactaaaatccaggctttacaagaacaggtatggacatctgcaatgctagtttttcattatggagttggattaatcttaagatgaaaccctagtaactctcttatttattattgctgttaggttactgcaactaaagcccttgagaaagaagtcaaagcgcgcaaaactaagattagtgatgaaagtgttgaaattatggcccttgacacaaagattattgaatgggatgggaaaggttgtcaaactgtacttaccttttgtagtattgctgaatttgtgtatgctctttccattctgaaatactcttttcctcacgttattgcatgaatacctttttgattagtgcatgaaatggaggagcatgttaaagctaaagaaaaaaaaaaggatcaaatagtagcagacgaaaatcagaagctggctgctttgagttctgaagttgaatggaaactcaagtgtcttgaacctcgtgaaaggaaagtagaggaaacaattgcaaaggtgatgatttcgtcctgaaattttgtgtggttcaaactcaatgtctttgaaaacttctttttccctctgaatcattgatttctggtgttcacatgccacatgccacctaatacaatctaatgttccaaagaggcttcattgtatgcgctagtattggtccaggaacatatgctgaccggcctgactatctccctaatatgctaaagcctgtagattatattatcttatttgttaatactatgatcctatttcaactatacttgacatatttttctgtcattacaggctactaaactatgtgcggaagttgattcaacaaggactgatgctgcagaagaactacagctgatatatgctaaatttcaacaaattggacatgcggtatgtttttattagaggactatttcctataatcattgataaaattgttggttgctaatataatccttcttcagtttacttgctacaaggataattttaagtctttcttggaacaagttgatgaggtgagcaaagaaactttagaaagtttagatcgtcaagctgtggagccattggacacatctgcaacattgtagattgagaaaggttaggtcatccagcaattgacacccactttcttgttgcagttaacagcatttcagctgttattgtagcatttcaagctaagtttggtagacggcagttttgcaataccttgctttcttgctgtgctgtaatcctaatgaaactcatctctccttgttttgaatggcagagaactcttgcagccccgctccctgaaaagaggatagccacttggagaagatagcctagtgtgttttatgccacagctgtaaatttggaattgagatgtttttgttatcactggtgacagttatggaccttatggtctgtttgaacctcgtctgaccaattcggtgactgagaatacttcatcgaattatctgcagtagttatgtaaaaatgccttgaatcactctgatatggaaatgttggtgtcaggttgccaagtaaaaactttggattatctggcctactatctgactacataattcattcctttagtatggtttaacggtatttatcaaaacgctgatgcacggtggtgttaggtcagcaaatctggagcacagatcgtgatatggacggatgtaacaactttcctcttcattacnnnnnnnnnnnnnnnnnnnnnnnnnnnnnnnnntttttttctcaaacgcgcaaaaggattgcatgtcaatatattactccatcccaaaatgtttgatgccgttgactttttaaatatgtttgaccgttcgtcttattcaaaaaaatttaagtaattattaattctttttctatcatttgattcattgttaaatatacttttatgtatacatatagttttacatatttcataaagttattgaataagataaacggtcaaacatgtttaaaaaagtcaacggcgtcaaacatttagggatgaagggagtagaagaaaagaatatttgttacacaacacaattagtcagaccaactgatgccaagagaggaggtaaacaaaagaccaaggaaaaaaatacgacttgggtactatgactccaaaaggcgggaagggggcagagcccaccatggtggtcaagtcgtaaagttgagtcgaggtacccttggaccgacttgtcgacttggtcgactagtccacgacttgtccatgactagtccatgacttggtcatgcaaaaacaggggatacaatatataatttttactactattatactgggctaagaaatgtatatagtataaactataaactatggagtagcaaagcaagacaattagtcaacaataaaataaactaaagtactaaacacaataagccaattatcatggtgaattggtaatttgctacgactaattacgactaatttacgaccgattttacgactaatgtacgactaaccacgactaaccatgactatcacacgacttgctatttggtcgagtcgtggttctttagtcgactagcttgaccgactttacgactaatcacgattagtcgggtgacttgataacattggagcccactactctcccaaaaaaacccccaaaattagcaatgccagctaacgaccatagatggccctctgagaggatggactgcaggacctccgagactgaagataatgcagagtcgaaaaccatggagttccattccttccacagttgctaggagaccaagaggatcagagaatcgaagtcaggacggagatgctcaggcatgcatgccctaaacgaaggccaccaatcctggaggcagctaccacgggagggagaaatggcaacccaaccaagaggtgacaacactcggagccatacttgtcaagcgaacacgcaatcaggaggatgtggttcgccgtcttaagctcttgagcgcaaaaggggaagaccgagtgaccgtcaatgtcgtgcttctggaagagatcggtcgtccaacagtgtcactgaaatgcaaaccagaggaagaacttacatttagcaggatccctcgcatgccagagaagatcagcacaagcaaatgactgctggccataaaagaacgtctggtacgtcgaacgcgctgagtagcgctagtcacttgtccaacaccaaacaagacgatctccgacacccgacgagagctggaagtgagacactgcatcccaaatacgaagaaactaggagatgaccgggacaattagggtgccacggatgtcggaaacccaagaattgttcgtcaggccagaagcgaccgtgtacggacctcagatgcactggggcacgacgaagaggagatcaggagccaaggaagccattgagcggccatcaatccattggtcagtctagaagagcaccgattcaccatccccggcatgaagaaggtggacgcatcgaacatgtcggaaacagtccgctcgacgagggccttcaaaccatcacaataaggatgcccagagcgctgannnnnnnnnnnnnnnnnnnnnnnnnnnnnnnnn

SEQ ID NO: 52407 - DNA, 1472 bp, Oryza sativa
tatcatcctctctttttatactactatactgcgtatagtatttatatacatatgtagtgtaaactttgtattacactatgtatagtgtgtatatacacatgtataaacatacgtatataagatatatatatatatatatatatatatatatatatatatatatatatatataaactttgtatacatgcgtataaaaaaaaactttgtatacgtgcgtaaaaatatatacatatatataaactttatacacgacgtatacagactttgtatacgagagtatacaaactttgtatatgtatgtaaaaatatatacatgtatataaactttatacatgtacatatacaaacttggtatacgtgcgtatataaagtttgtatatgcgtttacaaactttgtacatgtctttatatacgtacgtaaaaatatatacatgtatgtatacaaactttgtacacgtgcatatacaaacttgctactaaaaaaccgaaaagggagagaaaaaaccgaacaaagacgaaagaaaccaacgtagaaaaacgagaaaaccggacaaaaaaaacagaagaacggcagaaactaacgaataaaacgagaaaaccggaaaaaaaaccaacgaaacgaacggaaaaaagggaaaaccggaaaaaaaccaatgctacctaactcctccgcgcgcaatccgccgtcccctctccgcgcgcgccacatggctagtcgtgcgggaaggaacgcgcgcgactagtcgcgtattagcgctttcgcactcaaaggctgtactagagtgcatctactatataatcgtttaagaaaatagaaaagaaaaacgatagaaggctcgattgcctctaaaaatgtacttcctccatcctaaaatataaaacttttttggtgtatgtgactatgaatctgaacaggaactcgtagttttaagataagttacatccatcttaaattccttatattttcagaacgaatgcagcataaaaaaaataaaaggctttggtcgaacttgtgtatgtcattatgtgcagtcgtacagagaggggtactgaccacaagtgctctgatgccagcaggggcaccggtaggattccatatatctctctcgatcatcggatgatctgaaggctgtgccgccggcggccgtgccggcgaggccagccgcccttgttccagcaagctgcacaggagatcggggccctccgccgccgcggccttctcctcctcctcctccttcttctcctcccccatggcgaattggcgattcgatcgacaatcaatacagctaaactagctatgcgcgttatgttgaggccgtgtgcacgtacgtacgtatatacgtgtaggtttcggatgcggcacgagcaaaagaaatcatgtcaggttcgagttagacaacttcccggggtgtttttctctggttgtcagctagctagctctacctctgctcatcttatatcagatagtgtgt

SEQ ID NO: 52408 - DNA, 843 bp, Oryza sativa
cacacttggccgttaggtcatatcgacctcccggtcaccttcggtggatccgccaacttccgcacggagcgggtgaacttcgatgtggcggacctcagtctgccctacaacgcggtcctggggaggcccgcgttggtgaagttcatggcggcggtccactacgcctatctccagatgaagatgccgggccccggtggccccatcaccgtccatggcgagctcaaagtcgcgcttgcttgcatggagcagcgcgcggaccacctcgccgcggcatcaaagcccgagggtggcgacgagaggttcagcgcctccgtcccagccgccccgaggcagcgaatgatcacatgcgacgaggtcccgatcaagcaggtagccctgggcgacggcccgtccaagaccacacgaatcggtggtcttctggacggcaaataggaagacgcgctcgtctccttcctgcgggcaaacgctgacgtcttcgcatggagaccagcggacatgcccggggtccccagggaggtgattgagcactgtctcgccgtgcggccgggcgcaaggccagtccggcagaaagtgcggcggcaggccccggaacgtcaagccttcatccgcgaggaggtggcgcgacttctggaggccggattcatccgtgaggtcatccatccggagtggctggcgaatccggtcgtcgttcccaaggcgaacggcaagcttcggatgtgcatcgactacaccgaccttaacaaggcatgtgctaaggacccttaccccctgccacgcatagatcagattgtcaactccaccgcggggtgcgaacctttgtgttttttagatgcatactctggt

SEQ ID NO: 52409 - DNA, 1843 bp, Oryza sativa
caatggatctacgaaaagatcgtgtatttacaactacaatggaatagtatacaaagtcaacacaaatcattaaatagaatttatggctacacaaaccgttgaagatagttctagacctagaccaagacgaactcgcgttatgtggtgttagaattaaaaaaatatatgtgagacccatttatccgcagagtgactgagtgactggcgcctacctcgggaggccatgcgccatgctgatgttgtcgacatcaacaccgatgagcgcctccttcctcctcccagtcaccgctcaccgacaacatgtggaggaagagaaatggttaggtttgaccgatgttccgtgtctttctccggtatccgacaataacccctcgttgcacactttgcacaatgccgcgtcacccttctgtcttctaagagcaagtttaatagtatagcccactactgactctaattcatctatagccaatttatataatagttgcttactacactattaatatatggtcctacctatcatacacacaatacgtcttagagtccgtgttgcagctggctacagatctgtagcccgctgctcttctctctcatcttttatctcattaaatatgtttgtagccggctaatagtctgctattgccctttgctctaacaacgctttaccctttgctcaacttccttaccttttatttccatcacacgcgttttatcatctgacatcattgcaatatctctctttcgtgcaacacacagatattttgctagtggtaaattaatttcaaatgctcggttggacaatatgtcatatcagggataaaatttgatcctatagcaaaacattattagctattatccctatatcaaactgaaaattttattatgcacaacaagtaaaagaattcatgttttttagcattcaaaaaaaaaggagagaaaatgtaaaagggctagattgatcacaaataggactctaattattatcggcctccctctctagccttcatttcttcgtggatctcttttagcgtacaatgacccatgacaggtatcccaagaaggatgaccaaacagaaaacgatggcaaataccccctcgatactgttgcaccgtggaactaacgggacaacaaagaaagcaagcaacacgagagcaacagtgttcgcgaaccactgcaatatatatgaagaagagttaaaataagaactaatggttagttgaatatataacgaatgtaaacaatagtagctgataagacaacgagacaaaatatacagatatgaactttcaatggtatagctttaatgctctaaattattataagtataggtttgtccttgatcaaaccatttatagaaacagaaaaaaaaaatataacaatatctacaacaccaaattgatttcactaaacccataattaaatatatttttatagtatatttatttttttgaaaaatattgataattctttttataaacttggtcaaagtcaatgatgattttacttgaaacaaactgatggagtacgatttaaagccacataacttatagatggccatctggaccgtccggcacggcacgacccaagcccggccatgcctgggctgaggctagtcgggccggcatggcccgaccgacacaccgggccatgccgtgccagcccacgggcggcatacacggcccaatactactcgggccggcccgaaggcacaatggctcatcatgtttcctcatagaaaaagtctatttttggtccctcaactctgtgggttgtgtttaaatggctggaaagtaagtctattttatatacctcttgtcttgggccttgccttatacaattatttaa

SEQ ID NO: 52410 - DNA, 5894 bp, Oryza sativa
tatcctgtgtcatttggttggtggcatgatggtttcattccctgcctgacctgaaaaacctgataggttcattagcctagctcaggccaccaaaaacgagcgcctggctcagtctagttacacaaaacaaaacgcgctaatcaagcttgtcctgtcacggacccacgactgtgcatgcaaaaggtgttggaatattttattgttgaatcttggttggtgcaaacgaaccgaaaatacaacatttgcttatatgcgatagattaggatatgagataccgttttatttaaataatatctaccttaaccatgtaattatgaaccatctaatctcaatttagtttcctcaggcttaggctactaaccaaacaacatttgctcaggctagcctcatcaggcaagttttgacaggatagctaatgcctcttaggcatgtagttttcttaggcacatcactcaggtagccaaccaaacaggcccaaatccacaggccaaacaggccaaattgctaacgtgagactatgcctcccggtcacggtcaacaccagtgtagcagcactgcaaattaagaatgccaaattaattattgcaaggactatatactgttaataacgcaagaacaggtaaccgatcgagcagtttatcgtacctttacccaaaagaatagatgtccaaatgaaactagaacaccaataagaccgaacactccttcccatgtcaaccccaatgacggcagcgctagagctggaactgaagctgaatgggtcggatcagcatgtacagccagtagatatatgccataaatcaccagcgctgagaatgtcatgtagagaatatgacccacatgccgactcaagctcttgcaaatcctctcaccgaacatgccacagggaaggcatacattacccagaccccaaacagatgcaaatgcggcgagcatccagccgtcataaccagccggcagaaaaggtcgggcaagaaacagaactgccaaagaggtgctgaggatgtagacgtagccgatttgccttttgttccaaatctcgtcgtccgcctgtgtatacacattaatatttatatagagagagagagttgtggattgttataataacggagcgttgcttaaggcacaaaactggaatgtatttttttcacaagacaaaaattactaaatttcttgaaatgaaaataacacacaaaaaaaaaggtgtagcagtactagagggggggtgaatggtagagaacaccaaaaacacaaaaactgagcctgagaacactgtgtttaaatctgctggcatcatgtcttctttgaatgcatcttcttcgaagtcaaatgttgtgaatgcaaaaccttctgttgatgcaaaatcattgatttcaaaaccatctacttcacaaacttgtcgtgagaagtacccttgttctttttgcggaaaagatggacatttggttggtttttattttcgacttgcccgcaaacagaaaaaggaaagagaaattgcttttgcgaaacgacggtggcaaaaatcgggtttttgttcgaggagcacggttagaccgcagttgaacgggcggtcagaccggcctcgggacagtttttcgcatacttcaaatcggacttttgtgaaaccaaaaggtaagttttcagctaagtctgattctgattttgtcagtgcatatgtacctactggttctattggtcgtgtgactcagtgttggattccaaaatttcttatttctaaccccaacacagaggcctcgacatcttctcgttcgtaggtattttggcggcatactccccatgtgcattcaacgttgagatggcgattgctttttatggtaacatcaatttatttttggattgacatatttttggttctactctctcgattattagctttttatatgctagtgtttgaggtagtaatttttgttaatacaagtggatatatgtcgattcatgagaaccttggtgatatcattggcaattggatgtcttttttaaaatctttgatttcttcttgatttttctttggggagaattggaggttaatttgagggggagtttgtgctttttcatgcattcatgtttattttatgcatttgctctaattttgaaaataaataaaaataagaaaaataagagctttgttttatacctctagtatattcttgtgcatgctagcaaaataattgaggtctatttgttgctatgttagcttgtatgcattttagtctttatatgaagcttagatattgcttttaagtgagatgatgcatgacactaattcttttacttgaattaagaaaatatgcaatattaatgctagcatatggtttgatttttaaatgcttatatatagctttattgaattgttattcctcaaatagctttgtaattgctcattgtgaaaagagaataaaaaatacgaaaaaataaataccgaatccttggaagcagtcttgacgataaggacgtattcgatgtgagcaaaaataatgggtgccgaatccttggaaacagtcttgacgacaaggacgtacccggaataattgagagaaaaaaatatgagcaaaaaagtctcaaggaaagaaaaagttaaaaattctcttggttgttttgtactaaagctaatttgataaacagtaataaatgcaataggtatatatgtatagtgtttatttttcaacctatgtgcttgtgaatatattgcattataaatcatttgaagtcatgagtccttattgatgatttgagcttaattgtaatatctttgattcatgtttatactatgatgcatgcttgttaactagttgatgaatttatctcccttatcttgcaaaacatgatcattaattgcttttggtacatttcaaagctctcgaaaaaaatagaaaatggaaaataaaaatttgttattacaagtggcaagcatgacatcatttcatttgtgctttattgtcattatttctcttttgaattcttgatgaaatcattgtcaaagggggagaaatatacaaaatgcatgcttcttggaaaggggagaattgaactgaaactgtttcgatttacaaaatgcatgcttctcgaaaaggggagaattgaactgatgaactgtttcgatttttaaaaatagtcgattttgtgctttgattgcaaattgatgggagaaattctttcttttaaaaagggggagagtttttctttttctgctttgattgcaaattgatgggagaaattctttcttttaaaaagggggagagtttttctttttcacttttgtgatttttgtttttatttttcaaaaacacaaatttgcattttggagatgttgccaatgtattcatcaagggggagattgtgaaatcattgtcatgattaataattgtgatgaacaattggctatgcaaatgatttaatcaaagaattggtttgaaaagatgtgcgaatgttagtgtgagtgcgtgtgactaatgtgagtcaggttgtgatatctgtgcccagaaacggttgttttgtctgattgtgtgcaggtgacttgaggtcagccttagtcaatggtgaggaccgggactatgctcaagaggagcagaggtctattgcggtcgggataccatgtaagaaggtgactagagctagtattcttggaggtcaacttcggtcaacagtggggatcgggactaaactcagggaggagttgaggtccagacggtcgaggatatcgggtgacgaagttggatacgagatgtcacacggtggatggacaccgtgtgggagagatcttcgcaacaggcttcacgaggtgtgcgtgcaagtgctggtgttcgcgaaggagattggagtgagaaattgagaaaagggtatatggtgctacagtacacgtggtactgtagcatgcgtatggatggtatctatgcatgtatgttgatcatgcatgtgtggctcggtgcgttcttcatgcatgtgtgatggttcggtgggcttcggtggcagctggctggaggccgaaccggtccaggagcagcagcacgttggcccacgtgcgataggcccaagcaggagcaagcgcaggagatcgagtccgatgcggttgattgcggctgtgcgagttttgggaaattgtaaaaggtttggaaattgagggtttgagtcctactgtgaaaaggagttctacacctattttgagtagggggtttttcatgtataaatagagggggagcgtgaggcttcccggtatcgcttttttatcgcttttcagagcgtggagctgatagtttagttagggtttcgagtttagtcgagatttttgtaaggagtgttgttagtgcactttgtaaacacagagagaagcaataaagttgtcatctactttgagagttcttcgatttgtgtttcatcgggttcggcggttcgaccggcggcgtgcaagcggttcgactggcggcgtgcgagcggtccgaccggcggcggcgacaggactacgtcgagatttccatcgatttgagggtaacttttatttccgctaaaagtttttgggttttagttttctctaccattcacccccctctggtaggcttggtttcttgtgttcgatcctacactcttgagggaaaaaaattacatctccatttttattatggtcatctttattgtcaactgctaccttttgaggtcttttggcagttgaaagttgaaacaagaaaacatattactctaataaggtgcaagctagcaggagatctatgcaacaaatagtatctccaaaaccaagctattaaaatcttgcaatactagtaggaaataacatgatttttcagcaggacaactgcaacctaactatgcctttgttacaccatgccattggaaagtatgaaagacagaaagagcagattgttcagcgggactgtacctttgctgtggctgcggtgccattatccgtcaaaggaagggtataagcattgtgaggcgtcgagctctgcggagcagtttcattgggcctcagtgtgatcaatggcaatctgagaccattggagcctgaaactgcatatcctctgtcggaagaagagctgccggagatgtgagaggtaaccgaggcaagtaacaacaatgcattcagatttgggaatagcaactgatcgtcagctgcagcaatagcaaagaaatcatgcagttaggcacaagtaataacagaggcaagtttaaatagtgctgaacaagttggatataggcttgaactggtttcagaccatccattttaaggtgtcgtagaacagagacaagcagtattaacataccattcagctactactggttttccctatctacaatattcagatcatcatctccgaatttccacaacattcagataaaactatcatcaagaaacacaaaataccaaagtactgaacaatttacagtactgaaaactacaaaatccacattattgaacggacaaaagggacctgaaaaacataaacattgcccacaggaaactcagtcaatctagcaagcttggcaatgaaaaaatgccaggcaatctgcaattagtgaactatactagacttactgatgcagttttaacatttcaagaacttgtgcttcaggaaattcagtcactgtcatcacttgtcagaattcagtccctgtcatctacggaatcatcaataatctcaagttatgcagaccattcagaactacataaacaatgttcagagaattcagacacatgcatatcgagctagtctgcttactttcactgttgggcatgacaaggacgatgtgcagggtctcccggctgcgaggcaggtcgatgagcagaggagttagccgcccatggatgccggcgcgaacgcagagtgtaaactcgtcgtagcccagaatgcctgcgagcttctct

SEQ ID NO: 52411 - DNA, 6122 bp, Oryza sativa
acctgcacactacaacatagaaatttgctgcatctagcttctgagttctgatagctgtccatattcagtcttctagtgtgattatgtcctttcacaacatgtttgtgaaatgtcatggtttttatctatatttttggttttgtgctgaaaagtagtagaagttactacatgctagatgtgttttgactatctatttctttgtcaaacttgtaaaatctcactgctacttccaaatttttaactatctattgccctcatgtcccttttgtaatcaattagtcaattcttatatgaatctgatctaccttgccaacagttctttatattaacttgttactgtgttttgtgttaacgaagatatttcacgatgacgttgctaactatttctttttctataatcttctgaagctcgtcctggcatattcgcccagagggacagggcgaaatgggatgcatggaaagctgttgaaggtccatatacttctctctgtccttacataaatatgttttcctgtctgtccattctaatactgttgggctgtttcgccgtgctactgaactgaactttttgcaatcttcgcaggcaaatcgaaggaggaagcaatgagcgactacatcaccaaggtgaagcagctcctggaggaggctgctgctgcagcctcttaagaagttatgaactctatgctacatggcttctgtcagctgaacaactctatgctaatctggttgctgacaacttaccattctatcaattcgggatgtgaactatgtacctctttgtgtactgttgcataatttatccatctatttatgaagactattagtcctatgaatcatattatcttgtaatctttcatctctctggctgtgtactgcacaatagaaaaataatggttgtcaagccagttacatgccccaatttcaagtaaccataagcagtaataaccatcatatcctggatcatattccaatctcagaagacaacacaatctaaagagaaaaaagatctattgatcagaaggccaaaaacatatctatatgaaaaatgaaaatgcttaattgttcatagttagatagatcaacaacaccgcactgcacacatatatactgtttactcatcatgttcattcattctacacatgcatatgatctcatctggcaatggcaagaagccaagaactcctgaaaaaaaaaggatgaaatcttcagagatgtccatagcctaagacctgaccacctgagaagaggttgaggcagagcagggaagcagccagcagcgtccctggaatccaccacctgacaccctcgtcggcgaacatggcgcacagcaccaggcacagcagcagcagcatgtagaaccccagcccggaccagaatccgccgccgccgcaccactcgccgccggcggtgacgccgtacttggcggcgtccgccgggtagtagtatattccggcgaagtaggcgaccaccagcagcaggaccaagaacgccatgatgttctgcagcagcatcacggatagcacgatcgccaccggcacgaccaccacctcgctccggcggctgaggagcacggcggcgagcagcaggagcccgccggcggcgaccagggtgacggcattgtcggccaccgtccccggcaggttcgccgccttgtcgtaccactccgtcagggtctcgttgtagttgacccagaccagggccaccacgatgaggagtggcaccaccggagacggcccaccaccgccgccgcggcggcccagcccccacgccggcgaggtaccccggtagtagctcatgatcacctcttcttctttgagctctttctgcttcttatgctacttctgttcttgctgcttttaagcacactacttagtactactcagttgtaagtagcattagcagtgaaaaagtccaggtttgataatatttagtttctgaaatgtggattagtgttcatcttgttccaactaattttaactacctgcttgtgtcctgatgtcaattgtcttggaatttagttgaggtagggacctgcttaaagctggtagatgaactgattttagagaaagatggcatagaggatagtgatttgtaggtcttgtcattttcatgtatgtgtcattctttgtttttgtttggtttggctggggttattaactggaacaaaatcttctattgcctccatgtagacttgggaggtacttagcttagcaacagaaaatgatggctgatatcattaagtttaccatgggctgcttcaaccatacaaagtaaactgattaaactcagtagttgtggactcagtacaactgcttttattctaatggttatctaagaagattgtaaaaagcttatgcaatcaattggattcatttcagagtttcagattagaaatttcagttcattagcaaattccttgattagtttcagattaggagccatactgacaaaagaaggcattagtacatggcaagatgaaccaaacaaagccaacatatccggttttttttttctcaaattcactacactgttgagagaagacatgaaattggaagcattttctgaaaagtggacttcctttggcgacaaatgaataatgatccataaataagagagaatagaaaattaatctccattcatataagaagatttgatttttcatttagccattagcctccaactcatgtttttcctttcccccttgatatatatcactcagaatttcttgctagataagagagtgcaccagcaatctgctgagcttcttgttacacagtcaaaaacctgtgaagatattggcagcctattgaaggccatatacaagcaaagcccctactccggcaatgccgattatcaaactgacgatcactgtaataggtggtagcgcaccaccaatcgccctcccggtttctgcatcatatttcgcgaaccgcttctttggtgcgttgcattgtgggcagccatattcatcaggctgaaatggataaaaagcactagttgaattgttggatacacctgattttgcgggctgtgagtgccaaaagactgattctctgtgaaagaattgaagtgaatcttacctgttcttcgaaaggcttgggaaggaagtatatgtatccacaatcaaggcaaatgtgtgttgctctagcctgtgacaattcacaactttgcaggttgaggcttaaaagttggaaagagcagacgattgcaggcagcataagctctgagaagcagacagaactatcttgagcttaccttttgtgattccgtcaatttccggccaaatctcggaggcgccggccttttcggaagtcgcttcacatcaacttgtgcacccctgagatggcgcgaaatgacagcaggagatgaaatgtaaggaacttgaaggatccaaagtacttaccatgaaaagtacatatttctactagtattactgtctgaattttgaatataactgcataatgagtgcatgtacaggatttcaaagttacgaaaaaattgtaatgctggggaggataagtccttacctgctaaccacaaagtagacagagtctggctttgcctggatggctgtcttggtgaaccccagcttatctgcaggccatagttcatctccaaagaagctacttgtgtagagcacctggtcacctgatttcaggcctgctcttgccgcgttccctccagaatccacagcctaaagcaaatgccaaatgaactattactagtcactaattataacactttctgcatctccagctctaaggcaagctgtacatactgaaggcaaacagatatttttagcaggaaaagagtttggagttgcatttttaaccgtcgtagtagttcctagcttcaagtcccccccccccccccctttaggcataagccagtctggctgattgctttgtgtaacaaaaactcttttcctgctaatatattgacgtgcaatccttttgcacgttcaaaaaaaaaaacagatattcttgataagtcctaactcatgtagaagttgattcaacaggttgttatagttttctgagaaattaatccactaatggcaaagaactagttttatgaattaggacttgttgaagatattcctaataagtcctaactcatttttcctgaagaaattcttctaaaaatgtaagaatttcttcaggaaatatagtgatcttgagacagcaattcaatgctgccccttttttttctctgttaatggatcatgaagataaaacaagagcagggaatatacagtgaatagcaatctagtatgttcttgatgagacagcaatcaagtagtgaaaatttccattggttgatcatgcagagaaagaagaacaggtggcatcatgcatggaagtatggaagcaagctgtgttatatactgacggtgatgacgacgccgccgccggtcttttggccgagggtgaggccgagcggcttgtcgacctccacctcgatgtttttcgccgcgccggcggtcctcgcgttcacctgaagcaccctccgccgccgcccgctgccgccgccgacagaggccgcccaccgcctgtccaccagtgacagcccatggaaggccgtcttctgcactcagcacagcatcatcatcatcaacaatatcatcaaacattatcacacaagaaaccagaaaagcaagaagagaaaaaaaacatcaagaatcaatcaatgaaccaagaagagaaaaaaaaacatcaagaatcgatcaatggatagaatcaatcaatgaagcaagaagagattaaaaaaaaacatcaagaatcaatcaatggatatgcatatgtatcacacttacagttgatgatgagaggatggaagggggaggggagtgctgggctctgacaatggagcagtgcttggagggggcaggagcagaggagagtgtggcagccatggcggtggtgagaggatggcagcagtgcaggtggtgtggaggttgagggagaagatggctgccattttggatggagatggtgtggctaaggcaagagtgatgtgtgtggcctcacagtcacaaactcacaaccaaagggagaggcatacctgtggaaactgtgaacctgacaccgacatgtattccattctagaaaaaaaaattactccctccattctaaaatataaatatttttagtatagtgacaagtcaaacattttaaactttaactattaatagcaaaaaaaaaataaaagatcaaccatagaaaattaatgttactagatttatcattaaacaaactatcataatatgcaactctttttatttgaaacattttatttttataaagatattattggtcaaagtagcatatcggagaccgtatcagagtccaatagttgttatattttgtgacggagggagtagatcgagattcatagctaaaattattctctccatatttataatacttattgttattgtttagataagactgttgtcaaactttaaaaacttttattataaataacatctaaaatatttgtcttagaaatatgatgaccatatgtatacatatgatcttaaaaagcacttcaacaaatcatatatttatttatatttttcatatatagtaataaaaaatagtgatcaaagttattttttgaaaactatgtccggttcaaaccaataagtattatcagccttaggtagtaatggcatttttaaaacggagggtgtagccattcaccctgaaactgtggctacaaatggacagcttggaagaacgatggccatgtttgagatttcacaaacaattcaccttttttttttgtttgatgtagaagtctgggaaactttcatgttctaaatgcattctcagtttggttattgatcgaaaatccaaatggacataaaagtgacattctcagtcaaaaccagcaaatttgtggcctgtgaacacaagccaaatatatctcatgtgcaaaaggatgaacatgggtaccagtacaatgcacatttatccgggacgatcacaaaacaagccatagataccatatagaaagcacagacttaaaagaaacagaatgcagctgggaggtaacaaggtggcaaccatatccaacatacggactgcagtatttgtttcacattacagggcatccat

SEQ ID NO: 52412 - DNA, 1053 bp, Oryza sativa
aacatggtgtatatgttctattacagtaacaactctaagttacctactgatgcctcctccttgtcctccttgcaggggtggattcagaaactcttgacctcctaccctgtgctggccctcccgctataacacccacggtgctagaagtcgacgcttgctccacagatgatgactgttggggagcgacagcagcagccggtgcagcaccattagcatcaggaggtggcaaaggagcctgattgccactcccagcatcagcattgaccacctgctgctgtgttgctggtgcagaaggcgcatcttgtcttgcctgccttcgacccctaccccttggccggggtgcagatgaagccgcctggcctaccactatatcttggttttgcatcaaccgcctcaccatgtttgcaatgcctcctcttgtgtctggcctttgcagctgctgcctcaagctctcggtcctctgcgcactcggcctgggagggatttggatatcatttctggaggagttctcctcgccacctcctcttccataaatcggtgtgacgtttacttcgagcacctcgcccttgcagacagggcaatcagagtgctctgaatgtccatgaagccactggtatatgcaaggccagcagaagaggtggccacaaggggtaaccacaggatctttagctgattcaaagcagatattgcattcgaagctgccgttgcatccgcaaccgtcatccttcttggtggcatcactgccatcaccatcaagcatctgcctccttgatgcctcaagagaattatgagacctctggatggcccgcgccagattatcggcttccgggctattcgcccgtcggctgcggctcactggcccagtccccgccctcccattcccgacgccgtgttgatcgctcacctggatcaacctccgcagccgattctccggcgtcatagggcggcttgcagcagcaatctctgctccccttataagaccagtaggtgggattgctccaccggtctgcacaagcatttccaacgcagcacaagcaaaaatctgtggcagcg

SEQ ID NO: 52413 - DNA, 1950 bp, Oryza sativa
acggcaatgcattcggattcgggaatatcatctgatcattcgctgcagccatagcaaacaaatcacgcagttagaaagagtaatacacaagaattacagctcttgcaagtaaaaacagtgccagtaattcacatgttaaaatgctactcggatgctgaatttcacactgaaaaatctacaacattcagatgaatcctacagcattcagttaaacccaaggtgcacacaattgtctgatgatgcctgaaatgaatattcatcagataagtgcagatatatttcacttgtatagttctgtcgttctaaagtattcttcagacaagtcctaacagacaaaaaaagatgagctgaactagctaaaaaggcccagaaaaacagaagcactgcccacgtcatgccatgcattcctttcagagcaaaattaagaattacataagtaatgttcagaaaatccagcaacatgcatattggatgtcgaatttcacactaaactaccgatatgatcattgtgaaacaagttgaatagacaatgcaggcttgaacttgtttcaatccatccactttagttctgagtcacaacaatagtaataacccagatgcacaccatatttacataccaatcaagcattcagctacagtattcagaccattgtgtgaaaaagtctacaaagctcagataaaccctacaacattcagataagcccaaagtgcatagaattgtctggtggtggccgagattaaaattcggcagatgaatttcacttctgctgttctacagtatattcttcagacaaatcctaactctacaagcaaacacatcatgactacattttcagcaaattccacaacaggcacaaactactgaaaacaggaaaatctacagtgctggactgacgtaacaaaatcagagaaacagagacaaagcaaaattcagaatcacataaacattgttcagaaaattcagcaacattcatactcgaactgggatttttaccttcgctgttggtcctgaggaggacgatgttcagggtctcccggctgcgaggcaggtcgatgagcagaggggtgaactgcccatggcggccggcgctgacgcacatcgtgaagtcgtcgtagcccacaagctccgcgatcttctctctcaggagcctcaccgacctccctctgatctcaaccgtagtccagatttctccctcgctggtgttgtcgaggtcggcttcgtccacgaactggatctcccgcagcggctgggggaagcacgccctgacgaagaacccgggctgcacaaaatcaacaacggtagcagaaggaaattcgatcaatccacaaattgtactgcacggttaattcttgcaagaaatcaagattaatttccgacgaaatcagcatcaagacacaaaacaaaaaaacaggaatcgcaagaagagagcggagaaggatcggagaagctcacctgagtggcgatcgggagccccggcatgtctccactcggggggacgcgcaccacctcccacagcaacgtatcttcgccctcgaagttggcatccatgagcagaggggtgaactgcccatggcggccggcgctgacgcacatcgtgaagtcttcgtagcccacaagcttcgcgatcttctctttcaggagcctcaccgacctccctctggtctcaaccgtagtccagatttctccctcgccgatgttgtcgaggccgccttcgcccacgaactcgatcactcgcagcagcggtgggaagcacgccgcgacgaagccggactgcacaaaatcaacaatggcagcagaaggaattcgatcaattcacagattgtaccacacggttagttcttgcaacaagccaacaaccaaatcaactcccacccaaatcaactccaagagacgcaacaaacacacaagaagagaaagaagaggaggagctcacctgagcggcgatcggg

SEQ ID NO: 52414 - DNA, 1132 bp, Oryza sativa
ccgaccagtctgcaacggcggtttcttcctccatggcgacggatctgccggaggcggccgggagccctactggaaacggatgaattggtttttttcttcctctgctttgcgattgcgattgcgatttgctcggatggttcggtcgcgctagcgcatgcacatcgacctatttaaaaggataaaacggccgagtccgagatcgaactgttcaggccatcaccgagtcagagactgaggccctgtttagatgagactgaacttttaagtccctatcacatcggatgtttggacgctaattataaatattaaacgtagactattaataaaacccaaccataatcttggactaattcgcgagacgaatcttttgagcataattaatccatgattagcctatgtgatgctatagtaaacattctctaattatagattaattaggcttaaaaaatttgtctcgcgaattagctttcatttatgtaattagttttgtaagtagtctatatttaatactctaaattagtgtctaaatatagggactaaagttaagtcctggatccaaacaccacctgaataatactggatcccggcctattccctggccggccagcccgggcagtaaaattccacgggccaattttccggaccatttggaagcccatcagctgggaaattcccggcccgatccacgtggaaaatctcgtcgcgtcgctcgcgtgccgcagcgacgattcccctctcgcgaacgaaggtcgccgccgccgccagtccttcccctccagcgagatgcagcgccaagcctccctcctccaagatctgggttgagctgctcttcacatcctctcctttttctaggttttctataggtgatgcacgggtttgtggttgagtcccatctctgctcccgatgctccaatcctcctctcctcctggattctgccgaggcggcagtggcatttgaaggcgtcgcgagaagacgcaggtcactctctgacacgtgtgtcccacagtcaactgtcgtcaaccgtactcaatgacgggtgggcccgagaacagggagtgcggcagatttcatggtacaggattttgtcaaatgaagcggcgcaggttaatcaggattgggtttgagtggact

SEQ ID NO: 52415 - DNA, 848 bp, Oryza sativa
ctctctcccatctcttgttgcgattcttggtgtttgtcgcgtgtcctctatgcgattctgcaacttgtttgcgtcatcattcgttctgctacaatctgtgatgctgatttggtgggggattaatcttgatttcttgcaagaacaaaccgtgaactgatcaaattccttgtgctaccgttgctgatttttgtgcaggccgacttggtcgggcgcctcgtcaaggcgtgcttcctcccgctgcagcgggagatccagttcgtggaggccgacgacgacggcaacatcggcgagggacaagaagtctgggattcgtttcagtaccaggggaggtcggtgcagctcctgagaaacgagctcgaggaccgtgtgggctacgccatcacggtgtgcgtccgcgccggccgccatgggcagcacagccctctgctcatcaacctgcctcacagccgggagaccctgcacatcgtcgttctcaggcgcaacagcgaaggttcgatctcgatatgcatgcatgcttctgaatttttctgaacatagtttatgctgttctgaaattgttggcaatgctgtgggcgatgtttctgaatggcatgcatatctttttcttgtcctttttgttagttcaacactgtagatctttccagttttcagtaagttttgtggaatttgtggaaaattcagtcatgtttttacttgttgagttaggacttgtctgaacaacattgtagtagaacggcagaagtgaacattgcagtaggaattgtttttacttgctgacaaatgtgaggaattttctgttgatggaatgctagtcaggcatcacaagaaaattgtttgcaattgatagg

SEQ ID NO: 52416 - DNA, 1382 bp, Oryza sativa
gggggcggtggagctcgtactggcaagctatcaggccagggaccccgacttctccccgtgggcagcgctggacgagttccctccaggaccgagtaccacgcgcgcgcgcaggtccgggactccgccgaccacatcgtccatagcttccagggtacggcccctcggctcgcgttcgccctcgactccgacgagtaggatggtgcggacgacgaggctagcgacccgggcgcgtcggagtgagcccccgggcccccgccaatcttgatagccctttttttttcgaggccttcgggcctccttcttgtatagactaacttaatctgcaatcaaataaagagaaaatttctgtgtcaattctatttgttgtgtgtatgaggcaaggatggtctgtgccgcggtccttctgagtcttggcttgaacaagggctcgtgcccaggtcccagcctcaaacggcgcgggtcggggctagtgcctggggagatccacatgtcgagactggccaggccgggagcgtggtgaccgagggttatggatgacccgattgtgggcctttgccgattcccccccggagttcaccacaccccggggcacggctcggttctgggccccttttggcgattttagccggcccgggccaccgagggcaggatcgagcacgagcgtgctaattcaagtcaagattcttcaaaaggaaacaatggcacagatacagtccttaggaaatcgaaaatgcttttattgaaatacggaagagaaaaaagataagtatatgcatgtggtagcccccggccaaccctgcacgcccgggggggtgcggggttggcccgagcccgagacctgatacccaacccccactaggggtagaaacgacgaaggtgttcgatgttccacgggttaggcagctccgtgccgtcgcccgtggccagccgaacggagcccggccgggggacaccgatcactcgatacggaccctcccacattggtgagagcttgctcagtccagcacgcgtttgaacgcggcgtaggacgaggtcgtcgacgcagagtgatcgggcccgaacgtggcgctgatggtagcgccgcaagctctgctgatagcgcgcggctcggaaggccgcgcgccgtcttcgctcttccaagtagtcgaggtcgtctctgcaaagctgatcttgatcagcctcgcaatacatggtggcccgaggggacctcagggtgagctcagatgggaggaccgcctccacgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggctct

SEQ ID NO: 52417 - DNA, 1258 bp, Oryza sativa
aactaactataaccatagtaaaagaaattaccactactcactgattcgagcatggataacagtaaagctaaaactaactggtgtggaaaaaaggagaaaaaaaaatgagaggtgttagctctcatataacaattagttctacacgtgttccaatatatttacattaaatccatagtgaaaaaaaaagagagttgagaaaaaaatagagttaattttagagttaatttattactccatccatctaactttaatagtcatatttcatcttgacacatagaccaaggataaacaattctacttatcatccattactagtcattcctcgtaaacaagcgattcattaatatttacatttctcgatgcccatgtagccaatcttgtgtgaaagaatggagagtcacgcattaaatccgaaaaagtcattaagatgataggttgttggcttgaaatatgcctatcaaaaataaatttttcagatttggaaatatgactaccaaaagtagattagatggagggagtatatatgtaaactctaatataaattaatagtcaatagctttactattaaacttgttgttaggaattgagctgattgaataagcaagcaaaggttatgtgccgtgctgttgctgctgctggtgctggtattagaaggggaattaagtgagtagcagtggagctgtgtgcgcgagtaagctaagcgcgcgtgattagactggtaattgcgtgattagactgctagtgacgccgtggtgggggggtacgtacgtccgcgtgatgggcttatgatgcgttaatgatagaagaaggggggattagataggaggagtataatgccggcgccagctggagtccaaagcggcaacttgcgacttcgctttcctgacagccaggcatggacagcaaccctctccaccgctcatctcaaattcccgttttgcccccactattttcttctgttttttttttctcatctcattgctatggattaagggggaaaatatacagcgtaaagcacatatgtaacggaaacttgaaaactaccgttggtttaaaaaatatacgtctgatattcgtccacgtcacaacgagtaaaaattttactcatgaatgaatctgcgagtaaaacttttacctgtggtaacatggatgaatcttaaacgttcatttttcgatccaacagtaatttccagattttcactacatatgtggtttccaccatatattttcctggattaagggtgggttctaaattgcg

SEQ ID NO: 52418 - DNA, 1124 bp, Oryza sativa
  unsure (1)..(1124): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnctacagaaaagagttgacaaaggaaaagggttgtaaaacccaggatctgtaatgtcatagtttaaggggtcactttcagcaatcaataccaaaggtagcaaaacattcgagtacaccagaataatgattggcaaatcatgaggtttggacttactcatgtcatttcccctctccttggaactgtttacacattctgaaacctcagcgttttttttcctgattgggtaaatgtttcctctgaagtctcagcatgaatctggagtactgtttgaacagtcaaatggtcctgagttcgcatgaatccaacattcatttcaagtgattctgcttcagtttctgagcatgaatcctctgctttcttcaaaaacatagttcagtctgaagtgaatggtcaagtaaccaaatactgataaaaagcaggaagccaatccataaaaaaaaatcaagaaagacatgtacaatacctgaaaagacagggaagaccgacatggaagaaatcgatatgtgtttctggcaaaaactagagaactgataaataaacctggttaagttctactcctaagctactaggaactgcaactgcaattcgagatgcaacacagaattaccggattgaagccaatgccaaagatttcataccacccagaattaacgaagaacctatcatgtatccatgtctcacatccagaaatcaagagtttgaaattctttctgttaactgtttccgaactaggcataaaagaaagaagagtttgcagaggcttcacgaaagcgagaagcaaaaccccaacagtcaggtaaaaaactacacaagattcatcatcaacagcataagcatggatgcactgaaacaattctgactgacagtctgaatctctctctgtctataactacgataagccaatggttgatcttgcttctcggaaaatccatctcctccttcttggagcaactcagaatccccccttctgcagcagttcaggaatcagaatcgaattcaccaactcgaaatctcccagaaccagtggcgaaagagatga

SEQ ID NO: 52419 - DNA, 860 bp, Oryza sativa
gctttcagcttccggggccaaattctttagagaatcaagagaagcccaaccaaatgggcacaaagggtgttagttcccaggggattggtggcatgtggggcaacaaaattgttggtacccaaatatggaagtgaccactgaggctcctttgaaatgcagggatggtaaaacatgaatagaaaaaaatagactgcaacaaatgaaaagtacatgaatgattatttggctagagcttgaaaaggaatgggataagagagatggatgcaaaggaaattttgtaagagatttaacttgtgctaactctcctctaaaatctctatgggcctcatcgtttggcatattcatatgcttatcagccaaaatttgaattttcaacgttaaatttagagctgattttagggttttttcatcgaagtttatttttcagcctttgcttttagatcgctaagaacacatatataaaagttttattcacaaattgattttcgtttgtaaatatgccatttggcatattcagaaaatatgccaaccgatgcggctgtatgcatctttgttatcaattctaaagaaatttcatgggtgtcaactgtcaatcctttgttccagagtaaaaaaaaacaacaacaaatcatttagaattcaatcgctgcataaacatgaacagctgggatagattccttgtgcgcaaaccttcccacttggttaaaactaaagtcgcgtacggcaacgagccgatccgcatcggcccagccggtcttggaccccccaccgccgtggcacgggcaatcagcacgcgatcaccgattggatgcattggcatcagccgccactggatcgcgttagcgcgcggtgggcaccca

SEQ ID NO: 52420 - DNA, 4881 bp, Oryza sativa
accgcacgcaacgcacacggcaaaaatgaccaaacttgtaacatataatttcaccatattgctacgaaatcatcattattacgtgacaaacgcctcaacatatccatcccgatctcgggcaccagcttttggagcaaatcccgttcgatctgggcaccaatctcaaacgccttgggcaggacattcacgccgatctccacccccgagtgctggacgtcgctcgcgatcagcttattcaccttctttccgggcatgccggtggacctcgcgatcctcctgtccacctgagcagccagccttttcttggggcagatcaggggaaccctcgagaacgacctgtatcctgagtcgcagaactgggtgaacagcgagtccaagcactccatgacggaatcgaacgcgaggcttcccagcgggctcctgctcttctccccttctgtggccttgacgacgccggcgttgaagctgaacccgttcttcttcttcttcttcttcttcgtggagcttgtggtggtcacggtggtcagagcagactcgaatgtcttgacaaggaacgccttgaatggtgcctttgatgtccgtggaggagtagtagaagtagaccggcgaacgtttgttagtagcagctcaacagttgctgcaacctctccagggtgtatcaggttgctgctgtcttggccaaaattagtttcagagcacctggagtttcttttgttagttccatcttgttgcattgtgcaattctccgagcggcgtcggtctctgaatccagcttctgatgctggcagtggttggaaaagcatgaaagggtcagcatgcaactaaaaaaactgtgacttaactatacgatttttttgtgtttatagtgttttgtcacaagagatcgtagtaacaaactacttgtaaacaacctaaccaacaattagtcaatgcacttaaacaaaggtcccttacctgcagttttgagcaggctcccagaaaagcactcatcatctgcataataagatggatcgctagcatttgtagtaacctgcagatgatgacagccaaagatattcatcagagaagaatgacccttgcagttttgatgagaattaactcggtattgcaccatgatagagaacaggaaaaaccaaaattactgacctcatgctttttatgagtttcacgcaatttaccacttctaggaacctctctgaagccaaaagtcagactgtccagaaagttacactgccatagaaattcatcacttggagattcttccattacattgatagcactcgtctttcgaaacaatgaagacattactctgtcgtccagaatttctctgtttctcaactcatttcgattaaagcacactgattctgcactttccagacttgatatgccttgtaaagcttcactcaagaccaattccctttctgaagaaatattttggcagtccctacgatagtctctcttaggacaagaaccagttggagatcccagaacaacactatctgatcctttagtatgaccattcagcaaagcgaggacagcctttctcggtgaattagaagagatggaaatgatgcctgagttgttacccctagaagcaatgcgtgactctacctttctccgcgagtcattccttacagagtttggactggtagactttggcttctcactaactaaccctgcaccttttgcaattatcatgtctttctctgtagctttcagtgttgcagtctttgatatctgtttattagaacaatcaccatgcaggccactggttcggtgacattttgtgctcaagttcctgttctccgcactaccatgtggcatgccgattttatcctttacttttcctttggacctcaaagatgcactgttgttcatacctctgtttgaacagacaaagtcattggctgtgtttgccacattttgctccttagctctatgtttctgcctttggaccatatgccctgtatctgctgctctataagtttcaggcaatgcattctgcttcagattgttctgtttaagaggtctacaatcaacattctctcgggatatgtttttcggctgtattttttggacaccttgacttgaaacaaggacatcatctgatgttctctgaccactgtccttaaatccgttcctctgacccttatggtttccttcagattgtgcttgacatgatatgttctggtttggcctcctaacagaaacattcctcatagtatcctcttcgggaccactgattggaagtagaattgtgcagagaggtggctcctacattttgagcacctgaccttgatgcatcaacatcacacatttctcttgcgaattgatcggagaaatcgtgcatggcttcagcagcactctgcacatcactgctgttgcatctatactcgaggcgcgcttgcctccgagcctgatggtggtgcctggattgtaaaccgggttccaggaccttgactgctgcttcaatcagcctaaccttgttcctgcttgaaactgatcttggactcttaataggtgaggctaacttgtgtgctgcatgcttccgtgaccacaccggctgcgcatctgcatcgagctgattgccattgtcatgccggccatctctgatatgccctggcttttgttgcttctgatgcgagttgtatatgcttccataggagcattcactccggtgaccaccaagctcggaggcatccatggtttttactgccttttgatggctggtggctggcattgcgctgagccccattagcctggctaccacacccggtgtgcacatttcactgcttttgttgtcttggccaggaggtggcaagcgagtggtaacttcatttggatagtatggagcatcaagctgaaggaaaatagtacaaggtgagccagcaacttagcattctaaaaataaataacaaaggtgaaaaggaggtaaaaagggatcaagaaatgttaatgtaaagctaaagctaaagtgttaaaatctccatttctgaaaaggcaccggaaaaactttcctaggtcaagaaagctaagaaatctgaatgtaaagctaattgtttaactgatttttttaacaagagaaaaaaaagaggcttcatagcacaaaatattggcttaaaggggaagaaaaaagagagcttttttgggcatattctttggaaaattcaactagatctcataaagaatcaacaaacaattgtagctttacaacgagatgctaaaagaaaaggagaaaagtaccataccagcagagtcctcatcttggccgccggcgtcttctcgccgccggcaggtggtctcccaggcgagaacttctgtgtgcgcactgaaacagaaatggcagtacaatccattcagaaaaaaaccagaaatggttcaaaagccaattgaacacatctgatttgcacaatccaggaagaagaataataagaagaagaagcctgaacagtgtactactaccatccttgcaatctcacctgggggaagcagcttggtcttcttggaggacgaggagaagagcttcttcttggcgagcatctggaacagcgacgccacgcacgacgtcgccggcttctgccgctcgacgatcgccaggctgttgccgcgccgccgctcggccgggtggcggagcttgcgccttttatgccttcaccgtttcacacgcacacgcccacaagaacaagaaattcaaactcaaaaatctttcaaagcctcttcttgcttcccctctctctatctctctctctctctctggccgtttcttatgagcgaataaatgcaacaaatcctggaaaaccagtcgcttcaactctttctccggataggcattaattgccacatcaaattcttcatgactttgcgacaatgcctttgcagcaacaacagctcgagaaagaactatggcttatggccaaatgctagagaacaaaaaggagaagactactgtggcagcagcactccaactcttgctcaagacatgactaatgcatgccattattcctcttcctacacatagaaccggaatggatcaacactcatcctgaatgttcttgtatctactcctgtttgtgaactcttctaaaaaatgaaatgctataataaaccttgagaagaaaatatttggggatgaatctagagcaagtgggcgatgactggatgagccaaatggtggagttggagactggggaggagggggtccgggagaaaaagagaggggcttttgggtggcaatcggagaggaagagacatctcaagctgcttttgtttcttttttttttatgtgtatgtcatgggtagctggctggctggctgtgccaggttttctcggctttctttgctgatctctccttttttgtttgcttccttggccgtctagctgtacttttagggttcttcttggagtttgcactttggagtttggactggtctaatcggaagtgattagtattagtactcctgtaaaaaaaagataatgtaaattttagagacgaacctagataatttatctttagaagttactccctccattaaaaaaaaaagtaaatctagtactggatgtgacatattttgtataatggatttggacatatgtatgtccagatttgttgtattaggatgtgtcacatctagtacattggttttttataggattgagggagtagctttttctaatacagagggagtatcctcgataccgtttcatatgaatcttccaagtatttttttagaaatatgaaaaaaaaatccatatctcacaacggcccctaaaagtctaagatgaacgagtaaagaaactatacattttttgtggaaaaattctgcttggagtagttgcccactttcatttcctagctgtcattgttggtatgtttgattgta

SEQ ID NO: 52421 - DNA, 1702 bp, Oryza sativa
catccatgtaaaacctatacacatcatgcgttgatacaagccagttaggtagttcagtattgatgtttataatctcatcgttgtcccttgaaccagactgaaacggattacggattctatgtatgcatggtgcggtcgacataggaaggtccggcccgtcttagctcacgtcgtctaccgcagcagtaaagaccgtgcgagatacggaagaaggaaataaatcaggctatgcggattttcttcgcgcagagacgacgtccgattgacgacgtactaaaatttgagacaaaaacaccttaaatttttataatagtagagattagaagtagattatagggtccatatagaaatacaatcaggaaataataaaaattcagaattaaaaataaggaatattagaagtagagtatagagtccatataggaatttaaaactaactaaaattcggaataaacataataaaattaaaagtagagtttagagtccgtataaaaatataatttacaaataactaaaattcgaaattaagaaaaacatgggaataagagtttaaagtcaatatatgaatacaatttagaagtaactgaaattaaaaattaaaaattaaagaatattgaaagatgagtttagagtccacatagaactacaattagaaataataaaaaataatattggaagaagagcatagagtctatatagaaatacaatttacagaaaattcagaattaaaaaaagaaatattaaaagacgagtctagagtctatataggaatatatataatttacaaataactaaaatttgatattaaaaataattaataactaacacctatataaaatgcaatatgaatattacacattagtaatttcgtaaagttattgcaaaatttaaaattatgttgtcatacataatatatttgaataatataatgagaaaacatatatgttattatataagagaaaatacaatgatgttagcggcgcaatctgcgcgggccatcatgctagtttcattgaatagaggagacgaaaactgttaaaaaggataaagtacagaaaacaaaaaaaacctagggccgtggccctaactataggcggcgagatttttttgcacccgctaacccccatgtttttgcttcctcctttatctttatcttggctagcaaagttagcaccagcaactccttgtgttggaaagtcctccggttcctttcgttccatatctcccagttgacaagcaaggctaacatgcgtagtgccttcttaggtgcttctcgtatgcttacggtggcctcccaccactcatgtaccgtcaaaaatatttgccagttagaaggtcttagatgttcatagtctgtccactgcgcgatttcattccagattctccttgtgtatctgcattccgcaagcaagtggagagctgtctcttgagtctggcgacataaagggcatgtggatccgttgggccagcctctggttgctagtctgtctgatgtccacactctgttttggagtatcagccaggcaaaggtcttgcacttgcatggtgcccaaggcctccatatcaatgtgtcaaaatttgacgatgttgtacccaacagctgcgccttataggctgaggtggctgtgtattcgccgtggttgttgagcttccaggtgatctggtcttcatgttccgtgaagtgtacattccgaacggcgct

SEQ ID NO: 52422 - DNA, 2052 bp, Oryza sativa
ggggccaatttgccccaagaatcaaaaaccaaagtaaagccatccaaaaaagttgaccggcatatatcgccggtccgatctgcgatgaccggttgttaagccgacctcgagccgtcagacccacattagggcgctctctccagtttgaatcgcatggacgctcctattattccggggtgggcttgaatgcagcctcaaaagcctgcgttggtcgtgcaggccgagcaaactgccacttacaagcgggcccatctcccccttcccggccaggcctgcacgtatctcttcctcctgccattcacgtaccggcttaaccctgacacgtgggcccgacaacatcgtgccacaaagtacacatcctgattcccttttaatggggcataatgttgcgtttaaactcgatcgatcgatcgatcgaccatgtatataactatatgtgtacggactcgagtatacattcatgcatgtacatgtgcgtttttgtacgatgtgacagtgagcgaaaggccggtctgatcgttcggcctatagcagcaactaaaattaatttatatgtaaacattttatatctacgtacttaattgcttaattgcctatagtaccagtctgtattatattataagatgttttgattttctcctaagtaaaaaagacaataccaccaacattttgaacccaaaataaacatattatcaaaatatatttaatattagatttagtgaaactaatttgtattatagatgttattaatttttttataaacttaatcataactaaaatggtttgattagaaaagatgtcaaagcgtattataagtatgaaactgagggaataacgttgaaaatcaacaaataatgataacagatttaaagtaagtttaaaattaagttttaaaatttaatactattttttttgtggctgataagttaaaaggcaaaacatggaggcgtctcttgacctaggatgtcaacaaagacaaataatagcatcgctagatagcagtgctggaagtaggcaccaatagctcgatgattgcatcagaaagagcgatgctaaaggctttccctaatccctttcttttcgagcggcctatgctaactaataatgtacataacgcaaagctaatttcgctccacttgaaatgctacagtctgcaatgatagcgttgctcgcctttgatatttgatgatactactactactgctgctactgtgtgttgggccgtgtcgaccccagtggaggagagtgaggggtccaaagaatccaaaaaatgcccggcccatcagcctaattctctcggtttatttttcttttctgaaaaaaaagagcctaaatacgtcacgtaatcccctctctctctctctccccggatatttttatccattgggtagcccccaagaaaaagcatggacccggaccagaacccgcaaaacccagccacgtaagcagccacagcagcacgggcacagccagagctgaagaagaactgatcgataacgagagcgacacagatcgatgagaagaagtacaggtactaggatgaattagcagatggattacaacaagcacaccgctgtacaaaaaaaaaacaaaaagaagagaaaagaaaacaacatatgctgaagcgaagaagaagaaggaagaagaaaaaaaaaactgaagttgagacatgacaaaagcacgagcacctaccggctcgacgcgacagagtagtcctagcagttataaatccgggcgcggctcgatcttgagccgcgatgtggtggtgaggtgaggtaggtggggtcttcaaagtttggaggatcttggcggcggcggcggccgccgccgtcgtgccggagcaagcggaggctactcgtccggcactcggtacgcgtcggcggtgacctccgtcagccacaacccagggaacagcgactgcacatgaaacagtagcaaccactgtgagtttgagtttggattgcaggagtgccattcttgcacacaacaatttaggtttaataaaatattaagtctaagcatacgcttaaagctgtattgtatcgagggaat

SEQ ID NO: 52423 - DNA, 1763 bp, Oryza sativa
gagtactcagcaagccatgggaaataagtgtttaatgcaggcttcaaagaaaggctgttgttttgcgattgattttatttaaactcttttctgaaacaactaagggagtgcttctcaaacgacacggatgagacagtgcgtctcgtccggtcggagtatgtgccatgtttcagtcttttgaattgatcaagattggcacccggccaacagctttcaaacggccacccgggcctggctgatcccatcagccgcagattttccaaacatcaaacccattccacaacagcaaatttcacaaggcagtagtcaaacaaaactacgctaggaatcacctcacatccgcccatgaccgtgggcacggctgttcgaacagttttaataacctctgcagagggggtacactttacccacacgacattactaacccggatcatccagtccatgcagaacggccacgactagagacctaaggctttcatgacaaggcatttcgaaagccgacataggttcaccatatgccaacgagagaagtcccagaccaacaccagattaggtcccagaccatactgtgccagaaagcccaggggtcctccccgacatgtcacgcccagaaattcccgaatagaattccaacaagaatgtgcattaaaatccccgtccaggacgggccggggtacacaacgacaaatgttgacattcagatccacgtcttataaacatcataaaagtcttacataaatgcagcggaaaaaaagaaagacaccaggagttaagccttacttagaactgcagcgggaacccccttccccaggcatcttggacggccgggacgaagcttactcttcggagaaccctccatttgacacatactcgtactctggggttgggaaaagtagagcaagaccgagtactacccactgtactcagcaaatcataccggaataggggtatgatgcagggaattatcaaagaagagctagagtggttcatttgcataaagcgagcatttaaaagcagaagttgaaagatttaaacagtggtaataattaattaatattaactatccactgtccaacgctatcccacgttgcaacaggcccaaccatccaactaaaccatccaaattcaaaagattacactagggtgagactaatcacggtgaatctggttgaccgcccataaccgcgggcacggctattcgaatagttttactctgatcagaggtgtacaactgtacccacaagacacagccccacgaaacgtttccgtgcgccgacatgccaccacgacataccggaaagaggccgtgacaggaccattcgcataaccccctctaaccaagcacaccacacctcaggtttcacccccactcctcgcaaggcagcggcaagtcccctctcgtgcctaggtgaatccgaaagccgcataggccgtcgcagggcccatccaaactccatcatgcccacccttgcctggatgcgtcggctagaggaaagctacgctacaagcccagccgttgcccacgctggcttgtggtaagtacgataagttcttccagggcatcccgcgaaccggtctttaactgccattggtgcgaccagcaaaaccatgcacccacagcccaccatgtgatttattttaattaaccaacaccaaagcggtggcactaatccaacattaccattagaaccaacagtctaaacattaataggattctccccattgtgcactagttgaactaagcatggctgggtcccgagctc

SEQ ID NO: 52424 - DNA, 1515 bp, Oryza sativa
gatcaactttgtcaaaactgtaccactctagtgagaaggtgcggtcaaattatagtttgaagttaaattgaattacttatagcagagactaatattgctacagctctacaaggatatgcagaggtataccgaaatgctggtttccaaatagttacacaggcacatgagggaccaatcagcaccatggttgatgaaactaacatgtaaacaaataaaatgcagcattttatatctacttagtatatagtaatataaatacatgtatacaattcagtggagaagggatgagcataaacatcaacagcatcattgatgagtacgtattactgagaacagatcataaaactgattagatcattagatcaacacagaacagaggattcggtacctagaaatataaatcagcgggactaattatgtatatgacctgctgataacatacgtacatgtgatgcttgaccacatgaacatgatgctgtgagttaaattggataacctgctcgcaatgagcttaataagcatcaaaactaccctatcctactacagagggatcctgataaattgaagggcgtaacaataatagcaccaggaatccaaaatgcaacacgcgagaaccacgatggaacgaatcacacaatacatcctaatcagacagaacgacagaacatgcatcacgcggtacatcctattcagattcaggcagcaacgaatgcacgatacatgtgacaagcaaggctaacgagagaggcaaagtgcaaaaggtatacctggctcttgaaggcctggacttctggcttgaggtcctgcatgacgagcttggactcgaggtcccagatcttgacggagtcctctgtcgcggcgcagagccagtagcggttgggcgagaagcagagggagtggatgatggcgccggcgtcgagcttgtacagcatcttcccctcggtgagatcccagagcagggtggttccgtccttcccaccggaggcacacaaggagccgtctgggctcacggcgacggcgttgacgtagccgttgtggccctcgagcttggtgcgcagcttgcagttcgtgaggttccagaccttgacgctgcgatcccacgagccggagacgatggtgggggccatggggttgggggagaatctgacgcaggagacccacccggtgtggccctcgccggcgccatggtcgccgccgatggtgtacttgcactcgccgagggtgttccagagcttgatggtgttgtcgcgcgccgcggagacgatctggcggttgtcgacggagaaggcgacggagaggacgtccttggtgtggccgacgaagcggcgggtggtgcggccggtggctaggtcccagaggcggagctcgccgtcccaggatcccgagagcgcgaactggccgtcggagctgaggacgacgtcctggacgaagtgggagtggccggtgaggcggcggtacgagacgccgtactccggcggggccgcctcgggatccgtggccacggcggtggacggg

SEQ ID NO: 52425 - DNA, 2670 bp, Oryza sativa
  unsure (1)..(2670): unsure at all n locations
caggcttgcagtatcttaattttctttccgaaatatcgaagactttggtggaccaatgagttcttctgcttgggctcattgggccggattggtgaagagccctatgtttcgccgtgaaacttttttttttttttgcggggttctcactctgaccgtctgacgtcactctggagcttcaattacaatccggtgcaacacgtgtggaataatacacctagataaacactgtgaaatcatactagcagtagaagctgcaagagaatcctcgcttttgggattagatatacgtaaataataataaattcctaaaagccatagagaggcctaatccaccattgaacatctgcacctgtcaacttctccactatccaaaccagcaaatcacattgcaaaagtgatgtcaaaattcagaaagaaaggcaaccgaaagatgtatcagaatcaacgagttttttttattcttttaactctgcagttgtaagataggtttgcgttggtagagggtaatcctgagccttaggcaaatggcaatatagtatgacttgatgatgcaaaccttcccctgcaattgtggtcaagtgccttcattccttgagttttgctcgaaaagaatagctttcttgagtcaataagcatcattccgtttttgctgtcaaatttctctaatgcttttggttccctttctgcatgaacaactaaagcatatcagaagctaaagcataatcaggaaaaaaagaagtctcagaagcaagcaaagaggcaataataatacaggcaactactccatctcttgcttctctctatacaatctcccaatgtttcagtcttcagatatccaaatcccccattgcaagcctcctcttgtagctgctatttcctcctggcctttcttggcctctgcatttgctcacctcctcgaattgtcgaggaagctcatgccttgatttttctctggtttgaactgcaattgcaggtaatgatcgtttgctatgctcaattgctcacttcttcgtgaaatggaaaagaatcatcttgagccgtcagataaacatgttcagatacacaatttgctttttttttcttgcaaattacattcatatttggatttgtaaacgatgtgttctgatttgatctttattgtgcttggattttcttaactttctcaaggatggcggaccactttgcagtaatggccggccgggtgctaacggaatcgactgttcagtctgccattgatgaggcctctgttgttgccatgccttcttcagtgattgcttctgaacataatgatgttcaagatgagagggagaagagtggtgttcttgtagaatgtagaatttgccaggaagaggatgatcagacctacatggagaccccttgctcctgcaggggcagcttgaaggtaaaattcagtatcaaactaattaaattccgtttctgcaattcggggtatgccagatttagttgttaaacaactttattggtcaaggaatctatttaggccatcaacgtattttgcttctgcacaggatatttttaggcttatgataaattttgttcctgtatttcagacctcttaatctgtagtagtgctgcgaaataaattttgtaacagtgctatatacatgtttctttcagtatgctcatcgcaaatgcattcagaggtggtgtgatgagaagggagacaccatatgtgagatatgcttacaggtgaaattttcccggaacacctagtactcatggccatctcaaaacaagttgctcctacaaagaaattaacatatagtagcctgtatttctgtggatacagcaatacaccccaaactacgcagcacctgaaaagttgtttcaacatggaagaaactcatntttcttcaggtaattgatgtatcatcacaaaagaagcacgattctgagcttctgattagacatggatcatctcaagctttatcatttgcagaactcctggttacattcaagcacaggtcatgcaaaacacagaccgaagtgctgctgcctcaacaagctacgatcctgaactccccaacccaaaaggtgtaatctattgtcgcatagttgctctaactgtaagtgcctgaaaaaaaaaagaatcatcatttcgtgccaccaccaaaaattaacattcagacacactcaaattcatcagctgatggtactcttgctactccacgacgcaatctcggttttcctcggtgatcacgatgcttacaccgtcgcaatgatcactgtaattctctgaattctcagataatagcacacatattgatattaccctactactttgatgattgattatttgagccaaaatcatgcttctgaaccagctgctgatgcttagaacggctggaatcgttatacctgtgtacatcatcttgctgtccttaactgaactgcttcatcgacgcaaccagcggcaggttcaccaacctcattctgaattcttgatataaaagacacaatctgcagttcaatgctgctgaacaatccatgcagcttgtttcacactgcaatctaaccgtcagaaaatgcaattgccagatttcagacgctgctgctgcggtgaacatcaaccagcaggcgccacagtcaccgcggcgacagcatgtcatcagcatccaataagttcagagatgggggtaccgagctcga

SEQ ID NO: 52426 - DNA, 1691 bp, Oryza sativa
ctttaactgaacttgattacgcatttattttccttaaaaagaatgtgtactgacacctgccgttacatttgcttagatgctgtactgcacaagtttgagctggagcgctgatggcagcaccctcttcgctggctacactgatggaactatcagggtttggaaggtctcagggtttggcggctatgcaatctaggtggtgaatttgttgaaaggcttaggaatcttaatttaaacatcgtgatgcctatcaagtttttgacagttctgaggcataacatttgcctggtactttctacttcattttcattaattaatgattagatttgccaatgagcttatcggtactctggaactatggaagaggatccttatgcatattttttgtttttggctaagttgaaaagatattagttatgcaactttcggagcctcattgcctagatgtaaataatgcttcatcaattgctattttctgatgattttgatggtgctaattagcttttcatctgccgctgataccttaaatcttccatttgtttgccttattttttattatctttcattctgtggtttttaccgtcaccatcaggttagtttgttctggacatgtacattggatgttattgcgtttgtaatatgtgatgtttatttagcccctaaaagcctcttaagttaagaaatagtatgtggtataactacgacagaccgaatcacctggtgtggctgtcatctagcataagcattgaccgtattatctgcatttcataatcaaccacagtgttcttcagttggataatcaactgtcacctgccttctgttttcaactgtgaccatcgtcgtcatatcttgcctaacctctatcattttttaatttcatcgtcttctatgattgaaattttctcaatgcttagtttcttattaaatctatgattggaatttttctcgatgattaattacttatttaatctcaaacacatggttatgcaatccttcacgcaaactgcgtcctcgaccaatccagtttcacgacgaagtcgtcgacccgaacctggggggggggtcaattattcttcttcagattcagaaatcaccatgtattagcaactctcttaactcgtctaaaattgcaccaattcattctatcattgttgccgccatgtcgtcgtcttcctcattgtacaagcagctcggcctcggagccggctcttccgtctccggctctcacctgcttctgctcgtcctcggcgccggcttcctcgcgctcaccgtcttcgtcgtccaccccaacgagttccgcatccagtctttcttctccggcggctgcggccgtcctggcacggacgccgccaccgccgccgttgctgcctcgccggtcaagaatgtcagcggcggcgcaagtgatgctgctgccgcgaccacggcggcgcggtcgccggacaacgacgtgagggtgctcatcggcatccagacgctgccgagcaagtacgagcggcgcaacctgctgcggaccatctactcgctccaggccagggagcagccgtccctcgccggcagcgtcgacgtccggttcgtcttctgcaacgtgacgtcccccgtcgacgcggtgctggtgtcgctggaggccatccgccacggcgacatcatcgtcctcgactgcgccgagaacatggacaacggcaagacgtacacct

SEQ ID NO: 52427 - DNA, 21404 bp, Oryza sativa
  unsure (1)..(21404): unsure at all n locations
ttcatgtccgggatggggtacgcgctgtcgtgggacctcgtccagtgggtggcgacgcgaaggagagacggcgcgaccacgtcgggccggaggacatgtggacgggcgggtggctcaacctcgccagcaaggccaagaaccggtacgacatgtcgccgcggatgtacaactaccggggcgcctcgccgccgagctgcttccgccgcgacttcgccccggacaccatcgccgtccacatgctcaaggacgccgcccgctgggccgagacgctccgctacttcaacgccaccgccgcgctccggccatcccacctctgaaccgtgttcttcttcttcgcgccttctctctctcgatcgttttcgtgacggattcccgttgaatttggcggttgttggttggtggcgggtagttgttgcgcgaaagcacggtggattgcccctgtgttcctagctgatttgttccaaatttctcgagtttaaaatagatatgaaatggatatttgttcgttagtgcttacgtgttctttgataaaccaagtatgattattacgctgacgtttgcagcgagagaaaaaataacaggtgtgtgacatcttcagaggaaaatcacgtctgatagagaatgacacacggtatggatagaacgagcaatggtttcgccacaatcgggattggattctaatctcgaggggatgtcccttcgggtacttttttttctttcaaattctatataaatgattatgaaaaattctgaaaaaaaatgtagagtatagtgatatctattggtccaccaaaaatcaaattaaaattctacctacacatcaagaaaaaaaaagacaacttcagatattatcatatgaacaatgcgctactattaatatggtgaatttgtcttttatatatctgaacgtgtgagttgagttttatcgttgatatggtcccagggtactaagctcaggagagaaggccctccccgtatgacgcgtgtcataagactcctgaaggagtcgcgtccatgcattaggagcggccgtcccccccgcgaggggggggggggggctcaaagcgttcccccgcccgaggggttgagccaccccgaggctctcacccgggcgccgcatgacgggagtgttggggtgcgtgagcgccgcccacctaaccacattcatggttagctgagcagccacctcccatcgcatttaatacgacgtagggagcgtagtgggtgcgcctgtaacccgtctgcgaccggtctatgaccaggcgatagacagatgggatagcggcagacgcacccacgcctcaagctcctgttaggcggcgtggggacaggtatgccctgtcccatcgtggataatgaggagccctatgtcccccatccggtcagcagtaggcttgactgaaagggacgtgaccgggtccaatgacctggtgtgtgtgtgtgtgtgtgcgcctatggagtcgccgagcattaaataccgagtgacggggggctgtccctcgtgtcaaccggagaggtttgatgggacccgcatgacggctggcgtacggatcgcctccggaccaaggcgcaagatatgtgctgaatataaacagtatccactctctccccgaggaagtggggggtggcgtgtgtagtatccccttgaactataaaaggaggaccacgcctagcggggatgggggatgaaaaaaccgaagcttgtagactagagattcagagactttgtaagcacaaaagaatcatcatgcacataggagtagggtattacgctttatagtgggccgaacctgtataattctctggttctcgctttcgccaagggacctagtcttcgactaatccaccgcactcgcatcctaaaaactcctcaagaattcacccgtgccccccgccgaacttaaaaaaaaaggggggggctcttagttccccgctggagggaatcactcttcgataattttggacttgagattttgtgaagttgtatagatatattgtatgagtgttcttaaatttttttcagaattttttataaacatttagatagtttttttaagcaaacgagggaatatcccctcgaggggatccagatagtttctagccacaatccgttagcagccaatctgcatgggccgtacattgagcccaacgtctgtaaagacgcaatgaggcctcacacgacgatgtatgcagcccaacaaaacaaagcccgatattgcagcaagcgtcaaacatccaacatccagagttaatcaagtcgtcacgtcactgttccagcctagctaagctagcaacaaacgggacaccacccaatgcgatgatgggtatggacgaatgatgccgctggctgccgagacagacagaggccacaagaatccgtcgtcgccgccgtcgggtcggcgagcagatgagatgggggcgaaggaagaagtgatctgatcggcatctgctcgggcgccgctgtctcgagttgaatggcaaccgctatccgatccgctgccgcatgcgacccgcggagcgcctcgggaccatacgttgtgatggccaaaaacaccggatgatacggagaaaccaatgagagctagtcgcgctcatgtttctgcacgaacagccagaagagaattactccgcgaattatgggtgacacgccatgtgcggtgcgatcctttgcctctctcaaattgattttaggagtacgacttgtgtgtgtaatttcttttctcctaagcccacgatgttgtgcaaattgtcaaactaattttgtgccggtgatctcaagtgctagggggtactgtttaggtgaaaatgagacccccagggttgcttttgtttcaagcctagtagcgacaaagttagcaccacccccctccgctcgtctccatccgccacacagacactctctcccggccgtacgctgccgatccgacggttcccacctcccccaccccgccgtacgtggcctcgactccgcttttcttcccccctcggctccggtttcttctccacacgtctctcctctcctcctcctcctgacctcgccgccctcacccaccacccgctcccgccgccggctttaatgcctccggggacaagccctctcaagcgtcaacgactcatccactgctccacccgcgtgggcggcgcgtacgtagaccctagccggcctctacctgctcgctacagagctcacgtacgtacgcgcgcgcggtggtggttggcgcgcgcgcgcgtgcggtgaggcgtggtactagtattatttattcgctcctgcctcctggggaggtggaggatgctggcgatcatgagcttgctgctgccgtgggaggaggaggaggagacgacggaggcggcgccggtgttttgatccgtcgcgcgcgcgcggcgaggtgcggatcgggcggtcggttttgaattttggagcgggaattgcgcctgagatctttgtatttatcctggttgttcatgtatttttcttcttaattgcttcctttggttggtggtttcagtaggaagaggttggagacgtggagaggagtggccgtctcgtttcagattcttctgcgcaaattctggttacaactagaagttgcaggacgcgagagggttgattggtaaggtaattctatggcgttcgtgtgttcctctcatgtaggttgagtggtttcttgtgttatgtttgtgcattctagatctgattgatatgcgtttgtcatctccatgaattctgtgttgttttttacgctagcctgactaatctgccaagttaatggcactgtttatgttttctgaatgaacactgctacacatactaattttttcttactaaatctttactaacaatcatctcaaccgtttgatttaggtagatggaagttatgaaaaatctagatacattcatagcatgacacatcagtgttagaatttagtaagaaaaagttagtatgtatagacttttcctttctgaatagtaatgtacaacaaggtgatcaactgatcatgtactaatagtgaacactttatgatgtagtaactttttttaaaaaaaaacgatatgatatggagtaagtaactttcctttgttgattcctcgccgttgcttgaattctggttttctgctcagctttggtacagtatcattatcatcgtaccatctctgcatctcaccagcaagcttgtcggaatgtttgctgcttcactatagagttttaaggaaccaatgtccagagctcacgtgttataggtgcagtaaagtcggatgaaatcatgaatatctgtttcggtctagacacttttcttttaagaatggtcaccgggggcgaaatgcccacctgaatatgttacttcaaacaatcttacacagggcaggcttagcttatgcaagcgtaggtggccctggaggataatatggaagaatacacgggatatacaaagaagagaatacaaacgtatcacaacctcccccacctaacacaaagaggcacaatagatagaagacagaagctttgacgtttgccacctgcaaaatcacccaacaaaattccaaatcaagcaaatgctagaacccttgttcgacatcatccacttcacatgcagtctggaaacaccaggaatcgaaagtgtcggagggcctctccgccatacgcatgcggctcggtaccctggcagtgtgaaaggctgtggttgtcgaagaccacccgcatcatgcaatcagaataatgacttagtcatgttgctgctgggatcaatgcctgtcggcgtcctttgggggaaggaagccccaaaggagggagggccactgaaagattgaggccataggccatccgcatcaagtcatcttcaatcagtctttaacaaattgctactccctctgtcctaatatattgcaacctaggatgggataaatttatcccattctaggacaatgaatctggacataccatatatccagattcatagtcctaggatgggttgcaatatattgggacggagggagtagctagtttaacgccctccaacatccttcgggggaaggaagcgccaaagtaggaaaggccgctaaactttgcggacacattgatacactgttagtcttgatctcgtctaaaaatttaccatggtaacagatcaaacttgtactacctccgtcccaaaataagtgcagccataagtttccgcgctcaactttaatcgtccgtcttatttgaaatttttttataattagcatttttgttgttatgagatgataaaatatggatagtactttactcgtgacttatgtttttaatttttttcaaaaaaatttcaaataagacgaatgatcaaagttggacgcagaaaaccatggctacacttattttgggacggagggagtatttttcctttagaaagaagtacagtatataccttcatcttggaaatgacaaagttctcagtagtgtgtgtgtgtgtatactaatattttttcgaaacgttcgtcatgatatgattatctatgaaaatgtttctactgcattatcatatattcatatttttcctcgacatattgtactatgaggacaaacttatcagttaattgacaggctgtaaagttgtaatgcgcttcttacatttttgacagaagaagaagtgctgtcaactttgagataaaggcaaaattacgagaaaaaagactttcaagttcttttgaggatgagtgaccctggagagccttctaagcattcccaatggatgtcacactggaccaaaggaagcagcagtgcagagccccaagttggcagaagtaatgattctccggaggatgcgaaatatgacatttgcgaggacaattctgggccttcaaactttgagatcatgaaatctagattgtttgaaaggctaatggtaggaatcagccaagaaagagcttcgttggagcatggacagaagttaaattctaacatgaaagtagtggtaaaagatgctcgccgacacgctgtgcaaaaccaaattgatcagggagacgggccaattcaaaaatctgtgatgcaaaaagatgtcttatatgctaaggctgttgtatcaaaatcactttccattcagaagctttcagagttatcagtggattgtcagaaacttgcaggttcagatgacctgagttcagagtggaaccattttcctatgcttgcaatcaacagaaaaattgactccattctcaaccctaagaggaagtctgcaaagagtactggacccaatgacgtttttgtgccaaaacaaactctgaagctaaacatgactacagctaatctgatggcattctcatctcaggaatatgagctgcattctcatcgaacaaccgacgagacaatggatcactgcaaacatgcaggaggcattgtatctcgcctggaagatcatgctggtgtcatgttgaatcctgcagagcaaaaattaaaaggtcaattattgccagcaacgtcatgttcgtgtagcaaggatgacagtaactcatctgatagtctattagatgagcagcatacaagccgctacattgcagattcagatcaggaaccaacctgcagatctcgtgaaaaaaggttgaaatcttcagaaaacaatgacacgaactgtaaaattggaagttgctcccagaatcagaagtcaagagcacctggacatcataaacacaaaggttctgcgggagtcatgtttcgtacgtcagtacctggtaaagaatttgaagctgctgaaattaattgttccgacaaaattaatcagcgacatctgaatacacagagaatagtatctgcagcgaatgtcactggctcctgcatacctgatccagctgcagacatatctacagtaaatggtaggggggaggcagtgacccagccatcgagcatatctggagattcaactaaacgaaaagctccatatttatttgaaatgctaaccataccttccaaagctcaaaatatgaatcctgaagattcactgccttcaggaaactcgactgcttttggagttcacatgtacggcacaaatattggcagtcatctatttggagcaaataacaaatcatcaactgaaactgaaatattatccggcgacagtcaacatgtttcaaaatcctcagcaggtaggagagaagaagctcagataatactcatgcgacattcttttagcttatattgattaaaaggacttgtctctttccaatgttgtttgagtcgagattgatttattgggtatgaaagaaggcaataaaaaccttgaataaaatataacaattttctttattccattggtggtatcactcacagttttgttctctcttctttcaggcatcgcctcattgttggcacaaaaggtactagtgtcctatactactctcatgtttggtcgttatcatataagtttatgcaaatttactttaaaaatgtatataatattgtcggatatgcattttttttctgcaccatcaacattgttttccatatttaagattttgatcacatatataatcatattagcttggacatagcccatttttctcttcttatatcctcgcaaacaagttacttcatgctatctcatttatatgaacatgccgcggctaattcctatatggttgcaggcaaaatccgagcagctcgcgactctgtacatgaaaggagcatcaggatgcaatgtgaatgaacatcaaggtgtttcctccaaggcaattgtcgccaataagcaacaatgctacaatccaagaacagcacgcatggacttagatctcatgcaattccagttgagcagaatgagaaaccaagaatcacaagcgcgaaccgaaccaggcgacagatggctaaaacgcctacagattgacagcaaggaccctcatcatcttccttgctccaagaggtcaaaagctggagacggatccggtcgtccagtcaccggaggagcaagcagcatggcaccccgttgcgacgggagcaacgacgacgacgacattgttgaccgtgatcataaggaggaacaaggattggatgaaggggtggaaattcaaggcggccgagaagcatctcctgttccggcaaagagtgatgaccggtggattgggagatggtgccagggtggtgttcctgtgtaccatgaagatgatcatgatcagaggaaggaagtaacaaagcctgatcttgccgccggtgactccggaggacttgaaggtcagttcccaagcatcaaggcgatggcgatgatgggacgagcaatgagcaaggttcggccgtgtcaggaagagaggaggggatccttcatggtgtggaaggcgtagtaggagagatcctgatcacgtacaggtttttttttcctgttttttgttctgtgtaatgtagactgggctgccctctctcctcccgtggcagctggcttcagatccggtggctatcttatagggtatgtttaccaaagtatctttgtgccagcttggactccctaatcctcttaatctcttggcatctatggaaggaatgcaactctagagatttcgactctgcgctcttttttatcagtggttcagtgtaaacgatgtctggttttcaggtttatgagggtaattcggttgaccgtgatagtttgggagtaattcgtacttttttcatttctaaaataaatagttgtaaataaatggatctacgtgttataaacatctgcatttataatgttaaaaaattagtacccctccgtttctaaatatttgatgccgttgacttttttaaacatgtttgaccgttcgtcttattcaaaaaatttaaataattattaattcttttcctatcatttgatttattgttaaatatatttttatgtatacatatagttttatatatttcagaaaagtttttgaataggacgaacaataaatatgtgctaaaaagttaacagcgtcaaatatttagaaaaacagagggagtactctttttgtaagaaaaaaaaacttagtatgacagcttaacggatatattatgtttgttttttttatgtactaaaagggagcagtaaagtaaataaatctagcactgcaacttaatggatcgtcttttactagagctaatgacagaatggacaggacgatttgccttttgttccaactatctatgagactatgacatactcattccatcccaaaatataaggcttaactactcataacataaagactaagaaaatatttaatctcctgcttggttggatcaccctaatacatacaagcaatgtgattggaatatttgatggtataggatttaaaacaaatcaattctattggaaaatatttaatctcctgcttggttggatcaccctaatacatacacgtcttatattatacatgagaaaaaaatggttgtgtggaagggagtagtaagtacgtaaaccatcatcagtcatcaaatgaatctagtagctgattctaattaacggttgctatatgcagatcgacgagatgacattaagggggtgtttagatccagtagtgtaaggttttggcgtgtcacgtcggatatacggacagatatttaaagtattaaacgtagtctaataacaaaacaaattacataattcgcctgtaaaatgtgagacaaatttattaagtctaattaatccatcatcagcaaatgtttattgtagcaccatattatcaaatcatgaagcaattaggtttaaagatttgactcgcaaattaatcgcaatctgtgtaattagtttttctttgcctatatttaatactttatgtagatgttcaaatgttcgatgtgatagggtaaaaaaaaattaaggtggaatttaaatggggcctaactcctagtaagacacaaggaaagtgactccagctttacgagcaattttactgtctttgagaagataccatgaggtatcactttttggtacgaggtatcactttttggtacttagatactatgaaataacgaattttacactaaatttttgatatctcatggtgtatcctcaaggaccataaaattgctccaagctttagagccttttgttccgactatcgatgacgtaggtacgtaaaccatcatcagtcatcaaatgaatatactgaagggatggatttgtccctccaaccaaacatcacctattaattctaaacagttgctatatgcagacaaaaggaatgtgactccagctttacaaaagttcgtcaacgtaacctgtcctttggatagctgcaaaagctcaattatacacgtaggagtagttcctttggctgcaaaagtagtttggtgatgtggatgtgatgtttacatttgctgctgcctttggtgatcaagtggaatatggtagtactaaaaaatttacattagctgactagccattcgtgatgctatgtttgttgatttttccgatggagagaacggtgatagtttttttttattatttatttattggcacgtctcgtgtctatatatcgagaccgatcgtatccaggcgcacgacacttgacaactctgtactacgtagttcgtgcttctaaagagcgcgggggaacccatcggcgatgccggcgcagtcggagagacttcgcttgccagcggcggcgccgatgccgcgcggtgcgcacgctctctacggactactcgcgctgctcggcgcgtcggtggtggtgtggtccgtcgccggcaagccgcccgccgcccacgccgggcacgcactcgccggcttcctgctttggctgctggggatgatagcactggtgctgtccccgtacgccgcgcagccattgttcccggttgcaactactgccaatctcgccgtggagaaactgaagcatcgcttctccaacccccggacgccggcgcaggcgcaggcgccggctttggcttaaaaacccaccgacatgtacgcgacgcaacgcaagcggcaaagccggtcctacgccgaccaagccgcgccgtcgtttactactactactactactcgtacatagcaagtgaagtggtttgagactttgaatctgctcgtctgtgtgtgtgtgaataaaataagttcagtttggcgataattcgactgcaagtgcaagcagttggtttgatttactgatccagttctagcattcgcagctgatcacgcgttgtaaatataaagctttgttctttccttcattttcagtatacaagtttctgaagctactgtaacttccaaaaaaaaaactaaaaataacgaaaaaggctggacgatactagtactactcgttattactactaataatttactgtactactactagtagccaaacaaaggggacacattcaatttacatgcttctcatttaggagatttggtgcgaaaagaatagacatattttcagaagcaacgaactttcaatatcacaactagtgacaaaaaaataaaataaattgtatgtggggcgaaagatataacgagaatagcgccttaccatgtcctctgatgtagtttgttttccttctcttttttggttttttctcttcacccttggtgattgtgtacggtttactcccctacctaggctgcaatccatattgtagttcgtttatttatgttcctaaccttcactctcttgttttcacgtgtacaccttctaaccgtaaatgatgtgttttttaaaacgttctatggaaaaagttgctttaaaaatcatataaatttattgttttaaaattttaaactaatacttaattaattatgtgctaactcaccattacgttttcagaattagtttcgaacacaatcttaatattaaaccagtagcgtctgtcattaaaattactagtagctcggtttgagaaaccagaccattgattaagggcatgtttggagaatttaagattttgagaatatgaaaattttaggtttgtcagcttgtgtcttttaattcattttctgattctaggcctaaaacggtttgaatccaaaaagcccaaacccgcgaagaaatatcccaacccccttcgtcctcccctccttatccgccaccaccaaacccaaaaccccacctccacatctcatccttcccatccatggcgccaccgcgctaaaccccccaccacactccatccatggcgctctccgagctcccgctccaccactcctttcggctttnctnnccgccccaccttcgncttcttccgctccgncttcttttcttccgccacgccttcttcttcttcttcaccaccgncgncgcgtnctnctnctccttctccggcggcaaccgcgccccttcggcttcaaatccaacccgaggcgcgccgtggctgcagaagtgggggcccaccgaccccgccgggccgcggccaccacctcgggctccctccccgaccttctccatcgaccgaatcgtccaccgcctccgcaacctcggcctcgccagcgacgacgacgagcccaccgccgccgccgccacggccaccgcgcctcccgacggcaacgagcgcctcagcgacctgctcgaccgcagctgggcgcgccccgaccagcagttcgccgcctccagcttcgacgagtccgtcctcccctgggagagggatgaggtcgcgcgaggaagagagaacgaggaggacggggtgaagaggaggagggttagggcgccctcgctggccgagctcacgatcgaggacgaggagctgcgtcgcctccggcggctggggatgactcttcgggaccgcatcaccgtgcccaaggcgggcgtcacgcaagccgtcacggagaagatccacgacgcctggaggaaatcagagttggtccggctcaagttccacgaggacctcgcgcacgacatgaaaactgctcatgagctagtcgaggtgtgtgctatattagccctttctatcagcattggcagcttgctcgttgtaactgtttaatctattatgtttttttttggatatcagttcagtttagtgatttctagtggcaattgaacttgaattattatgtttgttgctgtgaattcgaggttttcgatgagttattagttgtgccatgataaatggattacttacatgacgtttgcctatcgatcagcgacggacaggaggattgatcatatggaggtctgggagtgttatggtggtttacagagggagcaattacaaaaggcctttgaaatctgaaacattggatggtaactcatcagcggtgaaaggggcagacggtacattgttcatcccggatgcatcaagccccacagagcatgatagccaggggaaggatgtaaacacccaacgtgagattgcagccagattaaatatgcagaatactgaggacatgactgaagaggagctggagttcaatcaaatgcttgatgagttgggccctcgttttgtggattggtggggaacaggcattttacctgtggatgccgacttgttgcctcaaacaattcctggttataaaacaccatttagacttcttccaactggaatgcgtttgaccctaaccaatgcagagctgactaatttgcggaagttagcaagggatcttccatgccattttgctctaggtgattatttcgacagtgttcatattgtttatcccctattatagcttttatttgttggtggcaaacgcctgactactgcttgataaaattcatttaagggagaaaccggaatcatcaaggccttgcagcagctattgttaagctctgggagaagagtttggtggtgaaaatagctgtgaaacgtggaatccagaatacaaacaacaagctaatgtcagaagaaataaaggtttggacaccatgctgttgctgttttgactcattgactggcatacctacttacttcacagttcacagaatttatgccaaggaacattgaaaactatggtaattgccagattatatctaaatatacaattgcttgtcatagctaagctgaatatatgatatatctagtcgtatttgaggcatgaagaaattcaactaaaaatcctgataaaaaaggggcaactataaggaatactcagtactcacttactcagcagtaggttttgatgaagtccatatttgtcctgtgaatattacaaaatccatgatttgttaaatcatccaaagcaacaccaggggtttcggaaaataataacaaaattgtgctgcactgcttgctctaatgaatataacttgcttaatgtaatgcttttatttgtctaaacaccatcatagacaatcatgctttaccaagatcatgatggagacagcttcatatagtttagttctattccttgtcgaactttcatagagttccaaaggtgtgtttccatgaatcaactgtgttcaactgttcatgcactatatttgatttaacctgtataggatttctgaatcagtgaagccttatctttttaacattatttcagaatctaacagggggcaccttgcttcttcgaaataagtactacattgtaatatatcgtggaaaagacttccttccaacatctgttgcagctgctttggctgaaagagaggagttgacaaaagatatccagaatgtagaggagcagaaaagatgcattccggttgtgcactcaatggatgacagtttagatgggcatgctcttgcgggtactcttgctgaatttcaggaggctcaagctcgttggggaagggaagtaactgctaaggagcaagaagaaatgaaagaagcatcttctagatcagtgaaggaaaagcttttcaagagactagagcacaaactttccattgtaagcattttctgcatgttctctgataaaacttgtcttattttgtattgccattttttaattatgccgttgatctaggtatgccagtgtgcttatttgacatatatttatttccatcagttgttatgcatgttctttatttcttcttcaattgttcaggcacaggcaaaaatacatagagcagagcggttactatcaaagatagaagcttctatggtccttgctaatccatctgatgataaagaaatgattacagatgaggaaagatctgttttccgtagaatcggtttgcgtcttaaggcatacttgcctgttggtgagtttcttgaacaataaccttggagagcattctatactatttctattgattgattattcccccttccattttaggaattcgtggtgtctttgatggcgtcattgaaaatatgcacttgcattggaagcacagggaagttgtcaaattgataacaaagcagaagactctgccctttgttgaggagacggcacggcttctagagtatgagagtggcggtatactagtcgccattgaaagagttacaaagggctatgcacttatattttaccgtggaaagaattataggaggcctattaacataaggcctaggaatcttttaacaaaagcaaaggcattgaagcgtgctgttgcaatgcagcgtcatgaggttagtttgctacaaaagaaaaaagcaagagcagtaccttctttttttatgataatcattgtacacaactttagcatccttctgatattgtttaaactcatgaattgttatgcaggccctcagtcagcatatagctgaactggaaaacaatataaggcagatgaagttggatttggtacgtaatttctcatattacagaaaagtagttgtgttttaattaaggcaaacatttagcataacgaacccttttttcttctcattatacagcactaaaactaatttctgtaggcttaaaatgtaatatgatgccatgccttttgtaatttttgccatttgcatcagagtaaaaacatattaacatgcatcttagttgatcctctgcccactaaatggcctttaaattccacaatatttacctattgttttagcaaaaaaacaaatgttgttattcattggcatttcattattaaggcaacaactttcccttagactgcattttttttcagcagagatgtttttgacagtgaggcatatatctgttggtgcgctagtgataaattgatcatatatgtcttttagttaatgtcttcattgatgaatgctttcctgattttatgtcaaaacaaaatagggcattgaggttgatgaggaatatgaagaggacggttcagattcagaaaatgagaataatgaagcagtttcctctgcaagatacgacgaggtatccaatcttttgaaactgatgctgtctgttttagaaccaccataaaatccattcttccctttaacgtgtccaggaccaagatgattttgatgaatcaagtgatgaagatgaatatgatgattatgatgaagatgatgacgatgacgatgacgaaggcgttgatagctagtaatatggaactgggctttgcgatgtagagtgatgtttatctctggaggtgatattgcaatcctttggacattcttggtaagagcaaagatttttgttttggagttctaccaatacctcaataggttcatgcatagcatatacagaaccatataggtacaaagaattaatcatgcagtttcggtttgtattttagggagattttttattaagaacactggggaatttgtagttggtttgtattatatcaacacctcatctgttactgtatcaattaatcaaccactagcctgtaaggggcttatcttttctgatgtccttctcaagaacattttgatgttagtaatgggcttagattctgagattttgaaaccacctccatttttttatttgagagatatttataccagcataaatggattaatggattttctcccgtactattcacttaggtctttttgttacacaagtactcctttgtgaatccttactgttattcagcattaaatgcaactttgaaatatcggcacattgcaggagccaagaggatcgccggcagaccttgacaactgtattgctgctgcttctgtttacgcatggtcttttggacgaagggcatataactttcgcatgtctctactctgtatatcccatttgctttgttgtttgcaaattggctgctgggatctgccttagaaaagctgagttgggtgtaaatggtaatcttgtgtcgatgtcttctcatacttctcattttgtaacaattatttaagcaggctcgaggtagaaggtacgtttccacccccaaaatgtactagcacacgagcactgtataattcttctgctgtataaccggatattccaggacacgaagaatgttgaatatacttggtttttctcccttgcacggttgcacgcattgttcatgacatgtttatacttaggttctttgtaagttttaaggtgattgttcttgtaatgctgatctggttcttatatcttcctcagtcctgttggcctttttcaccgtaaaacgtcattgtttatctgtctgtctaagtactactcgtatcaactactgaagtgtacgtcaaacaataaaaataaaagtgagtgtgcaatatgcttcgcacagaagacacgtgaacaagtttcaccaaatttattggttttcgactgtttggttttcatacaatctgtttgttggtgaaagccgaccggtattggatttcatatgacgttgatagaaagttatcactttttactagtttccacttcaaaccaaaaagatattggtgcgttgaccgaaactcatcggtttttactagttttcacatcgaaaatgaaaagataaaccctgcacgtttggcttgtcgattcgtgcagcatgtcgattcacaaaaatgctatcgatcggtggctattggcttgtttgttttattttccttcatttttacttgttgaggaggtggtcagagtttgagaacttttacggtacactacacttgtaatatatacttgtagtataaacaatctaatacactacacttgtaatatatacttatagtataaacaatctaacggtgtggatttatctgatctttcttttacagtataaattatgtagggtatatttgtctttctatatttttgcggaaggttatttttgtattttcatgattccttctttagtcagatcggatcgtgagaaaggggctagtcccatgcgctgccggtgacagccgctgcacgcgtccctggctcgcccccagcagccacggcgatcaagggccgccacgcgcagcaaaacaatgaaacgtcagcaaattaattctgaaagcagtcgaagattcatagggtcttttagagttcgtaacttcgtatgtgctagcaaatgctgatattcgtttcgatcaatcatgtatacaagcatcgtagtcgcacaaccggacactggctggatgatggcgtgccggtgtttgggaatctttcgatccgccgccccgcgtgatatattccgaagaagcgccgctgctcgtcgaacggacgacgagatccaaaacaaataccaactaagcaaacctttccagattaactccccccggtgcaaataaatctcaacttcaaattactaaataacccattctatattttgaacaaatactaaacatacccttctatataaagagatgcggcagctctactgtagacgctgagccatgccgtcggacgccgttggacggcagaggccatgtaagggaggtctagtttgcattgggccgagcccgttaatctgatgtaatttttttttccttttcagttttatcggttgagaaggtggcggagttttcttctccgacccctgttttcgcaagaggatcgccggcagaccttgacaactgtattgctgctgcttctgtttacacgtgtcttttttttttgtggacaacgtataacttcgatgtatgtactctatatatccccattgctttgttgtctccaaatcgctgttttgttgttcgtaccaacagttctacatcgtcctcggtcctgtggccttctttcttgttccccaactgtgtcagtgtttatctgcctatcatactagtagtatatcagctagttcaccaatctgtttcatgtagaagacgcgggagcgattcgtgcagcatgtcggttcataaaaacactattgatcggtggctgaaggtattggctgcnttgttctgttttcactttttctccagtgagaagaaggggttcggagttttcttccccgaccaccagttttctgggtttgacgaggcagcagagcaccagcgcaggcagggtagtagcggctcgaacaccgtcttctcggctcccgtgtggtagagttcctcgccgccatacatccgcttacagcgcaacagatgcggcggctcggctgtcgacgcctcgacggcaagccggccgtcggcgccggtggacggaaggtgggagaagagagcaaccaaccagcagggctgctaattttctagttgggcctggcccgttgatctggatgttatcggcttgtttcttttgttcctttttcttgttttgtttatttgttagcttgatcatttccgtcgcgcggtctctttcgttattcgaacatctcgggcgcagcccacaaggcggataacattttattattccaaacaaaatagaaatacacaaacaggtcagcttattttcttgggctttttgggtttggccaggtgcccccatgatatatgatatataagtctaattggtaggctgcgtttgtttgtgggtttgggaatgatattttgagtagcataactaaacatgaaaaatgaattaatttatttattaaaaaattatataaaaagtttttcgtggaacgcacagtttagcaattcaagaaagtagcctaagccgagaagtggcttaaaactcagcctagtctccgattttaaatgtatgttgctgttgtttttcactttctttttaatctaagttggttagtttctaagacatttattcactatattctcgttgttaattgaatgatactcccctgtcccgaaacataatgcgcaactaccactaacacaaaaccaagaaaaattactatcactttcttgtttggatcacgtcaataaatataatacatgtatccaataaaattaaaaatcttaagggtgaaagttttagaaaagaattaaaggagagggggagatgctagttaattgcacgtatgaatgcgcgctttatattactatgaaacatcgaaaaggtggttgcggagtatattttaaagaggacggagcgagtattattttcgtgaaagaataggatctcattttcagtttcaatgtgcaatgaatacagagcaacaatgtcacgttaactgtttaattactcctgtacacatgcaggtttaaaacgacttgtatctggagagtattcctacaatggagttatgacaaatttgtgacactcaatttgccaatttgtcccatccctttcccattttgctgggcactgaaatttgtggttggaaacattttttttttatcaatacacaagtggtagttcccaccaactgccccattatcttgacccttttttggtgcctaatacatatatatccaccttggtaggtttcagatgaaggttttcatgtgaaatcaccaatgattgttttatgggagtacagctcgtattgctgctcgccactcgagcaggagatgacacgatgcatttaactccacattattaattgggcatttgggcaacttgatttgggagttaaaataccggaggcccataatgagggagcaaaatgatcaaagtaatcttggacgtcgtcacctattcccatttctgaggcgcagcatggcacttactaattaacattagcaattggattggtacgagttgaattttatagtacttcataagtatatttgcagcctgttgtatttttctactatatttggtgtgaaaaaaaaatgcgataatcagtatggctttttgcatctttaaatgcagtgatggggataaaaagagatcatcatcttcttctgtaagtcttttttttaaaaaaaatatggccaaatatgttaataagagcatattacagtcctattgttacaagaacgagaatgtaaaatctgttaaaaataaaacgtagagacaccgcaccttatattgccacaagacatgcaaacacacaagtacaactataacactgagtcactgaccaaactagggtacatgcaaaacctgcatactccctctgtgctgtaaaaaccgacacagaatttgatttttttttttcgccccagatggagtatagatgatcatccacttctcccttttttttctacgagtctcggtaagcacatcagcaatatacgccagaaatttattctccaatatttcgatagcggatctcttgaggtgtaagtttcctcttttctatatatatatatatatatatatatatatatatatatatatatatatatatatatatatatatatatatatatatatataagttgactcataataatggtaaagggtaccaagctcgaatt

SEQ ID NO: 52428 - DNA, 2342 bp, Oryza sativa
ttattaaaggctggaatgttacattccattatcttaaaaaaaaaagttcagcattagctctaggggtctcatattttcgcttatgcttatgtataagccaaaatttgaattttcaattttaaatttggagttaattttggggttgcttcatcgaagtttatttttcagtttttactttaaactgctaagaacacacacacacatatatatatatatatatatatatatgtgtgtgtgtgtgtgtgtgacactcatatggggcactatggtgcccgggcaccatggtatctaatgcacaaagtcacttaaattttttaaattgtgagtatatacctagttataataattcgatccatacctatacctatcaacaaaacaactcaaatttaactttatttcacaatccatgattacatacctaactaattatatgtatggatgctatatatctagaatcaaaatctaacgaaaacaagttcaaattcagttcaaacttactttgaactagttagtaaagtagttaatgttaataactaagtaattgaaaaagtttcatactcatttgaattgggtatatactcaatttcaacaatggttcccgggcaccatggagcaccaaatatatatatatatatatatatatatatatatatatatatatatatatatatatatatatatatatatatatatataatttataaattattttcttatttgtaaatatgcccatgaataagccaaatgatagggcagcaggacggtaaaccacatgactgattgactgcaagagcacacacccagtaaaccaccgaccaaatggtagaatataatgtgatatactagtactagtattgttctggagagaagctaacaagatagtagttgttgataagcagtcacaaaaggacatggaaagacaatggtccaagcatgtagaagcaactcagcaacgtctctctgctaaaagacatgctttggttgtagtggtggcttaaactactgctcagatcacttggactgctcctcatcatcaaccattcaaccctccaactttggacgtattatgttcagccgcacatatgcagggttaaacccttaaaaaaccggagacatgccaacacatcgaaggtgacggctgcctccactctttgctgagactaatatagtatattaggaccttctatccaggataatagttgacctgttccctccaactcttcacttaatgttttttttaagttggttctctttttccaaagaaccttttcttttgaaggtcaatgggactcttgaatggagattagttagctcggtacccagcttaaggatattgttttttttggggggtaggatcattattgtgagatgctatatagctttgaccatggtcttaattagctctataatgcatcatatatagtgcacttccccaccactaagcaaccagtttgcagaggatagaaattgtttccattatccaaatcttctttgtttgtagtattaatgtaaagattaatcaaactctgaagcattagaacatatggattgtaatcatatcaactcgcgatgttgctcaggaaaactgtaccaccctattccagaagctagactattctgattgtatagaatcactatgaaaatgtacgaatatccgtctgggggagacctgtcagcgcaagtgcgcctatgtagaaccaataaaaaaaaccctcattcttgactaggggcttgtttagattgatttcatttcaaaccctatcattttttcggtaaagttgtcaaatatgtgcatccattttgtttcttaccaaactttgataaatatataagaaatcctaccaaaattttggtaatattgccaaaatgccagtaaggtttattttggctacaatctgaacaacccctagctttttacgagtaaattcactactatagaatttaacaaattgagaaaagtagtatttccttcgacgaaatctctgagataaatagcggagggttagttaacatcaccaaaattaggataacttacgatgaataagactagtatattgggaacgttggctggcagctgtggtgaggacatgttaacatcactgcaatttacaatataaatttgtcattactagctcttcatagtgctaaacttttgatatccagatcgatacttgatcgtcatccttgagtcctgtcaattgagttaagtaaaaaaattatatatactccttacatggatgttcgtcatctcccacattcatgcatcgatgcacaaaactacagacacttggcagatataaatttcattaactcaatagacacatgacgccatgatggtactg

SEQ ID NO: 52429 - DNA, 4598 bp, Oryza sativa
gtagtatgtaaatattatataaatgagctattagattggctacagataaattgaagttagtagttagctatagtattaaacttgctcttaattagcagcgacgatggagcatgcaaacgtcgccgtcgccgtcgtcgtcgtcgtccgtctttatcgattgatctccacttgaaaattaatcagggatggctgcaccgccgcaggggagaaggcttcattaattaattccacgtcgaaattaatctcaggttgggtgttaacttcggaagttggaataatcctcctgtgtagtatgtacatggaggatgatggacgccatggtccaatgggcatcaatgcaccgccatgcatggaccggcttccatttgcatagaaattgaccacccaatccagtgcacatccaaggaaaaaaggcatgatttcgtgtcaaatcctagcctgttcaaaattattgaaaaaaaaaggggcctcagatcatttaccccgaatcatacttcggctatgttttagaagcccaaaattataagaaacaacggacgaaaattttagaaaacttgatttttccaatatctacctgctaaagttcatatgccgaattctagaattattgatttaaaaaactactcctatataagattctaagctatttggagaactggagattctgaaattgcgagatactcactccgttccaaaatactccctccatatacttttgatagtcatatttcattttagcacacagactaaggataagtaattctacttatcatccatttaaatatgctactagttattcctcgtaaacaagcgattcattaatatttacatttctcgatgcccatgtagccaatcctgtgtggaagaatggagagtcacgcattaaatccgagaaagtcactaagagaataggttttggattgtaatatgcctataaaaatattttttttcagatttaaaaatatgcctatcaaaagtagatgaagagagtataaggcacaaccacccttaaccaaaagatcaagaaaaacaattattatcatctcttagtttggatcaccctaataaatactacctctatctacttttgatagtcatatttcatcttgacagacaaaggataagtaattctaattatcatccatttaaacatactactagtcattcttcgtaaacaagcgattcattgatatttacatttctcgatgcctatgtagccaatcttgtgtggaagaatgaagagtcatgcattaaatccaagaaagtaattaagatgataggttgttgaagtgaaatatgcctatcaaaaataaaattttcaaatttagaaatatgactatcaaaaatagatggaggaagtataatacatgcatccaatagaattagagatcttgagcgtgaatgatttaaaaaagtaataatttaatggagaaaaggtgctagttaattgtatgcatgtatgcatgctggaacatttttaaaaaagtagttgtgttttatattatggaacgaagggaccgagggagtatctaattatataaagtagggacaaagctagctgaactctaaattacacagatcaattagagcacacctcgtcggggtctcacgatcgatctcagtgcccgaactgctcgcttccaagttccaactccgcgcttcgcttggccaagttgggtcaggctccacgccggattttgccgtgtctgtatccatcacgcgacgcggtttgcagagcccaccaccggtggcggagaaccgacgcggagaaagccggttgcactcgcgctgttacctgcgcattgcggcggcctcccgtgctccgatccgatatacgctcgtctgatgtggatgggagatgcaacgacgtcgttgaagaggtgagtcgggcaaaacagtactgttctgtgacagtttttgcctaaaaacttggtggttcggtatagaaagttttgctaataacattgtgcttgtttggccgttatttttgtggttgcgggtatagccgtgagtagtagacgccagggtttcccaaaccgccggggccggggttaccgtaccccggcggtaagcacagtaatcgcggtaaccgtgaaaaaccgtacaaaaccataccgaatttatcaaaaattcaaattatttttaaaatttatttgaatttaaagaggttaccgtggtatttatattaccgtacccccgcggtaaccatgcggttaccggcggtaacgtaaaccctggtagacatggcttactactctaaaaatcatagccgaacaacttttttttctttttgaacggtcagtctgattagacttgtcttatattgatagaagggagtttaagtacacacagctaaaggccaaaagaaaaaaaaagtacaaattcgagtgcaaacaaacttgcacgtcaactctccttacacctcatggcaacattctcctgatgtgctttatgccggtgagtcccaccatcccaactcctattggatgcgattgattatttgatggattgttgcctctttccctctaaagattcccacaatcatttttctccagatttcccaagcaatggcaagaataccgaacaacctcttgtccttgttgaagatacacatatacatacaacaacattcacttgcacacaatatacgtgtggtattatgaaatgcacaacacatattcgaggataatgataaatctgcgaactcactaaattgttattgaaatgcatccgcccacataattttactcttatataagccgtttatttgttttttttttgtttgggcacatggaattaaccagagtgccaacgacaggcacatggacgaccatcttgcgatcgaggacggacagccctgatcgagaagacatgccacatcttgattcgattccactggagtaagtggccgggcacatcaaaagggccgtaacaaatacgtatcgatttctgtacgtactggagtacttccttttggcgaaacaagatcccgatcaatataccctccatctttccgtagcaaaagaaaggtaccgaaatgtatgtgcatcagtaccatttcacacaaaattctcttgctgatgaacaacgtacaccacatccttccagagtccaaactgtggccgcgatcgcataatatctggtgctttggtgcagctcatttttgtccggtgaggattctctactataatgtataactactattatagtcactggttgtgagtcatactctcttattgttcgatctacacgttagtgtctgtagtgatagttgtagtgacagtgatattatgatagaggatgtgaacccacttgtgtcgtacgcagtcgtctctgcatgcatccatcgatccttaataatcaacggacgcttttgacgccatgcatggcttttgagggattcgatcgcctaaataattggggttcgtatagatctcgatactgccacagattttcctcatttggttctaatcaagaattttttttgtgatgaaaaacagtgagaacaagttgattcgatatgagaatccaactgcagccgaaatatgccaacctaatggcaaaggatatgtgcagcgcaaggttatgggctctgacctataagcgcgtgcacagacgaggtatcggattatatttgtcaatccaacctttgcttttggaagttgataaaaaatgccaaccaaaaacttttgcaatgttctttgtttatactctagctttgatgctccaggtgcaagtgcatgaattcggccatgttcttttctgattctggattctagattttcatttgcacgcttctaaagctactaaacgatacgtttcatataaaatactagagtatgcaaatttttcatgggatactttttaaagcaactttttcaactctatagcagttaatttattcatctgtatatatcctcaaatggttaccataaaaatcaaataatccatcgatttcagttatcacaaacaagggccttagcagcagaatttactagtgtcacaatcaaaatgtcaaacaagccccaagtcctcgcgcatctcttccaccctttctctgtggaagaatgcaaaaggatttggcaagtatatgtaagaataaagcaggggtctctctcactcgcttgaagccaaccttcagaaagcagtagtattttagagggaattcatgtgatacgatgacgaaatttctcacacacgtaagtgacaattcaaaattagttcaagttgttcttgaaagggaaacaattcgttgccgttccaaatattacggccatggtgagctgacctgtcagttttctcgcttgatagcaacgcaacaatatatatgcatgtcaacgacggagtacaaaataatcacgtactcctactaactcttcctctaaagattgtttctcatcttatatttcgaaccttcctccgtttggtcatggagtcacctttcaagtgaccgagtcatgtgaccaagcaatgtgacatttccattcacctagctagagtcaatttcatggctcatataagatctccattttatacccacgaactcttataacactacatttatcccttaatatttgatgctgattagttcaaaacat

SEQ ID NO: 52430 - DNA, 2060 bp, Oryza sativa
  unsure (1)..(2060): unsure at all n locations
gagttgattttttcatggttttgattatagaaaatgagaaaattgtaatattgtgacctaaactttttggatagagggagtatgaccggtgaaatctccaaaactactgcagggtaggagtactcgtagtacttctaaccagcctgaccacattcaaacgcacagtagtacagtacttggaggacattcaagtcacagtacacaaatgtttccagcacaataaaactacttggaacagtactgtgggcagcagctctttgcaggccgcaggcgagtacagatggaccctcatcgaaacgaaacgaaacccatgccaagaacctgcgtgctctttgatgagccagtcattcctcgaggcatcttttcatcagatcagaattcagagcctcgcgagaaagaaaggctggcccaatcctgcagctgcacagatcccagcagctgcagctgtagctgtagtagtagctgtagtcgatcgacagtgtccgagccaatccatcgccgcaaacaagccaaggggaagaaatatatatagccctggccacgtactacgtactagcctctgccgatctgccatgggcgctagtatagccatgtgaccgtgcgagagtgcaagtgatgggtacagacgttgttagcaccaatctgggaggcttatctccaaacccccaaattctctccattccattgccgtccgtcgtgtggctgccgcacgctggaggggcagcggcaatcgctagatttacgagggtcccacggcgcagtggcacgacgacgcagcaccgtccgggattttcaacggcacccgaacctgggcgtatcaatcgctttgtctcccggaaaagagaacgacatgggatcgtattaccccaagcgtcgccgatgatcgccaaaagtcaaaaaaacgtatcaccgtccaccgaccgaaccgaggtcgctaccacgtactaccagtagtagtagtagtagtacgcggactcgcgacaagacagccgctcgggttgtctcttctttttttttttttcttgccgggatgggagcgtgcaccggtggctgcactcaccgtcaccggcaagtagtctaggcgccacacgaagcgcgggcgtgcgtcgccgaaagcgggggaaaaaccccgaaaatacagaagaattctgcgtttcccgcgggcgcgagagcccgcgaccccgcgcacggtgagacagggaccacgaccccgcgcgaactcccccttcaggtggacgaccaacccagcccagccagccgcgcgccggtttgtggctttgccgaatccaacgcttgcacacaccaccgcggcgccgtatgccgggtcccccacttgcattccacccggtcgtcgcgtcgcgtgatcgcgtcacgtcccggcgcgccaggatacgggtgcttggctccgcctccggcttattatttaagcacgcgacgccgcggccatgtctagtctcctcggctgctactactactgnnnnnnnnnnnnnnnnnnnngcgacccactactgccctgcgtctgcgtgtgccgcgtatacgcacaagccaaagagaatttttaggcgggtagaaacaaaaatcagacccagtttcgcgcaaaaaaaaaaacaaagagaagcccgggggtaagagagagagagagaatttgggagatgtgagacggaagcaacaagcacatgagcgttttgtgattaggaacggacaaaacaaggtcataaggcggcctaatcaggattggaggagaggtctagtctccctttctagtttcccctacatgaccagcgttgccaccaggattgccacgctcgtgcgggccgcggcggcggcgagccggccattgcggctccaccgccggcccggcggcgaggatacgaggatggtggtgatcgtcggcgccacgggcaccgggaagaccaagctgtccatcgacgccgccaaggtgatcggcggcgaggttgtcaacgccgacaagattcagctctatgacggcctcgacgtgaccaccaacaaggtgagcctcgccgaccgccgtggcgtgccgcaccacctcctcggagcca

SEQ ID NO: 52431 - DNA, 1096 bp, Oryza sativa
cggaaccagagccgccgccgccgccgacgttgtcgccgcggctgctccggttgctcgcggatgcagtactgcgacatggtggggtgagctcgccgccgtcgccgccgccgcacggagccgcagtcacttcattgaaggcttttgggggttcgagggtttaggccgccaattttccagtgtcccggcggcgcccttctctgacactgctcggtgggcccagaaaaagtagcccagtgacatagaaagaagagacaaaggtaattaacgtagagagagagaagctaagctatgcaactgatgagaagtgttcttcttcattgcagcagaatttgtgtactctttcttggagaggtggtgattcatcacatcgctctcctcctaaccgcggcactgtatgtatgtagtgagtagtactaatcatctaattatccaccgtgttcagaattttgagacagataatgagtacagtctagtatatgatttttcatcagtgtttgttgcagtgcaacgggtgacctgctctatttccggagctgaattttttttggtttggttttgtttgttttgtttgtttaattaatcctcctcctgctgctgctgctagtagtagtagtttgaggtggctaatgccatggtggatgcttgacatgttccatccattttccagctggttgttgttgggatgattggatgggtaatgccacgcttagtgtgtgattactgatcgagggggagaaggattgtgttgggcgtgtgggttggtgcctggtgttcttgctgttgccagctaggaacaaacaaattcgtccccgtctcctactcttttttctttctttctttctttctttctttctttctttctgttttttttcttttacccctcctctccagttttcccgtacggtcaaagagctggaattcagtggcattacgattttcactctcttttggattgttttctttcttgtttggattctacagcagcagtctaccgcatcagattttcagcatcgttttatactgtcgcggacttcaggcattggatactcgcttccagaagtttctggtcatttttttctttttctttttcaaaaaa

SEQ ID NO: 52432 - DNA, 3250 bp, Oryza sativa
tcttttactattatcttaatttttgtaaaaacaaatagtagaatcccttatattcacggacggaaggagtacttccttactagtcaggagggattgaaccggactactacttgtggataacaacagaatgattgacctgcgtttgggctccgtcatcattagctttctgcatttttacttctgcttattgaaaaataataggcccatttagtttgaaaaagaaaaaagaactgacgagcaaatgctccgttatttgatccaataaaccgacacaggagtatacagttttagtgtgctggagccgcggagccttggccaacaattacatattgcttgatccgttcatgcaatagttggaaaggattgtcacaagagtggtcaagctacgctctaactttaccacatgaaggattcagatatcagaactcgtcactgtttcttgacatgatcaaatttcgtactgtgcaatatcacttccaggctttgcctccggcctattttgcaggattgctgtactggatgagacagacaaggtatgggccagactaacgaaagggcctctcagtctcatccccagcctttcatgtactgcaatgtggaacatcaactgtaattacagaacacttgttgtacatctgagggaatgttttgtgctgttcttcccaatccaattgcaggagttagatatttggaagcttaagatagtcaatggatttctaaaaattacaatgtgtctgaaagattggtcaggctatccccttggagtgtgatcttgatgtcgtgtgctgcatgccacacgttcagagaaacattccccatgttggattttttgaaggttctcacatcaccaaatgaggcattcagaaagtacagtaaagtcacatctcgaggatgacaaaagacgttcgaaggataattgggtagggagttggcacaaatgtacactatctcatcaacgcagttctgcactagtttgaacaaacacactctcttgtgcgattacaacaccagcgacatgtccatgaaaaagaagagaacggacacgtccaaaaggcactcaacaatattgctttcgccaaaattcatatgaattaatccagcagatattttaaacatgatcagtatataggtatgctaataattactagtttcagttagtcagtagccacaagaagcaaatctggactatggagaactggaacggctggaagggcgcactgatcatgcatcaagccactcaagagtgaagaacatcatctagctctagccaaacggcactacctgtcaggaacaaagcctggagatactgatggttcagccaaaaaagataagcattttacctgaaaaataactcataaacctaacatggaatttctgaaatttgatgtccacaggaccacagcagaagtaaaatgactacttgtaccaccattctgcgtctgcaagagtaaaacattgacactacaggctggatggagacccgcatcagacatataatgcaaaccactggaaccaaatcaaccaattatgtgcaacatgtaaaattgtaaatcgtgaacatgaagcactattaagttttaactcttgatttacaaaataaaaaatcaatcataggaaatgatcagacagacaaaattgaagtcccagactcacctgcagcctaaaaacaccagggcatactgtcaatcaaataatccaataacaccagctccgaacacaaccgtgcataacttaaaaacctgattaccgactcaccatggatgtcatcagaatactaaattagtgcataattagattgctaagtgagtatggaaaaaggacgcaatgcaacaatcaagcagtctttcagctcctgcatagtgcacacaggtacacaactggtgttccaaatgtcaagaacgataagcagaagttcaaattattaatgcacttagcaaatcgttctaataagcagtgtcaggatatgactagtgaacacttcgtctcctccaaaagtgcaaaacagagatcagacgaaaaacagaagtatcagcattcgagaagcaagaatgatgtgcaccagcttttgcaaacaacagaatattgcaaaatgaacaaatatattgaacaaaggtatatgtaaaaatgaacaactaattctggaagaggtaattaatgccagctaacacctttcttaattgaaaattggcaatgattttgccgttctgttaaaaaaaattaatgcaagctatacttacaagcaggagattataacaaagcgcacccttgataactagtttgatttcctacctgaatttcactagctgagatttctttttctcttttcaaaccactttgttgcaccccaagtacactttcattttcttcggtatcaatgtccaactcaagacatgatatatgccctgcagagaaaccaaagctgcatctttttccctctatctatgcaatgcagaaagtagagcttaatacaaggaaatatcatcctcactaacactacaaaaccacatagtgatatcacagccaacaacttgcagagttgaagcgatttgcaccgaaagaaatatttcacagactgaaaccatgtacataacatgacagctaaccaaacatcacaccacatatgccacagggcacaaacatcgcatacgattccacctttcttctaattagaaaacctattcacaatcaaccataaaatctatatccatcctctgatctagaagaaccaacataattattggatggacatgttagccgtcagaagaaaaaaaagcaaaacatgggaacatctgaaaagttgctctcatttgcagacttcaccgcgctggcgccaatcacctctgcaagaggaaaacacacatgaagaaaagaaccaaattttttgggcgaaggaacacatcaaacgtatcgagcgatatctcacctcctcgacgatcttgtacgaatccaggttcacgtccgccagcgataatccgggatacagccgctgcaattcgaaccaaaaccgaacaaaaattgagcaccccccgatcgagacccaaaaattaggaatcatgaagcgcacgcggaggctccaaaatccttacatcaagctcgagccgcacggcgcgcgggcgcttcttgggccggcgcggcggcgccgtgccgcggatggcgatgaagtcggcgacgatctcctccctggtgagcgcaacggagaagcccctcttcttggcgaccaccggcaacggcgcaggcgggtgcagcagcg

SEQ ID NO: 52433 - DNA, 3585 bp, Oryza sativa
catgaggaccatgagaagaggaaggtgaggtgaggtgggtgcgaggagggaagaggaagaggaagccggaagaaagagagaaggcgagggtgatgttgcgggtcaggttttaaaaaagagagagggagagacgagacgagacgagccgagccgtgggcgtgtgggcgtgtggcgtatgcgttttttttttgggtttttccccgtctccgcgctcggcgcctcgtgtgattctgacggatggatccgtggatgggtaagcggtggcggaggcggtttttgggtgcagcggcggggccgcgattttggtggtgatgcgcgccgcagccgctgcgtgtgcgggagcgcgtcgtgtgatcgccttggggcggcgcgagcagggggcggacggcgcgcggccccgtcggcgtcgtcagaggttcggtggttttcgggttgctcctgctgtcaacgaggtacgattgcgttgcaacagacggttatctgacttattgcgcggattatcttacgtggctagcttctttgtttttattagggacgttcggctggcttgctgtacgtgacgtatatgtttttcttttgaatagcgcttagtgtttcttcttctcttctataaaatacttactgttaatagtttggtatagtgttttctatattgtataaaaaaataataaatcatggtaaaacaggttttcccgcgttttctttttcaaaacaaagtactaccttcatcccaaaataagtgcagttttgcactatttgtgtctcatgtttgaccattcgttttatttgaaatttttctacgattaatatttttattgttattagatgataaaacacgaatattactttatgtgtgactaacttattttaattttctcataaaatttttaaataagacagacggtcaaacgttgaacacggattcctacggctgcacttattttgggacggagagggtagttcacattacaaatacaacttacgagctataatgcctttatttgggtgagatcaccattcccgtaaaatcttaagcaaaatatggtgttctaaacattagttgaggagaactatggcaatttaaagtggagatcaaaatgagttcacggcaagaagctaacaaattaagaaagtacagcgcaccatagttgtcaaggcagacttaggccatgggcaatcaattgggtcacggtctggggccccaaacctgtggtaaacatataatggacaattatagatttttatcgtgtaaaacagatgtgcagcccaacatacataatgggccagccctagccttagtccatgttggtttcgctccctaatggttatgggctatgaatcaaatgttgcattgtggtgttattacaaccattttatgttattagctaaaagaatgtagttcttgttgtaatggagctactactatcgatgtgggtgttgctataatacactcatcgtctcgatgctatgagtcgctatgcgcaacactcgtgatcgtgtcattggcatcacgagacatagggccttttcactttgttgcccaaattaaccatttcaaattttggtaatgccaaattttaccacattttggcattaccaaatttttggtagaactagctttgtttggtttgatgtatttgccaaattttgtatagttctaagagaggaagcttctagaactgcagaaaaattggtaaagtagtaatggttgaagtatgtttaaagtagtaagaaggctaaaagtggcaacaaattaaacaagcccttaagtttttggttctatagtctagattgctttttgaaaaaaaaaatcaagtcaattaaaaaatatgccatgcaaaaaattaacaacaccacacagttttggtgacgacaatatcaacaagcaccttttgtaatttaggtgttgtataagtttttgtaaagaattctttaatttgcttatgttacttttatggaggattgaaagataaggatagaagtcagacgtataaattaaagcttgtaaggatgctagtttaggtaacgccacgctagagatatattggaagcaaataaaagcacacgtcatgtatctaaatgtatcctagagatgtcatccttttttgttctttttcttgtctcgttgaattcaaaggtaagtgttcatcatttccgacctttacaaaagcctaccaagcggacaacacagatgaccgatggggcatatgactatgtatgaagaacgtgaacctttgacaagttttgcctcttttttttttgaaaaatgaagtaatgttttagtgatgccagtttctactgttgtcgagatggtactcattgttacactatatatatactccatttcatagttacaagttctaatggcttgttctgtgaggttagaactcccataaagtcttaagcaaagtgtggcgttctatactagcaaatgtttctttagaacatggtaattcgaggtggagaaataagttcatgagaaccaggctatgttgattaagaaaccgtagtcaatcatggtttgtggccatgaaccaaatgcttcatcacaatgttaagagcaatattcttagccattttatacaagcagtagctaaatcaaagttgttcatgttgtaatagagttacaaccgaaaagatatggatgttgatataacatactcaccattctctggctatgagttgctatgtgtaacacatgattgtgcctatgacatcatatcttaagttttgattgtacaatttaaattgttttttctttaaaatgcaatgcatgaaagatgtggcaccgggcagttttggtggccccaatgttgactcgcactttttgtaattatgtgttacatggtttcgtaaagagtgctttaatatttgcttattttactcttacggacgtctagaagataaggatggaagccagacacgtcaattaaagctcgtagggatttagctcagttaacgccatagataaattggaagcaaataaaagtacacgtcatgtatccaaatatatcctggagatgccattcttttaattccttttcttatcttttagaactcaactcgaaacgtaagtgtttgtcgttccagcctttaaaaaaggctatcacgctgacgatacaggcgaccgacgaggcacgtgacacgcctacgaacatcataaacctgatacggatgcatacgtagacacatttcgtctgatttaatcttatgacaagaaaggtaaatacatgttcatactactcacatgtctcttacatactacaagagcaaatatctccgatcttttttctttaacaaagatgaacataaaaactggtaaacaaaaggagagagagaaaaaaaaaggcaaaataaaccggtgtgggcaaccccttcctcggccaccggatcacaatccgacggtccacacgggccatgtggctcgagaaacggggcaaatcggcgaccagaatccgcgggggcaaccgaaccgaactcccgcacggaggcggcgcggcgcaggagcacggcggagcggagggagtcggagtcgcgtccaaaaccaaaaggaaaccacggcattttcctcgctcccttctcttc

SEQ ID NO: 52434 - DNA, 2148 bp, Oryza sativa
ttcgagctcggtacccattacagatcctgggttttacaacccttttcctttgtcaactcttttctgtagttcacttttatcatttgtgcttgatgtcatagtagcacattgatcttgtttggatgagctcaactgaaaaggagtcaacgtgtcccttggacatttattttttgttgcaacgatggccttgataagctagttgtgggggccaatatatgacatgcgtatgcaatattgtgaatgtgtatatcttatgatggtactcgtgatcctaagtcatgatagtacagaagagattggctaaaatttatgagtgcagacaaaatttaatccttgatcgactctaattagttcactttggactttcggatggttttttaagggagtgaaagaggggcagtttaggcatagtccttcaaacaatttgaatgtaactctccttttttttttctatgctagaaatgtgttttatagctgtctagtgtagtctttctatagatgatattcctacgtcaacagataccctaattgttgcatatgctcttatgaattatctacaatggattcacaattcactctgttcctaaatgttgtttatgagatgctgcttgctaatattctattacatgctcgctacagcggatgaagcttccactagcacaagtgcacaaccgcacccatgatacacagctcttcaactgttcatgtctgggaaacatgtgctcctcctcctcatttcctgaatatttcttctcatattttttccaagagaatatgcgggagagttgcgttatcttggacaaacagatctatttcatttattcagaattaaatcaagcagacacttgctatccctcctttaattgatttcaacggtcctcattcagaaaaagatttagacaatttattgcctgcccatcataattaagctgagatcctgcttccaaacagttctttttcctctcttcatttattctacttttttgctgttttgctgccgatgagatcggaatgaacgattctcctcatgctgctctgcattcatccaaacttccaaagtaacagtattaaagtaattttactaattctttgtttcatattacatgttattttgactttaattaagatagataaagtttatagaaaattttagcaacatctacaacaccagtttagttttatagaaaccaatatttgatacatttcaataatatgatatgtttgttttgtattaaaaattttgttgtaattttttataaacttgatgaaacttaaaaatatttgaatagtaaaaaagtcaaagtgacttagagcaaccatactgttgcaaaaaagtagccttaaggtctttaaggtgaaccataacaattatggtattgaatatagtctaggccacaacaagaaataaccttggtggattagttcttttattatagtgtgctatctttatacattgtgaaaattgaaataacaagagtccagttgtgtgagttctattttatatgactagttggtccatatatattggtgatgtactaacaacgatggtcaattgctatagggtccaccttaatgctatgttgtggcaataaatattgaccttgcccttataatatgaaacggatgtagtagcgctagagaccatttggttaagtttctcatacaccagaaaccaatattcacaattggaaaacccgacacctgggtcggtgcttgcgaactaaatgaatttccaaaaccgcggaccggggaacgtaccgggtgtacgatttcccgctcttgcacttaaggaccgtttccttggaatttcatccgaacataagacaagtacgaccacatgggtggaatgggacacccctggctgagtaactagcttatcgggggagccatgatgctaagagacatgtggattcgccggggtggtgtttgtcacaccctgaagttctcctcctaagcctaaaattgaattaataagagaccctaagaaaataccggtgcaaagcaagagtaaaccctattaaatcaatgcaaataataatcggaattggcatgtggaatttttcttgagttctacatgtcgaaattcactaacaagatttttagtggaattttcagagctctcgaaataattttaaccatttaaaatcg

SEQ ID NO: 52435 - DNA, 980 bp, Oryza sativa
cgattcatggatcgaggagttgccagcggtgctctgggcaaaccgaactacaccaagccgagcaaccggggaaatgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggcccttcgagccgcgcgctaccagcagagcctgcggcgctaccatcagcgccacgtccgggcccgatcactctgcgtcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgagggggggtcgggtgtcaggtttcgggctcgggccaaccccgcacccccccgggcgtgcagggttggccggggcctacaacatatgcataattcttatttttcttacatccgtatttcaataaaagcagtttcaatttcctaaaggctgtgtctgtaccattttttccttttgtagaatcttgacttgaaatagcacgctcgtgctcaatcctgcccttgggggctcgggtcggctaaaatcgccgaaaggggcccagaaccgagccgtgccccggggcgtgatgaactccggggggggaatcggcaaaaacccacaatcgggtcatccataaccctcggtcaccacgctcccggcctggccagtctcgacatgtggatctccccaggcactagctccggcccgcgccgtttgaggactgggacccgggcacgagcccttgttcaagccaagacacagaaggaccacggcacagaccatcctcgtctcatacacaca

SEQ ID NO: 52436 - DNA, 1032 bp, Oryza sativa
aaaaaaagttaaaatacattataatataaattggggttaataaaatatatgtgcatttcacttcacgggccacttttaaagcccatgtatgtcgaccaaaacgtcatggcctacttctaaagcccatataatctatgtgataaaaagcataccattggaaattatgtgtaccttttaagcgtttttttactttaattaaaaaaaacagtactccaaacgaatgcaactcattgcttattaatttcgatttttagaatcattaaattataaagataatactaaattgagacccccacataagaccaaatttgtagtgattaacttcgaattttagaattattaaaccaaaaaaaaaagctatagttgaaaattgaaaccaagcattagctcaatatttattaattacgaattcataactattgaatcaatacgatttaattgaaactccaaactgagtacagcttgatatatttattaattataaattttaaaattatcatatcaaaaggagctaaaatttaaactccaaactgaaaacaatttgaaatttatcgattacgaatttcagaattatattgatactcatgaaaaaagatgaagttgcatcttcaaaccgagtataattaggtactgatttattccaaatactatatcgattatgtgctgtttattgatgatttttttttcttgcgcgatgattcgggaatactggtgggcatcgaaaacgtgcgtgctgatcaccccagttagttgctttcgcctaccaaaacttgattgatgcatacacagcaaaaacatgcatccaacttgccaatatgtatagacagtatatagtatagaattggtcgtgacgctgtgacgtaaccaatctcttgacagccctttcccctcatgaaacagtcaaggaaaatttctggttttgcatgtgcgataggcggcggattttcttaaccaaaaccacttttcggcaagttgccaaaaagaacaatattctcccctcgatggatcgggacagtcacaaaacttttatca

SEQ ID NO: 52437 - DNA, 761 bp, Oryza sativa
  unsure (1)..(761): unsure at all n locations
nnnnnnnnnnnnnnnnnnnnnnnnnnnnnnnnnnnnnnnnnnnnnnnnnnnnnnntgactcttttgcccccctcccctccccttcccttcggatccatccacgaaaatctcctgcccctgcgattccaccgcgccgcaccgatggcacgaaccccacgcaagcgccgccgccgccgcggcggagggggccacgactacctcttcggcctccccgacgacgtcatcctcgccatcctcttccgcctcacgacccgccaggccgtcacgctcttcgccctctcccgccgcttccgggtcctcccgtcccagttcggccgcgtcgactccgcgctcgtcgccgacccggccctgccgctcccgtcgctccccgcgcggccgaccttcatacgccgccttttcttcgccccccagacccgccggttctcctcctccgcgttcggccgcctcctcgacgccggcgccgaccgcgggctctccgagctcgccgtccgcctgccccgcagcgcgttccttccccagaacctcctctccatccgctccctcaccgtggtctccctcgactcctgcgcgctcccgcgatggtgccccgccgcgtgccctggcctccgcacgctcaagctccaccacgttgccatcccgcagcggatgatcagcgtcatcctcaaggccgcgcccgtgctcgagacgctggagatggtgtactgcatgggattcgccggcagctgcagtatggagtcctccacggtgaggaacctcctgtt

SEQ ID NO: 52438 - DNA, 1325 bp, Oryza sativa
cccctcatagaaatcaattacctgccattgttatgagcatatatatgctgctgtaaattttttatgtacaaagaagaggatgttagaccaccctagcagcttaccatcctggtattatggaagccaacttgaccgacatccatggatggggacttcttgagattggaccagggcgtgtagaccacctcaacattgttcatcttgtttcctgcacgacaagcacatgcaagctgcaaatatcatccagtgatccaagacacatactcgtcacgttctaattatcacacaatcccctcacataggccaaatcaacccaagcggataattgatccaaggggcccactgtagctagtgccaataatacaagaagctaaaagttgctgaaaagaaaaaggccggggtggaaaagcaaaaacaaaattaagattcctgtctgtaaccagcaatataatgtgatgctgcagctttgtagaattgtaggccacacgaatatccgacaggtcacaccatgctctatttcctctatccgtggataacataattggaggtgcaaatgattatcattatttgcaagtaaacgtttccttttcttttgagaacctgcatctatccatgataaattcttcgtaactgcagaatcttttgtggtaaactgtatctaccctacttttttgcacgagtgaaaatttactagttgatcgttagaaaccaaaagaatctagccacaagcacacaaagcagatggtggaaaagaaagctaattaagctatgcgctacctctacactcaaatgttgtctgaaatgagtgcgtaccttgaatggaatgagcctttacaagctgtgcacagtcctccagcagaccgtcgcagatgctatctatcgactcgcctttcttgagcctcaaatagacgtgcgccgaggataccttgtccacgtggaacctgacgggacaaaagcaattttccttgtcgaaattagaagggaagaatccactttaaaccgacctttccatcaaaacaaccagccggacgtctatatatatcttagatcttacttctaagaaaattcctacagcactatatagttcatcttaacatggatcggaataaatatctctacatgtttcagatgaggcgtaatttgacgaattaagcagaaaagtacttttaagcattggaaacccaaggagatcgaggtgaggtcccctagatggaggaagcaaacaaaaggctgcggtagtggccacagtagtagttctgtagtagtactagtgcggatggcaggcgatggctacagacagagttgcaacttgttgctgagcatga

SEQ ID NO: 52439 - DNA, 1228 bp, Oryza sativa
acccaacatcgtgttgacccgagtaattcccctgtaacacaccgccccgcccgattggtggtgcggaaaagccccgtacttttgcgaaaacgacgtccgtttcgacccaaacccgtcgcgtgcgcgcggctctttgttctctcggtgatttccgtgcggaagtcgcggttagttcgttgtaggtgacgacggggttttcgcgcaagaccgccgagacgaagtaggagatgggccacgggaatatttgggctgtgcgctcgcgagcgcggccgaaagatgcatgcgaaaagcgggggcccggcccgcgtatcgaaccggagaaaaacgaccggacaggaggagacgtcgacgagagagaggatcatctatctgaagctgactcatcataaggcgaccggcacgcaacgggacaccaccgaccggccgtctttacgcgagcggctgatatcccctagatccgtgtgagctgctttatccgctgccaggcttagcttcgtcaatagagaacatatttttctcattttttttagacaataacttatttttctcatgtcgtgggaaaattatgggaacgggaaagacaagagaatcgcgtgccagtagctcagaagatcggccatcaattgcgtgatccacgttcaacgggggggaaatcagaaaagaggagaaacaatcgcgacaaagagggggcgccaaaagctaatccattatggactcctcatccattggcgctgctgatccagcacaatcagtgacaaactgacgatgatcgtgacatacagtggagcttccatggcgtcgcatcttaacccatattcggtgattacataatatctcatgataaaatatagcaatgttttttgcgtgctattgcaaaagtcagcataatactaaaatattagcttctgcgagtgcaatggagacttggagagtaggacatggacactcatgctaattcaagtcattttgtcaatttgatccttcgtatgcagggaaacttcgaactgttcttacttatatatcttgatatctgtacagctatactgattgtcattatgtaaaaaaacccatgttaatcaaataaatagtaaataaataaatctagtcatccatttaggcgggatcaaattacaaaggcttagattagatgaagagtatatgccactagcaaatggctagttactgcgaagtattacaaagtttgggattaaattagtaaggttccaaa

SEQ ID NO: 52440 - DNA, 1703 bp, Oryza sativa
  unsure (1)..(1703): unsure at all n locations
catagtgaacccgctaatcaggaaatgtgttgttctgtataactttcagacattaagctttgtagtaggttagtaatactcgtattctcctatttgcaatgttgcattgatgtttaagcactgttcaaatgacacggtgttgataaaatgcgtttttgatagatattaacatgaagcgataatttatatgtcaacattatatgcttatagcacagatagctggagtgtaaatcacacaactgaacatcggaatgtgaatatggtctaacacatgtgtaactcttgctctttcagaaggtcatttatctttgtcttattttgtagttgttgtcatctgaatataaagacactccaaacttggctgtacaatttgaagacttgagaatactgtcagtgagcttggatttctcaaatgaaagagaactcatcttccttctgaagctgcttgagagttgccccaacctgcaacagttgactctttcggtatgcaatatcacccattcactcttgcattcacattagcatctttactatattgagtttcatcagtaagtttaccactaatttatctacctgccattcatgcttaggctgttgatgcaaaagacgacactgcattgccaaattttgctgatcatgaggagaggctttcaaagttatcatgcctaactaagagtttggagcagctcaagtttcttggattcaggcctcaacggtaccagaaggaactctttatctttctgctaactcaagcaacgaacctgaagaagatggcggtggagttcccgaaagaccaagaagctgctgtgaggagaattttgtcagtgaggaaagcccccactcagaagaaaactaccaagtacaaacaatactacttggagttagagtatcctgtggagcccaactgctcatagggctctcaagtcgctacatgactggtctctcttggacatacattcactccctagactttaacccttaagttgcaattctctntacagagatcacacgccggaaaagttcttattcattggcttcaggatgtaacaaaacatttgagatgctttattgcttcgtgcggtatgtaattttcaattttttgtgttacaatgttatacagggaagtatgagaatacatggggttacgagtacttaaaacatgcttgtgaggatgatgaacatctatttctgctgccaattactctgaagttctgccatagactgtgtgctcaaatttgccactccatctgtgcattgtccatgtcaaaattggaaatagtgcagatgattaggatacactgttgtttgtgtgaagggcagagaaaagaaatggattttggagcaattgttcacctgttggaatcgtcagatgggacttggagctccttttctgaactgaatggttcgaaaagacggtcgatgtcctcgttcttgacctcctcaagggtagcaggactccactgtatcgcaacaaaaattaaaaaacagtatgaaaaataaaaatttctagacatgtttaagagtgtgtatgagagaaccttaggggcattgtctttgtcgatgctgagagctctaattccctgccaagttttaggtgcaaatattatgatgaatgacatcttagtcttgcctgtatcaagaatcaccgttacttattcatatagtggcaaatcacagtacctcatagacatcgccagtaacta

SEQ ID NO: 52441 - DNA, 2614 bp, Oryza sativa
  unsure (1)..(2614): unsure at all n locations
agtcaagcaccagctgcagtgacacacctacttcaaccgtcgatacagcatcgtaatatacctatgccgtccgtttagccaaccgttcatatttcaaatggcgccgtgcctttataacgcgaaggcaaggaatttgtttcccaggaaaggtgatacgagcatatgtacctggcaatgacggcggaggctgctgttggcgacggcgcctcttgccgatgaagaagtagatcagcccggccgcgagaccgatcacgaccaccgcggcgacagccacgcccacacccactgtggtcccgctgcttttggatgatgaaggtgagggtgacgtcgttggcgcttcgacagcctgtggtggtgggggtgatggcggcggaggtgaaagttttggacctcgggtggtgaagggcttgcaataggcgaaggtgaagacggtgttgcactcggcctcggtctggatggtggtggtggtgaagggttcacgggagaaagaggtgaagggctcacggaagaaggtggtgagggaacccccgaagaagaagaagaaggaggtgggaattgcggattaggcctaggatttggggaaggtaccggattcggagtaggggccggaccaggtgctgggactggggcaatcactggagaagcgggtggtgaaaaaggtggtgaaggtggtggtggtgnaaatactggaggaggcataggggggtccaccggaggtggagnacgtggagctggagcaggcgtggggggaatcaccgaaggaggagatgggggatttcctggaggaggcggcggtgggttctccggaggaggtggtgtagggttccctggaggaggttgtggtggaataaccggaggagacggtgaaggtgttgttggagtagacggcggaggtgttgttggtgacgattggggcggatttgctgaagaaggtggctgtggaggccgatcagggggagctggtggcgattggggcggatttgctgaagcaggtggctgtggaggccgatcagggggagctggtggcgattggggcggatttgctgaagtaggtgcctgtgtagtccgattagcggaagcaggaggggtcggcgacgggctggacatggttgcgcggcgtgcaagtgcaacgtacgtgcagctcccagcgtgatcgctaaccgaccaataggtccaatgctaatgggcaagaagaggagagagcatcaagagcttatatatacctatgagctgtacgcagttcgccacgaggtggttttctctttggccgtgcagatcttcgtgtcgcttgcttgcttcaattttcaagcgacgtaagcaacagacgcacaggcgaaacttggtagtatccatgaaaagactaggctactcttcttatttcttttgccgtagtagctatcagtgttagataagattgaccgtgcaaagtcagagttcgattggattgtgcgaggaatagaaatggcactaaacttgctaatcatgaacttagtcatggatttttttatgcaagtgtagcattaaccacgaggaatagaaatggcactaaaccgctaaacatgaacttagtcatggattttttttttatgcaagtgtagcattaaccaggtagacctggtcagataccggcagagcacttgcgagccaatgatataggttgacagcttaatacacaaaatgagggtgacctctgtttttttctgggcagtggcttcgatacttgtatcaccattcatcactagacaagtatggccagcaatcaacctgcaatattcagaaacaacgtgtccgctcatgttttttctgctcggaagttcgtcagtcgtagctatgagagagagattcaggattttgacatatgaggcagattttattttcatttgggtgccactatgatgacatatcaacctagactgacatgtcaaaagcaatttatgtgattatttggtactaagcataagaaccgcatgtaacatcagaaggaaagagtaaacccagccacatcagttatgttaattccattttagaagctcagaacaaaataaaggaggcagcccatgaatgatgaaggttcttaagaacttcgaagagacaactaaagatcaagcaaaaaatgcactaaaataaaacacggtcactgtgaagttatccacaactggtaaattgaaatagcaatttggtcactccatcacccatagactttttgagtccatacttcattatacacgccagcagtaagcaggaacacatcttggaagcaaaaaactaaacaagaactagcaagtttcatacaacgcagtagctattggagtggatgagacggtgacagtttagttatataaaagaaattaaagatatcaaatgttcaagttgagatggttacaatggttttctaataattggtgcatggggtgacatccaaatacacgatgttttaaaacaatactctagccttattaagtctaatctaacatatatacccagtagtttgaaggaggctataggtacatatgatatgataatggtgcatcagcaaatcgaccgggtgatcaaatgcaaatatatatactccatatataagcagcaaagattttgaagttgctagcataccatc

SEQ ID NO: 52442 - DNA, 774 bp, Oryza sativa
caattcctttggatttgcagcacctttccaacctagtcacgattcccagcctttcacacaaaaactactattttcttggcccaatcggcaatctcgaatctcgaccccactgatttcatcatcggtgaaactaaccggatcccctttagactagccaaccctaacctgggtcactggaagaataccttcaagtcttggccatctctcgaaaaacctactcctgataagagctggaccacctggtaccaacgcgtatcggctagtaagaaagttcactgggatgaaattggaatcggccaagcactcactctcaccatagccaattctgctaaggatgaacctctgatggctgccgccacctacttctggtccaacaccatcaatgctttcttattcaaccaagggccgatgactccaactttaatcgacatcaccatgattactggattagatgtaacttcatcggctaaccctatgagcatgaacaccaagaaccaattcgacttcaagaccaaaagcataggtgactggtctggctatgtggcggcatatatgggccaagggtctgttacccctcgagagcatgtagctttcttgcttatgtggctggaaaaattcctcttctatggatccagttgtggccctacaaccaactggcaattcgtaactgaagccttagaatcaaagaaagaatttcctttgggcaaaatccttctcggctatctgtaccagatgttgaacaatgcatcggcttaaatatccggcggctcaata

SEQ ID NO: 52443 - DNA, 1360 bp, Oryza sativa
ggtggactatctccccctttcatcggctaccatgccccccaagacttcaactctccttcaccggcctaactagagaaccagccgatgcaagcaagaaaaggaaaaccagatcatcaagcatgagtaccttaccctgggctccaaagaaaaagaccaaattcaagaaaactcaaccacaaccaactgatatgtcgactaatgatctgcccgccttggatccatctattgaacaagctttagatgacgaggaaattggtgaagatgttgatcaagctgtagccgaaatgagtgacacagaaagaacaccatcggcttcacccaagcaaacgcctccaactccttacgcccccgttcattttacaagagtaagtacctctctctgacttcttctgaaattacctcactcttcggctaattacccatagactttgtggttgcagaagaagaaaactgctgtgaagaaaaaaaacagcagcaattgttaaatcggctccaccagtaagatgtccttaattcttttacttaatcaatctcaactgattatatataacacttgtctatttcgtagcctcctcctacttctcctcctatacagcaatcgtcaagtgatcagactccatcggctgtggggagtcatcacatcgaataggaagaacaaccagctgctcctgctatcccagtaagtttccctttgtctcaacaattagatcagctataatttacccagctcttattctttccgaaattgtctctgcaggctctagccgatctcttctcttttgacatcagagattaccttgatgaagcagaagaagacacttcaagcaaagccctagctcccctatccgatgatgtgagaaaaacacttgaagacatctctcatcggctagcagcctcttctttagacagtttggtagttgaccgtgggtcaattaggacacggctgtatgaagttcaagctctgattcccgaagatctggccgatgtcctaactctagccgcttatctcgagcaacatcagttcaagctggaaaaagccaagctaagactagccgaacgccgtgatcgcaaagagattaaggccacaatccaaactaatcggcagcttgtgcatgaagaaaaaaccaaacttgatcagctatctgaaggtctgatcaaatccaatattgaccggctcgaagctcgcaaaattgagctcttggcgcaacttgaggaatgcaatgccgagctagatatagaacacaaaaagctagccgatctcccaaaatcaattgaagaacaaaaagcaaggctcaaatcggctatcaagaatgttgctgacttaaccaagtctctgaaagtcatctctggaactgatgct

SEQ ID NO: 52444 - DNA, 1276 bp, Oryza sativa
tcatgcatcggcaatactagccgatcatgcgttaacccaaacacttgggtaatatttcttcaaatacttgccattgagtgctcgcccatagacttcactatcaagcccttgcaacatatatgctcccttggacacaaccttataaatttggaacggtccttcccaattcggcgaccacttgccgaatttactatcacgagtaccaatcggcaaaatcaatttccagacaagttctccttccgaaaaatccttaggtaccactttcttattataatgccaagcaatacgttcattatccttggtaacctttgcaagggctcgcaatcgtgtctgaaccagatcctccctctcatcggccataaggttgtaatactcatcagctgttaaatcgttttgtgattccattcttagagagccaattgtaacctcccatggcaaaacagcctcatgcccataaacaagtttgtaaggagggacttggatcgatccatgacaagccatcctataagaccacaatgcttcggccaacctagtatgccattgtcgaggataatcagaaattttccgcttaatcaatttgatcaaacttttattaaacgcctcggcttgcccattagcttgtgcataataaggtgaagaattcaataatttgatacccatgctatcggcaaactgaacaaactcgtcagacacgaagattgacccctgatcagttataatagtttgaggaataccaaatcggtagattatatgttcttgaacgaattgaattgcatccccagaatcaactttcttcaaaggaatcgcctccacccacttggtgaaataatcagttgccaccaatataaacttatgtcatttactcgatggtgggtttatcataccgatcatatcaattccccaacctcggaatggccatggcttaataataggattcatagccgatgccggatctcgctgaattgccccaaatttctgacaatcttgacaccccctataatatctgaaacaatcctccagcattgtcagccaaaaataccctgcacgccgaagtaaccacttcatcttatgagccgattgatgagtaccacaaattccttcatgaacttcgccggttgcaactttagcttgatcggcacccaaacacttaagtaacactccatcaatcgtccggtaataaagctcatcatccaacagagtatacttcaatgccttatatcgcaatttcttagaagccgattgagacggattatgcaaatactgatgcacatcatac

SEQ ID NO: 52445 - DNA, 2200 bp, Oryza sativa
agtttccgctagatctgagagtaacatttcctggttgcgcgtctttacaaccaagtcatcgacataagcctcaacattacgtcctaattggttacccaaagaaattcgagtagtacgttgaaaagtaggacctgcattctttaacccgaagggcattgtcgtataacaataagttcctatgggggtaatgaacgcagttttttcctcatcctccctagccatgcgaatctgatggtaaccagagtatgcatatagaaaacacaaaaggtcgcaccccgcagtggagtcgacaatctgatctatacgtgacagggggtaagggtccttaggacatgccttgttaaggtcggtgtagtcgatgcacatccgaagcttgccgttcgccttgggaacgaccaccgggttcgccagccactccggatggatgacctcacggatgaatccggcttccagaagtcgcgccacctcctcgcggatgaaggcttgacgttccggggcctgccgccgcactttctgccggaccggccttgcgcccggccgcacggcgagacggtgctcaatcaccttcctggggaccccgggcatatccgccggtctccatgcgaagacgtcagcgtttgcccgcaggaaggagacgagcgcgtggtcttggacgggccgtcgcccaaggcaacctccttgaccgggacctcgttgcctgtgatcatccgctgcctcggggtggcgggggcggaggcgccaagcctctcgtcgccaccctcgggctcggatgcagcggcgaggtggtccgtgcgctgctccagacaagcgagcgcgactttgaggtcgccatggacagagatggggccaccggggcccgacatcttcatctgtaggtaggcgtagtggaccgccggcatgaacttcaccaacgcgggccttcccaggaccgcgttgtagggcagactgaggtccgccacatcgaagttcacccgctccgtgcggaagttggcggatccaccgaaggtgaccggtaggtcgatgtgacctaacggccacgtgtgccccggcgtcacaccgatgatcggctgggacggccggagcaccatccccggggccttgattgcgtcaaaggctgcgggggaaaggatgttgagggctgcactcccgtctatgaggacacgcctcaatttcacattgcaaatggtgggggaaaccaccatcgcgatctgtcctccccgggcaacgcacggcgggtggtcggtctggtcgaaggtgagggccacctccgaccatcgcgcccgccgcgtcgcctcatgggtaggggccgcggccagaagctctcgcttcacggccttgaggctccggcgagaagcatgagcgcacgctcccccatcgacggtggcgacagtagcctgaggctcctggaaccccaggttatcgtcgccatcgtcgacgtcctcggcgggggccttctgcttggcctcacctcgctggttgccggcgggggccgccgggaccttgccctcacggcgcttctgcctactctactcctactacttcctcgtccgctcagccaaacttttgaccgcgcggcagtccgcgaggtcgtggaaggaggagttgtgcacggagcaccacttgccagtcgggcgctccctgctgggagcaccggcctccttatttctgtcgctcgcaggcctccccttttgggaggcccaggaagcgccctcgacggccaggacgtgcccctcgccgtcgaaataggccgacctcttcttcctactccagtcccgccgccctgaccgagcggcggacccgttggcggccggagctgccacaccggaaccagaaaagttccaggtccaggcctcctccttgcgagccacacggtccgcaagctgaaaaagctccacggaggtctagggctccttggaggcgatcttttcgagcatgcgattgtgccgcacgccccccctgaacgcgtagatcaccgcgtgtgcggggatacacggtatggtattgcggacttgacagaaccgctgaatttacgagcgaagagactcatcgacccctatttgtaccggatgcaaggtcgatacttcaccttggcgcggatatgtgccctggaagttcatggggaactgctgacacaaatactcccaagagtgtaccgacgcgggtggcaagctcctaacgggagacctcgcaagcccccctt

SEQ ID NO: 52446 - DNA, 1443 bp, Oryza sativa
gtttagcatgccgcacatctgcccttcttcatacagtgacttccttgcaatggttgcgatgaagcctggcatgaatcgagtcgggactgacgtgctaactccaggagttaccacgccggctccagctagggacgagtgtcaaaaggctctcatcattccgacgggacggggcaaggcgtgtgacaggccgcatgctgccacctaacccgcgatctgaccggtctgtgaccggtcacacactgcgaccggtcacggaccggatatgcgtgcgccgtgctgcattaaatgcggcgtggcgcgcttgtccattccgcaataaaagtggtttggtgagcgccgctgtgcccacctaacccacacccgtggcgccaataccacagggggtcagggcgccccagccctcggggccgaaacaggagcggctcgacccctcggggagacagaggagggggtgggcacgtccccctcgggcccgaccccccgagggggtcaggccacgtgggtgaccgcggctgcccaagcctctagtcatgatactcccggtcccatgtcaccgacagcgacacgaataaccattggggatggcgcaatagcacgcttttgggagtcaacctgaaagtgtggacgccaaccaaaggacgtgttgccacaggtttacgctatctccaaaagaaagaacagaaccttaagagaggcgattgcagatgatacctagtcgcaagacctatacctcttgatcctaggagcaatgataaccgagcttctagactagctagtgaccctctagacaacagtggatagtgtgtagctaaccctagatgtggtagatgaaatcacctggaaactcacaagtcccggagagtacatggtaggctcagcctagaaagcatagttcctcgaagccatcaacacgaactacaatgcgaacatctagaagccatggggaccaaacaaatgtaaaattttcgcttggctggctatccaaaatagagtctgaacttcaaacaggcctacgacttggggatagcatactgcacttgtgcagagacgcacccttgagacggcggttcatctcctcatggagtacagatacacctggataatttggggcatcctaacgaattggatggcacaggagtatagcaagccgaccagctagaacgccgccacattagtccatagctggtggacaacgatggctagcaacctgggacgcccaggaaaggaatccgcattcttctcttactgagcatatgggagatatagaaagaaaggaacctgatagtgtttcaacacaaagaattctcaacactaacccacgtgagaggctgccaaaactttaagctctgataggagtgaaatacctagcacagatcatcccataggtttttctttttctgtaaagttttgacttttgcacattttttctcatcctatattcaa

SEQ ID NO: 52447 - DNA, 1016 bp, Oryza sativa
tcacgtacggctaaaagtcgccgggctcgccgggcggggcaccgaaattccggtgtcgcactgtcacacccgcccgccacgtctagcggaggtccggctgctcagcctatccgtgccggccgcctcgccgctggcgccggccgtcatctgcacgtccaccgtcacctacccggtgtcggcgtcggctgcgctggtggtgtactaggtggacgggttcagcccgtactcgctagttggctcgctgaactcgctgatcgtgtactcgctgacggtgcccgtaccggtggccgagcccaacgccatcttcctgagccgcttcatctggtccgtcgtgccgacgctcgtccgatgcatcgcgctctgcccgggcgtcacgccagcgttcaggtgctccgccgccagctcgccctccaggtaacgcacgatctgaccattcgagtgtccacattttcagtgtacaagctacggagttgctgaaaccagaagccgtgcggtgtgtgctgtgtgtttgtgtttgttcagtgaaggtgtgaggagttttggcaagaacctggctcatccgcgggcgagaccgcgcggtgtggcgcacggcggcggtcgcgcaggcgatcagccgccccatgtcgtacgcgtcgtagttgttctccagcctcgggtcaaccagctcctcgaagttctcctcctccacagctctcaccagcaggggtctcgcctgttggacacacacagagatgactactttcaccggccgtggcaaatggaaatctacgtgttcggttcaagactcggaagcccactcacccaagaaaccaatgtgtcaggctggtcaccgtgagacaccatgataggcttcttcccggtgatcagctccaggagcatcacgccgaatgagaagacgtcggaacggtcgttcactttgcccgtggcagcatactctggagctaaatatctggagatacaagttgttgacagcacaaagtttagtccgcgtggtgcgtgcactgaggaacttttga

SEQ ID NO: 52448 - DNA, 1642 bp, Oryza sativa
gtgccatgccagctgctaggatcagaacgcccttgaaacattttatgcatgataagaacgagacagagtatcaacatggagagatcttctcaaggcaaaatctgctcatagacaagctgaaaccttactttgccagttctattaactaaaatgagttgaggaagctaatgtgacggtggggaaaatctgaatgaacagccagccaaaccatgaaaaactctcatttctatggctatttacatttgttaatccttaaagccttacccagagttaattctaatggataaacgcatactgtgcactcattggagaaccatgctacattcacaggtaattcccttcttttctgatcactaaagtttccttgaagtaggaattacatatccatatttgtaccaacaacctgtcagaaagctactagatgccagtgcacaaatgacgcattggtaaaattctagcagattaaacagactgaagtttccacatcaacggtttgtcttctggttaaatagggcttgacttgagggcctatacatcgatagattagtaaagtcagtttattagaagtatgtagaggtagaaacctatgaattttaattgaataacgtaatactgcaagtaccttgttagaggatgtaacggcagtcctccattgtggatcctgtgtaggggatggtctatccctgaacaaaataacaactcttgattgtgtgggcctttctactgtctgccgatgaggaatatctttcatgacccatagaacaaatcctgacggtatggatgatcctgcaagagtatccgaagtaaaattaacaagtggttgtgccatctctctctctaaaaaaaaaagaggcttgccaagtgctttcttgagaatggaatattatgttcgcaataaacatgagaaaatatcaacagaaaaaactattatacaacatgcattctgattccagaattattttgattgattggatgcctagtaaagagttaatttttgtgactaggcaattccactgttgcagttcaatgtgtgccgtaaatacaccatgcaactaattatttttctaaaatcattcactagtttgatggtgttgctccctacagttgagttgcacaacattcactaagtatcaggtagggagaactaagaatccaatttcaaagtggattccataaatataagaccgaaaagaaatgtaagttctggcatgactgcaatatatcaactagcagagtttgagtatttcaatctggtactacacatagaatcattagatctagcctagcttcaccctgggggtatgagaaatgaaaggttggataaataatttatccacacctaccaccacacttactcatttcactaacttattgtattaattcccacatatggttccatgttggagcatgctcacatgcattcaccatcaggcttcgaagcatgtgcacataataagcctgatggcacaccacatcctaccatattttcccattgcaacatgaactacatttaataaaatgttatcgttcaatttaagaggagttatttctagccatagatggtggagagatacctatgaaatagtacataaacaatatgatagcattgttgatgatgtattcatctgctgagtaccaatac

SEQ ID NO: 52449 - DNA, 973 bp, Oryza sativa
cgtggggagcacgtcggccattacgccgacgctcgatactgatgcgggcatccggtttcccacgcagatcttcccgggtcggagccattgacgaaggagtggcggccgaatggcgaacagcggctggcgctcgccgcgcccttcgtcttgacgatgcggagccggtggcagcagcaccagaggccttggtggcggaggactgcccaccagcatctaggcgctggcgtgcagtcatgcccaatttggccacatcgtccagccaacgttgggctggagactccgggtcatgggcgacgggcgggtgacgtaggagcgcgcccgcagcttggagcgcgccctggggcgtgctgccgttgccgtagacgaggaggcgacgctcctcatctcgccgcccttctccacctcctgtggatgtcgaagtcgcggatccttcggccctctcaagtgccttctcccgcctaggactttggcgtggaggtggcggtggagtacgagctcgacgacgtgggtttggctccccgtcgtcaccgctcatactcggggagaggtcgtgcgcctttgctggctcggccattgggctgaacaggaaaagcttggcgcacacgaaagagtgcgagagctcagaaaatccctcgcagagtcccctacctggcgcgccagatgacggagcgtggggctcctcaccgggagaccgcacaggcccccctttgccggttcggccggggactcagggagagattctaagctctctgtatgtggaaggctcgcgagaccagaaacacacaagacacgggcgatgtatacaggttcgggccgctgagaagcgtaataccctactcctgtgttttgggagatctgtgtataaaggagctacaaagtatgagccagcctctcccttgttctgggtttctaatctggaaaaatccagttccacatctcagtgggcaaggtcctccttttatatcttaagggg

SEQ ID NO: 52450 - DNA, 909 bp, Oryza sativa
  unsure (1)..(909): unsure at all n locations
ctcgcgttatcactgttttatttagccatgcctatttacctttgttatgaccttattattattgttattgttattattaccttgttcaccctagaataaacaaaactccaactagtgggtactctatttatggttccactagtatgaacttaagtagatgcttcgctggttaattatgcaacattaggtggttttacaactctaaactttgggaatgttcttatcacctggacactatggaatggtaggattattgtggaattggattcacaccgccccctttattcaaaatcctcaaaatggttttaggctgggttcggggtgcatggttttgatagtagcaccttggccatataaggaccggtcttcaggcctttattgcaaagcactaccatacttccacatgtctagtgggtaaggtttagtttgtggctcagtctggttataaacaaaagtacaccgatggagatggacgaagttgggggtcgatggacatttctaggacaaatgaaggctacactagctgcggcccggtagtcgagatgtcatggcacagggccggtgtcctgctgctaggggctcagtcgtgcctacctgtcccgggggttcccgtcgtaagtggggttgggtcggtactcttgtctatgactaggatgggttggaaactatgtcacgtcttccgtccgtataccgtggtggtatgtggcacgtggctacacgtgaagaagatgtgttttgtgggtaaagatgtacacctnttgatcagagtataatctatacgaatagccgcgccctttgttatgggcaagccgatcactgtacccaagttagtgttgtaattcttaaaacctgcttaactactaaaagggggaacggatggcctgggttggctcgggacgagctgggacc

SEQ ID NO: 52451 - DNA, 1042 bp, Oryza sativa
  unsure (1)..(1042): unsure at all n locations
agtactcaaagttcactcgttcacattttgaacacttccatcaattcccgatcgttttctgtccaccttagtcgctattgacccatccacgcacaccatataacctttctacccctcattgcctgcattctacttggacctctctcgccggttcggagacagcgacggagccccacgcggcgccgttgtcctcagccggcagtgtaggttccgggagggcggggtggagcacgaggcggcggtgcacgccacccgcggcagtgacaacggtggcgagggggaggtgcgggtcagcatcgatgggaagagagtggctgaggtgagctgtgtagggtggggtttccgcagcaaccgcgccaccgtgctcactgacgttgagatgatggacgtgttgtgggacgtgcacttcagagacatcccagtaagaacaagatgagagatggagagagatgggtgaagggattgactgacatgtgggccccacctgtcagtgggtcctacaatctttttaatgacaaatgggtcccatgtatattttttaattctgatattataaatgggtcccacttatgtgatgtctgatatacaagtgattatatagtgataatgcagtaatgtagtggagtcatgaaattggtgctttttaggttttgattgagccaatggggtgggcagtttttggtgcacccatgggttgccactactgttatttctatgatgcactgcatattacaatttgattagtttgtgctaagttaatgaaaacaattattttttaatgttcattatgcaatgaacggtttttttccggcacaattaaaattaagttcacccattgcaaagcacatgactcatactagatatcttaaagcgcctgcgtttgccgctcccaaagcgatttggctcctgttgactaatccgcttgagacacctcgctaatatggattgaatatggttgggttttagatnnnnnnnnnnnnnnnnnnnnnnnnnnnnnnnnnnnnnnnnnnnnnnnnnnnnnnnnnnnnnnnnnnnnnnnnnn

SEQ ID NO: 52452 - DNA, 779 bp, Oryza sativa
  unsure (1)..(779): unsure at all n locations
atggacgtaatatgtgacatgtagaatttttcctctcctctctccgaactagtgcagaggagagagatgtgcaacttttttatttttattttatttttttgatatttttttcaccttagaactccaggaccaaccatgtaaaaataaaaaaacctttcccaaanacggggacggaannaatttaatttgtggcatgtgaaattttccaaagctctaccgaaaaacttctctcctcgaaaacacaatcttgcaagcggaatttggaggttttaatatcgccgaacccagcaaagctgaggagaatcggatgtaactttttctgtagatgtccatgcatatattatttgcctgattccgagtccgtatgagaaagttacgcctattttaatagatgacatattttgtccgtttcggtagagttttggaaaattctacatgtcacatattttgtccgtttgagtttattttttatacggttggttcctatgttctcctaagtgtgaaaaaaatatcaaaaaaatgaaacaaaaataaaaaattatatctctatgtactgtttaacttatatatgtcatttaatgtggttatattttgaattagattaagtaatttcatatagtggtagagtgcattatgtttaacatgctgatcaaagggttttactaaaggagttatggtctaattttagtgaaggtgcaaagtagactaagtgggtatgctagatattttcagacttagctaagtggtagttcgagtttaaattttttttttgtggttgg

SEQ ID NO: 52453 - DNA, 1873 bp, Oryza sativa
aatggtacaaggcacatttggttacttagatccagagtactacaacactagccaactaacggggaaaagtgacgtgtatagttttggagtgatacttgttgagcttctgacaagaaagaagccaattttaataaatgatgtaggtacaaaacaaaacttatcacaatgcttcctagaaggacttcagcagggagttctgatggaaatcttggattcccaagttttggaagaggctggacaggaagaaattgatgatatcgcttcaattgcacaagcatgcttgaaagctaaaggaggagagagacctactatgaaagaagtagaaatgagattgcagtttcttagaactaccagactaaaaaagtgccaacccatttctgtaatggatgaagagattgagccttttatttgtccaaagaccattagctctgatgctcaaagcagtttcatccatactgctggttttacatcagaatatagcacaagaagttacaggttggagcaggaactctcgtcctcagttggtttgccacgataaaaatttgcgcaacagcatggtcgactccttgaagcttgttagaaggcatctaaattatttttcctatattttcataccctatttttatttaatttatgtatctgtctttatggtgttgtaaaaaaaaagtatactgagggcccctttgaatcgcagggtagaaaaaacggaggaataggaaaaacataggattctgacaggaattgaagtgtaaaacagaggattgcaaaacacaggaaaaacacaggaatggtcgtttgattggagcgcaggaaaaacgcaggaatcggatgagagagatagactcaaaggaaattttccaagaggttggagctcttgctaaatttcctccaaaatctacatacaatgtgtcattccataggaatttcataggatttggaaagcttcaatcctttgaatcaaagggccaaataggaaaatttcctataggatttaaatcctatgaaattcctacataaatcctttgattcaaagaggccctgaatatgtgtatcttggttttctctacttccatgttgtatctgtagagcaatatattatcattgtgcttgtatggtgacatttgagaattgaggtggtggactggtgataatgtatagacgtattagtaccgttgttcggcttaggtgcaagggcaccgcactgcacatagtaaaatacatgccaaatcacatcatgacacccgttaaggtagcaccacccaatcactacttctctctcctagctcatttcatcgcttcttagagccaatacaataatataaccaacagcgagctataatttttaccatgtcatcttgagatggaggaataaacgatcactagaacagaaatctacagtacgatgataacagaagcactattttattttattagggcccaccattcccttttgccactctctcagccaactgtagaaagtagcgctctgtgttagagcctgtgtaaaagcgagcgcttaatctatcatcgactaacactctctttcatgtatttttctctcaagctcatcaatcatgttaacatgtacgtctatcaccggctgaacatgctctattgaactcactcttagagcaagtttaacatgtgtagatagctaccggcgataaaaaagaacatgtcagcggcatcagataaccaaaagatggtgtacgtacagaagatggctatacatacaagcttcaatgaattaatttatcttttctttttgagaaaatctatgaaatgccattgacaagaactctaatcccagaaatgccattgacaagcgcaacttcctcaaaatgccatcggacaagcgtttttctccctgaaa

SEQ ID NO: 52454 - DNA, 1890 bp, Oryza sativa
  unsure (1)..(1890): unsure at all n locations
nnnnnnnnnnnnnnnnnnnnnnnnnnnnnnnnnnnnnnnnnnnnnnnnnnnnnnnnnnnnnnnnnnnnnnnnnntagattagtagcctacttatttgttctatttggttactggtttatcgatataattatcttaattcacttttgtttttcatatctgcctaattatgaatacttgcactgttcattcttttgcttgtcaaaatttaccagtggttttttgttgttaacaaacagatcttgttattactgacatatttttctgcacttgtagaattttatataaacatttaaaacatcattgggatagttaaatatttatgtcaaactgattaagagtggaatacttgcatataagatgctacacttactgctgctttcttgtccacatttttttatttccctactcatatataggtgtcactctattttcttgcttcacaggtcaatgcatatgatggtgtgcagattgttgactctatacataagtcaaaatatcatataactacacttgcagattcaagtcattgcagttgtttgcgagcttctgcttttgagatggccgagactggagatacagaaaatctactgagagagaagcatgcaatgtctagtgatgtgcaagggagtgtaaaaatgcttggtgacgggcacactgtgacggttcttaatgtccaaagcaagtcaagctctcctcagatacgctatcaaagtcctgtaggtcagaaaaggtcgtttactccagcacaagacaacaggggcagtgattgttgtcatgcttgcgaaaggcatatatatcacccaatattgccatggataaatggtgatggaagcatgaataacactgtctacgaaggtctaagtcgtcgtattattggatataccatgcaatatccaggagtagtggaggtgcgtgtttgttttattttttgtagctctttgttttgaattaggaaagtttcatgtatgccactgaaattgtgatttgtttatccatctatatctccaaaagttttgcattaatgttatatggcattctttactaattaatccttgttttctttaaatgtctcattttaaaaagaaaattttatgcgagaacttcagtatttgaaactttggaagtcttaacttttcaagcataaatctgaattttaaattccccggatcccttatttttggtttggaaattcaagaattcaaaatcaaggttgagacatgaaattccatattttaaaatattccttttcttttcaaattcgtgttattttggtagtttgacaattgtaattttagttttatttctaaatatctgaatggaatacttaaatcttagttatagctagcactacaatattaaaagattcatcgatacggtacaagtgaacaatggaaaattcaactattgtctaaatttaagtgttgtggaaatttccgtttgtgtatgttatggtttagcatgtcctgttttctttctgaatgtgactcccgtgtttgcttcctctatatcatttatattcttctttttacttactttctcatctcttactgttcaagttatttgaatccctccggttgcgtggtaaagttggtttgtcttaaattgatcaggcagttattttgaatgtacagatctaagatcgtttgattcccctacttagtggtgattccagttacggagttaccattatcagcaacaatattttaaaaggtctgatctattgttctgctctaattatgccaggaggatatcatccatcggatggatgtgttgaacccggaggtgcgtcacccctctactttctctttttggacctgtatattcgatattaaaatgatagtggtttaaataataaatatttgtgaaaaggcatgtagcctagtggttgca

SEQ ID NO: 52455 - DNA, 890 bp, Oryza sativa
  unsure (1)..(890): unsure at all n locations
nnnnnnnnnnnnnnnnnnnnnnnnnnnnnnnnnnnnnnnnnnnnnnnnnnnnnnnaattctcctctgtatacctctcttccacttggtgataagtatagttgcaccaagtgcaagcattacaaagccaagaccacaactaattccaagtgccatacctacaacaattatatatcgacaatagtcagaacatcacctataaattgcctcaggtagattttttagagtaattaagtattaaccactgagggcaattcaatagtatatataacttactaatgagcttagctgatgtcacacattcccttcttgttgggtcgaactctttcccgcgagggcaacttgtgcaattatagcctccaataaaattttgacatctcccattgcagtagttcggtagcaagcactcattgacatcttcaaacaaaagaaaaagtcagcatgcacttctcgaaacctttaaagtccttcgaattaattgctatgttactgtggtgacatatcacgtctacatgcaaactactccacgccaataatgcattattttatttttctcaaataaggcttaagagagataaaagtaacataacatggtataaaatggacagctagcccacaaatttggatgatccgtaagaaataatcatcttaaaacgatggtaagagagagagtttccgcacccgtgcaaccatcttcgatgtatggatttcctccgaagccaggagagcacttacaacggtagccaagctgtgtcccatgtgttacattgacatcgatgcattcgctatggacactacggcatgcataggaattgttattgatgtcttgcgtagcttcctggcaagtaaaactcacgacagcccaccacatcttcatatcattttcttgagt

SEQ ID NO: 52456 - DNA, 2172 bp, Oryza sativa
tatatatatatatatatatatatatatatatatatatatatatatatatatatatatatgggtttggttatctaaatttagtggatgccttaggctccgttcggtagtttgtttagttttcacaactctctcgtttactttgagcatattttttaaaatgctaaaattgtatttttcttaaaactatatataacttaaaaaaaagatttgctccagtccaacaaaaagtacctcgaggtccgtgaggtaccggtacctcgaggtactttttgttggactgagaaaatctcttaaaaataatatcatcttttaagttataataattaatactcaatttattatgtgctaatggttacctctgcgtgctgaaaaaaaaaactactactacttatattcaaacagagccttagactgaagatgcaacatgcatgtgtaaagttttcttcacttaagaattaaaaataaacaaatttggtaaaaccactgatattttgatcttgcaaaactacaacttttatacatcgtattagaaaactacggatttagcactaatttatcatgaaaatatataatttaaaatagggtatcgcaaaagtataaatagatttactaatgaagttatcataaaactacatatgcgcttcagagtttagacccttagcactaatgttctactggagttataaacattatatattttttagttaaatgagcactaactctgaaaacttttattacaaaatatatagttttaacatactacatcttaatatttttttgataaatttgatgttaaatttgtggttttgtaatggatcattttaaatttgtaactttgtgatagtttagtcaaattatctatagttttgtgaaatttatgcttttaaatttgtatggaactgatagaatatcaatactacctaaaatgttactcctccatttcatattataagaccttctagcattgcccatattcatatatatatgttaatgaatctaaacatttatatgtgactagattcattaacatctatatgaatatgggcaatgttagaaagtcttataacctgaaacggagggagcagtagtgatgattgttatgccgcaccacccctatcagcgatatttggacctcacaatggacaatctatactattacaccatcaccaccgacctggcaaataggctccattagttagcccgcaccccgagtcctctgtcgtttcactgttagatctccccaaaatttttaaccaatatttttttttcgaaatcattatgacagacaagagatccaaatagtgcaatttgatgatcatgtaactaatcaattcaatgtatgcacaacaaaaaatcataaaagtactaattatacttaattgacttaataaggtagaagctctacataaaaaaaacttctgcagcctttggtttggttagaagtctcaccagtacagccttcttgagtgtaaggaatcccattgggattaccatcggggcaatagcagtaatagccacccctgtccgcattgaagcattgagagtttctactgcaagcataggttgctttgttcttggatgcgctgtgacagtttggctggtccatgatggcaccgtagatcgtagtatagagaaagttgcttccgttgatccaaggggaggaaagatcttccgtgcgaaactaataagagtcatacgtcaagcaagccttgacactggattgttcttgcggcaccacctggccgatgccatcttgacggacaatccttagccgaaagccctgcacttccctcatcgtctcgatcgtgcagcaacctatgccgtcacaggtcccatttgcttgcatcatgtccaccgggtctttgaagcatagagtcgtgcaagaacccatggtatcgttcgaacagtgtcttcgtaatagatgaagaataaatatgataggtagagaagagagatgatgtatttattaatggcccactttaagaaatcatgggttgtagagtgtagtttctattatgatgtcctattgacatggcaccatagacactacttatggacactatgggttgggactacccttaggcaaaagaactactttaaataattgaagtggtcaaggtgatagttttgcacccacccctttcacataattaattaattacccaatttccc

SEQ ID NO: 52457 - DNA, 8498 bp, Oryza sativa
  unsure (1)..(8498): unsure at all n locations
cagaaatgctattgtctatggctccaaattctgtagctttgcaaaagacagtttagtttaccagtggtgataatttgagtatggagttaaccataccagtacaattagactaaaaaaaagaactccaacctagattatgcacacaaccacaaacacaccaagcaaaacagtggagattgccgtttgacaagggagcgcaccagattcggttcgaacagacgagacaaccgggagcggcggcctgccggcctccgcgcttgggggaggcaccagccttctgatcgcgccggggaagaggaggagccctactgccggggcggaccaggcctccccttcgcccccacacctcgacacctctctgacactgggcctctgtcggcaaacaccctgcaactccaccgcggtctctgtttggctttgcacttgtgccgctgtgtcgtgattgtgtccgtcattttcatgtcgctctttgctcatgttgcgccaccgccgtctcataaattagagcaccaatgttggcttgctcctgcatagaagaaacacactgctaattaacttgtagggcagagcttctaactgtacgtagagagcaaagagtatacaaaagtgtatgcggcgttatcgtactacagtaatcctacttaggcaacggtgccggccttcttttgttcatctatatgaattagaagactgtggcaattgtatcacgctagtgtatggtgattaggatttgcactttttttttttgaaaggagggcaaaagctttgcctcatatatttatagagatgaagaaaaaacagatcaaaaatatgtacagggattaggatttgcacattgcaactctttccatctggtactggatttgtggaaagaatgggcgggcgagtttattggtccctgcaatggctttagattttgcaaggataatatatagtagtaccacattcttagaagttgcaatatactccatccgttttatattataagttgtttgattttttttctagtcaaatttatttaagtttgattaagtttatggaaaaatagtgtagtattttcaatacaaaagaaacatattatcaaaatatactcgatgctaaatttaatgaaattaatttgtcattttagatgttgcttttaatgacaatagcccaattttcactcaaaaaatgttgaaatcatgagtccccaatgttttcatagggaactgcagtctgcgggattatatttacgaatctgctcgtaatagcttacaagacgagcatagtgaccctatacggtgacaaatccagcaaatatcctctaattaattaagctaacaaccccaatttaatcactcttagggcatctcctcagcgtgcctccggtcgcaaaatataattttactaatgaccactcctacttcagagtgtgtttcgaaccagagcttgttatatacgcacacaaaagcagccattgcatcgagcaataataatattgcagtttgacgagggagcgtaccgatttcgaacaggaaattaatcggcgctgagctacagcggcgtgtcggcctggccttctgccggtgcctccgccatgaggaggtgctggaagctgaggtggacggcgccgcccccttccccccgactccctcccgaggctgtggcttagttgcttgcgatgaactgtggcccgcgcaccggcggtgaggtctgaggggagggcgacgagcggcgctgccgcgatgaggccgaggggatggatgttgctgccctggacgatgttggacttgaggtccagagttgagggctcccgttgcacgtggttgggcttcttgaggcccaaaaactaacaggccgggaagaagatcgagaattcacgccatacttgcttatgcacgtaggcaaaagtgggggccgctgatccgcgaccagtcgcgcgaggccccgcgcgcgcgatcagctgccccccctctagtgtgatctgttatcctatatatactactatacgtactatatgtatacgtactatatgtatatacatatgtatatatatagtttatacgcatatatattatacatacgtgtgtatatatacataattttttatatgtatgcacttttaatgtataaaaagatatacacatgtatataaagtttgtgtgtatacgtataaaaaacctaaaaaataagtgtatacaaacatatatatgtgtatacaaactttatatacatgtatacagagttggtatacgtatgtataaaaaccaaaaaatacacatacaaactttgtatatacgtatataaaagtttgcatacgtatatacaaagtttgtatacatgcatataaagtttgtatttatacgtacacagagtttagcatacatatactattaaaaaacggacaaacacaaaaatatacgggaagaaaaaaaaggaaaaaaataaaaccggaaaagatacggaaaaaaaaacaaaaaaaagggaaaccgtacgcccatacgcgccgaccgccgcctcctctgtcgtgtcgcgcgcgggagggctattagcccatttcaggaaagcccacgacacgaagaagcccaaaaaacagagacccgtgggtttatagaaacagtgttaggctagaagtagtaggggtgaactcgccgcgcgcgctcacacgcgcgactagtcgcttattagcgatttcgggcaaaaatggcttaaaattgggaaccagaaattacgaggccattcagattgtagataaaataaatcgtactacatagataagtgtagatcatatagataagtgtagatcgcagaactgattgcaatataaattcagagttgatccagatttattacaccacttccataatttgtgggttgtccttcgttcagatcggaattgacttgtatgaataatttatattcccagtcatctaccagaaacgtttcgcacgtgcaccggtcgttccaatcatcatctcgctagcttgtcggggaggaaaatgtcacgtacttgtcagctgtacgtagtcaccgccgaagaacatgttggtagaaatgatttcgacttgcgaggtcatcttaccgtgaacacccgggcatgcatatacctggtctaacacggccggccgtagtcattccctcgaagtcttagttcaaaagttaatgcagagcttttaaatgcttagaaataaatttgacagctctaaaagagtttgagacatacacgaataaacaaactcacacctaaattagactcaggttgtgtttagttcagcgcgaagtttggattttggtttaaattgaaaatgatgtgactgaaaagttgtgtgtgtatgacaggttgatgtgatggaaaatgactgaagtttggatccaaactttggatctaaacacagcctcatttcatctctcaaccacatatatatttcttccatctgtggttatcacctttaatttctacacgtacgtatcttcactccacagtccaccccattacttgtcattttttgtttttgcataacaagattatcgaataattatttcaataagaatatggtgggcgaattggccagtttgtagaaacatcagagtactgctaactgcagtgtagatcgaccgacttgacatgttacttcctttcaaggattcattagaaaagaacctacaaaaatctactattgaatcttctacagtctctagtttggcaacgccgcaggccattattttcgtcatctagtagcatgtgtattgctttgttactgtgtgttgtgattaatagcatccggacagtaccattctttccagctggtagatagtcagatagccatggacgtgtggaaataatcagatgtgtataggatcagtgagcagcgaccggcagttgggcgagtcgttggctccagcaacgacagggatatctgatgggactagtgcccctggaattcgttcatatacgaggacaatatacaggcttggcagattgcaacaaaactgtttgctgctgatcgaaatactgatcaatcaatgtctccatatgttatatagcgcttggggaatcgctcttaatcttgcgtttacttaagtctctgcaggcgcacgatcagtataaattaagagacgacagacgttgcctctgaatacaaaatcgatctcacgcgtagttagcatacatatctgcacccacaaagctaggcaagctagccgatcggcgcaaagatgagctcgagcttattagtggcagcttgcgccgtctcttttgtgctgctgtgctcggctgctacgtccccagcatcggctgcagtctacggagttggcggagggctcttgtctatcccttctaatgattccctggctcattgcccctctcgttgcggagatgttggcatcgactaccccttcgggatagcgccgggctgtttccgggaaggcttcgagctcatctgccgcaacaccgccaaaactcctaagctctttctgggtgatggtactactgagatcacagacttgggttataggtatgttttggcccagatatacttcaacattacggtgagaccaggtacggatacctacaacatatcctgggtggccccaacagagggtattactattgatcattacaacacattttacgttatcggttgtaatttcgatgctaccttgttcgagtatggcacggaggacctcataggttcttgcatgagtagatgtgatggtgaaaaggcaccaataggagggccttgtaatgggatgggatgctgtttcatcgagttaccaagggtcttgcggggctttcagtcaaccataattcttcggtcggatggcatttctgtagcacaaacagatccagtgcaccctggaatcatggctttcatgtcatcggactattatatatcaaacacaagtgaccttttcttaggttggacaaacacaagtaatgttgaaggcacagtactttcttttgctaccatagatcaaccaagctgtgaacgcgcgcgcatgaacaacacaagttatgcgtgtagccctggcagcaattgccggaatgtgtcatctggaggttatcattgttactgctctggttatgaacaggggaatccttaccttctagatggatgcacgggtacgtacttcctgcctgccccctttttacccccaaaacgaagcaaaatataatgcactgtcactaacctccttcttattcttattatatattgtaatttctatggtggaacagattacaaccccaaatataaagaacactgttcaacatcctgtggagacatgaagattcctttcccttttggagtcgaagaaggttgttttgctaacgaaaggtttagacttaattgtacagaaggtaacctaactgtttgcgaattaggagaagcacaatatcatgtgactgctgtgtctttggatgatgggactctaactgtcggaaacatgatgaatgacacaaactacgagaaagaggcgataattgttcagaccacagatactggccgtgattattcattctcaggccctgtggaagatagatttgatctctctatggaatacgccattgttataagatgggcagttaccaacttaacttgtgaagtagctgtgcagaagaacactacatacgcatgccgcagtagccacagctactgcctgaacgtcacccacaggaaagagttcatgggatatcgttgcaagtgttctcccggttttgaaggaaacccatacatcgaggatggctgcacaggttatttcctcttcacacctcctccagtgtgcaccagcaatgctcatgcctgcaaatgtttagaaattgaattatatcaatttaacttgggagaatcgacaaactaatcatagttttttgcagacatcaatgaatgcttactgccaaactattgcaatggcacgtgtcaaaatttacttggaaattatacatgcacaagctgcccgcatagaaaagagtttgatccaatcaaaaagaagtgtgttacatcagcaaagcaacgcaatcttcttttaggtaagaccgtaagaagtaatagccaacatgcaaaatgattttattatgacaaaatgaattgatgcaggtattgcaattggaattggttgtggtcttggctccatagttatcgtgttgggggcaatgatacttgccaataagtggaggaaaggcatccaaaagagaatacggagagcatatttcaagaaaaatcaaggcctactcttggagcaactaatctcaaatgaaagcgccacaaacaaaacgaagatattttccttggaagaactagaggaggcaaccaacaactttgatggaactcgtgttcttggacgtggaggacatggcacagtttacaaaggcattctatctgaccagcgtgtggtggccattaaaaaatcaaaaatcgttgagcaaactgagatagatcaatttatcaacgaggttgttatcttatctcaaattatccaccgcaatgtggtaaagatttttggttgttgtcttgaatctgaggtgccactgctggtttatgaattcatatcgaatggcacactgcatgaccaccttcataccgatcttagtgttagatgctcgctgtcatgggatgatcgcattaggattgctgtagaagcagcaggggcactttcctatctgcattcagctgctgcaataccaatttttcatagagacgtgaaatcttccaatattctcttagatggcagctttactacaaaggtctctgattttggtgcttcaagatctgtttcacttgatgaaactcatgtggtgactattgtccaaggcacattcggttatctagacccagagtattatcatactggacaactaactgaaaaaagtgatgtatatagttttggagtgatacttgtggaacttctaataagaaagaaaccaattttcattaatgaggcaggtgcaaaacaaagcttgtctcattacttcgttgaaggacttcaagagggctctctaatggaaataatagatcctcaggttgttgaagaggcaaacaaggaagagatcgatggaattgcctcgcttacaatggcatgcttgaaagttaaaggagtagatagacctactatgaaagaagtagagatgaggctgcagttcctgaaaactaagaggctaagaaaattccaactgctcccaggaaatgatggagaaatcgagcaccttttaagcccaaatactagtaactcttatgcacagaatatttatacaaatgctggtgatttaacatctgaaggaatcccaggttctggttgctacagtctggagcaagaattatcatcttcaattagtttgccacgctaattaggtataccacggtgaagtgatatctgatatgctttgtagttccgttctgaacagggtatgctgtattgttttatttcctgtgtgtaattttaggttacagtacgtatggatagcccacgcctgttgtatattactatcattatttgtgaggaatatatggttgtaagggattaattaaggccaggtggcaaagacaaaaatttgtataatcatgaacagatccattcagtaataatttcataactccatttccagttgcttacgcagtacttcctccgtttcatattataagactttctagcattgttcacatttatttttttttaccggaatcacattcatatactccctcattctctaaatatttaacactattaacttttttaaacatatttgaccgttcgtcttattaaaaacttttgtgaaatgtgtaaaactatatgcataaaagtatatttaacaataaatcaaatgataggaaaagaattaataattacttaaactttttgaataagacgaacggtcaaacatttttaaaaaagtcaacggcgtcaaacatttgggatggaggaagtatatgttaatctttacctattataaaagtttaagatgtttttgccagatgtttcgtacgtcatctgacttcgattcctactcggcttgcgcactctcgcccgctcgtgcgcatcagaatcaggtccgtgttagtgtccgacttctcccctaatacctgcgcgtgttcacatcctccatcacgagtcgttcgcacgcaccagccggaaaaaagatcgaagcatcgatatgtcagcaaatcgatcggactctaatccagaccttgtgcgtatcagaatcgggtccgtgttagtgtccgacttctcccctaatacctgcgcgtgttcacatcctccctcacgagtcgttcgcacgcaccagccggaaaaaagatcgaagcatcgatatgtcagcaaatcgatcggactctaatccagacctcgtgcgcatcagaatcgggtccgtgttagtgtccgacttctcccctaatacctgcgcgtgttcacatcctccctcacgagtcgttcgcacgcaccagccggaaaaaagatcgaagcatcgatatgtnnnnnnnnnnnnnnnnnnnnnnnnnnnnnnnnnnnnnnnnnnnnnnnnnnnnnnn

SEQ ID NO: 52458 - DNA, 1172 bp, Oryza sativa
ggaaaaaagatcgaagcatcgatatgtcagcaaatcgatcggactctaatccagacctcgtgcgcatcagaatcgggtccgtgttagtgtccgacttctcccctaatacctgcgcgtgttcacatcctccctcacgagtcgttcgcacgcaccagccggaaaaaagatcgaagcatcgatatgtcagcaaatcgatcggactctaatccagacctcgtgcgcatcagaatcgggtccgtgttagtgtccgacttctcccctaatacctgcgcgtgttcacatcctccctcacgagtcgttcgcacgcaccagccggaaaaaagatcgaagcatcgatatgtcagcaaatcgatcggactctaatccagactgatacaaatcacataggttgactcacggccacacaaataataaaatcagcatgggagatatatctatatctataactaatataaatattcatatttttccggtcgtcacatccttaacccacgtttttcgtccgtcaccgtcgccttcagctttgttcacaaaaactagggttctatttggagagataagctcgaaccgagctcgattccgcgttaatttctccgggataaggtccgattcttggggaaaacggaagaggaggataagggaaatatttcccctcaaccaattttggaaaaaatagaaaggggcgcccggatttggagtggaaagcggcgccgggtcgggttctgtctccggccagaggttgaagacaacactgtagcgacagggatgagatgtggactttggggaaaaaaagcctagcccgagaaaaaaagaaggaaggacgtgaaacaaacttttagcggtgcagctactaggccgaacaggaagaagtaggatgctaaagtggacttcacggattaggcccaagaaagagaggggatttttaattacttctccagataaattaaccaataaaatgatctttaaattgttaaaattatttcaaatgctcaaataatatcaagaaaactcttgaacatacttggataacagcattaaaaccagatcatttaatgattaatttattatttaaataatactgaaacgttctttgtattattaaaattagtagttgagctttgaaaaatccgagaaaaattccagagagcagaattaaccacgcatagaattaa

SEQ ID NO: 52459 - DNA, 725 bp, Oryza sativa
ctcaaatgataaatatatgaaagtattatatgtttaccgtgttttatctaagagtacatgagcttgtcaagttgtgtggcgagattaaatatatcattgctgattgctgatttgttggctaccttgatgatgtccatatgagagcatctgaacatatatccattgaaataatccaatttcacgtccttagaatgcatacagacttcgaacaagtattaaaaaaataactcaacgcaaaaactcaacgcaaaagcttagtgcactcaggtcaagtcacaagcatacaacagaaaaacggcttccccttccatacacctgcatcatctgattataccaaagtacattcacgaataaaaacatggttccataacgtgattcagtattcaaacatgcattgcttgctgcttgccatagacaggactaatatctatactgaactgatttccttttgttttcgctatattaaatcgcctgcttcgagcacgcgcggcttagcgcgcgagaccgttctagtatttttacatatcacactaaatgtttgataagagacactactacaaaatcggtttttgcatgcggccaaaatcgattttcgtagacggttgcatgcggacacttaagccatccgactgcgaaattgaaaaataacaaaaaaaaaatctgaaaatcaatttccctagaccctaaccctagaatcgcaaaagggaactaatacaaactcatag

SEQ ID NO: 52460 - DNA, 1122 bp, Oryza sativa
ttgggttttgcccctctctcccggtcgtcacttcatccagcacggggacgatcggagccatccattagatcggacggctcagatttgcccagcgtcgggccaccgccgccgttgattacgctgcgcccaacgggccgcgaaagtgcatcggaccgtccccacatatgtgtgctgcgtcagctgcttggcctgcgagccgtcgaattgactcaactaaccaaagatgggccagcccaagtttggcccggttgggaagacctgggccaatagcaaatttgatcaaacaatgtggctcagattttttaaattaaagtccgtcagataaactcataagtagattcgaaaaataaatctaaaactaaatcctaaatcctatgctaatttatcaaattagactcggtcctacctatttgttaatatatcaaattagacttgatttttaccgttttgaggttttcaaggtttcccactatcgaacggtgtttttcccgttgcaatgtacgggcactattgctagtaaaaaaaaaaagctgaagcccatgacgccatcttaatcctctgctcgtactgtccaccaactaacaggcacttgacctccgccagtccaatcatacacagccacgtgtcctggcacttcaaaagttagttaatgtgttcaaccaccagcagctaaaccccgccaacctttgcttcccgccattaatttctcctccctatttatgctcccccatcctccgcccaattcttcccccaaaacgcacaccccaatccgatccagaattcctccgtcgcgaatcctcccttgtaccctgttcgatctcgtgcgcggcgcggagcggcggacgacgacgatgccaacggcggcggcgatggccggagggatggcgacggggccaggcagccgcgtgacgcggtacgccaagtcgacggcggcgtcggtgacgccggtccgccccggcaagacgcacgcgctgtcggcgctggacaacgccatggagcgccacgcggtgtacctggtgctctactaccgcgccgcgccggggctcgacagggagccgctcaaggagtcgctgtccgacgtgctgtcgcagtacccggccatgaccggccgcctcacgcgcc

SEQ ID NO: 52461 - DNA, 716 bp, Oryza sativa
tgaaccaagtgcgatggtaccttttcagagctggaagaacggaattcttcccagaacctcctgaagtccaactccaactcattttttcccctgcaaatacaaggttaagaacatttatttaacaatgggagtacaaactgagaaatttttgcaggaaattcacttgaaacagcagataaaattctggagaataattgaagcaaagggatcaaatgcctcgttttgtcattcttagtacaatccatgcatcagaaccatgtgatgcatatataatgtgaatgcctgacatgacacctacaaatacatgaactgccatgcaaggattggaagggcaactagccaactaacaagtacgagagagaactataacattatacaggctctaatattatccctttcccagtgccagttaccatacaatacaagtttaagttacagaacaccttgaaacaacgcacacaacgaagttaccaactttaacaacataatatctagtggtagtccagagtccagacaaagccacaaaggaataaaggatgagactcacgatatctcattagtaatgcaattgcaaaagtcactattctttcttggtaggttaatgatatttattgaatgctgaagaaatgacaagagaacatctgaataaagaaccaggtatcaagcatatacaaatgaaaacagctcataaatctccattctacagtaaaatatag

SEQ ID NO: 52462 - DNA, 3495 bp, Oryza sativa
  unsure (1)..(3495): unsure at all n locations
aattggatggtgtggttaatttgaattgaggtcagttcagtttgatcaagacatggatggtgggtgctgtaaggtcctgagaaatctggtcattgtttttctttttcgaaaaagagaaatctggtcattccgtcattgtatttgtaccgtaaaatattaccactaaaatcttgacttatacagcgagaatactcactcccgggcaaccaacgtgaggcgtcattatcgggcgctccccccggacgccacgtgccccctagcccaccatgtgtcatgctcccacctgtcatgtgtctcaaaaaaaagttttatctagtatactcacaatgtttcactatgcatagatctaatgttacagtgaattgaaaacattcttttgcaacaaatcaaccacatattttagaaaccctctattaaggaattcgtttcattttttgttacaccaaaaatgtttcacctagtgtacttacaatgtttatctaatattgcactaaacgaaacattttttcccaacaaatcatccacatattttagaaaccatctattaagggaatacgttttaattttttgttccaccaaaaatatttcacctagtgtggatcaaatgttgcagtgaactgaaacattctttcgctatttgctgaaacgttgtttttttatataaggtgaaacaacgtccgatttaaacgattgaaatattttcgatctacttagtggaacaattccgatatacctgatagaacatcgtgcaacatttaaaaataatttaataataagctaaaaaaatttcatcggaatatatccatgtatggtcttattttgaagatttaattacaatgaatttaatggtccaatcggatcatgatttggataaataatttaagagaaaaaatagtttaaagtgtttttgcacgcatcgtctgattttaaccccctctcatcgaacggagcgagagtcgcttcccttatacaacgatgagacagccagatatatttctcactcggaacccttctaatccgtttggttgggggagcttttagaggaccgaaagtttagaggatgggggtattacctattctgtttgattggagacatgagatttttctttatgaggctggaaaattgagggataaattcctacttttcaataacttgtaggagtggtatttggaagagaattcctccttgagaaaaaaaaagtgccgtcctgaaaataagcctgtcaaaaagggcgaaaaaaccgttagaaaaaactaaacagtctaaaaaaccggtatataccacgcaagataaaaaaaactacgcaatgcgggaaaaaaaaccagtccgattgcacgcaacgcaagaagaagcccatccgattctacgaataaacttaaaaaaaacacgtaaaaaatcgtttcacgaaatgtaaaaaagagtgattctcgggaaaaaaaccaccatcaaaaaaagttcacgaaaaaaactattttgcagcgttaaaaagaagtctgattctagaggaaaaaaatatcgtcccaaaaaaaacaggtttggcaccacaaaacattatatatatctctatttctttcaaaagcgaaacctgtttttttattcattaatatcttcttcggatcggtttctcgacgacgtactttttggatttttcatacatgcgtcaacgtatttttcgagtactgcgggtatcctcggggcatcaccaaatcagtttagatcaactgcgagtattttgtatgttggtagagatcacgtctattggcaaagatcaaccgcattggtgccgatcaaatacgacaccaacgacgcatcaaatactaacacggaacagaaagcagcagactgccggcacaaggatctctgttattacagtattactgatggactgattgttaagctccaaatagccacagacaacagaattttttttgaaacccgacagacaacagaatgcaacaggctgcgagacactggtctgaagaggcaaagcacttttaacttcagcttccttggcatccgccgaacgctccgcgacaacctttgacatcccaaacatctgagatgcgaaacatgaagcacaagaaatgcttcatcatcaaaatgtccaaaatgcagaaagagcaaagaagtgcagtatctgagtgtttgcacatctgaccttttggatggtgtttgaagcatgtcttgtgctcatccatggaggcatggatgaactcctcgatatggtctttcagatcttcgaggaaagtagcgccatcagtcctcttccggcaacaagtcatggatgggtttttgggaactgaataggcagaatcttgaggttgtgcattgctagattccatcttaagcctgaaaaagaaaagtcaaagggaagttgattagtatgagtctgaagaagacatcaacattgttagaataggtgcaaacacaagaacgcatatagtagtaagtatatagcagaaatgcagagtagcagcggcacaaaattaactgactgcacttcagttatcaaatcatagatgctactaccaaacagatttaaaggttcacatttatttttcaggtagaaacatcagtagctactactcagccaaccgtgtccaaactacgacggcctagaattacaaacaagatgacgcagcaaagaactactcactgatcgataagatctcacagctccaaaaattccaccatcgaatacctaagaggatttacacttgtctcaagttggttatgatcagatgcgagcccccttcactgagattcgactgccaccggagtcacctcccgcccttccctggagctgctgcatccttgaccatgggctcgaccttctttttgccaaacacctgaaacacatcacaggaaacctgcagattatccctcaagatccatcagaggaaacagcatgttataattagctatcaaattacaccataaagagaagattgaattaacttcaatctgaaagaacagagaacactaagtatagcaagaacagagaacaggagtactgccatccgttgnnnnnnnnnnnnnnnnnnnnaattagagtgtgttgctaacttgaattgcaaatgcttgtatacactactgcagttaactaattgtctatgtcaaatactcaggagatctcctcacaagctaatctataatttgccactaattcaacgtgactgctagcaacaaacagatctagatgtacgcacaggttaatagccaccaccaaatgactcgacaacaacaacaacaacaaaagcatcacaaatccacagggaaaaaaccgaatgcctctgctcctctactactcaaatagaacagcactgaaccccaccacaaacgacgattcaaatcgcgaacacaggaacccattcacgcaggccttcccataaacacaacgaaggcactaatcgaactcacattgctgcgttgttggtaannnnnnnnnnnnnnnnnnnnnnnnnnnnnnnnnnnnnnnnnnnnnnnnnnnnnnn

SEQ ID NO: 52463 - DNA, 1166 bp, Oryza sativa
atagagcttgtttccgaccgtattcgattcgttttcattcctacatatgtgtgtactgcgattttttttcttcctcaccagaacaaatcttgtaatagatctaatgattcaaaattgcgtgaaacttacatacaagttacactgtagtacatgcaagttacagtgtaattacatgcaagttatagtgtaattacactatgattgtattataattatatctgtcaaatttttaggagaaaatttgtctgacaaatgtataggtggtcccttgcggttttaggggtgtgaattaaactcaacgtaaagacgagagacgtcaagtggacttatttccaaaggagaaatttcatacgggacgtgtttctcggcccagcccaaatatctagagtacgtcttctactcatgattacgtaaataatgagagacgctatttactccgctagatcagccaccttctcctcgccacgtacgacacaagcagccactcgcgcgcacatggccacgtcacgcaaaacccgcagaattacgcgattcgctgagcccttttctgcaaaaacacgcagcctccctcttctccccaatctagcccgtgacctcctcgccggggctacttctccatcgccatcgacctagacctcgccgcctccttctcctcctcctcccgtgcgaactccgggctcgtgccgagggggtggacgcgccggtggtgagagcgaacgcggtgcggtgggccatggcggtggggtggcggccggcgatgctggtggtggtggtgacggtgacggcgtggcgcgggaaggcgctgtcggtgacggtgaccgacacggagtgcatccacgagttcgtgccctacgagggggacaccgtgtcggggaacttcgtcgtcgtcgaccacgacatcttctggagctccgaccaccccggcatcgacctcacggtgcccgcccccgatcctcctcgtcttcgttgtgcttttgattttcgatgcaaggatctataactagatgggtttatgggtttgttttttcgtgatctggggcacgctggattggggatcaggtggaatcgtggtcctctttttgcgatctgcgatttcgcggtgcaaaagtttggggaaatttggtgatatgaagatatttcatgaataggtttcgatttgattttag

SEQ ID NO: 52464 - DNA, 727 bp, Oryza sativa
tgtctcacttcctttcgtgatattttgtgctctcgtggaatgtaggtaacttcaccaggtggcaacactgtgtatacattgaaggggaagtctggtgacaaatttgaatttaaagctccaaggggtggaatgtacaagttctgcttccataatccatatggagcacctgaaaccgtttctttctacattcatgttgggcacatacccaacgagcacaatctggcaaaagatggttagtgttctggtcttttaccttgaccttttcgcttgtcacagtctcatatctgcttatcacgtcaatttatttgttttgagcattgaatcacaatcagtttaatatgcgatcataggtttatatttggtatgttcattttatatttgcgtacataagctatatttggttgcttttgcagagcacttggaccctatcaatgtgaaaatagcggagctgaaggaagcattagaatctgtcactgctgagcagaaataccttaaagcccgtgaagctcgtcaccgacacagtaagcttaacaatccttttgcaaatggtcactgaagctttggcagtttcctataatcctgcgtgtgatatgagaatgcataaatttgtatgaattttctgttggtccactcaccaccctttccacatgaagcaagaaaaaactgatccgttattacattttaaacactacaacattatcaccatcagaaagaagagcaaataggg

SEQ ID NO: 52465 - DNA, 1055 bp, Oryza sativa
gtccataatccaaatacctaattgcggtccagcttccattgcttcaaatatctgcaagggtacatagggttgctagctatacatcccccctcgcttgcaacttgccgaaggttaattgctcacactgttcatcattttatgatgaactaactttagcaacttggaaaggaaaaaaaagcgcatttcattaaaaattagcaccccctattaatctataggatctaatggaagtagagaactgtacatgacaatgtagggtcatactaaggcaactattatccaaatagaaatattcatacgcacctcgagatgtaaagccaatgttattgcccataaggtttggttgaagctgtgatgaatgattatccatttttcatccaaaaaatagccatatggatcagcaattgcacatactaaaacctagagaaaatttgctgctttaaaagcccagcccagctgagcattgaccaaccattaacagatgtcagagaaaagtaagccaatgaggtttactgtcaatttgcggattaagttattcacaatgcttataaactaagctatttacatgtaaactagcatctttgagaggaaagcgaggtagacatcaatacattggaacaaaactctcaaaaacctggattcaatgaccaaaggaaccaaagatctcaagtccagatatagatatgatgcttgtcagcggtagcaagaggtcctaacccacaccatgaacttgaaactaccgacgaagaatggccctgtaggatcgtcggtaccccatcctttttcaatcttgaccatatgtaaacagacccatcattagcaccagcagctatggagttttcatcagggcttatgcaaggcctgccccagctgctaaccactctgttacccatggccttgaattttccacaaacttccattgttctaggatcaaaaaggttgtgcacgttatcctttccacttgtaagaatgaaatttctattccgtgacacactgacagagcttacgtcaagatgagcgaatgtctgggtaccgagctcgaattcgccctatag

SEQ ID NO: 52466 - DNA, 726 bp, Oryza sativa
ccaaaaatgggttgattgtctcaagtagaagaccaacacatcctgtataacaaaaagggcaagaataacataaggcaaactcgccagctaaagtaaaggaaacagaggtgacaaaacaattgctgtccatacctacagaagttaaattctcctggttgaagggaccagcatttgctagcttctcaatgaatctcagcagctcgagttgaactttaggtgtaaatactagcaaagagcggatcaaaacaactacagcactagcattatatatacgctccttgtcaagccttgatagtccaaatgaggttgcagacaagaaacctgattcatcctctgggttttcagatgaaatgctctctacctgcaggttactagtgggaggaagaacaacctcaagtgcaagctcaagcaaaagcaagataacatgcttctcacaatccacacagagcaacccagattcagacagaagatcatagaaagtgttggaagacaggattgtatgcagtcttatcctattaacaggattgctgtatactgcagctgtcatagctcgcattagaaaaccaaagatcttcatatgagtaagcaaagatgattcagtctcctcgttttcactgtcattctggaaactgtgaagcgttgttagtagcagggaaaacccagtggcttctccaaaaattctttgagctgaactgtttgccccaagaatacgccacaaagcgccaa

SEQ ID NO: 52467 - DNA, 1523 bp, Oryza sativa
ctaagataatacttcctccatccaaaaatgttatataacctaggattagatggagacggaggtagtacagtacttgcaagcaattaaccagaacgttcttcggcgatgactacagctgacagcttctccgtatgtgacattattcatctcccggacaaccggggcacccaacgagtcaatttcgatgtgaaccgggtcgtgcgtgtagactggagcaaccctgactttagtcaattccacacctctcgctgtactggaatctactccctccattcgaccaaaaatagatacctctgtagggtatcatatgcctgtttagttctctcgtatacgaacacgtatttaaagtattaaacgtagactaataataaaacaaattacagattctgcctgtaaactgcgagacgaatctattaagcctaattaattcgttattagcaaatgtttaattaggctcaaaaattcatctcgcaatttacatacaaactgtgcaattggttttttttcttccacatttaatgctccatgcatgtgtccaaacattttatgttacggaaaagttagaagtttgaaggaaactaaacacagccgtagctatgttgatgggcttgtagtaaatctgattaccaacagcataaacagtcctgtaataacgaatcacaaagtgtacaactagtctgtaatataaatcgtttgagagtgacgatatgcacaaatcaactaacactagagagcctagcgcatctgtctatagcagaaatgtactcattgggttagcaaagtaacgcttgttacacttggatggttctttacagcgatcttgcttcaaaatactctgcaaaagggtaggtgccgaaggggcacgttcatcaaacacccgagcataaaggtgtttatcaaacatcagcttttccaacaaggtccggcaggtctgcagaaaggagaaaacaaaccatgagtggaataatgtaaaatatttattttttttaagaagggtatttttcccagcctctacatccaaccggatatatacagcctttttgaattcgctcaaataacccaatctgagaatttcggccctcaaataacccaatctgaaatttgctactatggatatttgaactcaagactgtctttttaaattaggtacttaacctatcaaataggaaacttagccatcaaataacccaatctgaaattcgctcatatggaaaattgaactcaggaccttgaggtgctactcaggtcactgcaaccactaggctacatgccttttcacaaatatttattatttaaaccactatcattttaatatcgaatatacaggtacaaaaggagaaagtagaggggtgacgcacctgcgggttcaacacatccatccgatggatgatatcctcctggcataattagagcagaacaatagatcagaacttttaaaatattgttgctgataatggtaactccgtaactggaatcaccactaagtaggggaatcaaacgatcttagatctgtacattcaaaa

SEQ ID NO: 52468 - DNA, 3836 bp, Oryza sativa
agtgacacctatatatgagtagggaaataaaaaaatgtggacaagaaagcagcagtaagtgtagcatcttatatgcaagtattccactcttaatcagtttgacataaatatttaactatcccaatgatgttttaaatgtttatataaaattctacaagtgcagaaaaatatgtcagtaataacaagatctgtttgttaacaacaaaaaaccactggtaaattttgacaagcaaaagaatgaacagtgcaagtattcataattaggcagatatgaaaaacaaaagtgaattaagataattatatcgataaaccagtaaccaaatagaacaaataagtaggctactaatctaccatatgcatgcttgctcacagatttaccttaatgaccagctgaaatctcttgagagtatgaacaatcagatcgacaaactggatgcctgcaggggataagaatataaaaatgaactatacttacaaaataattgatgcatagtctaacaattctaagtttaacataagttacacaaatctaaagaatacctagaggatccagtgcctgtgacatctctctcaaattaactccttgttcgccagctttatgaacaacacaaaatgcatttctgaacaggtcagaagacaatatgtctggttcatttttgttacaacataatgatggtgactgttcagcatatgtttttatagcatcccaaggccacccactgtaagagttctccaaatgagattctgacagtaaacgccgacatgaactggagttgtttagatacaatgatgacatattgtggctttctacctgtgaatcaacatccttgctccccatttcccaggctgaagtaaaaataaggcattctttatcatgtaactcttgtgtaagattacttgttttaattctctcttgattcaaagccacttgaagaccagggaaacctttctctcggcgatagcaaaagtcgctttctatcttgggcaaaggtttgtgtttcttagtcttactgcttttaagtttaaccatatcagccttgcgtttgtgactactctcatccaattcactgttatcatcaacaaacaaactagagctattaggctcatcagcctcaccaactccttcacttggcaatgagggtgaaatgaacgactctccagacaaaacaagagaaaagagctggacaatttccccacattgtagatctggatacaaacaaactccatcatccatggtattcttttgctgccctacccattgagaaaattcagaagcttttttccctgaaccaaatgggaagggtgaattcgaagcattaaaaaagaatttcccagaaagagtgtatggctttgttccatctccagttacctgtaaaataggaggaaagtagatgaacagttgaaaaatgctgccttaaattgcaagcacactttaaaaaaaaaacataaagcttaactatactgactaagtaccaaaaattgagcatataatatcattccctttgtcttagagaggtacaatatcattcctaatagggttcaatgtatatatgccactaaggccaaatgattcttcctaatatcagcacaaacagaatgacagtagagatgccaaataaccacttcaacctttgcagcatttaaatgtaagagattatcaccatagctccactgcaaactcagatgcttgtactacaggacaagtaaaagctgaaaaatttatactccctccgtttcacaatgtaagactttctagcattgtacacatacatatagatgttaatgaatctaaacacatgcatatgtctagattcattaacatctaaatgaatgtgggcaatgctagaaagtcttacattgtgaaacggaggaagtattacacaacaagcatagattatagatatgtgtagttgcgagctccgagaactgcacaaagaaatccgcgatgcaggaatgcagcctcatcgcatttatacttcttgggttcacagccaaagaaatggagcagtgcacataggatcttaaaattcacagaatgttgttaatacatctattattctattgtgttttccaacaaatacagattcaaaagcctgaactggggagagcatactgaagaaataatcaaaagaaatttgatacattgatgggaagatgaattagcaaacactaaccatgaaatttttctctctgagaaaggaaaaggcagtaaaaatttcagtctctgaataaagctggagggttgctgctaacgaagcttgcacttctggtcctgatgaggtgctgagaaaagccagcttcagaagctctaatgcatttgcaactgccaatgatctgcatacatctcttttagcaatatcatctttattatggttaatggccttttcatgagatctgaagggaatgtccatgtttttacttgcatggattgcatttgacagcctataggattttgcatgttcacggagtccactttcttgaattgcagtgcttgcacaggttgcacgtgcacctaaaacctgattattacaaggtaaaacatcagcgttaaataaaatatgtgtttattgagattaaatgtatcagtacgtactggctgtttctgcccatttggaacttccttggtggcatcattatcatcattgttcctttcattcttagacccaactctcttggtctgctccattttttctactcgaatgaattcaaggacttcatcaagtgcactctttatctctggatcctcgaaattatcccaaaagaattgctcagaatctggatccacacagttgtcatgactagaatttgagatttcggaaggtaatcctctcaatttccatctcttttccttttcaaggtacctagcgtatcgtatccctaaaaggtcacagactcggctcacagctggtcttatgtttgtttttttcctcaagtatgctatccttctacggcatgcagctggtggagctggaagatcagaaagagagttccaatctacgcgatgagatactgctccaagtgttgcacgggatctagtgtatatcatcagcaattttctgtagataaaaataaccaatcaggttcccagcatcatggaaaacattgtctccagtaaagtgcattgaaacaaaataattgatgtacaccaagaaatacctgtcagaatcgtatgtccacacaaatggtttctctctcatgcagcttcctcttaagatggtagatcgactgatccttggactgcttatcgtatcttcatccacctgtgggagagaatcagtatggaatgtggatggagagaatctctcagatacctcctcatgtgggatagactgtgctggtctcggttcagtggattcaatggtttcaacattccgttggataaatttcagggtaatctcatcagcagaccttttcctttttttagaggttgatcctgaattaacttttcaccgttttcttgcagcagggacggtgggctgtccattaagctgtctattctgagaggacgatacacagagcacctacataaatcagtccatccagtcagtgttactggatagaaaccatgtacattacagaaacataaagggccccgaacataaaaacagagttgaaacgatagcaagagtaaacaaaatcagccataacaatgttgcaactaagatgatgaaaataaggctaacattgcaactagatatgagatactattattatgtttcttggctatattgtatttatcactttgtttcctgctatatagtgtttaagcattatttcccttaagagctgccagtggagcttgtgcattcttccaaactttgtaaatattcctcaca

SEQ ID NO: 52469 - DNA, 1478 bp, Oryza sativa
ctagatatgagatactattattatgtttcttggctatattgtatttatcactttgtttcctgctatatagtgtttaagcattatttcccttaagagctgccagtggagcttgtgcattcttccaaactttgtaaatattcctcacaatataatccaaatagcgtatgagactctgttactgctccccagtccaaaaagaaaaacgagtccagttattactattttaactggtccccataggcccagatgctatcgcataaaattattgtcgatcaattcaactcagaatagtatgagtacacctcatctatttgagatttcacgaatttgctaccagttagtcgattacatgtcacctttcccacacatgttctcggtcacatgtccactttacaacatgagttggaattcacaatacagcctatttgccaccttgattcaccacattcaagaaaaagaaagtaggcattaggacaacctcacgaacacactttgcatggtatttgctgatacattaaacattcccatcttgtcttgaaattccgttgatctgtttctggttttgtgtttaccctttacccttattttaattttaatactttgcatgggatataattaatctgttatagggttatctttccacaatatagaactgaaccagaaaaagaataggggtgcattagttggtatataagttgaagaaatatcaaatacagaagtaaggtcaaatactaattcctataatgagtgtttttatttcagtcccctccattattttaaaaaaaaaggtcaaataataaaacagagtagctcttcgtatctctaaggagcttggagggaaatatcgagatcagacacatacctgctgtacagagagattcaactccctggcaattatacgacaatctctaaaaggaagttttccattctcactggcattcataatgcgctgttgtaactccagtctttgttcagtagtcattactctaagtgaactccatgaacgaggatgagaaacctacaaaatatagggtatcatatagttaatctgtacaacagtacaagagaaaatcacaactgagatcgaatggtctaacattagcaaaatagccaatgccagtcaatattatttacactgggtgtaatgggcttcaataataactaaatggatattgaaacacatttacaactagtagcatgattgcagttgacaatatacagttaaaaacaaaatagaaacaagaaaacggtcacatatcaacatcaggattcaacaacggtgagctctttgcacatggtgttgcagtgttcaatcatgaatagtaatttaacagtaatggtagatcagatgccctgaaaatacaaataatatggatacaggccagcattggccattcaaaatagaacttcaccttttaaaataataggcagagtcattttttactacaaccagaaaagagagaagatatatccataaa

SEQ ID NO: 52470 - DNA, 6619 bp, Oryza sativa
  unsure (1)..(6619): unsure at all n locations
ccagaatcatctacaagttcctttgcaagttggacaagctagcaaacaaaacgaaagaactaatcatttcaattcttctcaagctgaattacaataaacattaaccggaattcataagacagatatgcagcaggccaatatagacctaaaaaatgttaaagagcatgcctaaggttcaagactctcacaacgttaattccaacatcacagacaaaacattaccttgagcttatctagaatatttaccaagcgtgagagtcggcctttggcatgagtatccatgagttggttgtattcctcggtaggaatttctgaaagcgtttttccaagcctacacttagtaatcatgtgatcaatcttctttgctgatcccacaacttgcagaaagagttcaagaggcattttttttgtagctcccaccatagaaaacaacacagacgattgactaaggttcttgtcatgatgcccttctttgtcattatcaaatgggtcacaccaatttggcaaaccactaacatatacccacagaaatttatggaacagcttagctcgaatcatctttgcaccaatgaatccattggcatgcatagcttctaatattaatggtttgttatctttaactctgcgcggaatcctcaatccaagtatagcagtcgtgtgttgattttgcttcaatttagctgctgcacctgaacgagtttctgtatcaaagttcctttgtctattcctaatttgatccacaagttccggtgacaagtctccaacagaagaatgcagtattacatcaatgagacgactgcgggtgtagtctgtaaccagagggacactaactttgatgcatttacagctgccctcttcctgaagcttatttaaagtgcgagtcaatgtcttcctatccattatttttccattttctttttcaagtccctctaaccatttatgtaactccacctttagtacaaatttctttttctgcaaagggaaaaaggaaaggtgttatataacaatatgcagtcctacatgcaaggatgcacttacaccatgcatgcacatgataatgaaataaggtattttggcacattattcatattaaaaacttttgagtgttgtatactcaattagtaacctttagcatgtgaagaatcctcctatgccgtcgatcatcagaagtcaatggagggcagcgacgcctcttcctctgacccaaagcaagtttctctaaaacagaaataaggggctcactttggttaagctcattgattttaatggtgctcatatatgtcaacattcaaactttgtaattcttttttcaacatttaattacaactatgtaggttcacttgcaatgcagcataaaagttgtatcacagattcagttcaaaagtactttcatatgatcgccttttgtggtgataagaaatcctaaaagaaatttatggtcaaagttcaacttggatatcgtgctaactcaaagaattccttaagaaaaagaaacacagggagcacagatgacaagtacaaataactcgcagaactcaaagttagttcgcaagaagcttggcacatacagttctcaaaaaatgcactgtactaactggatgaaatataaatcactaactcagccgtataaatctctcaaactgtcagaacttgcctttacttttgatctttggaatactcgataaaaaaaaaggtgcagggtatgaaatagattacatacctggttatgagcctatgagcttattaaacagagcatatgactgcacatttacttggacgaaaatgtgaagccatttggatatatgcgactaagggtgttcaaaagtaaggtcaataagtgaagttttaagcagcataaaataccacaagctcctacaacagcatggcactcccccaaagaggtactaagcacaattttttgaaagaataaatagaaactaccaggaacatagatcactgtaccttgttcaacaatttgagaaaccccaacgcaagcttcatggttactctggaggggatgtcctgctggtttattgtggcattcttcttccaacaaaagcttgttattatcaacaaataaatcaacccgtgagattggagattctgatcctttagatggaactaatgaccacaaatcagaacacttctcgtggtcatctgggagtgcctccaaattatgcagagcagcaccagctttgtagtgtgaaaagttttttgaagtccaaactcggtattgtgatgtcttgtcttgaacttcagcttcccaagtcaaattgtattttttaagcatggatgacactcgcttatgaagcctttttgaattgttgtgcccaagacgtttgccaagctacatggaagttacatgaaaacatgagttgctaacttcaagaaatacagaacactaacatgctgcactaataaggtatcatgctttgcaacaagatattgcattaggatgggctattggatgctttataggcccatatggctgggaatgggctgggggtggggtgactgggaaaaggctgggcgttgggacagagtaaaaagcacatgattttctggtttcctcaagaggggcacgcagcgcacaacatgggggaaggggaggacagatgactgtgcttttaagtagtaagagactagatgacactgacaatattagtccatatcacactgacaatagcatgtgcattgccatggaactcaaataagtaaacgacagcttctaacctaagctttaaaaatgcaaaagcaattatatttaaatccagataaacaagttgatcatagtagagagataatgacactttactgcactatataatcatcaatgctagtctcatcatgacaggacattttgcacatgaagctctttttttttcattagggatttcaaccagaagaataatgtatcagaaaagattttatatcataaagaagctccagtaagttagtcaaaaatatagatatgttataggccatgctgctagagacaaaatttatgtatttacgctactagaaatgaaccagttacaacccacaagaagccgtacatatatgccattaagacaactattcatattcctgtataccaaaagaatagtttgtaggtttgtagaatatgtcattgaaaagcacagatgtataatttaactcctgaaaaagttacaagaagtacctcaacaagggttattccttttggcccttgagcgttgatcatatcgtatatacagttctctaatggaagctccatgacttgatcagttgcctggcctttcttgccaagtttgtagtttgaggttgtactttttggctgaaattcatttggatcgaatttcttcaacagacgtaaacagcgaataaactgaacaaaaggaatacctttatcacttgttggctcacaaagtatatgaccaggtgaaagataacagcacaagaggggtacatatggacatggtaaattataaagtcttttctaatttccagttcctgacaggaagcactgacaagcccaaaactattactgaatagagcatacattattaattgaaaatgccaacagaacaggaggaaagattaatgtcaccttatcatcaactttggcatcaaattcttcaataagttgtgcgtctcttagcctatgcagtacctaagcaaacagtgtctcagtaataccctataaggaggaaaaccagaagagcagaaactagagagcatatgcagtaagtgattctgagcaaacttacatttctccatgctctgtgcccatatgtcatcctgtaattgagatctacttttatatccgaaacaacaagagtctatcgatgaaataatagcagagagttagaaaactatagagaaaaaataaaatccaggagaataccaaatggaaaagaaaagaaggaacagttgacctttccactagcttcttctagtttatcgcatatggctttcattgctggaagataatcatgaatagatatatcatttttgtcatttacaccaaaagccccatcttcctgcaaaacatctccattgctctcttcattgctgcccagtagttcaggctttatgatctcaattctctgttgtgaattcatattcaggtttttggcatatcgcgagagatacaatgagttagtattgatgatttgtttattctgggaagcatcttcggcatcagctccatgatctttaacctttataatagttgactgcctaacgattaacttctgcgactgaaggctctttacaataaagtggaagttgtttcctttcatacggaaagttttgcatagatcattttgcgttacaccagaagtcctatgagaaacaaaggaaaataacatcacagtgcaaatattcaaaatcaatcatcttctctgcctatatatacattacggaacaatgtatatatggctaacagaaagataatgctattctatttgaccatgcttcttatgtaatttgcaaatgcatgctaattgctaatgatcagaatatatgcaggttcctgcattaaactcacgaaataataaaggtaagaccaaaatacatctaaggaaatggtgtttataactatgccaaattgtgagtaaccccacccaattttggtttgccaagacaatcatgcatagtagctcagcatttgggaaaaaacctcccagttcatagaaccaccagctcatatgatgatttgctcaacggttacgccagaacgcacctgcttgctccgacccgttcaagcgcccccttctggacggcgctcaactccgatttcgcgaacctgcggtcatacatcccgaggaagttgtccctgagcgcggcgctagcgaccaaccgcaccccccgccgctcggcctcctccacgtccttctccaccgggtcgacgggcgccccgtccccctctcccacaacgaggctgatgatggggagcgcgatgaggcgggcccagaggacgcgcttggcatcgaggccgggagagaggccggccgcctcgagcgcgccgcggagcgccggccataggtcggtgaccgggaggccgggcgagaggcgggcgcacacctccttcagcgccgtcgagacgagcgcgtccatgcccccgcggctcgtgtagggtggtgcgccccggtgtttcggcaggtttagggttttggctacggtcgcatctgcctttgcgctcgaggagggctctgtggtcggaggaagaggaggattactcgccacgcgaagcggagctctccgcgcttgccggcggtgtgcccacggtggggagtagtgtatcaccggctttggtccggtgatcaggcttgccgatgatacacaaagagtacgggttagattgcacggcccaataggcccattaacgttagaaatgctcggctcaataggcccagtaatggccgctccctagtccacaaaacctagtgacgcggcgaaacccaaaaacccttctgcactcgccgccgcctccgcaacgaaaatggcagcgctcgcctccctcctactactccgccgccgcggggggagccacgccgacgacgctctcctccgcgcgctcactaccgccggtggagagcagccactcacggcgtcggcggccaagacccgcctccgccgggagcacgaccccgaccgcgtcgtctccctcttcgaggccatcgacgacgccttccttttggnctacttcacccgncacgcgctattccttgncgnacgcaggctctcccgctcccgccgcttcgccgacgccgaggccctcctctcctcccacatcccggcctcccccaccgagccgcagctcgccgctgtcctctgctcctacgccgccgcgtccctccccgagaaggctctcgccgccttccgctccgccgcgccgtccctcccgtccccgatctccccgctccccttcaacgccgtcctctccgtgttcctccggtgccgccgccaccgccgcgtcccggtcctcttcgacgagctctccaaggagttctccatcacacctgacgcctcctcctacggcatcctggtcaaggcatactgcatgctgagcaaagacgccaaggcacacgaggtgttagatcaaatgcgtgggcagggtttcacgccgaccaatagtatctacaccacaatgatcgattccatgtataagcagaagaagatggagcaggcagagcgcttgtggaagcagatgttggagagcggacgcaagcctgaccaagctgtatataatacaaagatcatgcaccatagccttcacggcaagacggaagatgtgcttgaggtgatagcagaaatggaggaagctggagtgaagccggataccatcacttacaatttcctcatgactagctactgcaagcatggtaagatggagactgccaaggagctgtacagatcactaggcgagaaggggtgctcagcaaacgctgccacgtacaagcatatgatggcacagctgtgtgcccatggagatttggacggtgcattggtgatcttcaaggaaagctataggagcaacaaggtgccagattttaggacaatgagtggattggttgagggattgacaaaggctggcagggtggctgaggcaaagaatattgttgccaagatgaag

SEQ ID NO: 52471 - DNA, 1754 bp, Oryza sativa
tgatgaaacagaatgtatggcagaggcgtccactagtgaggaaatgccacgggattctgcttaatcagatgttatttatgtatttcaagtttaatttggttaggatgtttttacattgtgcattctctacaaaggaagaatttctaatgctcccaagtacagaggtaaacattagtttctagatgtggactcctgagccactaagagttatattgggctgacaatgcttataatttcgttgttatggatttattgtggtgttcaccttcagtaataattgttacaataatgtgatggctgatctatttggcgtggaagtgaatttcacaatgaaacacatcactgccggaagttcagctatcctggagctttcgtcatgttctgtactaactgttacaaacttacagtaagttgatgcctggattattcggcattgaagtgaatttcacaaggaaacacatcactgcctaaacttcagctatcctggagttctcatttcagttcctgctttggtttttttgagcaatagttcctggttgattccatgcatgcctatgcaagtaaagcattgaaagaaaatatgctgctggtgatgcttgtggtttcggaggttgtgctgctgtcatattgtttatcctatttcccaatacatcccactgaaattgctcataaatcatgttgacgaggttgtaatcttgtatgagtataacccttgtttgcagatttcagacgaaggtttgcagtgcatcagcaacaaggaagacatggcaaaaggccaaaagcaatgaaacaagttgccggtgccacctccatgctgcgggaacactcgttgatccccggtgattgatcgaaacattactgttgcattgcaagtctgaactctgaagtcactgaaatttcactttgtcatttcctggcaaccttcatcccagtatcaactatccacaggctgctgctatttggttgagacttgagactggggttttgtgaaatactacaacaagaaagcatggaggaattaagtgcaactaagatgcgtctcacccgtttgggagtagtatattttggaacggagggagtagtgtttaggatgtatacaaacattatgaaacggcacaccataatgcatacatacatcctatatgaagctcatggtgaccctcggtttgcggggatcatcgtccccaggatccgctagactagctggccgcagtttgcacaaaacgagaagctaagtaggagtaatcccctttcggcgatgcttgggagagctcacagtttcctgcataaatgcagcacgcaagttgaaactaactttacctctattccgtgaaagacataaacagtgttgcaagtcgcaaccccggttcatgaaatgtgcatggtgctgggatcctgttgataacgggattttggactatttgccatcttccccaatgccacactcctaaatgccatcttcccaaaaaacttgaataaattgccattggtccccctacattagttgattttctaccattttggtccattcttgacgccacatcagcagccacctcatgacaccatcaagaaaatgacattaatacccctgccctttcagtccaaatttaacatagtccacggcaaataatacacaaccaacataactaatagatgcacaataatttcacaagcaaacacagcttggaacatacagacaaaacctgcaaacgctagacagaccaatctaaaaaaagaatatcaggaaaaaattt

SEQ ID NO: 52472 - DNA, 1308 bp, Oryza sativa
ttggtacctctccttccagatctcctaaacgacaaggaggatgagagtgcacagtcccttttttggaactcgcattgtgtttgctagagcttcccaccagtcttttatggtatgggtcgcctcccattgtccaagggtcaagctattggtaacactactacaaaaaccatctttcgtggcggccattttagattttcgctagcggaatttggagccgccacaaagtaaaggccagtgaagatctaatattttcgctgacggtttcgttccgcttgcgaaaatctattttcaaaagcggacacacgattttcgctagcggttgcggtccgcttgcgaaagtaaattttcgcaagcggacaaacgatttttgctagcggttgagtgtcacttgcgaaaacccattttctctggcggttgtttaaagagaaccgccaatgaaaatcaacccaccccgccaaaaattccctaccccaaattcaaaattccccacccggccaaattcaaaacaatccatatttagaaatgggcataaacatcatttaaacacaatccaaatccagagcatcacaaatacgtacataatattggcatcaatccaaatacaacattgacataatcaacagaacaaacacagattaacctaacaaacattcttacaaaccaaaacacacaaaaaaaacacagagaaccctagtcgccgaagccatcgggatgagccaccgcccgctgccatctgccggtcgcggaaccaaaacacacaaaaacacgcttgccggcagcatcgcggtcatcgtcgtcaccacggtcacggtcgtcgtcgtcagctccgctgccggggacgagccgctgttgtcgccgccatccgctgccggggacgagccgccgccgccgacggggacgagccgccgccgccgacggggacgagccgccgcctcccgcgccatgtgctccccgcgccaccgccggggcagatttgcacgtcctccccgtcgccgcctctgttgtgccaccggcggcggcctcctcccctcagacagataggagaggaggggatgggagggcaggggcgacgcagggagccgccgccgctggtcgtcgttgccagagccgtcaccagtcatcgccgccagagccgccgccactgccgtcgctggtcgtcgcctccagagccgccgccgccgcagtcgccggtcgtcgccgccagagccatcgcctccatcgcaggtggagaggctgggagggaggagagggaggagagagaagaggagtggatgtgttgtgttttaatgtggagaagaggatgaggat

SEQ ID NO: 52473 - DNA, 7087 bp, Oryza sativa
  unsure (1)..(7087): unsure at all n locations
ccgccagcaaaaatagacatactttcgctggcggctgcattagatgggccgccagcgaaaatgcattttcgttggcggccggtgcccctcaccccctcgttacaagtttgctggcggttttcacatttttccgccagcgaaatagaccaacgtcatgaaaaatcgtttttctagtagtgtaagccacccggattgctaccatgctacatattctttttgtgtatctgcaactgacaacaagatgtaaagccgtttcgccttctctatgttagaggggccaaaacccattattttgccattctctaatcgcgagccggtcgaaggtccaaaccctgttttggatgactagccatgcgtggaatttgcatttccccggtatccaaactttccaaatgagagagatgaaaatcttgtttggtgccccaaggtgcctgataagctgacgacgccgagtattggccatggcttgtgaacttataggtaatttgatcaggatcctcgtttaattggatgtcccgcacaacagtccataaggtgactaactgacctataaggtccaccgagattggtgggttggcttcaaggtctaagtcattgatccaagcattatttttcattccctgatgtaaggactttcttcgagattgcgttgaccaatggcatgaggtcttttggcctacgcccttctatccaaacggagtcccaaaaacgcatagtgtttccgtcgccgatggttacttttgttgacgcaaatcaacacatgaacatgataacttcttttagctttaatttgataacaatatgttagacagccgatacaacatccattgttttttcgcttgatgcgttttgaacatcgtcacggtcttcaatttaattcatatgtttttatccttacctcttatgctatgcgtgttttcataaaaaattaaaataaaatacaactatatgaaagactttttcataaaaaaaatcctataatatatttttttgcattttaatccgtaatatgttccatctattaatgatttaagagttattgattaaactctaatcattatgtcgttctattgagaacaaatttaataacatgcgggtcctctctcctctcccagctaatatatcttatttcccatggacgaacttaaagcataatattacgtttgtttgttcttacttataatgtaggatactgccatggtctccattatacttgtttgattgttttgcctatcctataatcatatatcataaaaatattgaaaatataacaacattaaagtattttatcacaaaactatagatacgttaaccaaactatcacaaaactacatatttaaggtgttgtatcagaaaactatagatttaacaccgaatttatcactaaaatatatatttaatgataagtaacacaaaactacatatttaaatactaaagttatcataaaactacatatttcgaagtttaaatccctagtactaccgttatgttagagctataaacattgtagttttgtgattaaattggcactaaacttatagctttgtgataaatttgttatctaatctatagttttatggtgttccatcctaaatatgtagttttgtcataaattagacgctaaatctgtagttttatgaaaatttggttaaagtatctgtagttttgtgaaatttctaatgatgttattttcatgtgccaaatattaacattttttatatattcgtaataaaaaaacttcaagattcgactatgcacatttaaatatatcatttgtttgagaatgaagttggtagagagaaattcggttatgcttaagaacagtgatgacgtaggctagattttaacttggtgatttgaaaagtaactgcaaaaatattgaacttgaacgatctatgaaaactcttaggatgcgtagacctttttcctcctcacatttttctagtgaacatccttatgttaccttgatgtgatttcatatgcaaaacaaatgttttctccggcccgtgagtcaaataacagatcgatgtaaaagccggtatatatgtcgagtgtaagaaatttaccctcactccatgatagaaagcaaaattttgtaaagagaaatatgtaatttcatactgtccaatgagttcaacataaagtttttacagattttgaaagcctagaaacaagttttgaagttctaaaattctggaccagccggcactaaacaatttctagaggaggctatgctcattcattccccttggtaatttttctggaggtcactaactataccaggaagccccacaaaaatacgaaaaatttcatctcctctgtggcccctctaaaatttatgaaatggttgatgtcctattgttctaaaaatcccaaattctagtcttctgaaatataaagtgtgcatcaaattgaacggaaatataagatgttataatttcttcaaatactagtttattttccatgaattaatatgctttagttttttatgttggtttttcaagatgttttttttcattttttgagtttttttagaaggggagcagttttttaagaagagaaaggaggacaactgtgtttctaaagcagttaagaataagaagataccgcgttcacgcttaatgtcgcctagtagctagttctgacgtcgggcctcatgtaattttcaaatacgacacttagtactatcatttgtactaggcgagttggcatattgcaaggaggacgacgttgatttgtgcagtttgtcgtactaaacagggttatgtaaatgaaaaaaaattcaatgacagcattgccaccatacgatgttaactatagccgtttggccaggtcatatcgactcgatcaaaccggcgtggtcagtacgtacggtgcacttctgttaacacagctatctctaggtgaaagcctatataaaccatgttttaggacggatggtttatcatttaaaccagctattcgtattgaagttatagattttaccggatgtgctaggcaacagggaagcataattaatgtagatcagcccttgcctctcccaaataaatcgagtccctacttcccaagaaaaattttacaaggttgggaaaaaggaaattgtcccttgttaatagaataaaagtagtagtattagtgagcgggtagatatggagaattgaagtactaaaacttctcgatttatagactaatgatagttataagttaaaaaaatcaacttatcttggaacatattttaaaccgtagaaattaacttaggctctgtttgattcagcttagaattattataatctggattattatgagtaaactgaaacaacgagatagcttattatgatagattattacagtctataagtcaaattactataatacgataatccactctaaaggtgtttcttttagattattactccctccgtcccataaaaaacgaatctagaaccggatgtaacatattctagtattacgaagctggacatatattcagattcataattctaagattctagtattatgtatgtccagattcataatactaagatgtatcatatcaggtactaggttggttttttatgggacggagggagtaggtggctaacagctaataaagagaaacaaacaactaacagcttattctatgtcggcttattataatccagcttatagtaatctagctcagtaatctagattacaataatcttgggacatatggagtacttcctaaactgacgattcgttcgcatactgattacttcatttctaaatgtaagtattgctaggttttcttacaaagatttagacagaaatattcatcttattggtcaaattacaaaaatttaattgtttaaattccccttctaagcacccaaatgctttgattcacttgcattaaaattggtgtcgaagaaatagttgtattgtgtacaaatttgaattataggaatgtttttaatggactgatataaggtgtggaaatttcattgaatataggagtgcaaagggagctttacaagtatggtgtggaactgtacaaaaggggaaagggagaaactagggaataatatctgtcgttttactgctattagagccgattaatttttacggccaaagatggcaccaatagctcttgtgatgaaccactctatgtttcctcttcttccatattttccatacaattagtaggacgagtgtacgaacatgcctttggcggggcttgtcattgtcggttgctagtgttacccaccatttgtgcgctatgttggttttgctccaccatctccatgtttttgggtttaattgtgcaagaggccggtagtgtgctgtgtgcggaggatcatcttccacttccttggtgttctcctcctcttcgctacttgggcctttctctttttttttcgaggaagagtagaaatatattactcaaccaaagtgccagtacaaactaactgagagataaaattacaggtttctcctaaccaaaaatcagaaacaaactctgaacaagccttattggctagcgcatggcttgcatatatggttctgggagcggtgtatcttctgaatgatgatttccctttccccagcgcggaggcgtttaacttcttgaatggtgtgagctagtgctgatagatacttctctttagactgaatgagctaagaggccaccaaacaatcagtctctactacaatagacagcaaagtccattggatcgccaaagcaatttcctccgcgcaggataggagttctacttgggcctttcttgaccccgtagtcatcaagagtgatcttgcccctaccgaaaagggaagagctctcctctgccaacgtcaagtcaaccccccccccccccccccaacacacacacacaccgtagagttcagccaactcaacgtgacaaacaaaatggtagatcctggcaccactagaaaaacagttttctacagcagaacacataatttttggaatggaacttatttttgactatgattgtccccctccctagttgtatggagagatgtctaatacccacccgcctaggaaataaatctattttcgcaggcggatggcttaagaggtgcgtatgcaaaaatacctttattttttcaggcggacctcttaagtcgtccgcttgtgaaaattggttgtggcatttaaatagatgctagaggaaactgaaacatcagatatttgtaagtcccaaccccctctcttctccttagttccgcgatgagggtggcgagggcggcggtggtggggaagggagcagcggtggctctccaaggccgtggcgcgcgggataatagacggcaacgcacctgggaggcggggatccagcgacgatggcatgcgtgggcagcaaatatggtaaaggcgacgcgcggcgaggaggattcggcgacggcgacacacgtgagttgtggatccagcgacagcgacacgcatgggtggcgggggcgcaccctcctcgcattgctcatggttgtcttcctcgtcatcatggtggaggaagccggcttccggatcggctcctcggcagcgacggtggcatccttcctacgacgatgaccaccaccacaacgtccaacttgatgttttttttcttttttgttgagaacttccaacttgctatgaaaaatacgggtgtggatttgaatgtgattttgaacgtgaacttccacatattttttgagaacttccaccacggatgtgtctttcaatgtgaatttgcatgccatgaataatatattgctttttatttttctttttgcacacaattcttttggcaagagttcctcttaatgggtccttctgcaaaaattgacttttgcaggcagacccatgaccgtctgcaaaaatcgacgattttcacatcttgctataggcagagtatttggccacatgcgaaaatgtgttttggccgcctgcaaaaatagcttttctagtagtgcggacaaaccttggatagggcaatggctcatccatggtaacggcaaagcttccttccacgtagccaggccgaatataatatcgaggcatgaaaatgggaagcgactcatttgtgcttcatgcgacccactaacagactgggggtctgtttggggagcatctagcagttatagcttctcacagaatctttaggaccccaaacagtccagattttacccagattctaggaatctgtagttgtagaatccggaaaatgaactagaacccagaagctagaaaacccggcttctctagattctcagaagttggctaccaaccagcggattctcaaagtcttaagctccctcaaacatggcctagaaacgttgtggcaagtatcccgattcgcgccatttcgcactaaatcgacgaatttgatacatgttgtgtgattatattattggattttgatgcacgtaatataatcggacatgcaacatcacattgggggacaatgtctattcgcacaaggaatccccctacgcatatagacttggactcgaaaaaagtcctccgccccctcaccgaagggggaagggaggttcggagtactgtttacaattccgataccacttttcatgccggacgctagtggcacatcgattttcgtgaagtccgatcgaaaaccgatagattctgaacaatatttgtaggcaaaaaaatgaattcgaatgccctattttggtcggtctgaaaatcaatgggctttaccgaaatttcgaagaggaaacaaggcgttgttcagctccctttgttgcagatttgtgggctatagcatcaatccaacacatcagtttttttttttggtgcctatcgctagcgagatgcaattgatagtgtagtggtaaaaggtgtgcggtttcaatcttaaggtcccgtattcaatccccatcctatcagataggatgactcctgaactattaaaaccaatgcaatttgactctcttagctgttgacctggtcttcatcccacgtggtgcttgtgtggtattagaattaaaaaaatatatatgtgggacttatttatcattcacacaaaaatnnnnnnnnnnnnnnnnnnnnnnnnnnnnnnnnnnnnnnnnnnnnnnnnnnnnnnn

SEQ ID NO: 52474 - DNA, 2318 bp, Oryza sativa
agtactgtttacaattccgataccacttttcatgccgaacgctagtggcacatggattttcgtgaagtccgatcgaaaaccgatagattttgaacaatatttgtaggcaaaaaaatgaattcgaatgccctattttggtcggtctgaaaatcaatgggctttaccgaaatttcgaagaggaaacaaggcgttgttcagctccctttgttgcagatttgtgggctatagcatcaatccaacacatcagtttttttttttggtgcctatcgctagcgagatgcaattgatagtgtagtggtaaaaggtgtgcggtttcaatcttaaggtcccgtattcaatccccatcctatcagataggatgactcctgaactattaaaaccaatgcaatttgactctcttagctgttgacctggtcttcatcccacgtggtgcttgtgtggtattagaattaaaaaaatatatatgtgggacttatttatcattcacacaaaaatatataaggaaattttgctacaaggcactgctattgtgtggttttagccctaggacaccgcaaaaactaacttttggaggaaaacaatccataattgtggtattttgccagtggacaccgtgcctggttttagccctaggacaccgcaaaaactaacttttggaggaaaacaatccataattgtggtattttgccagtggacaccgtgccgactaaaataataacttccaattgaagaggagagagaaatcgtgtgaaatgtcaaaaatgccaaataatatattatgggacccactgtcatcctctctctatctccaacccttcttccttcctctctctcttccttatctctctctctcttcttttggcaaaatttgctacaggacactcaaagattatggtctttgctgtgagacactcgaagatcgtgtatttgctcgtggacactgtaaaaatatggtaattagctgctggacacccctcccattattttattattttttggctgaactggagagagaaaggacgttgaaagtaccaaaatgcccccgtgccgttttgcttgtaaacgctggttgaaccagacccaatcccctctcattggaaacggaggcaatgagccggctgtcaggggagaagacgaggtcgaagacaccctcgccgtcatcgtcgtcgcacggtaagccgcgaccactgcatcccggtcgccgtgccgcatctggccaccgcgccatgccgcaccacactgcccgctggatggccggaatcgtgcatgccccgccaccacccagccgccgcacggccggtccgcgctgctccaccgcccctcggccggccactacaccgctgggctgcgtcattaccatcctcgtcgggtcgcttccatatccgcgttaccgtgccagcctgcacctgcgccacgcctggccacgaccgccgtatcccggtcgtcacgccgtgccacgcctgcaaagccgcaccgccaccgcacgacgctcacctagccgcgccacctagccgccgcgcacgcggtcctggcgatagcatcctatggcgtgtcggcggtgaaggcaacgtacaaacagctccagcagacgcaacatccctatgacgccgaggcgattcagtccgcggatgccgcgttgtcctccattgccattgccgcgacaatcggagacgaagacgggaggggcacgagcggcggcacacatagcagcacaaggaagaagaggaagagagagaggatacgtgagaatgacaagtggccccatgggcaaacttgtctttaaccaaagtttatctctccgttttcatcaaaaataataaaataatggaaggagtgtccagcagccaattaccacttttttacagtgtccacgagcaaatacacgatcttcgggtatctcacagcaaagaccacaatctttgagtgttctgtagcaaattttgccttttcttttctcggctgtggcggcagcgggtgggacgacaggtgctggagcagcggcggcgaggaacagggcatcgcagatgggcgcgacggaggaggggcaatgaaacgaatttgggacgccgagatgaccaggccccaatcgaggggagaagaggcgaggcaaggcgaggctggcgtggtggtcgacggggaggagacgatatcgattcagcgtactggtgggaccacgtggtgctgctggtgaggagggcgtggctcggcgtcgctgcctgattcgaggttcgccaaacatgtaaggcgacgagagggggttctggtggggtggaggcggcgtacgtgggtataactctgacgatgtttttggtttttat

SEQ ID NO: 52475 - DNA, 1060 bp, Oryza sativa
cacagccgtcgccttcccctttgccatgcggaggaccttcacgccgagctcgttgcaccgcgccttgaacgccgcgttgcccatcctcggcccgccgtaggagaagacggtgaccgggcggcggcggcgtcgccgccgagacgctggcgacggcgaggtcgtatgccaggagcagcgcaagcgcgccgcccatgctgtggttggcgagcgtgacgctcacgtcctcaccaccggagcgggaggcgacgagtcgggacacctcgcgaaggagctggttgcggcagctgtcggtgcagccgaagcggcatgtctcgtcggcggaggtgtagatgttgagcaaccccgactcgaccttcacgtagccgccgccgccgtcgccgcggcgtggggcgaggcgcgccagcacgagggagctcctgtggttggccatccactcggcgggggtgacggtgccacggaatgagacaagcacgtcgcaccgcccgagccgccgcgtcgtctcgtcggtggacacagcgacgtacccggcccagctggcgcggccgctggtcgacacctccatgcccggcacagcggcgtccggcgacgagtagatgtacctcgtcacctcgtacccggcaccggcgtcctccagcatccggagcttgccgtacttgcagttcatgtacctcggcgacgaagggtcctccaatgccgcgtagcatgcaccgacgagctcgccgtaccgcgccacctctccgcggagcaacgggtgcagcggcgagcatgtcatcccagtcgccggagccctggaccttcctctacacgcgggcgacaaagcccgccgctgccgccgtcatggaccacctcgccacgctcgtcctctttctcccatgaactggatcgatccctttcagctagctagcaaggggcaatttggtaccatcaagccgaaaatacaattgaaaatacacaaaatggtaaaaatggcaaagtggcggtgagtacacgcttcgtattggcattttagcgaaacgcattttcagaatggcattccagcgaaaccgctttttgaaagtgg

SEQ ID NO: 52476 - DNA, 1199 bp, Oryza sativa
tctctccctaaccgctccaatattttccctaggtcttgccggccatcggccgcggctccaccgtggtcgggcgtcgtcgaaacgccgttcccgtcgcctcccgtgccggtcgccgccatcttttccgccgccggccacctccccgtggtcgtctcgccgtcgccgtcctcggtgagaatccctatcgccccctctcctttttccccatccgccgctccccatgcccgccaccgcgacgcgctgccgtcgccggtggtcgtctggccgcgtgcgcgtagccgccgtgccatggccggccgggtcggtctcggccgcgcccgtgccccagccgcgcgcctgtgctgcggtggaccgagtccaccatgagccaccccctttgacccgctgacgtgtggggcccgcctgtcggcgctggttccccttgctgacgtcagcaaatgccatttcctttgtaaaaataaataataattgcgcaataaatcgagtttaattctagaaatccattaaaatggctcaaaacttctaaaattcatatctaactcattcgaactccgaattgagccattcaacttgcaaaattcatctaaaattgagctctacatgtttgtttactttttatgtactgtttccttggtttttattagagtttttcctcgttttgcgtgccagcgtgtagaatccgtcgtttcggaagtccgcggtcgcgaggaaaagagttcggaagatcaaagtgaagaagcaaggcaagtcacacattccccttgagcatgttgatcccaatttataaatgttttaccgtttgcaaataaacatgcatgtcttgctaattacatgggaatagggtttacctatctgctcgcttgtgccatgtttacttgatatctatcctttgtcaaccttgggtgataaattgactagctcgtgttacttatgtgacctagctagaactatatgcttagccatgcttaattaccactagctcagtcgatgggataattgcagtattagacattctagtatcttgttgagccgcgtgctcgagacatctggccatgttttgtgggtgtaattatccaactaaaatgcgactgaatggtgggctgtgggtgcatggttttgtgagtcgcacccatggcaattaaggaccgggttcacggaaaaccctgaaagattacagcgcttggcacaagcgggaatgg

SEQ ID NO: 52477 - DNA, 9574 bp, Oryza sativa
gttgatcccaatttataaatgttttaccgtttgcaaataaacatgcatgtcttgctaattacatgggaatagggtttacctatctgctcgcttgtgccatgtttacttgatatctatcctttgtcaaccttgggtgataaattgactagctcgtgttacttatgtgacctagctagaactatatgcttagccatgcttaattaccactagctcagtcgatgggataattgcagtattagacattctagtatcttgttgagccgcgtgctcgagacatctggccatgttttgtggttgtaattatccaactaaaatgcgactgaatggtgggctgtgggtgcatggttttgtgagtcgcacccatggcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtccgtgggttgtgtcttgtgggtacagttgtgcacctctggccagagtaaaactattcgaatagccgtgcccgctgatatgggcgatcgaccagattcaccgtgattagtctcacacttaataaatcgacccaatgcactgtagtacaggtgggttggttgggcctgttcaacatggtgtagcgttgatcattggagattttaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgcgttatttacgtttggaactgtttattacttgtcgttttgtgtaccctggctggtcctggacagggatttaatgcacaaaatagtctggaaatttgggctaaatttctgggcgtgacagcacgacaagtatatctattaattaggaatagttttttagtttccttttgtctttagaaaaatatgtgtttagtgtccgataaggactttatgttttccttttatctttacgaaagtttctttcttgtcctacaaagactaatatctccccatgggtataaatatgtacacccggagtcattgtaaactatctcttgatcaatacaactactctcggcgcatcgccaccctctttaccgaggtttttacttatcaaccagcggaatttggcacttgaagcggggctgcatcggctttcgatctccggcgaaggggtaagtcctacgtttcgccggccccagtgaatctatcggctacattggtgttgttcaaggctgcatcgcttcgatctcttggatcgctctgatttggttgatatatttgcctacctgatatctcaattctatctctagttgcatttgtttagagacacatcggtttagttgggactgtcttggttaggttcgatcttctgtcttagccgatatatctctacaatcacaatgttgttataaatagatttgttatatccatcacattagacagatctatcggctcatcgagtattaaattatcatatacaatctcgtgctgcatcggttagattcgacctactagattattgttgataatataagtcttgttaagccgataggttcatgctaatgttttatcggggtgcaagctgataagttatctggacgttgcatcggcttgtaaggattgcatatacatatagttggatttagccgatcgcaacaaaagttttactgtttaatctaatcttgtggattttatgacatcagacctccagccgatgtatactttaacctttggatcaatacttgtttgactatatcatattgttagccgattggtttctactggattatattgctatattattgctatcagccgattgcctttatatcattatctacatcggacatatagccgattgctcaaaaccctatcgctatcggctggtatcggcatcggctggaattgctccatcggcttgtcagccgatcggctcattgatctgctatttgtatatcttgtcagttgcagtatcaaactgactggcacgcccgcatctcaacaacctttagacctgcactggagctaagcagatctctcaggccagtgtgtgtttttcacgtcaacagatattactatatgtttttattttctatacttggtgacaccctattttgtacaacttcaaattccaaatccatgtcagctctagagtttgtaaattagtttataataattttatattttatattttatctaaaatagaaacaaaagttcacatctaaatgttatcgatgtaaccataggtatagagacctatatattctgggttagaaatacacaactttaataaaaaaatcttagttctataagagcgaccccaaataatacctaaaaaactttttaaattgaactaaacattataaaacactaaaacaggtaagtttttctattacacagtatacgaacacacaccactatacacatagcatcatactaacgcacccgtgaattcatcctctaccacacgttcaaaagagacatcaaccatctctgcgcacctcccaaaatcaggctctcagatattactcgctcacagatggcttccgcttgcggccttccctttcggggcttgacgacgctgtgtcaagtcggcaacgcgcagatgcaggtggcaaggtcagcgaagcgaggcactgcgcacactggcacgacgcgcccaatgattggctcgcgagctgagagggccgcgaaaacgacgcgcgctaagcttagcttcggtgggcttctgcctgtacggcgagcgaagagcgatcgatggagatggatggatagtgcacggtccacgcggaagccaccaattttaaccgatccaacgtacacaacacaacaaaatcacacgaagctcacagcagcagcagcggcgtgccgtactgccgttcccgtgtcgtagtgtgtgtggcgtggaaagcgagcgatccgcgaccgcgcaaacgttggcgaagaaaggaacaggttttacgtacgttcgaccggttagtgccaaaactggatggagcttttctacttctgtttctcgcgtcaagatcgatcggtcgatcgatattggactaccggctttttattcgccggccctgccttgccgatcgaccgatcttttgcaatactggggaaatggggtgaggtaatcaccagtttagtacagacaagtcgaattgtattctttaagatctccctttttttttgcttttgtttctttttgcaaaagtttttttggttatataattggatacttgtgccaacttatggacaaatgaatcatcgatgcatcaatatgcatcgatgtatgtatggtttgattgaactgaagctacacgacggcggtagcggctagggtttcaagttattttgctttttgggatttttattttttttgccaaaactattttcgcgtaaagtcgctttaggtgaccacatacgaaaatcctgttttcgcatgtagttgcactacctgcatggaaaaataacagatatttacagacacctaggtgtagacaggccgaaggcctgcatgtaaaaatatgttttgaccgtctggaaaaatccttatttagtagtgttttgctctaattccttaatcttgtgtgccttttggctgttattggctttctcatcggcttttcgtatgcacgttaacttcttgagggtgggaatgcctcccatataggcacaagtacacaaccgctgcaccaccacctggtccttggatctagtgacctcaatctcatcatagcccgcatgtggcattgccctccatgcactcactctcggaagcgattgccacgtacactttcacctacacttcctagccgttagattcacgtattgcaacggtgatctcatcactattagatctaatgtcccccggtctaattgatcaccaccagatttggtaacctcgccattctcgtagaagagcttatcccacggtggtggagatgacatcatatccaacctctgcctttagtctctgatggagagggggcaggcaacgacggggcatggagaagggggaggtagggctcaaagagggaaagcaaggaaggagtgagggggagtaagggagagagggagatgagttatcagctaagatgagtggaagattgagctgcctgattcaacctatcgctagttcatccagttcactatggtttttatataggaaaacgtatgaattacccctttgaactatcacggcagtatgaattaccctcctagaccacaaaaccagacatttttaaccttgaactatctataccggatgaataaccccctttgatcaaatccgtcgtcgaccgccactgcgcgcctcaaccaccgaccgcccaggcgagctctgccttagctgcccatcacccgggcaagcttcgcctccgccgtcaactgactggtcccactactgcaggacagggcatgatccgcctccgcctgcttgagcgcgtacgcgggagagagagagagagagagaggggtatgacaggtgggcccaagggaggtatttttttatttttatttactgactagattgccacgtaggcgcaacgtgtgcaaactcaagtaaaaaccgttcaaaacagtgttaaggggggtaattcgtccggtattaaaagttcagggtgagtaatgtctggtttttgggttcaggggggtaatttgatatcgatcacgatagttcagggggtaattcgtacttttttcttttatatataatgaactggaaataatatttttttatcgattttagatgagcctgtagtgattaactgatttaaattgccttcctataccagtgaatcagtgattcaaagttagaaccgaaggtgttaagtactcctacttgaggtatctaaattttacactaaaatttttggtaccttgaggtactttataaaggatggtaaaattaccttaatataaattatgagatccacatacaaaggttttatttcagatgcagaaattccgtgtgattaaatatctgcattacatttgtcagtcgtcacttatcatagtaaacgtgcagacagctctcttttaataattgacatgtttgtacgaatgtgtaacgattgagtcattggcacgacactttatgtagtgtcatgtccgacgagatctgacttgcgagaaagcacacacatacatgcatgtacgaattagcatccagtgctttaatgcttttgcaggttgaaattgtaatagtctttgcttcttaattcctccggtctaaagtataagtttggtcatcattttcatactctcacgcatatggcgatgctcaacttaacacaccacaggggttaaaccaaatcacttggtgacgtcttctttgccgtatttttatctaacaagtagattttggatagtgaaagagagccttttagatcacttaaaagctgttacacttaggttatgaaattgttttctttattccgacgtttgaaagtactccttgtgctattaggtaagaggtttctttttgtccatgtgctagcaagtatatttcttattatcttatatatagcctttgcaacctaggttttaattaagacgatccatggatatatagcacaagtatttccaacccaaaaaatatatagggtttgttcagattggtgccaaaataaaccttaccaaaatttggcaaattggcaacattttcaaaaaaaaattggtatgattggcttaataatattgtcaaaattctatacacattgccaatatttggtaacaaactaaacgtggtcatatgcctatcaattttaccaaataatagtatgattgaaaatgtcatcaatctgaacagcccataagctccctttcattatgcaatggtgtgtgtgaaagatatagcagtagtacgggcacatacgacctgcactagctgcagcctcaattgcaattcagtgctggttaccactaagcaagcacaacacacacatgacagaccagtgaaacaaaggaggaaaaaaagaaggcactattgtgtttggttggccccttcaatgtgggagcttgaccctacctgaatggatctatcaaatcaaaacccttgtgcaaaagagacacatgtaaatgtgcaatgtgtgtcttcccttttcacctccattggttctcagctgagaggcagtacatcatatagagatctttggcagtgcacagtccggacactttagggggacatcatatatacaaagaatgtttggccaccacaaacttcagctttatcttacaaaattcatgcatggttcatttatacaatttttctcattaaaattaatttcactcgttgcaaattctttgattttttgagtagtacctagttttgcaacaaaagaagttattggagaggtattacagtcaagtttgttattctttttctagttgtatatataggttgaatttgaatttttcatgtttgtaggacatatctcatattgatcatcatgcttttttttttttgaaaaaactatgatgatcatttgaatgacacacaaaaaatcccttggagaatgaaaagagtttcccatgccattgctctgaaaatatttcaggccgtagctaataaaaaaaagagtgagaacaataaaaaaagagtgagaacaatctgtgatgatatacatgtatagcactaaaataatatcagcggcaagcatcaatccaagcagaggacataacaagtaaaagagatttgatagcttgcaaacgaagaaaggcactaaaaacctttgcttttccacatcaaggtgaaagcgagatgcatctttatccaactggatactggagaactagtagagactaataactagtggcagcagcagaaagcaccaaacaagcaccccaaccaaacaaggcagaatccacccaccccaaaaacgaatttaaaggaggaaaaaaaataaaggaagctaacgcaacgtagaatctaattagcattgttcctctcactctcaggcacaaatcagattcttccaggagtcaaaggctctctctcaaagctttggctttcggttcacatggtgacatggttcagattcctcgtgtgagccagggaggagtcgacacggcggctgagagcactgagcagaatcgcaactcgctctgccggagattccaagtgccacaccaaagatactatttctctcctagtagtagtgcattctcctgcatggctgcaactatggacggctacccggctctatctttgcctttggtttttctctcgctttctcactgcttgcactagcatattaatttggtgattgatctgaatcagctgcatgcgttggccgtgacgaattcagaaaattgagggtcatacacataccaatggtctaaattgagcaatattgtatttaatgtagcctaaaacaacaacgagaaatggacattctacccggtgtcttgtgcgctaggtagtgtaccaccatgtataaccatgtgtgatgccattgtatatgaagctataaacgatgaaatatagaagtggattaattggagcacgaacagtggagtatattagagggttaggaaattgcacttatttatccgatttttttttcaaactttgtttagcataaatccattatggcgtttgtcgaagctgtgggcgtagaaagttgtccaaaataccattgttgtgttgatgatacgttgaactaggctcttattacgcatattgccatcgattgtcttgtcacaagagtcacaactcacaacacgatgatattttcacaactgttgatctaagcgctagatagaaagggatcgaattctgcagccgtggaggcaattaccacaagttggttgcgtccactgcgcgaaggtccattcagggcacaaaacctcgctttctccggcgtaattattccgtgtaaagcagcagcgcatctcgtggcagacacgcgtagtcgccaagcaatcatcgcgcgaggagaggagaggagaggaaggattgctcacagctcagagatcatatgattggtgatgaaacgaaaccaagctgaggtaaggccttagtgctgaagtgcccgagtgaaaagctggctggaggaacgaactggatatcagaaggtttgtgtttgttcgttggctggctcgatcactcggagctcctgctgcagattgggtcagtagtgaaagtgtgtactatgcatgagatgagtgcgtctttacaggaccctgttctgggaacttgtgacgactaacggcaagaatacctttgtggccatgatgaggatatgaatgcaagggcttcaaggatttgtccatattccataggagctggtacaaaataattgcggtaggtgacatgctatttgcaagatactccctattaacaaagctccgcgttaagacagaatcagcacatgtgtattttgcatcaagtagacgcacaagcatattacaggctgttaaggtgataaggtcccaactaaaacatgttattcagcactcgagatgcaagaacaccttatgtacaaaagcacaacgggatcaacgtgccccacttaagctccgagcctccgaccaatgcaaccatcaagtcattagctgatcagaagacatctttccttcctccattgtcagtgatgcactaggttatattgagtgctagtcattaatcttttcgtaaacttgtttttacttcatgtcaaccacctttccataagcctgttttacctcttcaagattttcagttaatcctcataagaaagggattgaagagaattgaggggaattaattccacactagatgtataataaatccccttcaaaaacaaggctttaggcagttagaagaaaacccttcaaaacaatcgtcctatcaaaaaccttaggacaagtagcattcatcgtctccttccataactatggtagaaaccaccagcaatgtggtgccgctgccgacctcctctgatcgaaccatcccaaatgccccgtccacctgatctgatactgctgccggtgttgcttcctccttgaccccaatttcccatctgtgacgatccaccattcatttcttcttcctccctttcattgtattccaggatcctgcgcttaatactctg

SEQ ID NO: 52478 - DNA, 1856 bp, Oryza sativa
actgaggctgcacgctcactttcttcgagctcaagtaatgcagcatccagttcttctactgatgaatacctagccatgttgggtcttagctcagcaaacaaatcctgcaagaacacatggcaaaatatattttcggcatcatcaatgtaatgaacgccaacaaaaaaaatcaagtaatcataagccatatatctacagctccagtagagagtaatatattccaaaattcaaatgcatgaaactaatcctgtcgatttccttttgactcgttgtacaaacataataacaatggtaggattaagcacaaaacataacaatattgtctggttacgaagttacaatgttctaagatatttcattgtttcacttgtaaagtacgtagtttttgcacagtgaccctacagaagtcaaggctcaagacaagatactccttgttctattttactgtttaatgtttcttgttagcaagaaaagtattgttgacttagcttctcctatttagcaaaacaaacaggtcgataggagtaaaacccaattttcttttctattctggtccccctagtttctcaagaaaagaaaggattacaggtccatttgcttaccaaatttcataatgctatttttttgtaaagttcatttggttacaaaccaaatacccatatttggcaatacccgaatatcaacatgcctcagaaatatgatgaagtaatcaatagaaagcttatgcagtcatttgacccatcttgttgggttttttcccctcataagttcataaccagaatccgaaaccactagataactattcttggctacaaacaacagcagtttgactgcacacatatgacactcgtgttttttttacttagtaacccagcatctctaatggagaagtttcacaaagtatatatgcatgttgggttgtcatcaggctgttcacatgataaagagtactaaaatgtacttatgaacattggcaaggtgtataatgagaaaaactaacctgaacgtcaaattctatgtcaagtggtaagggccctttactaataatatatctttgaaaatgcagcaagaacttgtcaagctttctttttgaagagcctctgttgaaatagtggccacaagtctgcagaagtgtaatgattaacctgatcctgaagcaatcttctggtggatccaacacatcttgctgggataaaaaaaaaagaagattactcaactgaatacaatgacagaaagatttgttagatctttcttaaaatcagcttgcaataagtattaaaaaggacatgagtaagaagatcaatgttaatgccacaaaatccaggcttttcactctaagaaatatgctgatgttctgtataatttggagtgtgtaatatgcacacaaatacagcaaacaagttacataacactaaagccaggcacagcatgattaacttttgatgaagttgctcttgtgttgtactgagcaaagagaaaggatcagagcacgaaacaatgttctagtatagcaatttaattgtttcaaaacagcaatcttagagccatgtggttttcttttttgaaaattacagagtctgagcctgcatctgaacatatcaacagaaataaggaatagtgccataaagttaaatgaagatataaaaaagtttccaatctttgctaaaggatatactcgtttacctcaggagttccatgaccaaatacgatgataaggtacagagtctcgaatacaactgatgaatcaatatgcttgtagctgtatagctctccaaggaatctcatgtgggcgagacgccttttgtgcattccatagtcattcagctccagccctacccttgtctctctaaaacctg

SEQ ID NO: 52479 - DNA, 2806 bp, Oryza sativa
ctttgctaaaggatatactcgtttacctcaggagttccatgaccaaatacgatgataaggtacagagtcccgaatacaactgatgaatcaatatgcttgtagctgtatagctctccaaggaatctcatgtgggcgagacgcctttgttgcattccatagtcattcagctccagccctacccttgtctcctctaaaacctgaattgaaatagagaataaagtaaaccacttggacatgatccacaaaaaaactgaaaactgccactttgttacaatttatttctactagctgacttgcaaaaaagagagcttgtggatagaattttggtggcgtagctatttctcaaacattccaaacacaaagattttgttcagaaacaaaggtaaattattacaatcagacatgcccctttggatcaaaaacaacatgagctaataccttgaacaaaggaactaacctcatctaccactgaaacagcaaagtcatcatgatggcgactaagaccagcagttagaagggcaatcagatgaacatggctgtattttcccttgtgaacctttagaaaacactttataaggtattgttggcactccacccaaggtagcttgcgtaattggcgaagaacatgttcaacacttgatttatcaagatcggagaaaagcaatttccgtatgtactgcagaggaagaaaaagacgatgaaataatcactactacactatactctgtagataaattcagtgaaaataatcaaagaaacgatcaaagaagacagaaattttacttgatgcagaggtggccgaacttttgaaactcgagcagatctttcaggtggtttacaaaggtaataggcattttctacaagtgtactgtggcggggatccaaattcttcacatttttcaatcgcatcagtatctccaacatgttagccatacgaatagtagtttcaggtgaacgatacaaaaaacgtccacaagtctcgagtagattgcaggccacatcaatgttatgatgactgaaatcatctaggcaggactgcaaaatatgtaagatatgagtacacaaagcaagtggaaatgcagcagagctataaagttccaaatcaatgcacaagatatgaataccttcaagcagctaaaaacaagagctgcaggtgcaattttgaatttgcacaactccccaataaacctaatgttttttatttttgtttcaatgttgatctgatcctgaaaaaataacaaaacagcgaggaatagttagtcacggtaactatcaaaggggagaaaagaaaatcttgcgtcccttaaacttaacatttcctagtctgtttggattatatgtggggaagatgcagaacatctggtccatgattgtctttgcttacattgatgttaatagcctaatatagatcggagagctaatgatatatagtccctccattattaaatatatattgttttagaattcatgcagacaaaccttgaaatcttaagtcactcgcatatgctataataatataaagatttcatatgtgaactatgtcattagtaaatgtcatgattttttaaacatagttattgttttacaatgagtatacgattagagaaggcgatgatcaaacatgtacattagagactgtaacaatgtcctaaacaataagtaaaagaaaacagagggcataccagatatcacaaaagaaaaaaacaagaattttctttcgaaaaataataaaagaagaatctttttgagaaggaacatgaaatgagcacaaataatgcaaagggaagaaaatagttaatgtcagcataccttcttatttattaagaagttgaactcctcttcaagcatagaaagaagcatacttggaacatctttcatacatgttgaaagtgtagccaccaaccgagaatagtaaggcaaaagttccagtgaagtccttggaacattgaataacgtccgcacgagtttctttcgacttgctttagaatttaggtagcaaaactcaacctggaaccaaaagtaagttatgaatgataattggtgttaaacatgaagtggatcgataatacaatttgagttaataccgtcaattggtcaataagatcacggctaacacatcctggcagcctctgaaggaggttgtctaaacttgcaccatccacagctcttattttctccttctctctttcagtttttctgtcaaaatccttctctttagatttttccttgtctacaccttttcccttatctttatctttttcttcactatccttcactccatcatctgcctttccttccagatgatattcagtgatggaagaagtttgaggattgtcatgtacgtcagtatcttgttctgcgacgggttccttcaaaagaacatgcaacaatggtttagggcaggacatgacacaatgacatacaaaagggaaatgatacaaaaaaaagtaagaaaatgcacatttaaaaaagcaatgaacacattccatcttctctcttttcctctcccaatccacaaacatacaacaaggacacagaaacaatcttgtgtataagatatgaaaatgtattggaacactttatcaatcaaaattgtaaacaaggaaatggaaagcattcattggatcatgctctgtcaaacatctccatataacatcacatatttgattaacatcaattgggaattaaaacactgcacaaatatttagcttgaatcaatctacatacactatttgaatttaaacagaatcgtcagccatatctaagagactgaaaaggtctgaactttgatacacagaagaaatga

SEQ ID NO: 52480 - DNA, 2618 bp, Oryza sativa
taccctggatgcctcgtgccactaaaaaagagtacccaaggaaacataagtgacaaccaaattgtcatgcagtgatatattgatatctaaaaaaccagtttacacagaaaaaaagtactaagtttggagacattgtgttcttacagattgttcacgacccttctcattcaactttggttcagcctctcccaataacacagcgggcacaaatgctctgctcgaaattaaggcatataggttaatgtagttccacaacaactaactagtgagagaagataacagtgaagatatgaagggaaacctgagatcaggtaaagattcataaaaagcttttgtatcctcatcatcccaaataggttccagtgcagacggttcttttgcagtagacggggctacatcacttcctgtagtaactctagttgtgtttccatcatctggcatcacggggggctgcatgtcaagagcttcagctaacctgcaaaagaaaggttaaagattggcaaaaaccacacacaaaatacatgcaactagatgataatgttaacatcatcaaaagataagtgccaacagttagtcaacacatggcaaaatagttatatttatctaccaaaatttaatggcattgaacagtaacactacaaagatcacgtgttggaaattaacattgatgtatcactgaatgtggacactggtcccaacttgccatcctcacattggatgcaaaatttacaatttaaccatttgcaatgtcattgagcaaatctttttccccaaaatgtgcggctgtgaattaactaaatatctgcggtcttttgcaatcacaaacatgaaaacatattataggataaaatacgtagaaagatgtcttctatatcactttgtaaatcttttgcttagtaggaaggaaacaatgttttgaagttcgatcaaaacagtaaaaaaaaaaatttttccggattacatgatcaaaaggaaatcctctaagttacatattgtttttatactgaaatttgagaagggccaggaatgtctggtacatgttgtatcccagctgcacttaggcatggtatactcctcattcatgtgtatgtatattcatatgataaactatgttacagtgtgtgtggtacagaagaacaccatgattgcattgtaataaagataacaaattagaggaaattaaaatggtaaattccagggcagcacatgtcctgcaatactatgcaactataagctccctaacagaagaccagatgcgagaactggataaatggtagcttatgctgttacggaaccatatacaaataaattaaagataacactctcaaatgtatactcacgaggatacaccacgttgtaaatgatcaaaagacttccggagtttttcatacgaagcagtgttctcgtcgcttagttcacctttggcagttaaaacttttgcattctctgcctccatcagacgaagagactggggatagtgcatagttgggacgtattcataaaagatatcagaggaaagtaaaaaaaatgatgacaaaagaaggcaaaactagtatatataagagagcagttaccgcatgttctgattggagtagttcagctacagcatcataataagtgttcaaggctttcttgaagaactttttctgatcagccgtaacatttagatccttaaataactgtaccaattcagaatttgtgcggtcagatactcagcgcaatagtatggatactataatgcatggacaagagtttgttcgaatcattcaaacatatgagtcttctgaacaatgtgctagctggtatatgtattccagaatgctgtattggtagaatccttaggataacacagcttagcataaggtggggaagtagccaggtaggatcattttatacatacagatccttcccatgcttaagcccttgggcacaacgagtcaattatagcctaggcacttcctgaattgaagttccccaccattttctttttataataacaaaattaaaccttatgggtctatctatccttagtggtgaactagccaaattcgatattttatacatttctaaaagctgaaaaatgtatgtgcacatattcagaaacaaaaccagttgaatgatttccgttcaacaagtaaagagtagatctctcttcctaatgaagtctcatgatttaataagtatgcttaaatttctcttacctcatcataagcttcttgaccatgagactgtaaccctatgaaaaatctcccttgacgagcaaaggcagaaagaagagacaaatttgcctgagttgtttcccggtccttcaagtgttctaatgatgtaagatcttttataatgtttacaaatatactagcatcttcaacaatcccaacaaaatacagttcaattagaagtttcagtgtgcttctcttcttcatagctcttgagtttttgtctgcgtccaaatcttctccagatttcccaggaaagaatacctttagtagcccttgtgtaagacaaggagagaaatccttgtatctttgatgaagtaaggagcaaacctaaattacattgacacaatagttattatattacacaattccagatagaagtgacacttttggaagttcaag

SEQ ID NO: 52481 - DNA, 797 bp, Oryza sativa
aagttgtattgattgatagttatgtaagaatttataaggagtattgaaaaataaaactcattgatttactgaacaacggtaaataagaagataaaagtaaacttatttcaagacaaatggcataggctagagataaacttatttgggaatagggaagtatacattgctagatggatatgtgtcataacttaaccaagggcggaggtaaagtataggagggggaggggggtgctgaggaacccagttaagaaatttttttagctatatatcacctatttttcactatgtgttcaccccccctcagtacaaaagacttaggaacccacatcaacttaaatttgatctaaagtagagtaaattaagcaagtggtatccttctcaatttcattctacccctgcccctgaacttaacgagagtgacatctttatcgaaaccctcggtgatctattggcacttataaataaaaaccatatatagaattaaaggtgaattaagggttcgaccatggcggtgagctgattttcactaacaatatacttccattcttcatctaagttgacattgtttaggatatgattatacagtatcgaagcacattcatattattttttattgaagttattaataagatataactacacgcaagcatattaatgttgtttttagatattgttaacgccagaatttggtaagcccaaagtaatcatcggtctagagttagtatcggcttcagagtcttggaatcagccgatgggaatcgtcaaatcgccagcagttgtgttcttggtggagtcgg

SEQ ID NO: 52482 - DNA, 1461 bp, Oryza sativa
  unsure (1)..(1461): unsure at all n locations
attggcctcctcaagcagccgttcacgcgccaggagaacaccgtcatccagacctgcgtagtctccgcctacggcatcgccttcagcggtaaacgtcttcgacgctttcggctttactatgacttctactgcaccacctttgtggattggaaaacccttttnccccttccggtttgcaaagccgaaaggtttgggtactgtgtgtgcttatgtctacctccgaattgaatggagcgagtattagaggaatccatttggttagtgcgtcagcgtgttacaacgttactcttactggtggttgcgattttgggttgtggttatgtgggagtatgatgcagcagatctgatctggatgtgggagagtcgctggggaagtgtagcatttcgcggtagtgggtagctgggagacatcacggaatcggttgttcttgtgcccctgaagaaaaaaacaacaactactacaacatcggtctcaaaagcggtttctgataagagaactgtactggaaaacttgaagaattgtcattcttggattcggacttgtcaacttgatgctgctttgtcgcagttgagtggactctgctgtttctaccttttctgatttcacgaaacagctgcttgacttcagtgcacctgatttgaattgtgtagcaacgggacgaatctttagaagattttggttttggaagttggtttattaggtgagctaagttgtggatatagatagtcaacactatatttttccctgtgctggtaagaaaatcgctgcattgctctcatttgatgggaaaagccatttgcgtttaggatgcgacgtttgcaggagtaaggacaagctgaagtggaccagcttgcttggtttgactcctcaccttaaaataaatgcatggcgcatgcttcttctttttttctttgcttaggcagacatgacacatgcatgtgaaagcatttggatcggcataaacaattataatggtctgcaggattatttgagaaccatgctacgtggtacactgatgatcattcgaataatttcatgtggcaaggcatgatgtttacttgcagatgcctagtatatgaggaatttcgtaaggatgtcccatgtgcatcagatggatataagttattcttaacaccagaattaagtttgtttactgttttctattccaaaacagcaaagaaaatcaagtaagtgtttccaagaaagtggtgaaccaatgattaactagttatctactatgtttttaagtggtaataatatgtcaatgcaccatgcatgagatagttgcttgattccttgcctcatttgcccaaagcatctcatattttcttttgatgtctgtttacctttatgaaactgtatcccttgctagaatgtcataatgtatgaacaaaaatttgtgccaattgacatatttttgtacctggttattccaaattccaatgatcaggtgggtttgg

SEQ ID NO: 52483 - DNA, 945 bp, Oryza sativa
caacaacaggtcagaactcagaagtatagcataacattggttttaacaacagtgttgactatgatgtccgttgcctcagcttaacctatagctaatatctggtgaaacactacctctgtcgtctttggctgtggtaaaaactgtagttactaatgtctagtgtctgaccatctggataatagttaattcttagttccaagccattggtctcccatatttgacttgacctgttacctttcaggtttttctttgatttctctcctacatatgttggagttggcatgatctgcccatatatcgtgaatgtgtcggttcttcttggcggtatcctctcatggggtgtgatgtggcctctcattgccaagaagaaaggaagttggtaccctgctgatatctcagacaacagtctccatgggctgcaggcttacagggttagcatccacctttccgctgattcccctttatgaagctaaatcatacaatacagaattcaaaaggctagagagcgctttgagtaatgttttaactgtaagttcattacctttgcaggttttcatatccattgctttgatccttggggatggtttatacaacttcctcaaggtgcttatccgcacaattgcaggctttatatcaatggttcagaacaattcaaaaggcatgcttcctgtttcagacaatggcatgtccatgtccactgctgaagaggtatccttcgatgatgagcgtcgcactgaaatcttcctgaaagatcaaattcctaagtcagttgcatatggaggctacgtcgtagttgctgctctatcgattggcacccttcctgagatcttcccgcagctcaagtggtactacattttggttgcctacatcgttgcacctgtgctggccttctgcaatgcctacggaagtggtctcactgattggtctcttgcctccacctatggc

SEQ ID NO: 52484 - DNA, 722 bp, Oryza sativa
atgagctgcgagtgctgcgggctggaggaggagtgcacgggggagtacgtgggcggcgtgagggcgtacttcggggggaggtggctgtgcgggctgtgctcggaggcggtgaagtacgaggccgggaagagctcgccgcgggcgcccgtcgacgtggaggaggccgtgcgcgcgcacatggccttctgccgcatgctcaagcgcggcggccccgccgagcgcgtcgccgagggcatgtgccagatgctgcgcaccgcctcctggaagcagcggcggcgcgcctccggatcctcctcgtcgtcgtcgtcgccgtcgccgcgagccgcgcccgagcgccaccaccaccaccgcgcgccgtcgacgctctcggtccagctcatctgatcgggcgatcgatcatcgccatacatgtacagcgagcgcgcgcgcgcgcggtggcgtggcgtggcgtgcggttcttgtgacgaggtgcacgcagcgcacgacgcatgcaatctccatcgtcttcttcttcctctcgcatctagtagagagactagcagtagtaatatacataaggtttctatgtgaattttgaattttgatcaggtggtgttaaccacggtgaaagagggtgcacatatgtgtaatcaagttcaatatttttcacattcttttcaagtaatatttcacatgatcttgtactatactctcgtgcctttagctagcttcgcttctaggag

SEQ ID NO: 52485 - DNA, 886 bp, Oryza sativa
ccagtgatcgcagatgctgcaaatattcctcctgccagagaaaaacatttacatgtgaggtagtagctgctcgtttccagctctgcaaaaaccatcgggcacgtcacatactcacgttcaaatcagtatacatggaaagcttttgcaacgcaaagaaacagaaagcttgtccttaccgtcgtcatatcgtagatcatgtcatatactgtacaccacgattcagagaaagagacaacacagccggaatcctcatgctctttagtgattgatctttacgtctcagccatcagttgcgatcacgacaaaaaaagtgatcagcgtgcagttaaatcagcagcaatttgatgcattgcaaaaatgatattatagcgtgcaattatcattggatagcagcatggttaatatagggtaagtaacatttcaaatcacagataacagctgctacaggtagagcagacaacaagaactgcgggcatttcgactgaaacaacaggcatcagaattcagaagccgttatgctgtggcctatggataatgagaaaagtgtttgctagtagatttaatcttacagttgtgaatgtcaaaatgccttttgttttccaagcctctaatggtacaatgagaaacaaagaactggttttgctgaggctgtaggccgatctacttcttgatcttcttatcgtttctgccccttttcctctgctctctcctttcctccgagtagtgcttctttaccagcatcttgtgcattgatactttcagtgcagctagaactgaagctaacacctcttcttgctttgcaatgtcaagacttccttgcagcgccagaaggagcttctcaccatgtggcacctcactgtcttccaagactgtaggaacatgatca

SEQ ID NO: 52486 - DNA, 1531 bp, Oryza sativa
  unsure (1)..(1531): unsure at all n locations
nnnnnnnnnnnnnnnnnnnnnnnnnnnnnnnnnnnaaaatgatctttaaattgttaaaattatttcaaatgctcaaataatatcaagaaaactgttgaacatacttggataacaacattaaaaccagatcatttaatgattaatttattatttaaataatactgaaacgttctttgtattattaaaattagtagttgagctttgaaaaatccgagaaaaattccagagagcagaattaaccacgcatagaattaaatccatccatgctttatatttaggaaattttattatacatttacaacttattaatttatttatatataacattaattcaccaacaaatacatagcattaagtgtagccagcagcgaaaaaatgaggttggattcatcatgtcatctttccattcactacttaaaaaatatttttctggatgaccacccgaatagattgcagacaggccataagtgtttgtgcctacaaaaatttatcccattttcccatacggcttcttaagaaacttgtatgcaagaatcattttttccaaacggaccatttaaaatatatggacgtgaaaatgtggtgtttaactcaccggcatgcaaaaatacccccccgtagattctcactttttttattctccagtcctctctctttcccatcacccccattcatctcctccctcccagcggtaggcaagggcgacgacgatggcttcctcctcttctcccccactccttctctcccctctcccccctcccgacgcggtggagggctcgggcagtgggagagggcggaggagggatgcgacagcggcgacagatctggcggtggtgaggcgtccggcggcggatccgacggtggggaggtgcggcggccatcacccgcgcggatccgactgcggcggatccggtggtggggatgcgcggcaacagcggatccgatggtgaagaggcacgggggcaacggattcaactctccctcccgcgcgtcgacagtgatgggagcgggcggacccggccacccctagccccctacgccccacgacaaggacgaggatgaggatgaggacagcaacgacgacggttacaacgacgatgatgacgaggaggacggcgggcatccgtgatatggacaatattacatgacctaaaaaaataaataacttattgtagccataaatataggagtcaataaaaaacaattttatttcaaggtggtatcaatatctttcttataatcataaatcgagcggatccggtagtggggatgcgcggcagcaacggatccggtaatgaagaagcatgggggcagcggattcaactccccctccctcgcgtcgatggtgaagggagctggtggacccagccacccctagcccactaccccccacgacaaggacgaggacgaggacagcaacgacgacgatgacgaggaggacggcgggcatacatgatatggacaatattacatgnnnnnnnnnnnnnnnnnnnnnnnnnnnnnnnnnnnnnnnnnnnnnnnnnnnnnnnnn

SEQ ID NO: 52487 - DNA, 986 bp, Oryza sativa
aggtggtatcaatatctttcttataatcataaatcgagcggatccggtagtggggatgcgcggcagcaacggatccggtaatgaagaagcatgggggcagcggattcaactccccctccctcgcgtcgatggtgaaggaagctggtggacccagccacccctagcccactaccccccacgacaaggacgaggacgaggacagcaacgacgacgatgacgaggaggacggcgggcatacatgatatggacaatattacatgacctaaaaaaataaataatttattgtagccataaatataggagtcagtaaaaaaacaattttattttaaggtggtatcaatatctttcttataatcataaatcgagtagatttaaaacaacaaacaattaggtatgagtgtagtgagtgtcaattcgttgcacaacaatagaaggttcgatttagtggagtcactttcggttgatatgtcatcgctttcgattccttatctactaacgtgcatgtacagagtatatatatgtaaaatcaaaattgacttcacccgtggcaacgcacaggcactgtgctagggaatataaacatatatatatatatgtgcctagatttattaatatttatattaatatgaacaatgctagaaagtcttataacctgaaacggaggtaatactcaataatagtagcagattaaaacatcaacgaggcatggagattgatgtttgagaaggaagcgtaccaatatcggttcgagaagacaaccggaggtccggagcctccgagatcacggcggcgcgtcgtcctggcggtgccgtcgctgggagtaggcaccggcctaacgaggtggaccacgcctcccgcttcccctcacgccgagtcccccgacaccgcgatccaccgtccctcggcggcggccaagcgcgtcggtaagcgaggggagtccgctcgctgctcgatcccccctaaaatcggaacgaattttgagctcc

SEQ ID NO: 52488 - DNA, 3165 bp, Oryza sativa
  unsure (1)..(3165): unsure at all n locations
gcgataacggctaggtgccactggaattttgagaaattagatccatgccactccatcacatttttcgtccttcccgtcactctttccatccttcccatcactttttcgagtacggaggccagcatcgtgggcggaaggaaaacgaaatgccgatgaaaaatggggagcggcggagcggatgaaaaacggggagcggtgtcgtgggcggaagggaagggaagtaggcggagcggcggagttgccggagccgctgctttctccgagcccctggtgtggcaggcgcgccactcctcggcgcagcctcctccccggcctctctcccttttcatcttagatctgcccgaagggaggccgtcgacagcaatggcgcccctccctgaaggcacggtagcggcggcgcgactccctccctccctccctccctccctcttcctctcaccctggccctgaggggggaggggacgaagaaggaggacgatggcggcggcgcgactctctccctcaatcctggtggtggctcggcgacaagtaagggcgacaggagcccagctcctctctcccctcttctcctcttctcatccctgcttctcccttctaatcgcggtggtggagctagtttagggtcagggcaagaggcaggcctcaccgcggtgctcgcggcgacccgcgccgcggccgacatgcgcgtcaagctcagacgccaggtgcagtactccgtccccctcgacgaccgctcctcggatgccaacacggttatcaagtacacctccgcgagctcgccgccgacccactcctcacctgctacggtgcagtcctgcttcggcttcagcaggagctacaaccttgtcgtctttgagctctcacacaactcacttgatggccccataccggacgcccgcacacacgccgtcgctgctatagcacctgccgccacccctccggcccccgctcgccgccgccacgaccgatttggcccccgttccccgcgtacatccgtaggggaatagaaaggaggatagaaagggagggaagggagataaagggaggaggaagaagggaaggagagaggatgacatgtgggcttcacatataagtgggtcctacaatattttttttggatgaaaaatgggtcccacatattttttttaattctactgccacataagtgccacatcaacgccacgtggaacgaagcccaagtcaacnccgccacgtacgcatcacgtcagcgaaaccgtccttcaaaaccatcgagggaatcaattgcaccggttttaatagtcgggggttgagatatccggtattgtggtttagggatagggatggcagttttgcccatgggttcgggtatccgcggatacccgacccaatgggcacgggcatgggtgtaaaattttacccgtgggcttgtccgcccaagacccgtagacatcgtgggcaacagccgggcttcattttttacctgtgggtaacccatgcctgacccgatacatttgtattagctaatttcgatttatctcttaattattatacccccttctcttggttcatttgtgatactaactaataataagttgcgatgtaattcaaattattattgataattgataatttggtaaattgttgattttatttttctttgttaaattatatatctttcgagttattattcatgtgagatccattgggtacccgacgggcatacccgtgcccgtcgggcatgggtacgggcatagagttttacccactaaccctagtgggtaggatttgggcgggcgacgacgggcatggggtcaggcatggttttgctctacccgtgaccaacccgacccgttgccatccctatttagggatacaaatcagattcggtcactagttaaaggagtcaaactgaacttattccttcgttagaaacgcagccggcccagccgagcccggagcccgtgcaccccggaaccgtgcaggctgcctacgcgaaagcggaacagcgccaccgcgacagacaggcaggcagcaactacccgaccgatcgcctcctcttcctcctccttcccacctcccgcccacgcctccagatctccgcgagcttcgaccgccaccgcgaccgccgccgcagcaagcagcgtcatcccccgcgcgacgccaggcatggcggccttcaccaagctcgaggactcccccatgttccgcaagcaggtgcgccgccccgccgaaccctctcttctctccctgcccgcgggaggtgtcaccttttgatccggtcctctcagggttcgttgctttcgggcgagatctcgcctccggctccgcgtcgttggtatttggatcgtacgtggtgggggatttagggggggtggagctggaggttggggtgattgtggtagctttgggctgggatttgggaggttgggcgcattctgtgtggcgagatctcgacctgattgcatgctttattggccgttgattggttcggaaatgcgattgttcctgagtagaatggatatcaaattccgctttggtttcgacgaataccgtaggttggttttgatttgccggcatgagtgcattgtaggttgcaaaaggaatattattttacatttattgtgtgttctctgttcctttcccgatcgttttcatctttgagcagtgctgcatttctgattgtaatggtgccattttatttttattgctgcatcacacacttgaacaattttttaattcatcgtctaatttctcgagataaaatcctgtaaaaacttagggacgaaataagctagacgattttcttttccagttcaaatggctggtttgggttattagaagccatagaaaaaatagtgacctattatttaggccctgtttgtttcagcttaagtttattgtaatctacattattgagccagattactgtaagctgaattataataagccgacatagaataagctgtgagctgtttgtttctctggattataagctgttcgttagctgttagccatccaataatctaaaaaaacacctttagagtggattactagattatagtaatctggcttatagattgtaataatctatcataataagctatctgtttgtttcagcttattcctaataatccagattataataattctaagctgaatcaaacagtgccttagactcgaagg

SEQ ID NO: 52489 - DNA, 1596 bp, Oryza sativa
tatcaagttgaatcttctctttttcctgataaatccttttgttttcatcttaaacagacctttacatgcatatatgctattgattgcggcttatttccattgatttgcaggtcaattctatggaacagctagcgatgaactgaaacaacggtgttcaaatcttcataaaggatgcaaaagattcatgtacattaagctcccaactactgttttttttgggcgagctactaactttgcagcacaggcgtacactcgatgcagaatgcgtagcatgattattattattatttttggtttaagaaagacatcactctaggtttatgccgatgtaagtcaatatcaagtttctgtagcatacaaccttttactgcaatgcacacaattacacgatttcaaaacttgtttctgtttctatggtccaatatgaattgtctgcaagtttatatcgacaaaaatgtttattggataaaattgtgtcaataaatgactttgcattcttctttcttacttttctagttcaggattaatatttttttgttaccatgttacatgtaataatttgtagttcctattgttcctaggatagacaacgataataaaaaaccatatgttcgatatattgttttgttatagtattgctgataaccttagtttcaggggatcacttgatgaaggatacgcgggagatctaacatttgccgatgctctagaagcatttggtgctggtcaagatgatcctgttagtgttgccattggaggttaatttcatcaaatctctgttatatctgttgcttaatttttcctggtttcccatccatagatagctaaacaactgagtccatccttgccaattgctaaacatcttgccacgttggtgtccttttgtctcctatcgattatgtaccacatctttaattttatgtctgttccctctcttaaggaaagatcacagtaacagatcattagaatatatataaatgcagacataagcaagcacatactatgtacttcttttattttacttattaatatgttgtaggcttgtagtatgataacacaatgtttcttaactgtaatggtttaatgcaatgccatttcactgaaattatggaatgcaaatttgttaataaagtgaagttcatgaacacattcagctttcaatgtggaagatccaaattctgaattctgttgcagggcctgtaatgtccaagttcactactgcttttagggagcttggaacatacaaggaactccttcgttctcaggtaaaatctattctatgccattgaattctttatgtactactccctctgtcccacaaaatatggaatcctggattcccaatgcaaatttagtaataacatagaaagaccaaagtgccctcattactacattcattcatccacccattaattcacacagcacatactataagaaaaaaaaagaggcatctggcacaaaaataagcgccaaaaatttgaaattttctagtacctgcagaaagaaaagagaacatctcccatctgaaaaaaataaatgctggcaagaaatgctcttatttaacctgctaaaatttacatgaacccagaacagaga

SEQ ID NO: 52490 - DNA, 4854 bp, Oryza sativa
gcaccgcatccatccgccaccgatgcagccgtcacatccaggttgcagcatcagggtggacgcataaggtcgtcgggaggagcgagaggggagcgcgagacagtggcgcagtgggcatggggatggagatggagatggagatcgttggagcgccgcattgatgaacgggcgagacgatggtgaatgagagagactcgagcgagatgggtgtgtgcctgggaagagataaggtccttctcgaccaccgatgtgaagtagtcagtcattgaatgtttcacttttttgtgtacagatcgtttttttttctgggaccctcctccagaaatcctttttgtgggacggagggagtaattggcaccctgtgcgctgcaacacgctgatcaattgttaatatgaaaaattagctgggtgatggaacgaaaaaaagagcatagcatagtaacatttttcattttgatacattctgattgcattggtgaaagaatgtgcatttaattttagataaaaaatgcttcctgtccaaatttgaactgcaataaataggactctacataaagattgtccagtttcatcataacataaatgttccatgaaatacaaatcgaagtgaatgtacctccttcaattgcttaatgcaaacacttggaaacaagaaaaaaataagtaagatatattcaattgtttgtttccaaatctgtagttttgtgacaagactcagttgattctgactcaccaaagcattcaacgggaggaagcataggggagaggaatgaggtgggtattatgacctgtgattattgtagtatttgatgggatgataaactcaagcatacgtgcggtacttctctggtagacccatggtgttgggtgtcaaggtgtggaggacttgtgggctacgcattatgccagacatggagcaccagagtgagggcaggtgtgcgctgaggaacggaggaaggcatatagtaggggatggacgctgaagatgcagattaaattcctcacatcctaccttgtctgcaccagtgcggtccactcagattccttgccattgcatcagcggttacagaagaggatgtgatgatgattgattagtgagaggatgagagaatggagcatgtaaggaagcgtggtagttgggccggatcatttgcaggttgatgacttaatcaggaatttttggaacatgtaggttttttgcatggcatatacaaattgaggtgacatggcacgatgagagtagaggaaaatagctttaattgcagttagtgggaatgaactttataggtacataggattctccttctccatatgttgtttcatacgtccatgtcactcatcggtaatgaaattgaaaagtaagattgctgaatgggactaggagttcccttttgatgcaaataacactgtgacactgtaaaagggttatttgcaaagaagaaccgtttttgttctttttatttttactagcttaacagattgaatctctatcattctaatcagtatgtgtcctcaaccaggttgatcatatgcttagtgaacgtttgatgcaattcattgatgtggatttgcatggcgtgaaggtgagggtgacaacctcctgccccaaaaaattaagcacactactgagatctgtatttatgtaggtagtacctcaggttttgctcttcttcatggatacttgcttgcgtgcttgactttttgttggatccgaatttcaagccttttgcttctgacaatgaaaaaattgcatgaagtgatcttagaaatgtagttcgagtttcactgacttccattttgggtaatgggaacaatatatggatgtccttctgtcttaaatacaatacacctgccctactgtcttgatgttcatgtggaagtttttaacacattaattagttaatactataggctaacatcctgcactgtatataggattgtcgtcagcgtttggatagggctacagtggggtatgatcaggtgatatcttgcactctagctatgtgattacctagttttcaatttgcatatttcttcattttggcatgtggtgccctataagaatatatgttgctatcttgcttgtcaggcacgtgaaaaatttgtatcagtacggaaagggactagagcagaagtagtgacaggacttgaggaggtgaacagggacaacttgtttttttttccgtaagtgatcatttatttaatttctatacaacatctctaattccaaatttgcaggatctacacaatgccaagtcagctttcgaacgatgccgctttaacctagtatgtatgaacatttttttatatagtgttgctaattttattgattttgccaagccaataattctccttggctgtaaggaattcaggtgcacgcactttcaaatattgaagcaaagaagaagtatgagttcttggaatcaataagtgcagtgatggatgcccatttgagatatttcaagcaggcatggtcactctataattcgattgattattattgtttggtttattgggttcttcttgattttgttctttatgatctagggatatgaactactgagtcaaatggaaccattcattcaccaggtttagtaatctcttatctgacctattggtcttaaaccgatgaacatttatttcaatcagcatggatccattgaccataagttaaccattaatatgctaactgtaaggttttgatacaggttctaacatatgcacagcaatcaaaagaaatggctatcaatgaacaagataaacttgcaaagagaattcaagaatataggactcaagaggaaattgcgaacttgagaatggctagtaatgtggacacatctaccagtggtgatggtatccatgttgttggtcttcaatcctataaaaagattgaagccctaatgcagtcaactgccaatggcgaggtacttccattatccactgttgagtaaacaatcataaataataggctaggatacctggacggctaagcttgctgcatcactgttcaatgttctgcttcagagggattgatgatgtttaagagcgaagcaccttttatttctaagatggtgattgcttcttcatgtattcctaaattaggtatctaggcaaagagatcgatggtgttatccctttggttcaaattctagtattataatgccctgttattcccatttataattcaccagactacattttaattatatataacatgcaaccttttttttagttaagctttgttgctttctttcactaatttatttttctggcaggttcaaataatcaaacaaggttatctctttaagcgttctgaaaattcacgagaatggaagagaaggttctttgttctcgacagtcacgggactcttttctactacgggaataaaggacaatcggtatgcaataaaagttagcgatttgtgggctgtcatggattgtttaaaatgtattatttgggaatttataccttaattgtgttacataatatacctgaaatattgaacaattgcatgttgtttgttctgtattttatatttatctctttgttcatgtgggaagcaaggagcggcatcacagcaaacagctggtgaagggactggtgtttttagtcgtttcagattcttgaaccaaaaggctccaactcagggtgacaatgcactttcgtgccacaaaattgatctaagaacttcaacaattaagattgatgcagaagaaaatgacctaagattttgcttcagagtaatctctcccatgaaagcatacactttacaggtaattggaacacttttagggtgtgttcggacccaagggttcccaacccttctccatcgtattccgcgcgcacgcttttcaaactgctaaacggtgtgttttttgtaaaaaatttctatatgaaagttgcttaaaaaaatcaaattaatccgtttttgaaaaaaaattagcaaatacttaattaatcacgcgctaatggaccgttccgttttccgtgatcactgttccggggtgggaacgtgttctagcgaacacagccttagtctgttactcggatgtcacattttctgtgacaccaaatttctagtctttgatgatacatgcattgttttatatattaatactatagactttgtcaatcgcaggcagaatctggtgctgaccaaaaggattggattgagaaagttactggagttattgcatcactgcttaatttaccattcccaagacaggtttcgatacttcctatggcaacacttcatttctagtctttcgtgctttttgaagaaaaactttgatatgctacactgcttgcaagttgcatctccattgcataataatcatttaatatagtaatagtgcttgttctgccccttaaaattagctccattttagtgcattttaatcatatattcgagctatcgattgttcaggataatttagtataatcgtatgctgattcagttaatcccaggtgtcgtatggaaatctagaggcggaacatcatggttctgcaaattctgttgattctctctctcttgaggagaacaaaagtccagagggacatgatgatatattcaatcatctcaggaatattcctggaaatgacagttgtgcagaatgtcgttcaccggatcctgattgggcatctctaaatttaggaattcttatttgtatagagtgttctggggctcacaggaatcttggagtccatatttcgaaggtgtgaactctgtcacttgttctttctttttgagtctaatttatgctacttcattgaaagttacgtttttggtgacctgaccctgtctttcacaggaaagcacttcaaaattttaaactcataaaagttataactta

SEQ ID NO: 52491 - DNA, 1936 bp, Oryza sativa
  unsure (1)..(1936): unsure at all n locations
tcagttaatgccaggtgtcgtatggaaatctagaggcggaacatcatggttctgcaaattctgttgattctctctctcttgaggagaacaaaagtccagagggacatgatgatatattcaatcatctcaggaatattcctggaaatgacagttgtgcagaatgtcgttcaccggatcctgattgggcatctctaaatttaggaattcttatttgtatagagtgttctggggctcacaggaatcttggagtccatatttcgaaggtgtgaactctgtcacttgttctttctttttgagtctaatttatgctacttcattgaaagttacgtttttggtgacctgaccctgtctttcacaggaaagcacttcaaaattttaaactcataaaagttataacttagccacggtagtagtataaaactgtaatataatagtggaaccatttaaagtttaatgcttatgctattgccattaatcattactgaaatgattggggcttaatgtaatgttgtaaactttgtcaatgtccaaaacatcgagtaaaaaggaatggtggattggtggtaataaatcaaattagaagcagaaagcttggataagatcataagaatatcgactccaacctctgttaaccttcgactcttaaaatgagatccaggctgtggtaccaacctaggcaattcacagtatctaattcacatgttttatcattattttctgactatatatttatagaaatattaaaaacataattgtatgaaagtgttttttttttcatgaacaatctaccaaaaccattttcacatatcctgatacttatgcatctattaccaactccatgtagttatcagtcacagtttcttgtgataatgctatatgtacttgatataataccttaatgataatttgatggaaagattaactattttattttagatttttgctcatttgtgtttcttgttgtacctttcaattgtattttctaatgcatataagatggtcagagctaagaacattaattttgcaatacactctcttgtgactttgtgatttgtagatttcaaatatcatttgattttcagatttagcagtagtgtggtccatatttaaggattgcttttgatgtacttatttgatgtaggttcgatccttgcgattagatgtcaaggtatgggagccagtgataatggacttgttccatgaacttggaaatgactacactaattccatttgggaagctatgcttccgaaagaagatcaagggtatgttgaagtgtatgtaaatgtatattttcttaactatgttttgccttcatgctttagacaattttcttcctagttacacctctcttctgaaatttgtaagtagtggtatattgactaatacaaacatcagccaatatgctttttgccaannnnnnnnnnnnnnnnnnnntagttttgtacttctgcatgtattgtttagtcattttattttcttttattttactcattggattattgtcaatttaaggagcataatactgcactaccgcatttgtaatggactatagcattcttgacttaactcagacttgaaatttccaatgggatattctgtcttgcactgaaatggatcagtttcattatggtaggtgaatataatcagtgtagctaaggaaggtgttctatcatttagaaatgttaatgctaataatttcattcacacgttcaagataggttagctttattatcttctacagatgagttggaagatctctcttttaatctgatagtgccaatgaatatatttcatacattaatggcattggcatcagacatgttcattgtgtgtggaaaaactaagtttgctcctttctcctatctattttcttcttgatgtgtatgcagaataaacgagtttaatgatgctattcttttcattgaaaagcctaaa

SEQ ID NO: 52492 - DNA, 3546 bp, Oryza sativa
attcttttcattgaaaagcctaaacctactgatgctttttcaataaaggaaaggtacatacagacaaaggtaaattattctgtccatccttttatatgctgaacctagcaatgctttcttgatattgatgtatatccttgttagtcatgtgctagttgaagattgaattccaatgtaacccttgccttttattttataaatgtgttgttttgctatccagcttcagttctgtagctacgactcacatgactgatatcacataaatcttttgggaggctggggatgttcacatgcacatatattatatatagttagcagcagttgtatggatcatgggaaatctttatgatgtaaccattttacactttactagcacaatagccatgcgttgcagcagtttatttaatataaaacataattatgagttctcttagtaaaagaatatcttgcctctacttgggtgaagcgatgttcttcatcttaaaaggcaaaattaaaagagtgtagcttatgtcttgctcaaatttcaaatggatggtaaacagaagagagcaatcaaattgctcgtgtggggtccaccaatctcatgggcccacatgttagttggtggtggcggaggcaaactcaccaccaccactatggtcttttataagagcatagatataattggagccagaactcagtctatggattggttcacaaccagatttgtagtttgatttatcattttattttctgactgtactgtttttttgactgaaagtactgccaggtctttgcccagcagtgtgattttcaattattgaaagaataattataggaaataattacaggaagaaacaagagaaaaaaacaaaagaccctataaagtttgtaaccaattaacaacagattgcttcaggagatccttcattctgcagagatgcagaagaatctcatttgtaaagagagacttccaagaatggaactgttgcggtcagggtacaaatactgaagataattgatagaacatgaatgaattgcatacttaacaattaacccttggtatttcaactctaaaacttgcataattgatcaatggctggccggaaaccacaagcttttgtagtgtgatccatatgcaacgaagtgtcgagtaatgcaggctgcaacaaccctcaagttcttttttgcttcaaatagtttctattgctaattttgatagtattaacttcatgtatgaatggaagatttagagctccctgttttcttgattctgatgaccttctgtttgttgtgccatcattaattactgtaaatgatctatgcagtatgtcgacaagcttcttattgccaaagataccaatcaaattaccattgatatattggaggctgtaaggacgaatgatgtgagggcagcatatcgcattcttgtgttggctgatgtgagccctaacatgatatatgatgagttaaacaatgatgttcatcatgatccttcagtaacagatgggaagttatttgatccagcatcttgtgatgtaaaggatgattctgggaaaccagaaggttgtctacaaggctgttccctgttgcacattgcttgccaatatggccattctataatggcagagcttctgcttctttttggtgcggatattaataagcaagacttccatggacggacaccgttgcaccattgtgtccgaaggaaaaatgatgcacttaccaagcatctgctaaagaggtaggattgaatttctagcagtatggaatatagataattacagctatccttccactgttgccaagctgaagtatcgaactctttacataaaggctattttttttttgtttcattcagcataaaagtacagaatgagacactgaggcatatatgatatgttctggggtcctgacaatgtctttagtaatcttatcaatataaccaaaattgtataaaatcaattggatgacttgttcgccaaacacttggattcatactagtcatctcatcccatgtctaaggtccactggtctatggaggtttgtctcattttcagtctcatcatacctatagcgcctatcaggtggcattcagttggttggcataccacttgtgctgtgagttgtgccttttcgagatcatcaatgatgcatttcaacagtttagtaggaacagagagggaaacagcaacaaaaaagcattttcctttcctcaggctattattacaatccctttaatcctgtgtttgtcctcccattttcctcaggacaacaaaaaaaaccaattagtcactgttaatttttgtttgactacatggataatgttaaatggatttctgttccataggggtgcaagaacaaccattaaagatggtggagggttgactgctttagagagaagaatggaacttggagcaataactgatgaagatttgttcattttatttgtaaggtatgatcaagattagtaaaattgcttttcacaatattatcttggcaattactagcaaatgccagtttttcatttccttttcaacgcttgaaaccttctcttgttttcaaaatatgatattgtcttcatgtctgagaaataaaagtacatctcatatgctaaatatttgatcaagcataccctaagtaaacctttttaggagatatcgatctttgcagtttcctgaaatttcatgaagtagcttgtttatgcctgtttcttgaagccttatgttatttctagtcatgaagaattttgttacttagtggtgtaataggaatacttgttaagaaaaagggtctcatttggggatggtgtcttcccgcttatgtgggttcaatactgacgttttcctagcatgaacatattagtgtatcttgatatgtaccagtaattgattgtagtaattaactttgttgcaacttctgacattataacggacatgcttgtgcaggtgaaatgtcaagaacacaggtttgtagtaagcaaatgtctgtatctgatagagttgtaccagtttttttagtttatatagaatgaatacatttgtatcttattacggtgagataaaatctctgacggtctgacctttgcgcttctgtcgtgtactcgtgtgatcttgccagtcttctcagatcactctttgtacaacagttgtagcatagcatatagcatacatcaatcattcatataccaaagtttgtatcatttcctccatcatcaaacatgtaataacacgttcgagcaatatacccgcatgccattatcgtgcgattttgaaatccacttactaattgctgccatgagttgtttgcagttgtttgtttcatctgaacctatcaattatgtgtgtatcgttagcaacttagcatcgccctgcggcactgatgcctaggcctgctggatttttcacattttggtctttttgaaaaacttgtttcgcaagtagacccctagaaaaacttatcccaaaaatggtcctttttggggcgccagagtggctggcgccagcctctttggcgccgtccccctgccgacgtggcggggcgatgctgaggtggctaggggga

SEQ ID NO: 52493 - DNA, 764 bp, Oryza sativa
tctggcgccccaaaaaggaccatttctaggataagttttttcaggggtctatttgcgaaataagtttttcaaaagaaccaaaatgtgaaaaatccagcctaagcctgcgaggctgcgaccgcctcctcgagcagcatgatgatattgctcggctcgctgccatcgcacggcttgttccccttaccgttttcggcgtggttatcggaccccacggtaaagtggttaccttgataaccgcaagatataccgtggttttaaaaaactttatgtattgtaaccgcgataaccgttaagtaaccgcactgttttgtaaaccgagggaacgatagccgtacagcgtggacgaacgcaagtatctgtacagaaacgcaaacagagatcgacgaagggaatgccaaacgcccagatctgggaggctacgacctggagcgcagatggtgtttgtctctgaaacagaggagaggacgagtcggctcaaagcaccagagagaaaaactaaccacaggatggtggcacgctcgtggtcgtgggcgcctgggcgacgaacgtgcaagctggagtatgagagagcgagccatgaaggatgggcaggccgcactcacgggcacacggcgagctgcaagcctgcaatgcctgcaaggctgcaaatcagagtccacggagctacagcgtgtcgttagagcaagtttaatagtatagcttactgctagctctaattcattatatccaatctaataggcaattcatacaatagttgcttacta

SEQ ID NO: 52494 - DNA, 715 bp, Oryza sativa
atgtattgggaaataggataaacaatatgacagcagcacaacctccgaaaccacaagcatcaccagcagcatattttctttcaatgctttacttgcataggcatgcatggaatcaaccaggaaactattgctcaaaaaaaccaaagcaggaacctgaaatgagaactccaggatagctgaagtttaggcagtgatgtgtttccttgtgaaattcacttcaatgccgaataatccaggcatcaacttactgtaagtttgtaacagttagtacagaacatgacgaaagctccaggatagctgaacttccggcagtgatgtgtttcattgtgaaattcacttccacgccaaatagatcagccatcacattattgtaacaattattactgaaggtgaacaccacaataaatccataacaacgaaattataagcattgtcagcccaatataactcttagtggctcaggagtccacatctagaaactaatgtttacctctgtacttgggagcattagaaattcttcctttgtagagaatgcacaatgtaaaaacatcctaaccaaattaaacttgaaatacataaataacatctgattaagcagaatcccgtggcatttcctcactagtggacgcctctgccatacattctgtttcatcagaagaaggatcttccagctcaagtgtctttggcatagcagcctcggcctcagaaggagttt

SEQ ID NO: 52495 - DNA, 1643 bp, Oryza sativa
attagttcagtttgcaatcatggaccaaccaagttgtgaaattgctcgaatgaaaaatacgagttatgcttgtagcaccggcagcaactgcctaaatatgtcatctggaggttacacctgtgagtgcgccaattatgatctttattattattatgcagaacaaagtccttaccttttggaaggatgcatcatccgaggtgattcctctctacctttctccacttaaatactactaaggcacacacatatagagagctttatttgcatatcgaattttcattccttctctctttctaaggcgcaaacaaaagtcttccgtatcggtttttcgttcatttttctctctctgtggagcagattacaaccccaagcggaaagaacactgtcggagatcatgcggaaacatggcaattcccttcccttttggtcttgaagaaggttgtttcgcaagtgaaaggttccaacttaattgtacaacaggtaacatcacacttttcaacccacgggacgcacgttataatgtgactgatgtgtcaattgaagaggggacaatggtggttagcaacttgttgaacgacacagaatatgggggagaggacataatatcccaggtgtatggtggtgcagaaataaagtgggcagtagccaatttaacgtgtgatgccgcagtaaaaaaagatgctacatatgcatgccgcagtatccacagcaattgcctaaacgtcacccatgggaacatattcatgggatatcgttgcaagtgccttcccggttttcgagggaatccatatatccaagatggatgtgaaggtttgttcctcttcattcccaccaatttgcaaatgtttaataattttatagaaattttatgtggatagtttaaccacggcatttcccctttaagcaggtagtagtgcctgtgcatttatattgtaccaatataaacaaaaaaaaaactgaagcgttaattgcagatattgatgaatgcttactgccaaactattgcaacgggacatgtcaaaatcttcctggaaattttacatgcactagttgcccccgcagaaaggagtttaatccaattacaagacagtgtgttgcatcagctaagcaacacaatcttattataggtaagtcatagctgacagattagtcaatcttattgcattaagataatgcaaagtggcttcacggcacaaaaataatgaatggctgtaggtattacaactggtattagttgtggcattggttccataattattgcattaggtgcgattattctagccaataagtggaagaaaagcatccaaaagagaattagaagagcatacttcaagaaaaatcagggcctactcttggaacagctaatctcagatgaaagcgccacaaattaaacaaggatattttccttggaggaactagaagaggcaaccaacaactttgatgctactcgtgttcttggtcgtggaggacatggcacagtttataaagggattctatctgaccagagtgtggtggccattaaaaaatcaaaaattgtggaacaaactgagatagatcagtttatcaatgaggttgctattttatctcaaattatccatcgcaatgtggtgaagctttttggttgctgtctcgaatctgaggtg

SEQ ID NO: 52496 - DNA, 1453 bp, Oryza sativa
ttattctagccaataagtggaagaaaagcatccaaaagagaattagaagagcatacttcaagaaaaatcagggcctactcttggaacaactaatctcagatgaaagcgccactaataaaacaaggatattttccttggaggaactagaagaggcaaccaacaactttgatgctactcgtgttcttggtcgtggaggacatggcacagtttataaagggattctatctgaccagagtgtggtggccattaaaaaatcaaaaattgtggaacaaactgagatagatcagtttatcaatgaggttgctattttatctcaaattatccatcgcaatgtggtgaagctttttggttgctgtctcgaatctgaggtgcccttactggtatatgagttcataccaaatggtacattgcacgatcgtcttcatactgatgttagtgttaaatcctcattgtcatgggatgatcgaattaggattgcttcagaagcagcaggggcacttgcttatctgcattcggctgctgcaatacctattttccatcgagatgtgaaatcttccaatatactcttggatggcaactttactacaaaggtctctgactttggtgcttcaagatctgtttcactcgatgagactcatgtggtgactattgtccaaggtacatttggttatttagacccagagtattatcacactggacaactaactgaaaagagtgatgtatatagttttggagtgattctggtggaacttttgacaagaaagaaaccgattttcatcaatgatgtaggccaaaacaaagtttgtctcattatttcgttgacagactccgtgagggatctcttatcgaaataatagattctcacgttcttgaagaggctcacagggaagacattgatgatattgcctcacttacagaggcatgtttaaaactcagaggaggagatagacctactatgaaagaagtagagatgaggctgcaattcctgagaactaagaggctaagaaaattccaatttctccccgtcccaggaattggtggagagattcagcaccttttaagcccagatactggtaaatcccaagcacagaacaactataccagtgcaggtgatttatcatatgaagggatctccagttgctacagtttggagcaagaattatcatcctcagtcagtttgccacgctagctatatatgtaacatggagtgttgagttatcacatattttctacgaagtgttatgttacgtagttcagtccagagaagagtttttgcatgcttcacttcctgtatacttgcagcatgtatgcatagcccatgtgagttgatagaatgacagttgtattctactataattatttgcgagcaatatccttgtaaggaatgacatggtattgtgatagtgtatttaagctacggtggcaaagtgaacaagttcagtaataattttat

SEQ ID NO: 52497 - DNA, 3583 bp, Oryza sativa
caattcctgagaactaagaggctaagaaaattccaatttctccccagtcccaggaagtggtggagagattcagcaccttttaagcccaaatgctggtaaatcccaagcacagaacaactataccagtgcaggtgatttatcatatgaagggatctccagttgctacagtttggagcaagaattatcatcctcagtcagtttgccacgctagctatatatgtaacatggagtgttgagttatcacatattttctacgaagtgttatgttacgtagttcagtccagagaagagtttttgcatgtttcacttcctgtatacttgcagcatgtatgtgtagcccatgtgagttgatagaatgacagttgtattctactataattatttgtgatcaatatccttgtaaggaatgacatggtattgtaatattgtatttaagctacggtggcaaagtgaacaagttcagtaataattttattactccattgccaatgtcttgctcagtaagggtcaccaataggtatctgactaataactcagtttgtagtatgctggatctttttttccacatagcagtgacatcgttaatacggagtattatagagcttgtcggaagtcagaacttggaactcagagaacgttccgaatgcctttacacaaagtataaatggcacggttgaaattttttatttcatcacttgtccaaaaaccctgcattcataatgggaactgtaaaattgtttggatttggtgggataaggtcataggaattgggatatatatagaggaaatctaatttatggtttgattgaggaataagggaaaaaagtgaagggttagaatcagtccacactccacaccccatcaccatctctatcccaatagcaaaccggaccacaagtagtagtaagtacctatgctgcaaacaaaaatgctattgtctttggctccaaattctctagctttgcaaaagacagtttagtttaccaatggtgataatttgactatggagttaaccataccagtacaattagacttaaaaaaagaattcaaacctagattatgcacacaaccactaacacaccaagcaaaacaatggagattgccgtttgacaagggagcgcaccaatttcggttcgaacagacgagacaaccagagtggcggcctgctggcctccgcgcttgggggaggcaccggccttctgatcgcgccggggaagaggaggagcccgaccgccgaggcggaccaggcctccctttcgccccccgcacctagacaccgcggccaccagttgacggccgagcaagaggcgcggtggtggaggcgcaagggctctccgctctccgcactccgccgtccgcagcactctacgctatttgggctcatgggctttgtattctttctctctttctttttccattttccctctgttcggctttgcagttgtgccactttgtcgtgattgtgtccgttattttcgtgtcgctatttgctcatgctgcctgcgccaccgccatctcataaattagaggaccaatgttggcttgctcctgcatataagaaacacagtgctaatcaacttgtagggcagaacttctgactgtaagtagagagagcaaagagccgtaattttgacaaattgacccttctataaaacttagtttcaaaataagtcgggtcaaaaattaatttcaatactaggccgtgaccttagcgccattagggttggcgctgagctaagctaaaacgtccaagcgccagcattgttggcgctaaggtcatatccgacgtggaacatattagccacgggctaagcgccaaatgagttagcgctgacctcttagaaggtttaaaattagtgtgggcaataactgacacaagttaaatctagctcagcggttggtcagtgtggctgcaagccagagttccagggttcgtttcttggtaagaactgagaacctaaatcatacaacataaaattaaaaatacaaaattataataattgagctaagtatttaacattttaattaatgttttcaaatttatttattccagattgaacataaaataaaataaataatccccttaaaaagtaacataaaaataaatctacaaacaaaatatgtgattgtttggaaaaaaaatttcaatagaacaagattcaaagaggaagtaagaaaaaacctgaaaaccggctttcccggttcgaactgtgaacctgtgggctggagtagaggggcctgaccactgagctagcttctgcgttatgacacttccagcacacattcttttaaaccatgtaaatatcagcgccagcacacatgacgctgagctcctcttttgtggctaatccgtgccacgttgaacgtgatattagtgccaattagagcaagtttaatagtatagccaactactagcttcaattcatctatagccaatctaatagctcattcgtataatagttatatattatactattaatacctggtcccacctgtcatacacacattgtgtattgaagtccgtgctacagctggctacaaatctgtagcccgctgctcttctctctcatcatttatttccttaaaatatgtttgcagctgacttatagcctattattgtacttgctcttagggtggcgctggtacgttttatctcagcaccattggggttaacgctgaggtcggcctagttttgaaattagtttttgacgcggcttattttggaaataagttttatagacgggtcaatttgtcaaaattacgggagcaaagagtatacaaaagcaagagtatacaaaagcgtatgtggctttatcgtactaaagtaattctagtttggcaaacggcgtcggccttcttttgttcatctgtatgaattagtaggagattgtggtaattgtataacgctagtgtatcgtgattaggatttgtgttacgaactcttcctgggatttctgtcgaacaattggtgagcaagagcgagagagggagacaggaagaatagaagagttcaggacataaagaacaaaggattaggaggaggatgggatttgaattatagagaggtttcagtacaatgtttttcgataccgattcccataaggctaggcctttatatacacatgctagccactctcttacgcaacccagtctggcccaattatacgagtgttgggctgtcgctgtcttgagctcttcggcctggtcttgacagggttggtaacatcctcccctccttcacatccggcttgtccccaagccggagcagcagggtaacgctccttgagccgctccagatcttcccaggttgcctccgatgttggacagcccgaccagcaaaccttgacttgatcaacagccgctgatccccgacgtatcagtctgcgtgctagcactcgcactggaacaggatctgcttcttccaccgctggaggtagggtagctaccgtagaagaagctggttccgatgccttccgaagttgggacacatgcaccaccgggtgaatcatagaagaagcaggcagcgccaaccgataagccaccggtcccacccgagcagtcacctgaaagggaccaaaaaatc

SEQ ID NO: 52498 - DNA, 4807 bp, Oryza sativa
  unsure (1)..(4807): unsure at all n locations
gccaatttaaacaaagtggtccatagagtgcttgtaaagatccggtcatgatctgagatcaaagactgaggcagtccatggagcttataaatgttagagagataagcttgtgccacatcaaaagctgagaatggatgagctaaaggcacaaaatgggcatatttagagaacttatcaacgaccaccataatgcaatcaaaacccgaggaagtcggcagaccttcaataaaatccaaggataccatttgccatgcatgatccggaacaggaagcgactgcaaaaggccagggtagcgaacccgttctgttttcgcttgttgacaaacagtgcaattggccacatatgtctttactgctttcctgagccctgtccaagcaaacaaacgcttgacacgggagtaggtaacctgtacccctgaatgtccacccactgccccaacatgtaaagattgtaagatttgagactgcacgtgcgggttagcaccaatccaaactcaccccttatagcgcaaaataccagattccaaggaaaaatgaggtaatgcgtcagatttgagtgtcagttgagccaccagctgagaagaatgaggatcttgatcataccccttttgaacttcctcaagccaagctggaatacaaactgaaagagacaatacttctgttgaatcatcggccactcgtcgggacaacgcatcagcggcgctgttctcactacctttcttgtaaaccaaacgatactgcagtcccatcaacttggttaaggctttttgctgccaaggtgtggctaatttttgatctccgagatgaatgagactacgttgatcagttcgaatcacaaactcagcaccctgcagatacgagcgccaatgatcaattgctaggagaatcgccaagcattccttctcataagtcgacaagccacgattgcgaggaccaagcgctttgcttaaaaatgccaaaggatgtccctcctgcataagtacagcaccaacacccacagctgaagcatctgtctcaatttcaaatgtctttgagaaatccggcaatgcgagaactggagctgaagtcaaggcagtctttagggcatcaaaagaagcttgagtttcagcagtccaatggaaaataacattcttcttgagaaaattagtcagggggcgactcagaatcccaaaatggcgaacaaatttgcggtaataccccgctaacccaagaaatcctctgacctccttgacattagaaggcaccggccactgcagtactgcctgaatgttcttagcatcggttgacaccccttcagcactgatgacatgtcccaaataagtgagagatgaccgagcaaacacacacttagatctcttaacttgcaactgattggcagagagaatatcaaatacagcccttaacaagcgcacatgttcctccaaagtccgagtatagatcaaaatgtcatcaatgaagactaacacacctttacgcaagaatggctcaaagattgtattcattataccttgaaacgttgctggtgcgccggtcaatccgtaagacataacccggaactcgtaatggccattatgtgtcttgaaagcggttttatgttcgtcttctggcttcatacgaatctggtgataaccggctcgcaaatccaaactcgtaaaccaacaagctcgtgccaactcatcaagtaactcatctataataggcagagggtaccgattcttaacagtgatagcattaagatgtctataatcaatgcaaaatcgccaagtaccatccttcttctgcacaagcaacacgggagagaagaaaggactggcactgcgttgtatcactccttgtttgagcatgtcagcaacctgtcgttcaatctcatccttttgtgccggactgtaacgatacggtctcaaatttactggttgggctccaggcagcaagggaatagagtggtcaaaagctcttggtggtggcaagccagagggttcatcaaaaaccttggcaaattcctgaagcaatccctccacttctcttggcagaacaagactgattgcaacagcttcactggcacaaagttcaactgtgtgtaggactgcattatgatggaagagacccttaagttgatcagccgaaataaccgggcaacagctaacatccggcaccacaccctgtaacagaacctgcctgctgtccaacacaaattgtatggtcttaagcttccaatcaatttgcattggactgtgtttctctaaccaatccatgcccagaatgacctcataacagcccaacggtaacaccttaagattagtgctgaaggactccccttgtacccaccaatgacaattaggaaactcctgacaacattgcaagataccaccatcggcgattttcacttcaagaggagtcagcgagctgcgcacaccntgcagtttattagctaacttctcactgataaagctgtgagagcttcctgaattaaccaacatcaagacctcatgtcgttggatcaatccttacaaacgcaccatacgagaagactcaataccaagtacagcttctcgagaaatggccaataactcaccatcatctgattcagcagggggctagtagatgactccacttcctcaggaacctcatcagaaaaaagctgtagcacttcttcaatcacatgcagctgcacagtagggccacaacgatgatcacgactccacttttccccgcaagtgtgacaaagccccttcgctcgatggaaagccctgagagctgcaactttatcagtagcagaaacttcagtagttagcttatcatctccctttggcacaaaaggtccaacaccagtgtgcaagggtcctcgggctcccccagtcggctcaaagcgacgcccctccttgcgattctgttccagtacttcctcttgcaaacaagctaattccacggcagtatccaaatcggttgggcaatgtaaaacaacagcagatctcacttctgccttcaacccatccatgaactgagtaacaaagaaaaccgaattccacgagggatgatgcgcatgtaacccatgcatcaactcgttgaacttttctgcatatgcccacacagtgctagtttgccttaacctattgaactgtcgaatcaaactttggaactcctctctaccaaatttcccacacacccaggcagcgaattcctcccaactcccactaacttcatgagctcgggtcgactgcaaccaagtcaatgcagtacccgagaactggagtatcgccacaccaatccagtgatcagaaggagttccacacagcccaaaataagtctcacacttcagtttccaggccttaggattttcccctgcaaactctgggcactctactctagatgcagaaatttgacccccaaaactaaacccacggcatcccccactcgactcaggaactgaatggaaaggggaagtagagttatacgcacccttgaccgggggagttcgtggggagttgtttccccacacagccttcccccggtgattcgaagcctcgtggtggcaaaattgcctaggcgctcctttgccgaacgccgacgtggaaggtcggttttccaccgtcctcttcggcagccgctttgccccaggcggcgtcggaagacgtggagccatttcctccggcttgacgggatccggcttgacggactccgacttgacttgatttggggacggcgcgggctgcttcaccatcttctcgagctgagcgcggatgtcgcccacctcgtcccgcaattccgccaccaccttctctaccgtcggcttccatcccgctagctccacaaccatcggcttgatttcctcgatggattccaccgaaatcatgatagcctcgttctgcttctgaattgaagtcatcgtagtcatcagctcgccaagttgctgctccatctcgttcgccttgagttgcgctcgcgaatgataccgtggcttctctagataatccagattcgactgctctgataccaaatttgttacgaactcttcctgggatttctgtcgaacagttggtgagcaagagcgagagagggagacaggaagaatggaagagttcaggatagaaagaacaaaggattaggaggaggatgatgggatttgaattatagagaggtttcagtacaatgtttttcgataccgattcccataaggttaggcctttatatacacaggctagccactctcttacgcaacccagtccggcccaattatacgagtgttgggccgtcgctatcttgagctcttcggcctggtcttgacagggttggtaacaatttgcaccttgccactctttctttccagctgatactggatttgtggaaagaatcggcgagttaattggcctctgcaacggacgtagattttgcaaggataatatatagtagtaccacattcttaatagttgcaatatactccatccgttttatattataagttgtttgacttttttctagtcaaacttatttaagtttgattaagtttatagtagaaaaatattgtagtattttcaatacaaaagaaacatattatcaaaatatactcaatgctagatttaatgaaattaatttgttattttagatgtttcttttaatgacaagagcccaattttcactcagaaaatgttgaaatcatgagttcccaatgttttcatggggaactgcagtctgcgggactatatttacgaatctgctcgtaatagcttaacaagacgagcatagtgaccctatacggtgacaaattcagcaaatattctctaattaattaagctagcaaccccaatttaat

SEQ ID NO: 52499 - DNA, 4595 bp, Oryza sativa
cggtttccaatcagataatgcctccagatcttcaaagcatgaaccactgctgccaattccaagtcatgagttggataatttccttcgtgtggacgcaactgccgcgaggcatacgcaaccactctgccctcttgcattaggacacatccaagtccgtgacgggatgcattacaatagacttggaagtctttcgtcgggtcgggcagaatcaatactggtgcggatactaatttctttttgagctcctcaaagctcttatcgcactcagctgtccatttaaacttctcatccttcttaagcaactgagtcatgggtcgggcgattctggagaagttttcgatgaatcggcggtaataacctgccagtcctagaaaactccgaatctgcgacacggtctttggtggggtccattttgtaactgactccacgttcgatggatcaactgctacaccctgggctgtaatgacatggcccagaaatttgacttccgtcaaccagaagtcacacttgctgaacttggcgtatagctggtgctccttcaacttctcgagtaccagacggagatgttgttcatgttcttcctcggactttgaatagataagaatgtcgtcgatgaataccacaacaaacttgtccagaaatttcatgaacactttgttcatcagattcatgaagaatgcgggtgcgttggtaagtccgaaagacataaccgtgcactcatatagcccgtaccgagtggtgaaggccgtcttcggaatatcctcttcccggattctcagctggtggtagcctgatcgcaggtctatcttagagaacactttagctcctttcagttgatcaaataaatcgtcgattcgcggtaagggatatttattcttgattgtgacctcgttaagtgcgcgataatcgacgcacatcctcttcgtcttatcctttttctccacaaaaatgaccggagcgccccaaggtgaagtgcttggtcgtatgtaccctttctgcagctgctcatcaacttgcttcttgacctctgctaattcgttggccgccatcctgtatggtctcttgtaaattggagcggttcccggtgccaagtcaatccggaattcaatctccctcttgggtggcatggtagtgaggttttcggggaacactttccgatactcgcagactatgggtatatcttccaattttctcaagttcttccccacggtgtccactgggatttccgtttcaatctgattcaacgaggctcctttctttggcgagactagggatttgtacaccacggtttctcctttctcattggtcagggtgactgtgcgattcgcacaatcgatgactcccttaaacttggtcagccaatccatcccaagaatgacatctaggtctttggattcgagaaggatgaggttggctagaaatggtgatctttggatttctattagcactgaagggctaaaactgactgaggttgaactatttcccggggtacgaaccctcattggtgtgctaagctcttctttccttagcccatacattcccacgaatttctttgaaatgaaagaatgcgttgcaccagaatcaaaaagtactgttgcagggattgagttaacagggaacgtacccagtacgacctctggtgctgcttgtgcctcctccgcagacgcgtggttgacacgagcctggataaaccttggcccggcacgcctgggcttcgggcatttgtcagcgaagtggccaagctcgccacagttgaagcaggaccctggttttgctcccgtctccttcttggcttgcgcgggctgggctgactgtgccggtgccattggtgggcgtggagctgcaccgcggttgggctggcctccctggtggttctgactgccactagtgccctggtggaagttgctggagttgaacgggcggtgctggcggacgatcatggtggtaggtccaccctgctgtccgggagtgaagcgcggtcggtgctgactgccttggttggaccggaactgcgccgcctttcttttcctgtccattttgttgcgctgatcctcctggcggattgccttgtcaaccagcctctcaaagtcggcgtagtccccagatatcagttggttggtcagctcatcatccagacccgccatgaacttctcctgcttctcggcgtcggtgcggacatcctctggtgcatatcgcgcgaggcgattgaactcatggaggtactctgtcacagtcctgttgccctgatggagcgcacggaattccctcttcttttgtgccacgaccccatctggcacctgtgccttcctgaagctacggcagaactctgcccatgtgacttcagtacccggtgggcgggtggccatgtggttgtcccaccaagctgacgcaggaccctgaagctggtgtgtggcgaaagcgaccttctcctggtcattgcactgcaggagattcagcttcttctctatcgcatggagccagtcatttgcctccatagggttggtggtgctggagaaggtgggtggcctgacacgtagaaactcaggcaacttggactgggggggagggggaccaactgctggtgctgctgttcggcgtgctgcatcatcctctgatgcatctgctgcatcatggctgccatcatctgagtctgatgtgccataacttgggcaagcgtcggattctcgggaagtggtggcggaccattgccagaatcaccgttggggtgcacaccatcagcgcgttcttcgccgttgctgccctcgcctgttgcgcggctaccagtcctggtgtagaccatctggagggaagagcagacggggaaaagaagaaaaacagatgctcaagaactaagctttattacaaaggaattaaaactgtaattgttctgatctgaattaaaacacttaaaaaggcaagcaaaaatccttattaagacagccatatcataggcacatgatatcgaccgtcgtctgaccccaaacaagcaacctacacacacaaactaacaaacaaaaactagacagtcgatgaactagtggaaaaacgagcctaatgctcggaacggctcctgcggtcggtggagtcgaaggcgtcctcctgctcgtcacccggtccctctaagcgactcctggagcctgacggatcggtctcgccgctgccgctgggagtagcagacagccaacctccggtaccactggctgaacctctggcggctgatgctggagcgaaggagagagtgaacgcgggagctggagctggagctgcaggaactgcgggcggaactggagctgctgcgggagctgctggtggaggtgggttcctgggcgcaagctggatgcgcacaggtgcagtcgtcctcttacggggcgtagtgcggatccggactcctcctggcgctggaaggcccttcaactgagcattctccttcttcaggcgcgctacctcgtccttcagagcgacgatcctcatgagcttcccatcgttcaaggccttggtcgccttgtgcaggtccgagtgcatcctatccaatcccctcatcacagcacacatgtgaccgaaggtggtgtcgttctcgccagctgtcggacggaaggagctgacgccatcaccatgggctcgacgggggtggtagcggtacgccgtgtcgtggaagatgtagtcgtggcgctcccgtagcctggccatcatcaagtaggctgcctcctgacaggcgtgatctgctgtgcctcctgacgcctccaccgccatgttagcgaggcaagtccccacgtagccatggacctccaagcggacacggtaaggaaagctcgcactgagcggtgggatggtcgtgtactccggcgcgtcggggtagcccactaccagtgtcatgcgtgccagctctgccacaaagtcgatcatgccttctccgcggtggttgggtgggtgaccggccatctagagaagacaaaggagtaggatcaatgcatgctcaaatccaaatttaaataaagcaataaagactcaaataaaggaatcaaataagagcaaaattttatgcatagatcattttacatgagcgcgaataaataagacagactcacataacgataaaataatgggaaattagatacataataataataacgaacaaagcataaataccttgcaacccatgataccgagctaggaccgaatgcatttcacccatcaaatcccaactgactgacgaataaatcccaataattttactaaaaccctagactgactcgttttgaaaaactcactttaaacgagcgaccaagatttttcccttgaaccacaagaacagatccccattttcccggaacaaatccaattgcgaagaacatatgcaatgaaaaaggattcagagggctcttaggtttttccatttggcttgccctacggtcaaggtcggttctgataccaacttgtcacgcccagaaattcccgaatagaattccaagcagaatgtgcattaaaatccccgtccaggaccagccggggtacacaaacgacaatgttgacatacagatccacgtcttacaaacattgtaaaatcttacagaaatgcagcggaaaacaaaagataa

SEQ ID NO: 52500 - DNA, 5877 bp, Oryza sativa
ctggctctgcgggggcttataaaaggtatctgccacggcctagtcgtcttggccctgggcatgtggaaacagagctggcgagggcgcccttcctcgcgtgtacaaactcgtctcgccgcccctcctacatcacgctcatcggcgacggcccgctccaacatcccgttccgcttgctgccaccacggcccaaggggaaaagaaaagagagagatatataagggagagagggatgaggaagaagggttggagagagtggatgataatgggtcccacaatatatttttgtatgtgaataacaaatgggtcccacatatatactccctccgtttcaggttataagatgttttgactttggtcaaaatcaaactgttttaaatttgactaagtttatagacaaatatagcaatatttgtaaaaccaaattagtttcattaaatcaataatttaatatattttcataataaatttgtctttggttgaaaatattattttttttctacaaacttagttaaactttaagcagattgactttaaccaaagttaaaatatcttataacctgaaacggaggaaatatttttttttaattctaataccacataagccccatgtgggacaaagaggtcaacactaccgcgtgagtgccacgttagcaaaactgctctccaaaacctcttggagtcgttgtatccggttttctgatttgagaaggggtgaactagatttcggcctattaaagggagtcaaagtgcactttttccatctacaaaaatacgccagtgggctttcatcctaggagtggtccgtgaaaactggatccaacagcccaactgtgcttacgtttcggcctttccccgccatttgcgctactggccgtgctccccgcccccacgccggcgagcgcgttgcagccttgcaggcgaggcaagaaccaacctatcgccatctatcttcaagaaaaaagaagcatatcgccatcgccaccgtcgccgccggggccgagcgcgcgcagctccttcacggtggagccgacggtagctagcttacgctcgccgccgctcatgagcaaaagaagcaatgtgcgtgcgtcgtcggtgcgcggacctgcatcctggcgtccaaggtgtcgccgcgaacagctgcagctgcaaatctgcaggtgccgcatcacgtgtacggtgtacccggtactgggctatactactggctaacaggccggtgagctgaaacaactacttcctctatcaaaaaaaaaaaaaaaggataaaccttgagtttccgtgtctaattttgactgtccgtcttatataatttttttttataattcgtattttcattattgttagatgataaaacatgattaatattttatgcgtgacttgtttttttaattttttttataatttttttaaataagacggatgatccaatgttacaaacggaaatcagggtttgtcttttttttagagacggagagagtataaaatccaaactggccagtgcatcaagaatcaaacgtactacggggcaccggatgcctgagacacggcaatgccggagtagatataccgtcggcgtcgaccattgtctcagggagtcacagatgtgtagatttgttgcgtgttgtcaggcggtcaagatcctcgcttatccctgcctctgctgctgctacagtgctctgcacccatccaatgtctgcatccataagatttgctccccaggccggcaccaatctctgacgatctacgagcttcaacagcaagcagggctagcattcatcaattcaacccctcactcatagagtcctaggactactacactaccactgttcctgtcctgaaccgtaaggattttcttttgtttgcaagtcgattctactacggtcgcctattgaatttcggaagatcgaaattacatttcgtcaaggcagacacgttgctcactgtacatagatttgactctttaattcgcccccagcgaaggcttcctgtgcgttccattatgcgtgtacttgttcggtggatcctgcatttctgctatgctgttggacatgagagaaaaatggcgcgagccgaaaatttttagctgcggctccaccaccatgtggaggttaatcctggacgctagtagcaatccagttcttccccatggcgcgccaaaaatgcacaaccaagagtagtagtagtagtattctgcgccattacgccgatacggttggtagcttttctgtcaatgcatgcacgagattgcacttggcaacacagcaaaaggcagctatttctctctctccctctctctcacactaggaatcgagcaaaacgtttatggcacatgtaaacatgaatcatatactcctagctgatgaatcactggtggggttcacgcatttaggctttgttcgctagctgtgggaattaatcccagggaaaagcctcccacgtggggtttgggttgtcccctcaccccacacccaatccctccccgcgaatccccccctctcatccctctgtttggacagaggtgggattagaagggatcactaccattcactacacttcaaattcagaatgagtacaacatttttgaaaattcggataaaataaaaaaaactggaagaaaggtcacgaacgtcaaaataatctagaaatgataagaaaaaaattgatcatgaaaacaaaacaaaaattaaacgtggaaaataattctaaaaatccccaaaaaaataaaattgtagaattacaacatatgcactctaaacatagtccagaatttttaaacaatcataattttggatagattaaattctacaagcagtaaaacatccaaaataatcacaagttttccaatagatatgctaggaaccaacttaacattgatactacaaaaatctctcttcgttttcaaagaatctaactttcaaaatcagtctaaaactgaccactcttaacatcgtactcgcatacaatttctattgaaggggcactgcactattgcaacaatcaaaattcagtgaaaacagctttgttcaaatcagatctctctcattgagctaactggaagaataaaagttccaattgccattgtgcaaagcaagacaaaaattggttcttggaacttaataaatctctgtccaatcaaactcaataatatatctctgtctgatcaaacaagtgataattctgtagaaaaaattggttcctgcaaccataatagctacatgaattaagcagttaaggaaaaattatctttcatccatcgcatttcacaattcaaggagtctctaagaatcttgcaaaacaatccttccaatgggcacagctagcaaatgggccatggaaccctgtaactacacatccaaaaagaaacaagtgttagacactagacaatggtgattgctaatatgtaaactaattaagcaacaggtaaaataaacttgagcacaggcaataatacaattacacatcaaacacactgacacacacggagagaattactatactttaaactatgtgtgagaacataataatatgcatatgttttacaagattattaaacatgaaattagaggcattcaaggtggctacatgcataaatacttttaatctttcagcaaataaacagtctgcaatgggaggagggggatcaataatatgttcagattttgactagttccagaagtactttgtgtacttagttttgtttaaacctcaggtttgaagacataatttcctactcgatcattccacagaaaaataatatttttatcttttgaaggcatgcttttttgatgtaaagcttgtatctctattgctagaagctggacatgttatgtcagatcaaactgtatagcatgtttacttaaaaaggttgcatcctgaaagggtgatagttgtcacgcccagaaattcccgaatagaattccaagcagaatgtgcattaaaatccccgtccaggaccagccggggtacacaaacgacaatgttgacatacagatccacgtcttacaaacattgtaaaatcttacagaaatgcagcggaaaacaaaagataactggagctaagccttgacttgaacggcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaataggggtatgatgcatggatttaacaagggatagctaagcaggttcatttgcataaatactggcatttataaacaggaatttaatgcgaaaacagttgtaaaaattaaacagtattaaacatccgctgtccaacgctaacccacgttgcgacaggcccaaccatccacctaaactatccaaattcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcatagaccgtcgcagggcccatccaaactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttaaccaacatcagagtggtggtattaaaccaacattatcatataaacctatagtctaggttttaaatgagatccccaatgtgtgctagttgaactaagcatggctaagcaagtcctagtccaaagtctaatcatgttataacccaagctaacaaaggagcatgatatccaaaagcatggctgtaacaataggtatccatcccatagtgatattataaaacagtgcaatatttgaaagaaaacaatggagcatttgcaatataggatcaacatgttcaagtgacaagcatgacttgccttgctctgctgctggaggtacctcggcgactatttcgaagtacaccggagcgtcgaaagaaccggaatctagcgacatacaaagcaaacattgcaaacaggctataagactactgaaacagagaacaaaaccatttttaatggattctacacatttttcttgatttactgagacttgaatgggcttaaacggagctcggatgatttagttatgaattttagaagattcactgtgtttattactataaaagaaatccttaaataatttattgcgcaatattaaccagggctgacgtcagcgagggggcgcggcgcctacaggcggggcccaccggtcagcgaccgggagagagagaaagagggtggcggcttgcgggcccaccggtcagcggcacgggaaaaggatggggcggcggcgccacgtggcgaccggaccgacggccccgatctacccaagggtagatcggacggcggcgcgggacctcgcggccggggcgcgcgggcgcggcgcgagactgcggcgaccatggcgccggcggcgcggcgctcacacggcggcggcgcacatgcggcagcggcgcaaagcgacgaccgacggcggcggagagcggcggctagaggagaggaaggggaaaagaagggagggga

SEQ ID NO: 52501 - DNA, 1453 bp, Oryza sativa
agggttttctcctgatttcaccagcattttcttagggtcaattaataattacaattttgacttgggaggaaaaattcggggtgtggcaatagtgtaatgataaactgtgggagccttatataccttgttatggacagctacatttctcaagttttaacaaattttgctaagcaaaaagccatggagaaagattacctaaaaaaaatatcaataacagggtatgatctactgaagaagtgaagctaaatttttgcagagaattaactttgtcctcagcattcttataaagtgaaagtttgcaaaattgcagggtatgtttgcattcatgaaaaatgtacgggtagtgaaatcattgagaagcttgactgcctcatgtagaaagctacacaaaccactacaatataatttggaaaagagaaacacagtggaaattattgtgctctattatacctcactgtaaatcctgctgcagaaagataattcttcttctcaactgcctcaagccctaacgacttaaactctgcaattttccttcgattcacagctttgtcctgataaagtgagccataaaaaatatcaaataaatgaaatccttgcagaatacatgggaaagatatatactaactgtaaagaaaatattgtgaatattccaggaaagatacatttgattactcaaacgtgacattttaagcactcatggtattctacaagtattcatcttcagcattgtcaattgactttgtcctctgagcattcttgtaaactgaaagtttgcaaaattatatactaaggatcactaaatcggctgaacatttctatagagagcacaatatatatcatcagctgcctactatttctcttgctgcattccctatcaaccttaattctcaacataattccttaatccatacaaccactccatacatcaactagcaacaaatccatccactagataagtcacaaatcttttcagagtgggaaaaaaggagatcaagaatcagacctgcttcttgatgtccaggctattgtcctcgaccttgccatctcccgcaatcggtgaatccgaagcgagaaggagagatggcaagcagcggtgactgagggcgggatggagagcgggaaggagagcggcggcggctgaagcgggatggagaccggcggcgaccgagggcgggatggacacagtcggcggccgaggacgggatggagaccggcggcgactgaagcgggatgaagaccggcggcgaccgagggcgggatggggggcggcggctgctggagatatgctactcctagatctctgccctagagccgtctcccggacctcgcgccgcctccaaaccctagcgccatgggagtcgaggaagacgagcgctgtctctgctcggggaaaaaaaaatcgtctcggagatgatttttctttacccgggggtttggcgtggatcgggcggag

SEQ ID NO: 52502 - DNA, 2204 bp, Oryza sativa
  unsure (1)..(2204): unsure at all n locations
ccgttccgtatccaaatcccgtggattcgatcaatcgatcgatctctgcactgcacagctgcgcctgcagaatctcgcgacaccttgtacttccatttttttttcctctcctaaactgcatggtgacctcaccggcaactacagccacctgtgtatatatatagacgccccaccgtggtggtgatggatgtgaggttttgtgcggcgcgcttgctcagcgtatcgatcgatcccacgagagtctgcgagagagagagagagagagcacgtagaagaggttgagaagttgagatgtcgtccatcggcgccggcgcatgaggacccgaggtgggggcggccgtggccgcggtggcggtgggcggcggggcgcccccgcacgtcctcgccgtggacgacagctcggtcgaccgcgccgtcatcgccggcatcctccggagctcccggtttcgtggtacatgtgtggttgatgcatatcagttttgttttttgttctgtttgtggttgctgctgttgaaaatgttgttttggacgtttttctggtgcagtgacggctgtggatagcgggaagagggccctggaactgctaggctcggtacgcctttgtttttttcctgaacttttggccttgttttgcatgtcaggttgcggtgatatgcagccgcaattttctcatgttcctttggctcgctcatcatcttgcaggaaccaaatgtgagcatgataatcacggactactggatgccggagatgacgggatacgagctcctgaagaaagtcaaggtatacatgcatgatcttagattgtcctgcagaaagcttaattactttgattaacaggagaatcaatctgacgacgcaaaatcatgaatcgtatatgcatgcaggagtcatccaagctgaagaagatccccgtggtgatcatgtcctcggagaatgtgccaacaagaatcagcaggtatttttatccgtttataatatctctattgattagagcattcttatgtcttatccatacagattaccgagcacttaaccattgttcttccatctttgctctgttcgattggtttattaaccagatgccttgaggaaggcgcggaggatttcttggtgaagcccgtccggccatccgacgtgtcgcggctcttcagccgcgtgctaccatgagcctcgccgccgccgctgccgactcaccggccagccggcggcgcagtcacgcacggcggcggacgcattgtttgtttcggagacttttgaaagagcaggagaaacggtgcaaccctgccttgatcacttgacgaatgaattctccattttttttctcgttggggtcgtcttcttgtctttgtgtaacttgttgcaagctagtattaagacagagggaactactgaactattgaacagagcatatggtctctgtttctctctttttttttctcctttttgttgctttcagtttcttgaagttaatttaaaggcggggacaatggagttcctaacttgagcctaaatattttcctgtcagtcaagtcccgtttgtgatgtgtgtgtacgtgtatcgatgagcgtatgcaatacgtcgcgcgtacggtgggagccctggggggatcttgtccccgtcacaggccgttggtgttcttgtgcaaagcgtatccggcgatatcgttctcgttccagtacagactcggggcttgcagagccatgtgcgatgtgcccatgtcgtcgcagtaatgtacagtagatagtagcaacaagttctggtaattctggctggctcatccgctgtggtgatacggtccattaattcctgccatttcaagttcataaaaccatcggccagctggggattgggattcggcagcgtacttgccaaatgcaacctggattttgttcttcaggacatttaatactccctccgttctaaaaaaaactcaattcctgggtttctgttaggtccgtatctaacgtgttcgtcttatttgaaaaagttatgaaaaaaattaaaaagataagttatgcataaagtattattaatgttttatcatctaacaataatgaaaatactaatcataaaaaaagcattattaagtctttttaggacagagggagtaagtttgatgatgtcgattggcgaatccgctactgtttannnnnnnnnnnnnnnnnnnnnnnnnnnnnnnnnnnnnnnnnnnnnnnnnnnnnnn

SEQ ID NO: 52503 - DNA, 2183 bp, Oryza sativa
ccgttccgctcgccctcccactgccgcgagtcgccgccgccgttcccctcgccctcccactgccgcgagtcgccgccgccgttcccctcgccgtcgccgccgccgagccgccgtcgtcctagccgccgaccgctgcccccagttcggttctgatgcgccccgatgccgcccgctcgctctcgccgccctcctgcctgtcggccgaatgggaagaaggggagagaaagagagagaagggagatagggaggaggaagaggactgacatgtgggccccacatatcagtgggcccacatttctttttgtgccaatgactaatgggtcccacgcatattttgtaattctaatgccacgtaattgccacgttaacgccacgtggaccgaagactcggttaatatcgccacatagacgccacgtggcgccacgtcagcgaaaccacctcccaaaaccggcgagggagttaaattacaccggttttgcaagttcggggggtcgagatttctggtattgcggttgagggatacgatttagattcggtggtcagttgagggagtcaaagtaatcttattcctttatactgcaccgcagcaccacacttccttttcaagaatgcatccgaatttattacttattatcttgaaatttgtactcctgcatagcaatgcattgcaaaagtatgctccgctggatctttttatcacattgttttggaaggaagtactgtacctgattttctcccaaagcagattggtagatattcgaagggggatcatttagagtcgacctgcaggcatgcaaatgcagtggatccggtgaatctggcccattctcacattttactgcaaggcgaaattactaaacaatgtgttctatacgaaaattttatatatagaaatttctttaaaatatcaattatataaatttattaagtttgtaataatcaaaatttaattaattatgtgccaataatagctttttcgttcttcatcagtttcaaacaccatctaattaggctaggccgatgggtattccgcattgtaattgtcccccttagtcaggccgtctttcggcccatttatctcccactcccccgcgtccgtccctaatattgggccgcgcacgtgcgaagtcattgccgggccaattttcacgggttaggcccatttaaggagagagatcctcctgcttctcccctcccgtgctcccctttcttcccctgcgccctcccaccgggagtccacacccctctcctcctcgcccgcaacctcccccttcgtgccggcctccgaccgagaaagcgcggcgtctccccagccacgcgctcgtctccggcgaccgccgcgccctctcctgcaggtacgtgcccctgcttcccccacgttcccctcccgtgcgccgtgcgccggggctctctcgggcttccgggccgagacggcggcggcggcggcggcggcggcgcgaattgtggcgcgcccgccctaccgtcctctcggtctccgcccgcttcgggacacccctgcggtgccgctgccaactagggagtagtttcacacgcttagttcgatccctaggggtttttggttttgatgcgttcaaacctagcgattcgattcctgtcggttttatttgcaattgggagaaactatccactttaattcagtctctgcggcccgcggggggtaggtgtgtgtggtggtagggattagttgccctgcagtaagttctgtatgtttgggtactttgagcactacagatctctagtgatcagcgtgaatctctaaataatggcctttatggctttgtcattaacgtgagatgcacatatgtcgtgcatatcttattgtgctgtttgtcagggatgttgcatttagctgtattttgcaaataatttgcagttgcagacttgcagtgaactactagtttctaaaacgtgaaacattcctcttctcttttctagttttgcagctttccactgtgtatatctggtttctactttttgtaaaataaaatggagaacactcagaatgagaacagcaaggaagccaagcaagatgacgagacccgccaaaacaagcaagatgatgaggtaattctggtgtgcctttagtaacaatctgaaacaggcaattttgcttaatctcattttagcacgatactttttcattgacaaaatcaatggatgg

SEQ ID NO: 52504 - DNA, 814 bp, Oryza sativa
gaaaaaataaaacgtaacggtgaatcaaaagaaagcagtttttctttatctcgcataattaaatcgtaagtgtcttcgtccgcttttgaattccctttggtatccgtttctttgcctttattatcttgagaaaaataaccattgtgtacacctaccgcactttttcctgtttcacgctcatagatttcattgaaccagcgataaaatttaccgttatcacggtaatttgccaccttatcaataaaaaacagcgaaagcactttaatgcctttgctattcagccatttttctttggctaaatgctctttaatggtgcactccatctgctttttcataatttcatcacgcaagagatcatcatcttcactttgtgtaagcacttgcccattagataagtggatctctccaaatgggggaaatcggcagacgcataattcattgataataaacccgtgtcgataactctcatttttgcctgatttttcatagagatcatcacctgcttgaatggtaactacttttttcttcgtttctttctccgtttgaacgtgaatttcaattttggctttgagtttacctttgccaaccacaggctcttttagcaccacataagccccgttcacatcgttttctgccagcacaggttcgacttcgatttgttttaccaatttttggttataagcgtctaacggatttaagctataaattttatggtatggatttttatgcgtggcagaataacgcaatacaaatagcggattcagggcttctatcgcctgtttggctaaatctgtttccatattttgcggttcat

SEQ ID NO: 52505 - DNA, 863 bp, Oryza sativa
cctgactagaataagaggaagaacattatcagaatgtaccataaatagccatgatgcattttacagttccttaacaacaatgtcaaatttctaaaatgtgccacacaaaaaatcacaaaggtgtatgacattgcacctgatccaaagctcgtttcatggctaaggtagcacctctaccatcattttgtggctgagttatgtggtgtgcgtcacctgaaagagtcattcacaatgaaaggcatcctaacgacagaataaacaaaactctttgtggaataggaggataccagacattccatagcctctcacttctgcataaatttttgccccacgttcttttgcatgatcaagtgcctacagaagagtatatggttaaccctcttaaggtcaaataagatgaactaaatgacactttccagacatagaaaaaaatgcatacacgatagagaaaaagaattagaatattaagggatcaataagtggatatgtgagtcaaactgatcataagacagatcaaagtattaaatggctgatattaaactacactcaaccagaaacttcagaacgaaggtgtaaaataccaacatttttctgaactcacctccaacaccataactccacaaccttcaccaatcctattaattattttgaaacaaagataagaatagccacacatgaaaaaggaaaaaaagaaagggggtatgatttgataaaggatgacatacacaaatccatctctaccacaatcaaatggcctggaagccgcttgaggaagagagttatattttgtagacaatgctcttaatctgaaaaacaaataacatcacaatgaaataagataaggttggccacactaatcagag

SEQ ID NO: 52506 - DNA, 5773 bp, Oryza sativa
atccctccaccgattgagactccctgatacaactccaatcagacaccgcaattcagaaacacataaaaaaaatatatagttcataccaacagcagtttgtaccgttctttccttcttctcatcttctgaaggcaaccaatttgcatctcttaaagcctcatcagctgcacatagagcataggctataaatccggatatagatttattgtcctggaaacaagaaggtcaatcaacagttcaaacatcaaagcatgatacagagtttaaccatatgagctattcagcaccgccattacatgtttacagccatgcaaacaacattctgtcagaatattttggctcctagtaggagaaggaaaaaaatggcagaagtaattctatctacacattttgttccaaactaggacgtgcatatttctataagtatgcaatgaaaatatgagtgggagcacaaattaacaaaaaaaaaaaaggaaaggaaaacattgagaaatcaagacacttgtcactcctggtggcactcaagataaggtcattgccattgtacagcctaccaggaacaacattagtttttgtattatgatgatctatcacattactagcagaaaaatcgtgttggataaagaattatagataacctcaaataggaaaagtggtgctagaggtagtatgggcaatcaatatctatgtacatattggccatgaaatgcggttaaacttatcatcgccacaaaatggggtgaaattatgatgtaaggacagagcaaaagttgcattcctatatatttgcaagacctaaacgttctccaattttagcatccaacaaggcctgaacaaatcactccactcctcagtgcttgaatcccaatgcagcacagaaagcaatctactgcaccaatccaatctcgcattaacaactagtagaagcacattaacaaagcattggaattattagggctaatgaagcaacggtgagtatgataagcaaccttagtccaagcctcctcgtcgaactcggcgtcgcccttcccgcgcggcacgggggcggcgaccctggacgggagctgctccagcgtcctccccgcgtcggctccccccgggaggcgcaggtcctcggcggcgagcgcgcgcaccgcgcagccgccggccacgaggcggtcccaggtgggccccacgccgcggccgagaggggtgacggccccgagccccgtgaccaccacgcggcgccccgcggaggggcgcggcggggggagctcagcctgctccgcggccgccggagccgccgaggaggaggagagcccacggcgtaggccgaggcggagcgcgcggcggaggcagcccatcgcggcggcgccgtcgcaaagccgccggagttcgaagcaaaggcgaagagtggagatgagtcctctcgactgttttccgtttcgagcagtttacagccgctggatgcgtgcatcgaacggctaggatctattgatgtactgcctttcttttattatttttttccctttttcttctttaaatttaaatattgttggggctgaaccaaattacttcactgtgcaaactataatttaccaaccggcaaacatattttacacaatcaaccctcatcttgctataaactttgaggacagtttcaactagcaaatcagcagtggaacaacaatagacacatgcacacaagacacggtgatttacgtggaaaacctcttcggtatgaggagtaaaaaaccatgggaccaacgatgcactccaagcttctgttataaacaataatgggcacaaatggagtcttcactagaacatctaaatgcacatcgcaacatcagctataacatcaagttacacacttgacatcatcaacatcaaccaccaaaactaacaagaggtatatcaacaaacaagcagagaaatagcagatcctttttggttctcaactgagatctcccaaaccacatatgcaaattgcacgaaacttggtacaaatgatggcctatgagtcatttccaagctgtccaaaaaacaacacaattgaacaccatttgacccttcaaactgacattccaccaaatgttgcataatgtaactgtagcaactcgagctgataaaccactactcaaatcaggtactctactcaaccaatccttgcataaactagccagattaaagtgctcaaagtaaggaacaaactcaccaagtttggtgccaattcaatcacgtttgaacctccaatcgctgacttgatgaagatcggataagagctaccaagctgaacaaactgtaacttttcttctctactctccgctctctctctctcttgtgttttgctggttttcttctcgtcctcaatggttgttgttatctcaactctctccatgaaagctagggtttttcttcctatcacaaaggatgtggtaatcttcaccattgatcaaggatatgaatcaatggctcatatttgttagattttcgggctgcaatgggctgagagcaaatgcttatggaggaaaatttggcccaacaaatactagacttacttttttttaagaggaaagtactccctctgttgcaaaatgtttgacaccgttgactttttagcacatgtttgaccgttcgttttattcgaaaaaatttgtgaaatatgtaaaactatatgtgcacatgaaagtatatttaacaatgaatcaaatgatatgaaaagaataaataattacttaaaattttttgaataaaacaaattgtcaaacacgtactaaaaagtcaacggtgtcaaatattttgaaacagagggagtactagacttactagtactgttttttaccactatttctgaacaccgtttggcgcatccaaccattatcataatttcaatttatggcagtaaagacataaacatcttgcctcttcttgatcatattagaatatgagaaagttgagagtttaactcatgaacctatgaacctatgtctcgaatcttaactcatgaaccatcattgtcgacaggtgatgcccgtagaccggatatagagggtattggggtactttggtacaaggatctacgtagtacgacatcaagcgaacaaaagacaagaattatactggttcaggccccttgataggtaatagccctaatccagttgatgtgggattatatggtagaaaacacaggttacaaagggaacaatgaacttgtcgaatccggcgaaatcgtagtcgagttgattcgactagatctcgatggcttggctccttgcaggctccggcttcgtaggttatgtgggttgtgtcggctctgagattcgatcctttaagccctcaccaggggtcccttttatatcacagatctggaggtctccaagtagaactcggagatatcagaccctattcgatacgtcaacgacccaatcttgtccgagtaggattcttcccatccgtagattccgtgaagtatttccatagaatatataggaagtatctgtatgcgcgtgggtataccataccgatatgtaacatatatcgaagggtaaagggtatgcctaacccgtaaccctgacagtagcccccgacttctgcttaaaatgggctcgtgtaaccattcacgacttcgggtgtcgagattgttgtcgttcccggtgcgaggatcgcggagacaggccgtagtcgagcacgccattcaaagcccaacggtcacgagcgaattttaaactgaagtccagaaaaccgccgcgcgtaacggacccagaaatttccggcgggcatctctctctgtccttggaattcgcaccgtcggtagtgcgcctatttaaaggaattttggagatccattttgaagtccgccaaccgtgttgaaaacattccacctgtaagcgctcttcgccttcttcgccgtcacaagaaaccctagttcatcaacctaggccctttctccggcgatcttgaatcagcaatggacctcagcaagtcatcttccaccagtgcgtcgctgaagaagcttcaggaagacggcgtccttcctggccgtggaaccatggagagagaagcaggaggtactaatccccagcccatcttgggtcgcatggttgcgatcgaagattatgttctctgcggtcttctccctccaccttccgagtttcttctcttggttttgaatttctatggtctttctcttctccatttgaaccccaattccattgcctttcttagcatctttgccccatctttgcgaggcctacattggggtagagccttttcttgatctctttcgctcttactatgaactgtgttggatggaatccaacagggtatctggttgcgtcgggttccgacttcaggatggcctgaagtcgcgttatatccccttccagtgcccttcttctcgcagcaaatagcggaataggtggttctaccttgagatcaaagattcgaaccctgtcttcgttgttcccaaagaacaaccggacaagatttcgtcttggaccgcaaagccccccttgaccccttctcttcagccgtttatcgacatcatcgatgatctccgagtacggggcttgtcggggtatgaagtcattgcagacttcgttggtaggcggatccagccactccaggctcgggcctatccagcttataattattccggaccggaggacgcgacccgggtttctcctcggggtatctttctcgcatttatcctgacatgcttatgttcgcgttcctattgactcatcgaaatctggttctcgatttacaggtctgaacagtgaggccgtggagcgccgtgtcggccaggtgatgatcagcggtccgacaacggcgagcaacatccccacgcctctttgtgaaaagggggcggccgagcgtgatgacgctatcaacgtaagtgcacccgataagcatcacgcatttttccttcgagatcaccttatgacttgattaagcgtaggctcttcctctgactgacatcatcgggccactcacagaccatcaggtggcggcgtctctgaaagagaaggtcgccaaggaggcgtatgatgctgctgctgccaccactagcggtggcaatgttgcgacaaaggggaggaagttctcctctgtaagcggacatcgtcgcaagacgccgacaccctcggtaatttatcctgtcgtcagatcgtgcagccagaaggattttgccttactttgcgttgattgtctttcaggcctcggacgcgtcacccccacctccacgacgacaacgtattgtgacgatcggcgagaagtaagtagatgaatttttagatttccgtgattctattcaagcgttgtctgacccatggtcgtcctgtagggaggcgcgggcaaaggctgcgcaagccaagtccggagggacttccagtgcgtcgcctgccgcggcttcgacggatgtcgtgcccgcagccgggagctggaaggcgacgcctagcggcccagtcagcgatcccgcggtaggtcgtgatccaccagctgccgtcctcacctgggaggagctctaagtcaagatggggcgcctcctcgaagcgggtgctcgcggtattggccgcgagattgcggaggcgaggtcggaagcagcgctggcgaacgcacgtgctgaccggctggtgcgcgagttggctggagctcgtgaagacctcacgaagatgagggaattggtggccggcaacgagcgacaacggaagaggctcgaggaccgcatgtcggaactcgggaacaacctatcggagatccagggctcgttgcggtcacctacactggcctg

SEQ ID NO: 52507 - DNA, 1780 bp, Oryza sativa
ttcgtctctacaggatctgacaaggccttatcggctctgggcgtccccagccgaagatcccttaggttcctcagaggccttttcaagacggcgtaaagggacataaggacaggtttcaacgcgaggtgtcatcagggtaagggatcatcaggcgaaaacactttgattgtaatatgggcctaaaaataggcttcattgatactgtaaggtgtcttacaggtatggatggtattgactcatacatagaatttacgtagttggtcaatgttccaagaatttgctaactcgcgaccgtcgccgtctgcgattttgaatgcgcctggccacaagacttgtgtgatcgtgtaaggtccttcccattttggtgagagtttgtttcgccctgcttggctttgaactcgttggaggacgtagtcgccgatcgaaggtatgcgtgctcggatgcgcttctcgtggtaacggcgaagggcctgttgatagctggctgctcggacggcaacctgttcacgatgctcctcaagaagatttacatcgatgtcccgctgttcctcctggtcctcatcgcagtgcttctgtactcgtgtactctgatgtcgtagctcgccgggaagcatagcctcagagccgtacacaaggaagaagggtgtttccttgttagacgttgtcggtgtggtgcgtacggcccatagtactgatgggagttcttcaacccattttttgtcgtgtgacatgagtctgtcgtagacgcgggtttttatcccttgtagtactatgccgtttgccctctcgacttgtccgttgctttgagggtgagagaccgaggcgaagcatattttgacccctagcccgatgcagtaatcctggaaatcgacgctgatgaactgggagccgttgtcagttatgatgcggtgcggtagtccgtatctgcaaaatatccctttgatgaatttgatggcgttgtcggccttgatttcccccgtgggtactgcttcgatccatttagtgaacttgtcgatcgccacgaataggaatctgtagccgccctgccctcgtgggaatggcccaagtatatctagcccctagcacgagaacggccaagttagagggatagtctggagcgcttgcgcgggtagctttgtgtgtttactgtggaattgacaggcttcgcatcgctagaccatgtcgcatgcatctttaagggcggttggccagaaaaagccttgtcgaaaagctttcccgaccaatgtccgaccggcggcatgtaacccacatatgccttcatgtataccgaggagaaggtgtctgccgtcgtcggtcgagacgcatttgagaagtaccccgtttggcgctttcttgtatagatcgttgccgaccatacagtagatctttgctttacgggttattttctcggcctctgtatcgtcctcaggcaactccttgctgttgacgaatttgattagtgggatgcgccagtcgtctgtggtctcgatgtcggcgacggcacgttctaccttggtgacctctgagctaatgtcgggggtgtccgagctaacttcgccgctaacctctttcactgatggcttcgtcaggatgtcgagaaaagtgccaggctcgagcgattctcgtctggacgcacgtcgtgctaggtcgtctggctcaatgttgtccttgcggtagacatgtcggacctcgatcccatcgaaccttttctctagcttcctgacttctgcgagatacttggataactcggggttagagcatttataatctttgtgcacct

SEQ ID NO: 52508 - DNA, 5597 bp, Oryza sativa
ctgggacttgatggctgttcgtggcaccaagtggacatcaaactggctcagctcgactacccatttcgcaatgcggccgacaacatctttgtttctcacaacttcgccaagagggaaagaggagacaactgtgactctgtgagcttgaaagtagtggcgtagcttccttgatgtcatgatgaccgcgtaaagtagcttttggatctgtgggtatcttgtctttgcgtcgtggagagcttcgctgacgtaatagactggtcgttgtactttctctctctcgacaacaatgacggtgctaacggaatacggtgtggtggcaatatagaggaataattcttcattaggttggggagcaacaagtacaggggggtttgataggtagcgcttgagtgcaacaaatgcctcttcggcttcctgtgtccatacaaatttgtcttgtttctttagcagagcgaagaaggttgcctcgttctcccatcctagcgatgaacctgctcagtgccgtcatgcatccggttagcttttgtacctccttgagtcttgtgggcgacttcatgttcttgattgccttgatcttctcggggtttgcttctcattcctttgctagaaacgaggaatccgagcagcttgcccaacggtactccgaacatgcacttctctggattgagcatgaggcgatatcgtcggaggttgtcgaacgtttgccgcagatcggcaatcaatgagtcgcctgtcttggttttgacaacgatgtcgtcgacgtatgcctcgacattgttgccaagctggtcgctaagtgcgccctggaccgtgcgctggaagatattccctgcggttattagtccgaacggcatcttaacgtagcaaaataccctgaacggtgtgatgaatgctgtcttctcttcgtcctcttttgccatgctgatttggtggtagccagagtaagcgtcaaggaagctcaacaactcgcaaccggctgttgaatccaccagttgatctattcgagggagagggaagtgatccttggggcatgccttattgaggtcggtgaagtcaacacacattctccattttccgttggccttccgcaccatgactagattggctagccactctggatgaagtacttctctgatgaagccagctttgagaagtttgtcgagctcttctcgtatggcttgttttcggtctggtgcaaatctccgcagtctttgctttactggcttggcatcgggtcgcaccatgagtttgtgctcaatcacctccctggggacccccggcatgtcggacggctgccaagcgaacacgtcagcattatcggggaggaaggtgatgagcgcgagttcctatttctcgtttagtgtcgccccgatcttgacggtcttgtcagggttggcactggagagtggaacgatcttgatggtgccgtccggtttcggcgtcttgtttgtcttgctcactttcttgggtggctcagtcatggcgggtgggctgggcgtttgctcgaccatgtcgaggctccgcttgtcacactgcactgccagctttgcgttcccttgaatagtgattgttcccttcggtcccggcatcttgagcacttgatacgcgtagtgagatgcggccatgaacttcgcaagtgcagttctcccgatgatggcgttgtaagctgtgtcgaattcagcgacatcaaaggtgatctgctctatttggaagttgttggcttggccgaaagtcacgggcaacgtaatcttgcccaatggttttggggagtaattccgtggaagggttgatcggttggtgtcaactcgctttacggaattcccattgcgtccaaagtgctggcgaaaggaagattgattgagctgccaccgtcgatgaggactcgcgctaccttgatgttccgaatagtgggttcgaccacgatcggatatcgtcctgggatgacggcggtcttggggtggtcttcttccgagaactctatcttctgctcagaccacttcatcttgggtgcagcccgctgccatgtcgaacagacgtcacgttccactttcttgtattctcgctttgaggagtacgttgtggaaccgccgaagatgtgtgaaacgtggaggtcggagtctggatacgctggatccgattcgtgaggaacctcctcctcgttcttctcgaccacgcgtactcgcttgcctttttcaaatgcgatgtgcttctcgagcgattttttgaaaacaaggcaatcttccagagaatgtttgtccgtcttgtgaatggggcaccatgctttctttgtgttgctactttgtgggtctgggcgcttgggagggttcacgtattctgctgcaagaacttccacttgagctttccttttcccatttttgcgatttttctttttgcttgactcagatgcgtccgtggctggtttcttgtctcccccggtcttcggcttatcgttcttgcgtcttagcgcatcatctgcgtgggcgcatcgctcaacaatctcgaacaatctccgagtggttgtgatgcgtcttgtcgccaactcctgtgtagtgtagcgatctctgacaccggatttgaaggcgcgaattacagaagtgtcggtgatttcggggattgtatttctgcactcgttgaagcgccgaacatattccctcagtgattcacccgagttctgagtcaacacgtgtaagtcgtcttcgatcgcgtggcgcttgtatgttccttggaaattggcgacgaactgttgccataggtctgcccacgaagagattgagtagggaggaagatgcatcagccatgaacgtgcaaaacctttcaacgcagttggtaaataatttgccaacgcgttgtcgtctgctccggcagcgtagagtactgtggagtagacttgaaggaactcctctgggccggtgctcccatcatacttttctattgctccaggttggaatctctcaggccatcggacatcacgcagggaacgaccgaaagccctacacccagcgttgggggcggtgggttgtcggcggtcgtgtgtccttcgtggatgtctgtctgatgatgaggaggacgaggatgatgacgatgacgacgggtcgcttggttccggcgtacgattacgaggatgtcggcctggatctcgggaatcctgtcgtcgtctcccactgttgtctcggcgccgatctctgtcatcgtcttcgttatggcgatggcctcgacctgtattgtctggcacccgtcgttcgcgatcgttgtgatcgtggtggttgtcctggtctcggtcctcgtttgagcggtctctttgatttccgttatcatggcgccgtgaagagacatgacgccgagaacgattcacattgtcttgtgtacgtcgtgcctctcggcggccgttgatgtgatctcggagatcgccagtgccgcgaggtggaggggtagctcgttggggtgattcccttcgttctgggtcttcaccattgacatcgccagttggtggctgctccgagtgcgctgcggtagcggcttcttcaaacgcgttgctgaggttggtcactgattcccgtagtcattctgtccaacgctcgaggtcatcgttcagaacgggatcgtagggagtttccctcagtatagcttgaacggccctaatgtgctgggctggagtagtcaattgtcctcccgcttctgcgttggcatgcgctgacgtgccaacgtcatcgatagccaatacctcccgcggcgcactcgttatcgatgacccatagtcttcgagaaggtgtaagactgatgattcgtgaggatcgatatcgattaccccaacaaatcgatctgaagttgaagtcgctccttgttccttgtcgttatccctgatggggacgtatgacttcggagacggagctttcatggcgccaagaaagaccttgcagcttgagaggtcgtgattctttgtcttgtgaataggacaatagacatcacgagttggagaaacacgctgaattccacgctctttgcaggcgcgaatttcagcgcggacgttgaggaaaacctagcaggcttacaaagtgtgtttcctggttttgtggataggacaccaggaccttgtggcttcggaagtcatctttgtcagctcgcgattcatgtcggaagaacaaggtttggccgcatcagaatccttctcgagctcggatgtcgtcgatgctccgttctccgtctcagcgggaggatttttcgacatgaagtcgtcttggtttgtagacactgcgttctcgtttccggtcattgggggaccggttgagatcggcgttgtggtgtaaaccgggaagacgatttcgctgacttgagtccataccagcatcgttaaagcagggtgtacttggctgaggttggtgttgacgccgttgtcgacgaagctggatgacatagtagtagaaccttgagtaccaagtgcccctacctggcgcgccactgtcgataggtgatgcccgtagaccggatatagagggtattggggtacgttggtacaaggatctacgtagtacgacatcaagcgaacaaaagacaagaattatactggttcaggccccttgataggtaatagccctaatccagttgatgtgggattatatggtggaaaacacatgttacaaagggaacaatggaacttgtcgaatccggcgaaatcgtagtcgagttgattcgactagatctcgatggcttggctccttgcaggctccggcttcgtaggctacgtgggttgtgtcggctctgagattcgatcctttaagccctcaccggggggtcccttttatatcacagatctggaggtctccaagtagaacttggagatatcagaccctattcgatacgtcaacgacccaatcttgtccgagtaggattcttcccatccgtagattccgtgaaggatttccatagaatatacaagaagtatctgtatgcgcgtgggtataccatactgatatgtaacatatatcgaagggtaaagggtatgcctaacccgtaaccctgacaatcatcattttttttacccactatattttcttttaaaaaagatttctgaacttgaacaagagctatataagaaaataagctcacacccaccaagttcataatacttattgttttagataagtaaacggtctcgaaaaacaattttgaccactttcctccatcataatataaatagaaatattgtaataatataatttcattgatgtactttttaagactaatatatacatatagtcttcatattttaaaacaaataattttaaaatatttatagttaaaaagtttaaaagggtgtgtttatttcacgccaaattaaattggaagtttgattaaaattggaacgatatgatggaaaagttcgaagtttatgtgtgtagaaaagttttgatgtgatgaaaaagttggaagtttgaagaaaaagttgggagctaatctaggccaaagtttgacattagccaattccaaacgacgagtattatctatgtaaagaaagtagctaattataccagtatatgttaaatggtattgtcattttttctttaacggtaaatgatattgtcgttatccatgatatggat

SEQ ID NO: 52509 - DNA, 1316 bp, Oryza sativa
ctccgttgagcgacaaaccataggaagtagcgacactgagaggggcaaaaaagcgccagattggtaggtgctaaaatgagatcctgcctgggaagagggcaaggtaagccgaccgggtagagtacgaccccgaactctcccacctctagatgaaagaatcaggatggtcctttgagagagttgttgtctgcaacaacgaccaatctgcaagtattgcagcattgcctggactcccaaggagccatggagatcgcggatccaacggttgttggccaacgcatcagcgaccaagagctttcggcggacacgcaccgggacgcgatcataaagctcaggtgcctaagagcgaaggctcgaatcctgtagccatctgtcctcctagaagaggatcgacttgatattctcgataatctgcccatttaagtttactgctcaggccatgacatgataaaccaagtggctggagagtggcctttgtatggtagcgaatctatacgagggatgaatctacatatgtgttataaatgtttttaaacctatatgtatattagtgaatctagaccatggacggagaaaacaatacgttatataatatgaaattgaagaagtaattaagtcactagttcaatctcatttcctcagaagaattatccatgaataagtccaacacaactaagatatacacactacatatatgaatgattcagtatgcatccgtcaacatagtacaatatagaaattttctagtacgatgattcttgatatgagatatgctcagattcgtagtaatatgatgtatcacattctgtattgcattgtttgttatattttgggatgtatgtagtagtttatttttttgtttcaatagataaataattcagtagctcagcctcagatgaaatatcagcagatgaggtcagtcagtcccatttccaccacacagcagcagcatccatacatttttctctctttcttttctttctttttatttgttgttgaaaagagcatccaaacatgcacgcatcaacatccacactccacagtgtggctgacgccctgccggtttctgccgcctcacgtcgccgcgagcgccaccacagtagtactagtacactagtacacgagtcctccctccataataataataataataataataataataataataaaaaaaaaaccgagtctccgtgtacaacgtgaccgtccatcttatttgaacggagggagtagcacgcacgagcacagaagccacaaaaaacgagttcgaaagcgaggctgcctttttggcgccatccatggcgctgggctgcagg

SEQ ID NO: 52510 - DNA, 813 bp, Oryza sativa
aattcctgcagccccagctcgaaattgaagtttactctgtaggaagcagagatttagccttgcaaattcctgcagtatattgagccatcactttcttttacagcaataacttcgctcaaaacaagtttgccttttttactaattgttgtatccttgttcatcaggtgctaaaattcaatgggcaagaagcactgttttctgctcttcagagagtcaaagaaggtaatatcatccaagttcttatagttagaatgttagattgctgcctgtacaacaatttatttcttggatacaaaggacaattttcactctgtttctttcacatattactgccagcagaacctgaaaagatgatcttatcgtcaccaaatgataaaataaaatgcttcatgacacgatggccagaacatttcataccagtttacttatgccacaataatttgtgccatttgttcactgcctgatccagcttgttgattacttgtgcagagttgatgcttctgggtttcatttccttcctgcttagcgtcttccaaaaatttatcaatcacatttgcatcccggagagtgctgcacatctcatgcttccatgcattactagagagacgtccgagaccacagaagatgcttccaaactttgcaagcgaaaggtaggatgtgaactatggagagattttcttaaacttttgggaatttttgataaactccaccacgaagtgtgcactctggattgtttagctttgttatttttcactaaagaatttgtttcttgtgggtatcttttctttcttgaagagtagaacaaacaagaaa

SEQ ID NO: 52511 - DNA, 1236 bp, Oryza sativa
attttcacatgattttagagcagaaagtttttgattggaaaagactatacctactacgtttttcttactgaactcttattagcattgatgtgtcatgctattaatatatcctagattttttataatcccatatagttaaatcaatcggttgagataattgagggttgagatcattgagggtaagagtttagtaagaaaattttaattggtgtagcagtgctcttttgaatttattgtttgaaatagcgcgtatcgacgaacatattcctacaaatttgagatgaaatgttataggattttcagaggattcagttcggtttccgcaagataagcatgcagtgttccaaaggataactaaagagtagattacttttgcaatgagtttacagttcaactagttactaactagtccaatgctacaacgtcgcaatggtcacttgccagaaaatacaacaactgttctccactgtttaaacacaatttcacatctatatatcactggatagcaattaagctccccaaattattattgaatcaatcagaagtacccaaaaaaaaacagagaatcccaaaacatgactactgtacagaaatcagtcaggagggccactgcaaacaaggcgtttgcttcatgctcagtttcagtcagcacagcaagaccgacgcttcttcagtcttcacaccaaatccgggtcattcttgggtccagcagccacctcctcgacgtgcaatggcttcttgtagagctggagcagcagcgacgagcagacgacgctcaccgacgaggccgccatgcaagctccggcgagccatggcggcagccggatgccggtgaacgggaacaggacgcccgcggcgaccggcatgcccaggacgttgtagcccagagcccagacgtagttgagccggattcttgagagggtcttcctggagagatcgatggcagtgatcacatcctcgaggctgctcctcatcaggacaatgtcggcagcttcgatggcgacgtcggttccagccccaatcgccaggcctacgtctgcagcggctagagccggcgagtcgtttatcccgtcgccgaccatggccaccgtcaaccctttcatctgtgaacaaatgatgtgatgtaagttggaataatggtggtaaaatctgtgatctattccaactttgtttttgctgcaaggagaaaagattgcacctgccagtccttgatcttttcggctttaccacctggat

SEQ ID NO: 52512 - DNA, 3612 bp, Oryza sativa
  unsure (1)..(3612): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctgctcctccttcatgatcatctccttgtggcacttggagcacatgttcatggtcgccgcgctgccaaagaagccgcagttattgatgcaaaggattgggccctcgggctgctggcagccagcctccttgtgttccatcgcaactgtgatctgttcatcaaacaaacaatgcaaaactcaataccgaaatgcgtataagaaacaaatttaaaatttaacatacggataaatcaactagtgtccaattaaatcgggcggtaagataatccaagaagcacctagtgctacaattttcctatcgaaatttccatataattgtgacttttaaaataacctataacccactgcggcgagcttacactttatgaaacaagatcctaatttctatgaggcgcaacgaaatcgccatcacaaaagtggattcctcatcttatcaaccaaacgcgcctatccatttcgacgaaatcaaattcaaacaccgtaaatctgctgtaacacgttttacccactcacatttaccccgagtaatgattaatcgcccacggttctacaacaaatcaaccccaaaaaaagatcaggaaactcacgcgaatctaatcatttcaacctgaaagatcacatagcctaatacacaaccgaaaaaaaaaatcaaacataaacgctttcccctcgagcccaataaccaataaccaaccacatcaaataccaaatcaaacaacgaccccccacatcagatccccgcaccaacccaaaaccgatcccccctccccaacaccagcaccacgcggatcgatcgatcgaatcgaatcgaccccaagaaaaaaacaaaaaaaagaaaaagaagcccacagatcaaacgggtcacccacaaactcaagggggggggtggaatcaggcagggggagcaagagggcaaaccctaaccctggtcgcggcggcggcggaggccgaggcggcggtggcggaggaggcgtgcggggattggaatcgcgagctcggtgcgcgtggtggcgtctcctctctctctctctctctctctctcactctctctcttcaggggaaggtgggggtggggggagagagagacactgataaaaaagaaagcccccgatggcgacggggaaattaccggtttgcccctcgcctcgacgtgtatttacgccacgtggtggggttgtgggccgttggatcgtggttggacggatgggaatcggagggagggtgtggggttttgcggttgggtccctgggagatgtggggttataaaaagtaggggctttttctttcttgctggggaagaagatggaggagagggagagcgtgtcccttttccttctctttattgttggtgtgatacttgtgtttaattattaaatcctttcttattatagtgctggaatttagtttttttctattgcagtaatactgtgaaataatatgaaccggtataaaataaaaagataacgtgttcatatgataatcgtataaattgttgctaacttttgtagatgaaaagaacaacatgttcataaccattccctataaaatcatattgccttataaatgaaacatataggttgtcctagatataaaacaatttttgcctgcttgacactcttgtgttcatgaaaattattttttttaatacacaaaagagttgcgcacctatgtattaagaacaataaaatttataagcggagccaaataaaaagaagaagagagccacatgtggagtagatgaaaaactagaggaccataaacctattctcatggtaagcaagagacgacctattgtgacatagcactctaccttattgcgtcatgtatataccttatcatgtacaaaacaataaaaataaagaatatggtcagaccaacttgcttttaactatggatgattggtagtattgatataggggtaagaatacatttttaggatttagttcaatcataagggtttggattaagtcgttgatttcgtaccagctaattaggtatgctaggtataaacatttggcatagcatacatgcacttagtaatataggtgctcaatgaaaagagaaaattgacatttagccatcgtcaggatggggtttcgccagaatgccactcccaaaagtggtttcgttaaaatgccatcctcaaacaggggcaacatgttgtaatgccattttatccatttcttctcaatttaatgatttttgtagtgttttttcttgctgagatgactaaaataccctttatcctatctcatctctctcttcttcctctccgttgcatatacacagcacggctcgatggcgtggctgtggacggggacgacgccagctaagctggggacggggacggggaaggggacgacgccggcgtgggtggggaaggctgcccccaacctccggcgcgtgcgccagccaccgcgatcgaagacggcgacggcggcgagcctgacctggacctccatggtaccaacgcccccgcccttgagcggcgcggcgtcgtcgggacccacgtatgcgccatccacctcgaggcggaaggcgagcgtggtgatgttccgcggcggctgcgcgaagggcgggagcgtggcgacggcgatgggggaggacggggcgagggagacggaggcgagcggggagaagcgatgggggaggacggggcgagggagacggaggcgagcggggagaagtaggtgacagtgagcttggagtttgggttgtcggcgaggagggaggcgtcgatccgtccccagccgcgccggtgccagggcagggatccatctcctccacgcaagtcaactaaatggtcacaggggcaattttgtcacaccacggtggaaatcatttgcaaatcagctaatttggtcgaaatggcaaagtagcaatgtggcgtcgttcgaaaatggcattataacgaagccacaatccggagtggcattctggcgaaaccccatcctgacgatggctaaatgtcaattttctccaatgaaaagggatcatctgacttaactgttgtgtaattgagccactgacacatggaaagagactcacatgtcagcatatgtactttctccttgtctttttcttaaccaacgcttgtaagatcttgtattgtactccctccgtcccataatataagtgattttgagtttttacttatacggtttgaccactcgtcttattaaaaaaaattggaatcattatttacttttttgtgacttactttattatccaaaatactttacacataacttttcgttttttatatttgcataaattatttgaataagacgagtggtcaaacactacaagcaaaaactcaaaatcccttatattatgggacggagagagtagtattcatcaaaacgttag

SEQ ID NO: 52513 - DNA, 5166 bp, Oryza sativa
ccacatgtcagcctgaagtaccgcacatgctctgcaggggatctcaattgagcagatgatattgatctcttaggtctaaatttcataagtaaactatttataaggtattgtttgagttgttgataaaacctaactaacaagctttaatacgtagagaaaaagaagattcctacaacattgtactccctccgtccctaatataaggattttaactttttgcctgtactgtttgaccattcgtcttatttaaaaaaatttagaattattatttattttatttgtgacttactttattatccaaagtattttaagtataacttttcgtttttatatttgcacaattttttttaaataagacgagtggttgaacagtgcacacaaaatatcaaaatcccttatattatgggatggagggagtactgtcttaaccaaattcctcatgttatttcccatcttcgtctactgtggaggagctctaactcattactcatccgttataattatcattttctttaggacaaaactcggtttagtatgtaacatttgatatactacccggtcgaaccgtaccaagctttcttgtaacatatatgatggtgttggagatctctagccaatcttatgccacatcgcatatatttcttttaactatgtatgtgccctaaataaacttagacatttattcgagccctagttttaaagacaaattctatctacccaaattgtaccgattctacccagcacacatgctaaaggaattttgcaaaattatgtatgctcgtgtggctgatctctcctctctactacacatccattgtataaaaacgagatttgaagggagagatacccctctaaacttttttttgtaaaatgaattgataaacatgtcaaaaattaaacacgagattttaaaatggaaaccacacgctctttacaactgcaccgtgaagtgatctctcacctccggtgtacaagcattttccatcgaaccctccatccccatggcgggtggttcattcgacgagacgccgccaacgccaaatcccggcgcgaaccaaaaagcgcgggaaaaatttccccgcacccgcgccatctccacctataaagatctcgccgccgcagccgccttctcctctacactactagtcctcttcaccccgccgcttccaccagatgggccgcaagaggagggctagggtttcccgcgacggcgacggcgaggaggaggaggagcccgcgccggtcgccgcagagagcaagagcctctacgaggtaaatccccaactccaaaccctaggtctatggcttacgaggtgttacccgtacgggtagcggttgattttgcggcggggtggtgttggtctgatcgaatcgtgtgctggatgcctggatcgatgtttttttgttctttttcttttttttccgggattcgagggtgaggagcgcatctgattgttcgatgcgatagcgggatagctttcgttttcttgtttatccggtgtcgcgtcaggttccgcccgttggggaatttcgtggttcgctgcgcggattgatcgtgtgttagtactagtgtacaagtataacccatatttgcataccagattacctcgaattgaagcaactgtgtgtaccatttcaatgtgcaaaaacaattgggcaagattatgctactgatgaacccaaagtacgaagtgcgtacttatgcaataggaaaaacattttgtatcccaaacatggaggcagttgcttgaaggctcacatttcacttgtgaagccttatgactgatatgggagagtgcttattggtttggccttaactttcagctctagttttgggcttcgcagtagtagtacctctccaaggattttatagtgacttaatcttctttaaatcttgctggccttcctgccaattgctctttgatggtatggcattcttgcctttgagctatacctgttcctcttaagtattactgccacagaatttatgaaggtcaactgatgtttaaatctaatttttatcatgttctggaatctggagtaaatgtcaaacaatcaaacagttacgtggctgggtgtgatagggcctctaactctctactatgcacatacattgaggacatagttcaatccttgctagcttgtctcgttaaaaatttatattgtcaaataaaaagggtttctcatatcatctgatcaatcagaaaacaccaatgactgggtaaagtgtgcaagagccaagaggtacaagaggttgtgattggcggttgatctcaagctataccactattagttttaaaagcaagtacaatagcattaccttacttgcataacttaattcaataaaccttatatatgtcccagctgttcagacatcagtattttttttttgtcttgatctgtgctgaaaaattgtaattaattggcgcacactactagactgtttagcgcgttttaaaaaaattctagactgaaggaaatgttgctgaaacctaagcttaatgaagtgccaaagaagagctgaaagagttcatggaaattcatgtaattgactttaaaaaggccacaaatcataagattgcaaccagaaacagtggctcctataggctgagctagctgcaagcctgcaacttaagagccccatcggttggcctaataagccaaagcaaaagccaaaatttgaattttcgaacttgattttaagatattttcaatgtagtttcttttagtgttggattttaagttgctatgaacaaatatataaaagttttacctataaattaatttttatatggcttattagagaatatgggcaaccaatgagacttattgtgctgctacctccctagcagtgacccctagcaaagggcattgctggcttcctgcagcagttgtctgtggtgcaggtgcagctagctcagtggaatcggcctaaattatttatttttaagcgaagctgtagaaaggaacctaaagtacatatgcaatcagaaacaattgttatgcttcagttttgtctttctttataacacaagtaactcatttgatgtttcctttcttcattctgaagatcttaggggttgagaggacagcttcacagcaggaaataaagaaggcttatcacaagttggccttacgtcttcatccagacaagaatcctggagatgaggtaggatcttgtttccaaattttttccatggattaagtgccatttgtctcaattgagctgttatgtgatgtcaggaagccaaggagaaatttcagcagcttcagaaggtgatatctattcttggggatgaggagaaaagggcattatatgatgagactggaattgctgatgatgatgtgagcacctgattccaagtagtgtgatttccaacctttcactcccagtagattttctgaagttttgtcttttcctgtaggcactggttggagaagctgcagacaatcttcaagagtacttcaaagctgtttacaaaaaggtatctttttggtccatatcaacaaaaaaacttgtgctatctgttcacctatacaatgatcggtgatgacctacacttctgcaggttactgaggctgatattgaagaatttgaagctaagtacagagggtcagattctgaaaaaaaggacttgaaggatctatatacaaaatttaaaggcaacatgaacaggtggcttacaaaatttagtgttgattaattttctatacagaaggcaatgaattgcaagtgaataattgggttccatttctattttaatttggtgcccttgtatgcaggcttttttgttcaatgatttgctcagatccaaagcttgattcccatcgctttaaagatataattgatgaggcaattgctgaaggtaaatgattatatgctgttgccatataattttatcatataatattgaatacctttttctattccttttctacaatgaagcgctggcaaagtgtttagcttatcatgctaactcaatctattccctgaaacttctctaatggttaaactcctttccatttccttcccttttgtaggtgagctgaagtcaacaaaagcatatgataaatgggccaagaagatctccgagattgaacctcccacaaacccattagagagaagagtgaagtaagctctcattctcttatctcccaagtaatccgccttccgagatgttgtctaccatcagttgctcactactgcatttgcctcaaacctcgtcacaggaagaacaagaagaagagcgaggagaacgatctgatcctcgcgatctcacagcgcagggcgcagcggaaggaccggttcgactcggtgctctcatccatcatgtccaaatgtgacccaaaggggagcagcagctcggagcccacggaagaggagtttgagcaagctcgtcagaggctcgagaaaaagcgttccaagaaccgcaaatgattcgccttgcagcctcccttgtggcttgtgcaattctgtttcatcgagtttgttaaccaggcctatctttgacagatcagattgtctgatattctgatccctagtatctatgtgagattggctgcttctgttgtggtgcaagttcaggctggaatctgaacttcctgctcttttgctgaaactggggccgatctttagcatcactgcatatgtgtataatcaaaatcttaaatgtttcctggatgtgaacttgtgatctagtttctgtataagttaatccagtagctgtcttgagtttttacgcctgtaaacgatataaacaagaatgcatcatcaacagggacgagaggcgggtttgcaatctcgttttggggttgaattgtgaggcacagcactattttcactaaattctgatgaaatttcaaacggaactattcataaaactgaatggtttgggaagctcgaataaaattcgcatgaacaatcttgataaaaactggttggtttttgcgaaattttctgtgatttcgagataggctagaaatcatatttttgagaaggggggggggggggggtccaatggtatttgaaaattttagggtttaaacagcaaaattcgattgaaatttggcaaacgccttagattacaactccatcgagcaatcacctccactaatcaccaccacccctatcttggcaaacccactaatcaccacccccatttttgg

SEQ ID NO: 52514 - DNA, 2836 bp, Oryza sativa
aggagagagagagtgaaagagagggtgtctctcgtgggagaaggcggcgcggttggtttatttgtgtttttttttaaaaatatatgatctaattcgttggctaatttgattgtttttggtttatattttaaatatacgtgtttgtgaattgtggttgaatatatatatatatatatatatatatatatatatatatatatatatatatatatatatatatatatatatatatatatatatatatatcatgttgcttaatttgttttctgacgttgtacctgctcaaatccacacttgtaagcttgtaaccgttattttatggcaatttaaatatagcatatgaattgatttgttcctttttaattgttttttttgtttaaaatacattcagatcgttatagatttatcgaaaacggtaaacatctttaacacaagtcgttttgtggcatggagaaccatctgccgctcaagcttatagaatggacgcaggagtaggtgggtggatggcatgattcatgtggctggctattgtattagcccaactacattgtttcagttagcttttatgaaactgataaataatattgatattactactccctccgagttgataatatttgtcgttttaaaaatatagtctaagaaacatatttgaccactattttctattataatatatatagaaatatcacaaatatataattttattgaagtacatttttaaaactaatatatacatatagttttcatatttctaagataaatattttataaattatttatagtcaaagatttgaaggtttgactttactctgcttcaaaatgataagtattaccagttcgaatggagtatagtacattgtttctccttaaaaaatctacatcatgttatccgcgtcacattactaaaatcataaagagatgtgacacttcataatactacgaatctagactaagagacggttcagattcgtaatactagaaaatatattcctccagaatcgcttatattatgggacggacgtaacatatagaagttgatttagaatattaaaactcaactaatcaatcacatggtaatgactttttcttttgtttttggtggcttaacttcatctcaaccaaatctaaattcgacctgctatatctgctcatccagttagatctcgaccgtcgaatctgcacgatccacgatatcaaattcgcgatatatatatttttttaaaaaatacaaaattccaagaacacaagttgccaatatgccctgacaaagacaacaaaaaaaagaacagaagaaaaaaaaaattaccaagacaaaattcccctatctattgactaacccaaacccaaagcacataagcatgtgattagcaaaagacgccgtactctctctctcatcaaactgctgacgtacgcacgccgtgagacgccgccgcagcaaaagcttcccttcccccatctccctctcctctcctctcctccccgcctccccccgcctcgataccctgcaagccctagctctctctcgccgccaatggagtcgcaggtgctggtggcgctcgccctctcgctcgtcggcggcctcagcacgtccatcggtatggccccgccccctcgcgcctcttcccctctcaacagtttcgtttcgggggtttggatgctgctctgcctgcggtcgggcgcggtttcctagggttccgcgggtggatttaaggccgttttgtgtagcttgcgggctcgctgcttgaaggaatcgccaagtggctgagcatctcgcaatctcgcgttcctgggaatttctgtgtttctggtgagtttcaggtgtcgatagcgaattctgtcttgctaccgctcgtataggtgacttccatgcgaattcagatgcatcctttattagcaaatcgaaaattagtgtttaggatttttgttaagaaagagagttcagaatccagtgagtatctcccttttgtaccattttggcttgtgagtgatgaatgttttgctatttaggcctctgaatatgaaaattaattgatcacaatgattcatcagatttttttgttttaaggtcagcaatggggtgttgtaatttgtaaataagtggcataactggacaggtttagtggcagggtgtggttttctcttatgtgtactatgtataacaggataagtaataaatgtcgttgcatggtcaaaaacttttaacccctagggttcaacattgtacttccttatgtttggttaacaatttgcgaccgtgaatgatctcaggacattgagcgatgagtactctcttttaaaactgtccctaatactatgtggagggtttccagcaaggcttctttgtgccattttcccactttagaagctccaattttctgtttttcaggtgcgctgtttgtgattttgaatccgacgcctaatcttaagatgcttgggcttctacaggtgataagctttgttctctatagtaatggagcaacttcactatcttttaagcaagttctggttttgctattggttcttggtagattgatctcttgctgttactgaatacagggttttgccgctggacttatgttgagcatttcctttctagatttggcacacaatgcattgaattctattggtttcttgaagggcaacctttgggtcagtcatgctttgcctatacttatagtatccatgccaatgtaatgccgatctatctcatacaataagcagcaaccattgttaactaataataatattttgcagttttttgctggagttcttttctttggtttggttgtcaagtttattccagagccaactgttgtgccaacagctgatgcag

SEQ ID NO: 52515 - DNA, 3418 bp, Oryza sativa
tcctatggaatgtctcaatccatataagttttggaggaatttgaaaatgaggttcaacctcatggaaatttttatttgtctttatctctcctcgaagttcatgcatctttcacgtggtctaaccaaacggtcgttccttatttttcctatgtgttttgtagttctctattttacacttttattcctattaaaatattgtgttttctatttctccattttcctaatcccgtgtttcaaagaagccttaattattgcctgctgaactaacttgatatatctcataatattttcttcctcaatctcttgtttacttcaagagtagacaacaattagctagcagtagatgcctagcatgacaacaagttaaaatatgatgcatgcatgcatgacaacaagtaacagctgtgcatgcaaaaccttttttgtgaagcaggggcagtgcgagtggaagcaagcaaggatatactatgctcatatgctagcataaaaaaagaagcttgagactttgatcgatcgatacggtggtgtgcagtgcatgcatacaggaggacagtacatagctgcaaggactacacagttattagaggaggcggcgatgatgatgatgatagagccgagctgatacattccatcgatcgatcagcagccaagcagcttcctggttcgtcttcttcctcctccctctgcaactttattccattttgcattgctctctatacccctatagtactactagctgatagtactcctgtctgatgtgagtgctcaatggctcatctatgtttgtctatctttcattggatcgaaaaatggacggctgggattagatgagggggaggtaggcaggggtaggaagagtatatatgagagggagagagatgagagatgccattgcatgcagatgcagaacgggacatgaggagagacagatgattgtacaagttggggctgtctggtccctgtcgtcgctaagctttgcgtgtgccctcacactcacgtagtacacaaaaagagagacatgggcctatagcttgcatctggggttaagcctagttttttttttctctctctctgattgggaggatggattatctgattttgtgataacatttaagggtgttcaaacgaatgagttaccattaccaagttgaaatgttgtttaaaagaagtcttctaatgaacatatatatagaaagtttcagcaaaaatcatactatctccttccctatatgtttgaagttggttagttcatttttttagtccattactcttcaagtgtttgggtataatatgcccctgctaatccataattcgtaaggggaaaagaaattaataagaacgggtagtatcaaaataatggaatactcctcttgcaaaatggagaagctcaattatctaattgttttatgatcttatcatgcatctatatatatcttattgaaaaggatggactatttgtttgtgtaatagcaacatttatttttttgcagggtaaatgtggaaaaacgtacgaaaatacatgaaagtttagaacaatttgtgtcgtaggaatttcattgcaatcttcaaaatttaaagacatttcaattcctgccatccaaacggtgcccaaaagctgtaaattaggttagttcattatataatcctcggctacctcctttgtatatatgaaattgaacatccgtacttggctagacaatatatgcattgtagacttgttgctagctactccatttagtctaaatgatagacttactaaggatcttatggccatatgcatgcgtctatactctataccatgatccgttgatacatctcatcttttgttggttgcagccttgtagacgccttttatattattagaccctaattgaggcccaagggtgcagctagttaccatgatcatagttaagagaagccataaacaactaatcaggggataaatattaattctagcataaacatacttggggtgtagttaatggagctcaaactgttcaagtctcctgtcatcagctaaagacacacgaccaacttgtcaaggtgtttgaaaaacttttggttttttactagtacgtgttatcaataataactatggctataatcacatgggatactttgtgccacaaaattaacgaaacaaccagaaaagtcaccggtgtttatcggtgtcataacgtgttggtcatacttacatcatggtgttaattttctacaaattagcagtttatcagggtagctctagggttaattatgtacatattctgaataagagcaagtttaatagtagagctcactacttactattagtcaatgttatattagtcaatgttaaagttaacatgtacagtaggttggctataaggttatctttattttcttcatcctctctctttctctcaccatgaatttaatgcatatttcttagagtttgtgtgcagttagctcttgcatgagagccaacactccccacttttatttatctctcttccacataagcatatagcttgcttatagcctactattatccttgctctaacactagccctgctaggtacaatagtcaatagatccgtccatatatatatatgcttatacgctcaccgttcatggtgagcttgcatgcataacttcatctattctgcgtacactgacatggatatatttcagtagaaatcgtcaggatgtgctagttttgcatgtgtcttcatagaaccaaaaattttgaacactgtttatgtgatagaattttgtcagggaaataaaacttagcaacaaaattaattgcctgaagggggtgtaattcagaattttagggttactttggaccacaggtttttcaaaaacactgtatcaggaaaaatatattttggagcaccctaacactttaaatcatatggattgaaaaaatacaggaaatctgtaaaaacgactgtttacatggagcttaagagagatggaaaaaaaaccttacgttaaaatttctctaaaattcttatgttttgagccgattaagaaaaaacataaaatttttataaggtcattacttttatctcaagaaacatataggaatttttttcataagattgagagcttttaaaattcctttaaaatacttccaaaggagcccttagctagatatagacagatactcatgcaagtaaataaatctctctttcacacaaaaaggatggacccttcttgaccattcccccccaccaaattaagtccactggataaaagccaccaaattgcaaagtttatgctcactttgccaccctcctctcctcctctcttctccaagctttagagagagaaacacacttgttcttcatctacccttctcctctctctctctctcatctggttctagctagtactagctgctgcatcttctactgctgttgggctgcaggaa

SEQ ID NO: 52516 - DNA, 2591 bp, Oryza sativa
ttcctgcagcccctactctgtggcagagcagacgatgatccgcatgtccggatgccgcccacgctgacgcccacgacatgctcggctcatcaccagctcgcgatcgaggcggcggcgacgacgccgaggcctccgagcagccgcagccgcagccgcagccgccattgtcgccgcgcgcggggggcggcgaggcgagggggctcgtgctcgcgtgcgccgacctcgtccaccggggggacctcgacggggcgcgccgcgtcgccgaagccgtgctcgccgccgccgacccacgcggcgaggctggcgaccgcctcgcccaccacttcgcccgcgcgctcctcgctctccgcggaggaggcaagggtggtcatggcggcggcggcggtggcgtggtgccgtcgtcggcggcgtacctggcgtacatcaagatcgcgccgttcctgcggttcgcgcacctgacggcgaaccaggcgatcctggaggcggcggcggcggacgccggcggcgcgcaccggcgcgtgctgcacatcgtcgacctcgacgcggcgcacggcgtgcagtggccgccgctcctgcaggccatcgccgaccgcgccgaccccgccgtcggcccgccgcccgaggtgaggctcaccggcgccggcaccgaccgcgacgtgctcctccgcaccggcgaccgcctccgcgccttctcgagctccctcaacctccccttccgcttccaccccctcatactcccctgcaccgccgagctcgccgccgacccgaccgccgccctggagttgcacccggacgagacgctggccgtcaactgcgtgctgttccttcacaagctcggcggcgacggtgagctcgccgccttcctcaggtgggtcaagtccatgaaccccgccgtggtgaccatcgccgagagagaaggagtcctcggaggtgacgtcgacgacgacaacgtcccggacgagctgccgcggcgggtggcggcggcgatggactactactcgtcggtgttcgacgcgctggaggccacggtgccgccggcgagcgcggaccggctggcggtggagcaggagatcctcagccgggagatcgacgcggcggtggcggcgcccggcgccggcggcggcgggcgcgctcgcgacttcgacgcgtgggcgtccgccgcgcgcgccgcgggcctcgcgccgcgaccgctgagcgcgttcgctgcgtcgcaggcgcggctgctgctgcggctgcactacccgtcggaggggtacaaggccgacgacgacggcggccgcggcgcctgcttcctccggtggcagcagcggccgctcatgtcggtgtcgtcgtggcagccgcagccatagcaatggccaagctcacaagtgatcaaccatggtgttcgacggttcgacctcgagagctccatcaatggcgtctagcttgctctcaagctaaaggtaccccactccatccatcgatcgcattggcaaaaaaaagattggatcttacgaaggatgaactgatcatagtctcagtgcttcatgtatcgatgatctagcattctagctagggatcaagcaatgatcctagctagctaagctaagctacctgccatttttcatggcaactcgagcttggatttgtgatggacacgttgcatgagaaggcgccattgttgggagaagaaaaagaggatcttttgggcattcaacttggtgagccagcttccttctaccactagctctagcaccaaattcttttcattttttttttgcttggcaaatcttgatttttttttcctttagttactcctacttttgtttagctttgatacccaaatctgatattggtggagttgttatagattgttggttttgacactactactactacataatatctagatttctagatctgtgttaattactatgttaaaagggtttgtgcatgcatgcacgctcttgcaaaattaggtcatgttgcatatacaattggtttctttgatctcaaataatgaagatgatctccctattgtggctcaatggattgggctcatttttaaattttatccttgcatttcacttcctctctctgctgtttgatgcgcttgtttgtattataactaatcatgctttggccaccactagctataaactaatgcaatttggttggtctttgttttacttaggggggtaatgaacaatgatcactcttgtgtgctgcgaaaggccagtgcattcttgcacactgtagctagtaattaattactatatttataccactcttgtgtagctaagctagctagtataattctcaaatgtgtgctagctaagctatagctgctgcattaagagaacaaaaaatagtagaatcatgtctcctgctgcctaattaaggagaattttattgtgttcttgtcctgtgtcagtgtgtctatgccccagatatgctgggaagctgtccttgggagagcatggaggaaatggcatgatcccatgcatcaatggcaaccctaattcctgccccctgtcccctctaacaaaatcatgggatttctcaagcccaagtacccccttttggtggcacaccctgcaatccttaaatct

SEQ ID NO: 52517 - DNA, 5690 bp, Oryza sativa
tatgaaagattgagatattttcttttgtcaaaggatttcaaaattggaaaagttgacaccaccctttttacaaaaatcattgatgatgatttctttgtgtgccaaatttatgttgatgacatcatattcggttctactaatgaggtattttgcaagaaatttggtgatatgatgtcgagggaatttgagatgtccatgattggagagttgagcttcttccttggacttcaaatcaagcaactcaaggatgggacgttcgtgagccaaaccaagtacatcaaggatctactcaagaggtttggcttggaggatgcgaagcccatcaagacacctatggcaaccaacgggcatctcgaccttgatgagggaggtaaaccggtagatttaaagctttatcgttctatgattggtagcttgctttaccttaccgcatctaggccggatatcatgtttagtgtttgcacgtgtgcacggtttcaagccgctcctaaagagtgtcacttagtggccgtgaaaaggattctaagatatttaaagtattcctctactattggcttgtggtacccaaaaggtgctaaatttaagcttgctggctattccgattcggattatgccggttgcaaagtggatagaaagagcacatccggtagttgccaaatgcttggtagatcccttgtgtcatggtcatccaagaaacaaaactccgtagccctctccaccgccgaggcggaatatgtttcggcaggtagttgttgtgcccaattgctttggatgaaacaaaccttgttggactatggcatatctttcaccaaaacctcactcctatgtgacaatgatagtgccataaagatagccaataacccagtctaacattctagaaccaagcatattgacatacgccatcacttcttaagagatcatgttgccaagtgtgacatagtcattagccacataagaaccgaggatcaactagccgacatttttaccaagcctcttgatgaaacccgcttttgcaagttgaggaatgagttaaatgtcatagacttctctaatatggcttgagatggtgcaccatggttgcttcttttgcatattgtatatttgctcctatttgttcttatgctttggatttattgtcatttggttcttcattgcgaaatggagcatgtcacattaaggaggagtcttgcactcttgcatgtgttccacttccttttatatgtgagcaaatcaactaaaagtgctagtagtgttttcaaaatgaccaagtcaacataagtcaaaacttctgcaaaatcgatgcattttgaaaactatctcttggaaaatgttttaaaaggttccctatatgttttccaagcctcacattgcaagaaaaatgatttttgaatgaaaatgccattttggccctcttttgaagaaactagattcttagttttggataaaatgagatttatccccaaaatgagattgagaaggaatttgaggaaagtttcaaaacaaagttggtagaggagaagttttgaaatgtttttggtgttcaaacctatttcaaaaaccaaatcattcaaaagttatttgaaaatcaaattcgcccaaaaacccctatagaccataaaaggtcacctcctagcgctcaagtgagttttgttgcaaatcttcataattttcaaatgttatgaatggttggcaatattttaactcacacatttcaaaattgctccaaaaatcaatttttttattgaattttattgtgtgggggtagccgaactgtgcaagggctatgcacagtcggctgggggccaggcggtctgaccggtgctatatgcacggtctgatcggcctgatggcggcggtctgaccggccacttgggcccggtctgaccggccgcacccttgaggtctgaccggccgataatagccggtctgaccggccagggatagtgggcccaggaatctttctttttcttctctcttcttcccctacctgactccatctcctcccattcagctttcttcttccccaactcgaaaaaacacctcctctctcttttcccaaaccctagtcacctccctctaccaaattccctcggtctgaccgtggatttctctccggttacaccgtaagtgattctcctccgcttcctctctctattccatggattggtttgtgtttttgttgaagtttttgatccatggcatggaaccctaggtgaagcacgaggtgttcttcgatttgcaccaatagtgggtagtttcttggtgtgattcaactccttcaaccggtaaatcactctccctcttgcgcattatctcaaatcggtctatttcaatctctagggttttgggtagtttcccccattattccaatcttgatgaaataggccataccctttgatgttcaagttccaaacttgtgcaatattgttctagcaatattttagactcatttgtgtgattgttggaaggatttggttgtgctcctgtcagtggcggtctgatcggcaggcggtctgaccggcaccaaagcggcggtctgaccggcctagggcaggcggtctgaccggctaggggccgtcggtttgactgacttgacgccggcggtctgacagtccctggcccccggtctgaccgcccctgacaggcagcacccccattccttcctcttcactatgtggcttctaaaattgttgcttatccatcctttgctccttgtttttcagctatgcctccccgcactcgccatggtcgtcgtgagcccatgcccaatcccgtcaatgagaatgaggaatcaagcggagatgagtatgttcaaagtgatgatgacaatatggaaaatgttgagggtgatgagatggaagtaagtgatgatggtgatgacaatgggagtggcaatggtgaagatgatgaggcaagtgatgatgggagtcctctcgattccaccatccaatttgtgtttaatttgaggaatgctcaacaatacactatcctccgtcatcatgatcaattccggaggcctaacgattgtaatgatccaagatttcatacccagttccaaaagtccgtgtatgaacaagtgtatgccaacaaagccttcgccgaacacaagtggatttcttggaggcacattggtgagacaccggagtttgaagatttgcaagagatgttctggaccgttgggattgatagaattgtcaccatgaagcaatcttttgatgaagatctcatccggcaattctatgccaccgtatgggtgtccggcgattgtgatgcaatgaagtggatgtcggggacccttcaatgctctatcaaccgccgtgaattcaaggagctcttgcacattcgcttcaacaatggggatgaccttcatgatgagcacacccacaaccccttccccattgatcacttttctcagatttatgaagacgggggaaggcacacatatggaaaggtggcgggttagagggctctcccaagtgtgatcaaccacatagtaagggccaccatcctcccaagatgcggcaacaatgatgacatacgcggagttgcttggcatgtcattgatgccattttggatggtcgtcggtttgatgttatcaaccttatgatgaaggagattgccatctcaaaggggactattggacaaggaatctattatgctccctacataatgaggttgattcaaagcaagttgggacaaattggtcacaatttaaaagaacataaggagtacaagcctcgtctccaactctcctcccctaaagctcctcgtgtgcgccaaccaacatttgatcaaggtgcaagctcaagtgcagccccccctcctcctcatgggtctgatccaagtgcttttttccatccacaatatgcctactttggaatgcaacccaatgaattcttcaacccggtccttggggctattaataccctaagtgaaagcattcaacgcttatccaccgggcatgaagcattgcatgaagatgttcgtggcttgcgcaccgatgttggcaacttgaatacttcggtgggaagattgcatactagggtgggtgtattggattcttgagtccaaaccttggagagtacccaagcttttggctatcatcgtcgccgtgatgcttctcatccttccacttcggcgcgtcctccttctcctccgcaagagtgaagacctttttggtgcttgatgccaaaagggggagaaaagtgtgttttatgttttgtgggttgggactagtagtagtgaggttagtcacctcatatttaataggttaaggaggtttggactatattttgtatgggtatgggctattactctatattgtgtgttctttgtcgttttgttaaactctctatgtcatttggacccttcatggtcttgtaatagcctacatttatttgtgagcactttatgtggtcttgatgtgaacttgtgctatgatggatggttggtgtgacattgatatacttgtgaccatcttatgcattcggttgattcatatgtgaagttcacattataatttgcatatgtgttgtgctatgttgaattgtgaaattgaaatgtgcattggctccatatttgctatttgtgtttgttatccatatgtttagggggagcttttgcttgtcaatgcaatatatgtccatgtgctctatgtttgattatatatatttgtggtgttcgtcatcaattaccaaaaagggggagattgaagcatctaggcccccggtgttaattttggtaattaatgacaagcgctaattgtggactaaccgttgtctttgagctatacattttaagtcaggtccacgttatatgtgcgcatggatgattatcgatggattaaaattgacggcgcaaagcaaagagaaagaagacggtaaaactagtgctttaatttagaattgatcgaggtgtagggcgatcaaaattgctagtttattttctagtttcgcagtactattaagaggggtaattacctagcaaagagatgattgaattaccacattatgtcattgcattttcatttgtgctctctttttcatcacacgcacattcacttgcaaattcactgggttcggcctgaccagggggcggtcataccgcccacttgggccacttggccggtctgaccggcgtgccctggccggactgaccgaccccaagcgggcggtctgaccggcgcataaggccggtctgaccggcggcacttgcccgatcagaccggccccctggaggccgagatgatgctgctcgggatggccgaaacagagccgacggagccgtagtcggtctgaccgagccgaggccggtctgactgcccactcaactccggtctgaccggccaggccgatggggccctctgacagcacttcaacggctagttttctagccattgcagagtagcacggtctgaccggccacatacctccggtcaaacaggcagagcacaaagttgggggatttcgcccccaacagctagttttggcgggtgggagtataaatactcccccaccagcagcaaggggactctcttggcacccaattcaattgcatacatcccttgcacgtctctcacacccacttgagctttgtgttcatccatctagtgtgttaaagggttgattagccaagagtcaagtgcattgcttccatttgtagacctagtgtggcacttgattgatcatct

SEQ ID NO: 52518 - DNA, 772 bp, Oryza sativa
ccagatccccttccctctgccgcggggccgtcgccgtcgagggtcatcgccatcggagtggcggcggggtggccagtccggcatgggctttccggatctagcctcgggcagcaacggcggtggcttgctggcgaggtcagcgcccggtcgccctcctcccgctcccctctctccctccagccgtcgccgtcgccaaccccagactccgccgccccgtgccgcctcacaggtcacctcgccgatgactccgccgccctcggcacccccgcccagcgccgcctcgcgggtcgcctcgccgatgtctggctcgcccttctcctcttcaaggccgccgagctcctcctcgccgtcacgatggcggctggtggagcggatcgacgagcgggcggcgccgtgggagagaggcaagggtaggagggggatttggggggagcggcgaggagacaggagcctgcagtgggtctcctcccagggacgagggttgtgtctctgcgaaaagtggtcgctccttgcaaagacccgcgttcctctgcttggcgccacgttcctagcctgggagacgactcacgctgaaaaggggatgggaggcaaacggccgtttgcgagggcacgggtcgagggtagggatggcaacgggtgcgtacccattgggttcacccaccccatacccacacccattgaaatgaaatacgcccgctccaatacccacacccgctcacgggtgaaaaattcccccatacccacacccgcatgggtgacgggctgcaggaat

SEQ ID NO: 52519 - DNA, 1180 bp, Oryza sativa
ataagtcttgatcaaaccaaatttagagctcttttcgtctaaaacaaatatctttgaagattccatgctctatcttgatgccatccatctacatgtttttacagggtgaaggctacaatgtcggattcggaacctgcactgggaaggttctgcctgcacttccatgatccaacatatagaggatagcctgctttcatctcatcagtgtgtcaataatctctgaagaaagcatgcaatgaggcaatgtatctagctagttacatctatattttagtgcttagtgatggtaaaaatactaataaggtatgcttccctgagctttacagaagggatgtaattaatgttctccagttacaataagaacttatttgaagtcgtcattgtctcagtgattttggcatgcaatgctggatgtgaaaatcgatgtaatgttggtcgcatgatcgaacggttcagaacgttgaggccaaaattttggtttggattttggaggtgagctggtgaaaccactcgtgcatgctgcatgtattgcagggctatgctagtacgtggtagcaagctatctggtaaaagcaaaagtaaaaacacaacaaaatgttttactgggtgcaaatcagggttcgacttaccgtcggtaaccgcgcggttactaggtttaccgcgggtgtatggtaatataaataccgcggtaaccttcttaaattcaaataaatttaaaaaataatttgaatttttgataaattttgcatggtttttcacggttaactgtggttaccgcgcggtaaccccggccccggcggtttgggaaaccctggtgcaaatcaccttttgtacgcacgaatctcatagcaattcctcttgtttgccgattgaagaaagccttgtatggtctcaaacaagcaccgagaacgttgatttgcaaaattcaagatggccatgatgaattaagctagatttagacagagctcatgtgatcattctttgtttgttccttatacggcttatggtatggttatttttatattttgtacgaatcagatcagtttccatccgaatcagaatcagaaaaagaaaaacatatattccaaacaaataagaatcaaacaaaaaaataattgaactgaagagattaaactacgacaactaaacggataacaattaattaattaatcaattaacg

SEQ ID NO: 52520 - DNA, 1348 bp, Oryza sativa
cgacgtgatggtcaccttgtcgatcaccacgttcttgctctcgtatatgttgaggtggaagaacttgctgttcttcagcgttatccccctcactgtcacgttcgtcgagtagtcgatcaccaagctctgcatccatccattgttttaattaattgcccattattagtcatacagagaagcaagaagataacaatacaaattactatcacagcattggttattttgcccatgtcaattaattataaatggactgtgatactcaatagtgtttgctggttaaaagaccagcttaggctatattcagatgtggaggttggaaactccaccttcccaaaggcaaaatggagtgatctattagcatttgattaattaaacgttagctaaaataaactttaaaaatatattaatataatttttttaaaaaaacaactattttatattttttataaaaaaacacaacgtttaacagtttgtaaagcgtgcgcatgaaaaacgagagagtataagatttattcgaaactaattaattcgatgttataggtgttacttttttgtatatacaaatttagctgaatttaaataagtttgaatagaaaaatagaactactttatgatatgaaacggaggaggaggtagctatagagagagacgatgggggtgtgggttgcttacattggggaggatcttgcagttgtagttcttgttgcactggttgtgggtccagacgagggggccctggccgtcgatgatgccgtggccgttgatggcgaagttgtcgacgtgctccacctcgatccagttggtcttgtaggcgttgaggtcgccggtgccgaggaggttgccgtcgaggcggaggatgatgctgctggtgcacggccccttgaggttgagcgcgccggtgaggtagttccccggcgggatcacgatcttctgcgtccccgtcgcgttgcacgcgttcttccacgcctgcagcacgaacgccgtgctgtcgctcgtcccgtcgcccttcgcccccagctgcgcgatgtccagcggccccgccggcaccgacggcgccgcccccgccgcccccggcgtggccggcgtgtacggcgccgccggcgtcgcccccgccgccgcacccgccgctgcagcccccggcgctgccggcgtggccggcgtgtactgcgctgtggcgaacgccacggacaccatcagcgccgccgccgccgccgcgatggcggcggcggtggtggcggatagagacgaggtcgtccttctcgtggaggaaaccatgttgatatcttagtaggtacggcgctgtcgaggaggggcgcgccgccggattatatatacggcgggaggggga

SEQ ID NO: 52521 - DNA, 1644 bp, Oryza sativa
ctgttcgcctgacaaagttagaaaaaagttaaggttagatgacatgagacagcaaactaggaacatcacacgacattcaacaaaaattattagcatttgcatctaagaagccaacctctgcaccagcagccaaatcacacagctctagtagcggtatcttggagaacacctttgtttgaacaacagaaggtttaccgacagtcagcgttccagttttatcaaatatgatagctttaacctgcacataaagaaatacaaggaatagtttagtgtcacaatataaaaaaaatagaatacatttgatgtgagaaaaaataatacatgacatagaaatcatctcagttaccttgtgagctttctcaagtgcattgccacccttaataagaacaccttgagaagcaccttttccagtggcaaccataacagcagtcggggtagccagtccaagagcacacgggcatgcaacaacaagaacagatattccaaactgcagagcaagctcaaagctatccattgcctttggaatccattctcgagggtatatgtcgaattgcccagctacgaaccagccaagccatgtaagaaatgcagccaccacaaccttaaaatgagagggaccaatatgagatgaagaaagagacgatctcacagaaagtatgcatgagaagcatcaaaagtagttaggaaacatttgcaagtatcaatcagggtaacatttctcataagtaaccagctgtttacagaggaggtgaacttggtaaggagtagagttaaaactgctactccactaaattgaatataatttgctctacgattctacagtagaagctggggtaggttcaagaaagtttccagatgaatgctgactaagtctagggtagaaataccaagaaattattagtgcgataactagtgaccagtacaggtaaagtttccagtgcagttgactatgtgtctactgtctaggataaatacctcgattacctgcgtagccagttgttattaaccagtagctaggcaggtagaatatagcaatgttgcaattttgtaaacgctggtgggaaatagcacgaagggaatttgcaggagaaaacaagcgaacctaccgttgggacaaaaaaccgtgaaatcctatctgccaacttctgaactggagcccttgcaagttgagcagcttcaactaactgaactatctgtgacaaagctgtttctgacccaacatgagtgaccttaacaattatacaaccattgtcatttacagtaccaccaataacctgttaaaaacaagtcaattgaaccatcaggatactagttcataacaagagcaaatacaatcaggatccaaaaaataccaaccttgtctcctggtttctttgcaatgggccttgcttcaccagttatcatactttcattcacatgactttggcctttgatgacaacaccatcaacagggactttttccccagggacaatcttaatgacatcatttctctgaagtaactgagtgctgatctccgtttctgaaatggcatttccatctttgtccaaagtaagaagacaagctgtttctggtgcaagttcagtcaacttcgacaaagcatctgatgtctttcctttggccaccacctccagatatttccccag

SEQ ID NO: 52522 - DNA, 845 bp, Oryza sativa
atagcatggtgccagtttggaagcttaacattttccaggaccttgagtcattgactagttctgccatggcatgatgtccacagccactaatcttaaaactcctaattagtgtcctatcatgtggatccattatctaaaaaagtgctatcatgatcattagtccattacatgatcgaatgcaacacaagctgcatgcgacaggaaccgacaactaatgtccaaaccaattaaccatactagccaaacttcaaagatagtataacttacccacgaaaagctatcttgaggagctaatgatcctaaagccttaaatagttaaattgctatctaagagacggctatctatgcccagcgaaggcaaaatttagctcatcattcaagaccattcaacattaatgcatggaagaagctaaaacttttttttttttgctgactctactttgctgcccccatttactcaccttctgctctcgaattcttctcacagtaaaagaacaaaccccccgctactgtcccagcaaaccagaccagccatggcgtacctgaaccaggagcggaggaaggtatcgccggcagagcagaaatgccgcctccggcagccctgccctacagctcacagctacgacgtggagtgagatcgatcagcgaggaagcaggattcaccggctccagggttccggtcactggaggaagaagaagacctctcgcctggcgctggcgcggagacagttagcgtggcgccggtgaggggcaggaggcgccggcggcgagggacaccggaaatggggaccgggaggaggcgaggtgtgcaggctggaacaatggacttcgagcttgggctggat

SEQ ID NO: 52523 - DNA, 1371 bp, Oryza sativa
aggttatggtggtacaaatttggataggatgtctctagatgcttatagatgatgggcaatctcaagaagattcccccatatccctgcccacaaatttggctggccttttctggctcatatttcgtatgtattacctccgtcctaaattagttatcactctaactttttttttatcattcgtcttatttaaaaaaatattataaatataaaaaaagataagttatacttaaagtgcttttgataataaagccaaaaaataaataataatttcgtaattttttgaataagacgaataatcaaaagttacaaacaaaaacttaaagggctggttttgtttgaggcctaaattagacttaccaatatttggcaattccaatagtgtttagtgtctatttggtttgaagccaattttggcatgcctaataaaataggccatttcaatagtgaacttaggctatttttacttcaatccaaacataattttaccttaccaaaattagtcatgccaaaacttaccagaatttggcattgacaaaatttggtaaggcctatttaggccacaaaccaaaccaacccaaagcgacgagtattttgggacgaaggtagtattcaaaacacatatattccgaataaaaatagatggacagcattggacatttggtgttgactttagcactgtgagaaaatgacaactcagaccagggtttcaaaatgcgaacgatagtcgaaaggcatatccctatcaaatttatcagtaaccgtgataattaaacggttgccgacgaacggcggtgaatctatatttattttgagcttggtttaaacttgatttaggcacgttcgtttgagccgttcagctcgcacgcgaaatgagacggggtgattagcaagggtaacaattataatttttaaaatatatactccctccgtcccaaatataagtatttttagttatgaatctggctaaatgtgtgaccagattcatagccaaaagttgttatattttaggatagagataatacattatactatatttatttcacaaaacggtacgttaagttcggttgacttcgtcaatcccaaaggatttatcagcccagtattcgaagatgtttatagaggtagggattacatgcgtgcgttcataggggtgagtgtgcgtgtattgtgagtgtatgtgttgtactatataatttttttttaaaaaaacaccgtttcgagttgctgaaaagaactcggtcttagtcttattgcctgttgggtactgaattactaggatttagcaattttctcgttttccatgagcactcttcctgaagttctagccagtgtattcttttcaagaactttttatataaatgttttctttct

SEQ ID NO: 52524 - DNA, 4588 bp, Oryza sativa
aaaacttcttaaaagtttgactaaggttataaaaaaatagaagcactttatagtactaaattagttttattacatctaatatagaaacaattttctttgttctgttaaaattaatattatatttttcttaaatttagttaaacctaaaaacttttgacttagaaaaaaatgaaaccctttattgtatgaaacggaggttgtactactcaattaatcattcgttaatgatttatttgtttcacgtgtagctaaaaggctacccctccgttgtagaataagtcttgggatgaaaatgttattattttttcctacaaacttagtcaaacttgaagcagagtcaaaacgttttataacccgaaacaaaggcagtagcaattgtgaaagcagggaacaaatgcacttggactctaagagtagataaagttgagaatagttgtattgggttttaataaagtagggtattatggttgttttcctttgagtaagttgggaatccttttcctcgaccttaaaatggagcggtagattagtacgtgaataattaagtattagcttaaaaacttaacaatggattaatataatttataaaattattttttcaatatttttttaagaaaacatgctatcatctagtgttttgtaaaatatgtgcatgaaaaataagagagtagaagttactaagggaaaaaagaaaacactatttcagaatggaggtgcaacaaaaacggggcacagtaagtgatggagctagaaagatttttgagtgcggacaaaactacattataactaattaaatttctataacaatatataagtaatttgttatagaaatttcatcataaatttatttataacaatatagaagtttaatgaaattttcgtcggtgagccgcccggggtagccgagcagtggctccttcctgggtgcggtgcaggaggagtaggaccgcgcgcgtgcgcgggtgtggccgtgtgggggaactgacgatgatcgtgcagttgcagtagcgcgagcgcgagcgcgacgttttcctccggtgttttggtccccgctccgctccgctcgccgcgggcgcccgcccatgccatgagtcccgcggctccagcgaaaagggggagtacccccccgctgtggtttttctgtcgctttgcatgcactgcacgggcagtcgggcacggcgatgtgcgcgccaccaaaaaccccaaaaggcggcgcgcctcccgatgcccaccgcaaagcaaagcagagcagagcatattcggacggatcgatggatccccctgctgcttgctcgctcgctcgctcaccctgctgaccatatgcgtgaatgtgatgaaaaaaagggttcatcccaggaactcgcgctgcaacatgtgaatcttgaggattagagtaataacattagtatagctaactattagccctaaataatctctagtcaacttaataatcaatttatacaatagttacatgttacactattaatacatggtcccacctgtcatacacacactgtatcttagagtccgtgctacagctgttctctctcgtctatcatcttcttaaaatatgtttatagctgatttataacctgctattgtacctgatcttactatttcatctgttctaaaatgtaaacatttttaaaatagacacgtatatgaaaaaagtagatacaaatgattagagaagggttgtgattgataaagaagagaaagtaggtgaagagaacggttgtgattggttgagagaaaatggtaggtaaaaaaatagcttcattttggaacaagtcactgtgctaaaatagctatattttaggacggaggtaatatttggttacgaagaattttagtcaacgtaaatagacaaaaaaatagaaatcagggttaaaaaaggtttgaaaagtttttttcgagaacgcgtaaaaatattgcacatcagtagaagaaatagacttctaggtgaaaaaaacggtttggaaagtctccgcctgtcagaacttttctagaaatggaaatcatcggtcggaattttcttgaaaattatgacctttacagcatttgtgtactttgttaggttatgttatcttcacatgtatggtcgtgtttaaagtatacgaacacatatttgaagtattaaatatagactaataacaaaataaattgcagattccgcctataaactacgagatgaatttattaagcctaactaatccgtcattagtaaatgtttactgtagcattacatcgtcaaatcattacgtaattaggctaaaaagattcgtctcgcaatttacatgcaaactgtacaattgtttttttttccatatttaatattttatgcatgtgtctaaatatttgatgtgacgtaacttttggaagtttaaagggaactaaacgctgtctatgttaatatgtacgtgcagaaactcgaccaaacatttgaacttgtgatcgtgaacacatgtatgtacagcaaaggccaccaaacaatctccatcaacataggcacgagggtttgatttatgtcttctcaaggaaaggccatcaagaactgtcaggctttcatgctgaagtgtcctccacagtttgcaataaacagtatcaaagggatcattttcagcaaacaacttccaagcactagggtcataattcctagtcatactccactgaactatttgctttctttttcccttcacctttatccatggctttataggataggggcaaaaccaacaaagctgaagcaaaagccccaatgtcatatccccatcatatgcaaagctgttggcttaactgatcctgaggccatccacaatgggtgccctcgactagggatagcaacggggacccataacccgcgacccgataggtttttactctattaggagtcaaatgtattccaaatattgcacccatgggtctcttatcgggctaaaacgtcacccatcgggtgggccgggtcctggaacgttctccatccacccgaacccattaacccgtgggttaaaaatacccatatgcctcagcccagaaaatacaagcagcccaaggcccaacaacaaatctaagcatctaagtctaagtgtctaaccctagatataaaaacccatttcctctccctcttactgattcacttctcctccctccccggtactgtgttgctgtaggtggccgccgccacaaaccctagggctatggcgcctctcgcccgcgccagccgcgccgtcgcacgccacgccgcccgcgccgcgctgcagcacgccaccaccgcgctcgccgccgccgcacgcccgcaccgcgccgccgcacgccaccaccgtgctcgccacacggcatcctcgcctgctcgccgccgtacgccaccaccgcacgccgcacgcagtacaggcctgcgccgtcgcgcgtactgcacgcagcatggcggcggtctccggctctggcaatgacgacggccggtgatcttcttccctctttattaactgttgcagctatatctaattgtcaggctctactgctatagcatctactgacccctcgccgtccgaagggacgccatctccattgaccagatgcggtggataaggaagacaacaccggcaaaggagtgccggctactcctttaaccatttttctaccaccttcttccactgaaacagcggaacccctatccggcgtcattgtctctgatccgaaggcaaaggcaaagccaagtgcttctccggctaacgttgttggtgcaggttcgaagcgtcgccccccccccctccaaggctaagaccactgcagctgcggctgtcaagagcagaaagcctccagtttctcctacaactactgcagctgcaggagaccgcaacattctactttcttttgggtaagcaacacaagaactcagatcttaatttaaacttcgcattggcatggttgtaatgtatttttgtgaatatgttgtgagtaaggaatagaagaacctagacatgtatttggggctgagatgctactcattgcatatttttttacatatgtttggcatattaatggatgtttgactagacgtgtaatatgtttgatgtagatttaaaaagatgtccgtagctagtgggagtggaagctatcaacgtcaatctccattatctcaagcatcacaaccaaaatcagagtctcttccactctccacatctccacaacctgaatctatcaatgactcagaacctattgaagttgatggtgacgaagatgaggccgaacaagaaagaattcaagagagtgaagtatataggcacagtcaaagcaaaatgtattcattgcatccaacaagttatcaggatgccacaaagtaatgggacttgcatgcttcatgaccattttaagataggcaaaattggttatatagcattgaaagttcatcgtttttggttttatagctccgaaagtgactggttcactttaagagcatccatagttcaccctgttcccatttttagcacttccgtcaattttttccgtccgtcttgatcgcgagtgatccagccacacacatgatatgacatctacccctcattgacatgcattatacttgtacttgtga

SEQ ID NO: 52525 - DNA, 2929 bp, Oryza sativa
ctgcacccccaaatctcatttaggccacctttggttattggttgtttaggtgacccagccggagctcgtgggaagccaggaagtggttacggttacggtgttggcgtccgtgtggactccccactgggacctttgcgtcttgagtatgctttcaatgataaacaagcaaggcgatttcattttggggttggctacagaaattaaccagagtatcattgtgtttgtcggcgtgatccttcatttgattagctgctgttaggagatagtaccattacttccatttctttgcggtatcaatatgtgaaagccttttgcaaagcaaattttgtctgtcccaattcccttattgtaacatatttgtacatttttttcaatcctccctcttctcatgtagatgttcttgaaactgaggagaaaatgatcccaccaggtaattactcatgacttatggttgggtgaagttccctgggataatttaaacaagttttgtcgttgtcgtaggacaaaattttggatttgtatcaatgtcaccatttgtattgtaatgttagctggagaaatctgagcctctgctattcagcttaaacaaaagctatcataatctgtctgatgacattgcaagttcgctccaaacaaaagctgccactttgagtctgtccaggaccaaagccacgtccgcacgcatgggcctgtattatgtgtcatgagaagttgcagcatgcatcggatttcctcagatctcaagatgaatgaaagcttcccaaaccaataaaaagctggactgaagagcactcacggaatcttccatccatgcaatggggacatgctagcaggtacgcacaatcagtgtctcatcctgtcattttccagctacaagttatccttttatcttaagatatactcaatacaatttcccgagctgaaaatttcaagaaaataattttctctcttgctgtctttggtaattttcattcttcttacagctacaacttacaatgttgataaaagttcaaaagattgtttgccttcaaagaaacatctgtgctgttttgggttcaggacttggttattgctactctgcttcatgccatccatgtgctactgcaaaatgctaccagtgtattagcatctcgatacatgtaatcatgcatatgtccagcatataatggattgacaattcttcaagacctacacctgcacaccattctgtcggcattattttttccatctctagaacttgcagtagcccaggcgcccagctgtccttctgcacactagtagatcagatgactcacctgattaaattagtttgctactgaatttgttcatttggtcccagtttacccctaccttcctgccatagagtttggtttttaatcaaacaagtcatcttgcaatgcattgcctgcatgctgcaggttagtcatcattgcacaggcaaccatcagcaggctgtcccatgctgataatcaaatacccaggagaccaatctttctgggattcatgcatgcatgatatggcctgcagatataagctgacaagccagatgcagccaacgattgacagtgtgtaatcagtctattatgggaggagaccaacctgagcttatcatctccagtttttcagtggaccgatcaatcggcgattttcgcgtttgtgatcatgaggtttcctgcagattaatctcccctggatgcatctggggacaacatggatggatgcttctgctgctcagctgctgtctattcatggtattctctcttgccttcttgcagcggttttcagaggtcactccagtatccttcgttaattcgtaggaactagggaaatcaaatcttagtacaccgtaatgctatgtttccaactaaaagaattggattattgcaccaaatatgggaactaactagctaggagtgcctcatgattactgaaaaacccaagccacattcttacagaacactttataatgtcaataattacacttcattttgcctgcctagctaggtagctagatggcatccaagaaaatcgaattgaaagaaaaaaaatagcaagatgccaaagttgtactactacatgattaatgcaaaacaaggtcacaacaccaacttttccatgattaattcaaaatcaagatgatcacaacaccagcttttccaagccactgttgcacttatctgtccatcagggacagaaagcatcaccctctccacatcaccagtgcacgaaccatgatcttccatagattggcatatcaaaaggcaaaagctagaagccagtagtagtgtaccaccaccaccggtgtgtgtgggtatcttgtagtacttggtgtgagcgtgatatgatgcagcattgcagcttatctagctcagcgtagcctcctagaaaaggaaacgggaaagcagcctctcatccagatcgaagctctcgctatcaatcctgggtatctttgtgtactacgctagctgtggcgtgtgtgttcatgcatcatgtgatataacagtgtagtaccatttgtggtctactcctccttcttactcttactccctctgtccatataaaatcaaaccctcctcttttttactcttactccctctgtcccttataaaatcaaatcctagcatcccaatgtaacattagtggagagtgaaaatgaccaaaatacctcttattattaaaaaaaatagtaatgatgatatgtaggtaaagaatgttgaaggaataaaacttctcattttacttgctgggagtaggtagaatggtagaagttggtttttttttggacaaaattcaaactccagaagttgagtttttttggacggagagagtaaaatataagagattttaaatatatgtaatatatcatagtactatgatcatgtgttcagattcaaagtatgtaatatatcatagtactatgatcatgtgt

SEQ ID NO: 52526 - DNA, 2461 bp, Oryza sativa
atcggtcaagcatgcacagttcagtcacagcgcctttccagtggcgggagctagaaacacttggggctgtttggttgtatatatgctttagtttaccaacttttagagctaaggtgcggtgtggtatgtcataatttgtttggctgaaaaaaactcttagccacatatatagtggtagatcaaaaaagttttagagcatggggaaaaaatattgtatcaagtgtttgcaatgaaaattttgcttctataaattgaaaattaaaacatttaaatttcattgtgcggccacccgaccagcccggtcatcgggtggtggagtggatccacccctggccacatgttaagcaaacctgattgccaaaggtttggtatgaaccaaacacctgataaaagttatttatcggtatttttaaaatgcttttttgctaaagcatagttgtgcaaattttcaaagtgtcatgtcccttcattcgatccaaaatccctcaaaactcgaaagtaagattaacattaggcatagttggaagatttttgaattacccttacctaactcttgtttaatttaagacggacttcattcccccaacacacgttctctcacaattagagaaggacccacaggtgacggtgtctttgtctcgttggaatccctctcctcttcgtccccggtggttgccggtgaaaggattggggggagggggggtccgggggagtgctcaagctcgtcccatagtcgggtaaattatgttacagatcctttgtccccctcccccacctttcttgtaaagattaaaggagatgtcgacttctgtctcctttgtcctggcggtgtcatgccatggatggatctgctagacttggtctcggaagatgccgtctagctagcaaccgtcaggcttagaaccgatgctttggttatcaacatctgtaacatgtagtccttcaaatccacaagcaataaaaggttacgccggccattcttcaattttccaatgagcagacctgcaagggttggcgctcttccctgtggactttggtggtggatctcaaagcgatgattgtggttttcttgtttggccatgaaagcttcaacctccatcatggaggccttgattgggtttgcttcttgactatgccctttgcagtctgccatggtttcatcaccatcaccgtagacactggatggaacaatggaacatcagctcggtggaaggagttgaaggacctgatcacattttacttttctttagaggactttttttacatgtttcaaaatgttctatgaggggccttgtgtactcccaattgtgttttaataaactaccctgaggttgttgcctcagtttattttttaaaaaatcaagttcctatttaattagtatttagggcttagaacgtagaaatttttaagattttcatagaactagtttaatacatgcaaaagaaaaattccaaagaggtcttatagtagtttttaattttgaagtgaaatggttcaattccaacatacaataatttagattttagaagacttcatgcattccaacctttatattttgctaaaatctcgttttcgaaccaataattgagtggatttggtcgaaccaataattaattgtaagacaggtttgtattttgcatgtgccaaaatttgaggtttagtgaatcatgcctgatgatgctgcggtagacgcgtagagatatgagtactttatgtaccacatgtgtattatttggcattggagtaagatttttcacagttcatttgaacatgtgtcgaaggaggaaacctgacgaatatatatatatacattggtgtgtgggactttcatgtaattgagaagttgttaaggttttattcgcaattcctacatattaatttccttgattcaattcaaaacaaaagctaaaagatgtaaccatgcatctctcaattggtgaccacgatctcgatcatcttgaaacattcatgatcggtgactaggatcgatgatcatcgatctgtccctctgctacctagtacgtgctgttactgtatctaaatttatggctctcactattgatctattccatccataccttgaaccctaagtgctgtcagttgggggttgcaaagcttgcgacgacccctacagtaattaattggggaattaattaagctggggagaaagcagcacaggacaatgaatgctgctactatttggcatttcattttcaattaatcaatcaagccgtgtccagttgaacattgagctatactgctagctatgcaaaaacagtgggccctggctgcaggtccattttgttgtgtggcttgtatggtttgactggtgaatatatacagcttaggaatttacaaaactgtacttctggcagataattatttgtcagagaaagtagatatgtgcatgtgagctgttcaagatatataaaaaatgaattttctcacatgtatatatgt

SEQ ID NO: 52527 - DNA, 1059 bp, Oryza sativa
tcttcatgcaccctagctactaccttagctcgcattgatccatccatccatccatccatggaggactacgcccaaaccaacctgatctcgagaggccatggccatcatcatcaacccgagctcatgaaggaattccctttcctcagcctcatttcatctacctcttcttgcatcagcagcagtggtcagcagcagcagcagcagcaagatgatgatggccatggcggccatgatcgtcatcagctgctccggtacggttgctgcagctgcaacaaacagcaggaggaagaggaggaggaggtcacggttgccttgcgcataggcctaccggccgtctcgtcggcgtcggcgtcgccgtcgccggcgatggcgaaccatggggctagtgcttctagtacaggagttgctggagatgatggcggcggcggcgccatggccggcgtgggtgtggaggtggagagcgtgcggaggagcggcggcggtggcggcggcgggcagtactggatcccgacggcggcgcagatcctcgccggcgccacccagttctcctgccccgtctgccgcaagaccttcaacagatacaacaacctccaggtatttatacgtgcaaaaaacacatatatacttaaataatggagtatatgacaagtgtgttttaaattcctactccgatccccatttgatctatatggtcataaaaagatataccaataaatttctagcaattgagcatatttatgagttatgatcagctatcttatgaaactcccaacaatcgatgaagtttatcattagtcattataatgtgtcttagtgaatgtgcatgctcttgcttacgtcgtggtgtgtttgtgtaattaatgcttgtcatagtggagagtgaattttaaactcgagagacgtcccctcgttgcacttaaatagttataaaaaaataagatgatatattaacatgtgatatatcacttcataaatatgtaacttaaaatttaacttgtacgtgtaaaaaaaaattaactgagaatatatgttaactagctataatttaatttgattttt

SEQ ID NO: 52528 - DNA, 2342 bp, Oryza sativa
gggtcgcagtaccggcgaggcgggacggcggcgctgcgcggggcgcagccgacggcgatgctccggctgccgtgctactgctgcgcggcggggtgccgcaaccacatcgaccacccgcgggcgcggccgctcaaggacttccgcaccctgcagacgcactaccgccgccgccacggcgcccgcgacttcgcctgccgccgctgcgccaagcgcttcgccgtccgcggcgactggcgcacccacgagaagaactgcggccgcctctggcgctgcgcctgcggcgcccacttccgacacaagcgctccctcaacgaccacgcacgggccttcggcgccgcccacgcccacgccggcgccggcgccggcgccgaagacgacggccgcgccgccgccgccgccgccggtgtgctgcgatgaccttaatttatatatatgtgagtgcgaaattaattagctgattattggttagtttcaggttatttttttagtagaaaattaatttgtttgtgatcgatcatatatatatgtggaggactctcttaattgtttttttgtttggtttgatttgatttgatgtgtattgcatgcaatttgcagtttgggtgtgagatcttaattatattaattaaacactatatatatacagtgtgcttatggtaaatgcatgggttttgaactgaggttagatttattaattcgaactatgtttgacattgctatgactatagtgattattgcatattgcgaaatattcaaacttagctaattaaagttgagatgctttttttgaagttttagatccacaagaaataatagcattgcgaaattttatttagcttatggtagacatcggtagctagtcgtgcaaactttggaatattggttgtaagtaaacgccggaattaatcaatgaattccattacctcgaatttgcttctctgtaacaattcgttccatttgttatggcttgtatatattcaatagtacttaataactcgcaagacacttgttaaataaaataacaacactagctggttcttggttttgcataatttctagaaaattactgaggagatgtgaaaaagggacttgtagaatgtaccgttatcacgattcatgtctaacaaaataatccactaggccataaaacattttttaatcgaacacaacaaccaagcttaccagcgagggacgtcaatggtaggaacataaaaatccaaatttttttaataagaaaatatcctaaaacccgaagaagttgctccggtcaaactgcccgttgagcgtcgttctgaccacctgatactgttggtttgaccgacggtatgccaccggtgaccagtctaaccgcctccctatcgtctgcctgatctcctattgttgtttcctcttgacttgatgccattggtccaaccaccaagatgccttcggtcacaccgtcgtggtctgactgtcgttcctctactggcctgaccatcataatagagagaacataaatcagaaaaattctttgaatgtagatcaactttattgcttctaattgtgtttataaagtgcaacaaaaacgctcctctctcaactttcgactaaactcaaatctaggttaaaccctaacttttctcatgacaattctctatttatatcctgagatgactgcacaaaagccacaaatccaacatgagtaagtagtcctaatccattcggaaactcacctgtacaagtatccaactcaatatcctttacaaatttaaacttcaaacttttcaaacttggactccattcaaaattaactatgctttccatatgcatacaacacctcttgtatgacatacaaaatcttcatcaccacatgcattgtcctctaggattagtaccccacaagatctcctgatcatctagacaaaacttctctcaagttgactccctatccatcatcggcaatactctcctgagatctcaagacacacttacatatgaataaataagaaaccatattcaagcattagttcttttccaacttgactcaatattatcacacaacagtatatataacatacgtatagaaatcatctggaagccataagcaagaagcaatcattgttaatcaaaaaatcaactccaaaccaactccaaacaggagctagtcaatcaaaccgtctggttggccggtttgaccgccaccatgcctacagtttgaccggtgcctactgtctggtcccatacagagacaaaatcacttcgccaataaatcaccatatatcaaaaccaatacaaataaaatctcatgtcaattgttcatcacaataacaatcaaaacattgattttaccgttttggatgtgt

SEQ ID NO: 52529 - DNA, 706 bp, Oryza sativa
ggcaatatcatgacgaaacactgatgtgtcttgtactaggacaatgcatactgtctgcatagttattgcagaaattctgtgtctcaaatacaaatttcaacttactttagctatattctaatacagccgattttgttcatacatgatttcagatctcattcttgaagcagttttatgattctgttggtaaacctgattatcaagtacttagatcagcttttgttcaggtcagatgcatctctgagtaacttcagctcaatcataagtgtcattgtactatttttgaagctaataggacataattttttccccagaggcactacccaaaccgtcctgattttgatttccacaagtacatggttcgtgctcttgagcatgattttaaagaagtagttggaatcaggttagtatcttggttaaaatactaactttacttgattaaaaactacatcatctttactgtatctaatgctatgcaattacatgcagctggtacctatggcttttcgttattgtcttcctgctactgaatataaatggtaactcccataaacctaaaaacaagtgccctcatgtaattgtttggataactgaattccatcacactgatatctacttaaattttcttttctttcttttttttcttttttttttgctgggagatatccacttaagttaccatacgacttattctatttctagtacc

SEQ ID NO: 52530 - DNA, 1595 bp, Oryza sativa
gccgctgccgccgacgattgatcgcgcgagctgcgccgccgctccgttcgccgtgcgggccgcagcctccgagtccagtgaccgacaagtgggacccacctcccggaaacctatttgggattgacggtttgttgggctgggcccaagagctgacgacaaatggcccaattatagcccaaagcataataagcccattttcgatgcgatcgagcctaaatgagcctagattaggccattagggagcagcacggcttcattagcaatgttgaattaggtcctctttggcatagcccggatccaagatttcttaaagctaaatatttgtaacttcacatgtccatggatttaaatctataattatgttgataacatttgaacaaatcattttgtttccattttttgtgaaatttaatattttaaaccacggtacaaaattcaaatcttttgagctatgccaaacaggaccttacactcagcttcaaccctccgcagcaaaatgaaataattattagtgtatggttaattaagcattagataaaataaacttttaaaaatagattaatatgttttttaaaaaaaaaagttgttttctatatatattttttttaaaaaaaacgtaccgtttagccgcatgaaacgagcgagtagaagttgaaaagatgtggtaaagaacacatccttacgctctttgttcacttcaaactctgtgcacttccacatggaattcaataattcaaacagaatgaaaatttcaccaagattttgccggaggatattgttcaccacacaaaacttattacaaggagttttgagttttcaaagacctcaaatcccagggaatagggtaagctttggcatagaacataagtaccgagtctacaactacagatggaagaaaatgaacttttcacacacaaagatgctctataagaggaggtttgagaatgcacactggcactggcgtctgactagcttttgctatcttcattctgttaactctttcaaggggaatgtgatgtcaaactagctggaagaaacacatctgaatttcatggttccaagcatatcgagtaacatcgcctgtttgttttaaagatcgtatccagtagatggacaatgacaacctctccactgacaacggcaagaatcaaaggactttcggtggtgaagaaaaccccagcctactcagcaaccaatagaagagtatggtccatcccagcagcaacctgtgaaacctctgctccttccagggtatcgatgaggaaaggctcaggctcatccatcgagcttcccaaacctagcctgccgtttcggccagatccccatgcccaaacctctccctttgatgtgagagcaaccgaatgaactcgaccagccgaggccgacactggcctctctccattcagaccgtcgactagtgcaggcacgtcttctttgccaggtcgtccaagctgggagctgcagttccatccccatgagaggacgccggtctcggcatggtcatcgccttcagttgatatgatgcatgttgcaagagagtggccaacacttgctgacacagagaatggactgtggctaatgtcgacaggaagaaa

SEQ ID NO: 52531 - DNA, 4581 bp, Oryza sativa
aaatgccatatatacaagtatgcaacaatgaaccatggcttactaacagtactactgcaagatgtatgagacagaaaattgtccataggaagtgcacacaaaaaagaggttcagtttgtagttaaaagaagtaaagaagactcacagcagagaaccagagaatgatcgagcccacatgacacatcagacacctcaacatgacacacttcatgaacaagcgaaggttcccagatgatgggcatattgtcttcactccttattttttcctcaaccatcttttcaacggcctctagcattgagctagagtacttgtcaactgtttttccaagtaattctttggcagaagaagcctgagtaatatggccaatttctcctaaccttccgttttctgaatatccccagccaagtaaccctccatcctttgtcaatgccatagcatgtccccaaccaaatgatacctagcatcattccttcaattaacaacttttttctcacaagggagcaaacatccgactacttaatttcagggagaaagttagaaccttgacaatatcataattagcaagtgcttccactctagaaggtactgcagcctctacaatgtcctttccaagcccaagttggccacgctttgatctcccccaaacccataaagagccatcacacccaattgctgctgaaacaaccccacaagcagatacagctcggacttgaacattttccaatcctctcactttttcaggcttgctccaagtattcctgtcagtcagcaaaatggtgcatcagcctcccaaaagaagtttattttctcagaattaaaacatttgcaaatatttgttaagtaaccatgtgcaagaaaaaaaaactaattgtttcgagctataggttaactcatgccatcattggcttattgttcattcaaatctagcatggaaaacgaaaacacgattgtttcatacatatattatcagtattggaggtttgaattccaaccaataagaatcagatatacgatataccatgtcctgatttcaatctactcacatatcaaactgaaaccagcaaaggacgcttgtacatctactcacatatcaaactgaaaccagcaaaggacgcatgtgcaaacgccaggtagtgggcaggtaattacacccatcttataccacttcttcatttactccattgttactaaataagcacatatcatggtttctgatttgtttggtccattgttactaaataagcacagatcatggtttctgatttgtttggtctaggaaagccactttgctgctgatctgaggctaaacaatccaccgccgtgccttataatgtctccactccactatagaatacgagaattttcctaccccaaagaggatcaaactgttcgaacgctgggaatacttgtgcgtggatgagaaatcgagaatcgaggatatgagctagatcgatcatcacctcggggcgtggtgcccgcggccgagctgaccttcatcgttgcggccccacgcccagacctccccttcggcggaaaccgcgagggagtggtagtgcccggcggcgacggcggcgacggacgtcgggagggagggcacgggcgtggggacgtagacgtcggcggccggcgccggctgccccgccgcgccgtggctgttgtccccgaaggcgtacacggccccgacgcgcgggagtggcgcgccgttcccggcgagctcggagaggaggcggcggcggaggaagccggaggcggaggcggccgtgcggcggagaggacgcatttggaactcgagagaggaggaggggaatgggtgggtttgtttcatgtggacctcaaaaatgggccttgtgggttgtggcccatgtccaaatcatgtaattttgggccagcctagtaaagcatctctcaggccttcatcactattccaatccaaacggtccacaagattttatatttctatttcttttggaataccagatttttttttctagacaagattattttatgtggtgcaattaaatctcctctagttttcttccggaaaaatttttttcctctttactgtcagggataaacatacttctaagaaacatcttacatagcgtagcatgtggatgacaataatttaaaaacggagaaaataaaatacacgggacactcctagttctaccgcctaataaaagggagatatttaactatttaccacgtttataagtgttaattaaaaatttatcactggaactttgagtgacaaacttttaatcaacaaaagtagtaaatagttatatgcccaacaaaagagagacaagctagcaaatcgatccatgcgaccatgcgtgcaaatcagttggagcacaaatttacatgttacacccacaccctacacccatgcataataatacatcgtatatacgtacgtacatacatacccctctcgatcacacgcaccatcgatcgtacaaagttgcgtacatacatacgtacacacatatacgcatacgcacgtacatacatacataattaaaaactcgtaattaattaaatacgtagttgatggcatctctaatggaacttgaggctggtgaggatgttgttgtggacgggatcagcgaggtgatcaagcaggttctgcacggggccaaccccggtgaagagcgcctggacggagaagccgaggaaggcgagcatggcgagcctgccattcttgatctccttgagcttgagctccttcatctccgcctcgctcttggtcccgaagccgagcgggttgaagagcgggccgccggggtaggccggctcgccggagccggcgaggtacttctcgaggccgaggaagtactgcttccccatggagcccggcgtgtaccagtcctggaagcggcggtgctcggcgaagccgacgagggcgagctcgaagacgaagagagtgtaagggtcggcccagtaggtgtaggtgcccgcgggggggatcacgccggtctggaaccacgggatcgccgtctcggcggggacgaggcccagcttgccgaggagctccggggcgaccatgccgacgacgcccatcatcgccgtccggccgttgaacacctcgccgtaggccagccaccgtggctcgatgaacccaccggtcccctccgggtccgatagccccagcgggtcgaacccgaagtctcccggaagcctgcatccatccatgattccatgcacgcacgatcaatattatggaagccatggcatatttacaaacgagatataatttgtgaataaaaactttagaagcaaaggctgaaaaataaacttcgataaaaaaaacatgaaaattagctctaaatttaagattaaaaatttaaagtttcgctgataaggataagcataaacgaaaagatgaggtccgtagacgataaatcatgcggttatgtgccacaggtcatctttgaccataaaagtaaaggttctctgaaatttactctttatttatttatttatttggaaggtctattgattattgtttcctatgaaaagtttgatcattttgattgtactactgtactatgaaattcagttggatacggctagttcctaccatcttaattaagctcctttttttttttttgaaacgcatgaattttacggttgattcctataaaaattcttcgaaaatcgtttcaaatgaggccttaacgcctcttttattgcaacatgaataaattttaccacatgaaaacttacgtgccatccaggtagctcagggactgcttggatgcgaaccacagctgcctgtcagcaccttgctgaaaccaaaccaaaccaaacataaatttaaccagatcagcataatatctttcaattttgaattgaggaagagtagaaatcaatcagcatatataccttggcagggggagtggcctctgccctgaccatgaagggtgccttcctggaggaagaagacctggagactgaagattgcaatggcctccccagcagctgcctcccagagagaagagcctgagccgccattgttgtctctctccaagctcaagctcctcctcctcttcccaagctagcagtggtgagctgaaatgtgtgctccaaattaaacttggtgagtgctagaaaagggggatgaggggaacacaaggttgcaggggtgctgtgcttgtggccatggaaaaggggtgggcccggggaaatctaattctggtgtgaggtggcatcttagcagatgagggcatcagtggacccagtaggagtgtgccacgtggcaggggggcaggtgagataagggagctgcctctcagtggcttaccagctgccagcacagcatgcagctgaggtttgcatttcctgcatctgtgcatggtgtgttcttggattgttggcatttgctgagatttttttgtttaggctttgtggatagcacagattggtgttgtttctatcctgcatttgtgatggaactagtgccagttattcagccaaaaaaattgacaaaatgatatgacatgagatattaatcaatcttaaaaccaaaaaaagaaaagaaaaaaggaaacaatatatcatggaggggctgcaggaat

SEQ ID NO: 52532 - DNA, 860 bp, Oryza sativa
acaggaagctgaactcagcaacttactaaagaatttattgggttcccatctgctgaggtttctataccaggttgaatcaactcctttagtactcctgtagagaattgtgaaaatggttatatagatctttgggcagtgcacattgtacattcattaatgcagtgctaaaacgagctgagaagtataatgggaaacgcaatggtcatcatttaaagccatgccattttcctgtttagctagatgtaatggttccgtcctgattttcctttcattttttttggggcatgtaacagataatttaaattattagaagtattcttatgcaaaaaaatgtaatttgaaagctattgttcctacagtacagatttacaatctacattacggaaaaagtagtacaagtgaaaacttgaaggggcaaatatttaactaaagcaatcaaactcattatacctctacattgctgctaaagtgatttcatttcacatcaccagatttaggaaagaaaatcgttattggtcaaggataggtaaaacaagatgatactagatactcatgaagaagcatgtatgggatatgtttgtgatcacaccttcaatgtcatagagaattagataattaatcccaatagttgagaaccagcgtaaaagttgcttgaccttcaaagcattctttgcctctctgctatctactacaacacccaagtatgcaagtctctcaagatgtagatttcggtacttgggcaacaacttgaatgaaatgagatagcattctagatcattcttcagatgtgacaatgaaccaaagaagctgatcaccaagtggacaaggcaccacagcaaccctaagatgagctttaaaat

SEQ ID NO: 52533 - DNA, 1028 bp, Oryza sativa
gtaagatctggtcatgtaagtgttctctccctcgggtattaaccaacgcgtaaaatcggaaatcaactttccaacttcacggttgggggctaggatcagagcttatttaaccaaggcgggtcaaaggtccaagagccttatcctccgagaaaatttctccgacaacaaggctgggggctagggagagtgtacgactcaaacggctgactaaagtcgttaactgagaacgcactcttacacacgacattcagagtaagagacatttgttaaagatagatttctttactatttcacacaatacttgttacagtttttacacaaatctttcgctacattacatctttttcctaagatatttgtcacagggtacgaaaactaccaagaaggccaacgctagtccatagactggaagatcttctcggccaatggcgacatcgacctcgctagatggtctatctccgccggagtcctccgagaacaagcaaaaccctcacggagaaattcgaggtccaagctcgggcgatgacctcgtaggcaagccaacacgtgccctccggcgtatcggctcgatcgacgacactcctgcttcaaggcctcgtcgatacgcttgccgatgccatcgagttgggcacaggccccgttcagccacgagatgtacccggccgccgactcctcaggatctccgcggaccactcgaagttctttacagactctggctatggatgtgcagcaactctttaagtacgagttaaaccacacctcacgacctcggagcgtttccacagcctgctctttcttcacggccagcatggttctctcgagttccgccacttcaaacttcatcttccagtattggatatgacgatcttggctagcaagggcaccctcgagatctgcataatgtgataaccactaagtcaagctgtacgcctctttcgagaacatggctgatctagtcgggatggcatcaaggggtgaagggactactaacctgaggaagtcgtcgttatccctgtctccgtatcaag

SEQ ID NO: 52534 - DNA, 770 bp, Oryza sativa
acccctatacgattaggcttatccagatttgtagtactaggtggtgcctaatcatgtactagtatttggggatggagggagtaattagttttctgcagagcctggctgattatgctgggtgttatatgtaattgcctccatcccaaaaagaccttattgtgcatagcaagaaatgaagtctttctgggaaggaggtagtaatacttagaaatcctctattagtgaactgttgattattgaactttgcgatctgaagtgctcttagttgcagtaattttaaatgcttgctcgctcctacaattgtggctgactttgtgttctcttgttcttaaacagttcgctcccaagacgtttattcctgcattgtttggtcatgcttcaaatgacatgttcattcagcctcaccactgtgatcgtattcaccaggcgtatggggtaatgcataatgtagtttgttttattaatgccactcaaaatcaaataaataatacataaatcgctaattgactgttcctggcttcctgctgaagaatacattattatttgtttaaaattaaatcatgtttattgtacagggggataaaagtataataaaatttgagggtgatcacaactccccaagacctcaatcatattatgattcagtttcaatgtgcttctataatactttgcatcctcctcaattgcctgtgaaatgctccaataatctaggtgctttcaaagttggcacggtgaccaatgaggtaaagcttcttaaaatacgttacaaa

SEQ ID NO: 52535 - DNA, 1258 bp, Oryza sativa
tgtgctctattgtaagcctattttcatcatcacaagtttagacagataatacagtatcactcttatcagagaattagtctgtattttcattagcaaaatacttctgcttcagattgcatgactacccctttctttctttctttccttttttttgcagaatacagaatttgtgcaaaattatatgtataggcaaatattatacataaatgttcaaagaatttaatgagtacactctaacatcggtataaaaattaagttttgtaattatggcatttgcattgcaatttcagaagcacaccaaagcaatgcttcaatgcctagtgcacagttcagtatgaaatggaaatggttcttgaagtcatatctcatgaaaactcgtatgttctagatataactgatatgaatatttgtgaatatcatcaacagtgacatagtgcttttaaagtaggtatgaaatggaactagttcttaaaatcatatcacaagaaaacttctacattgagaacacaactgatgtgaaatttgtaaatatcattgtagtggaatagtgttcctaaagtaggtaaacacaaatggagaaaagtgatttcaatgatctgacctgacccttcttggtggtaaggtgacggagtattgtctctggttgcgtcttcccaacagttggttcaccactggtgatggagagaaatagaaagaggtggaagataagaaagatcagaatatcgcatagaaataaaacagtaacaagtgaagcgaatctcaataaatcaggctatggttctcacgttcttctatccagaaagcgaatattgatattattaacctcagcttcagaaacttgtagcctcagaattcctccagaaagaatctcagcatatgaaacctgataccaaatcaaggggctttattgatttatcagtagtaaacaaaataccttgtttttcttgttaaaactgtaaaagtctgatgtgttttgccctacaataatgaatgccagagctcaacttatcgataggttgctaacttcagcattaaccacacatcatatttctaatcctgttaggactaagaatttaacaaataacagaggattaccatggtgtatgcccacctatttgacatcagcaatatatatgcaaatagtgcaggttagacaatctggatagcaacaaatcgactgctgttgttgtatgcatctaaaagtttgtagttacaaagaatgtactgtaaatcaaatgggcaccagaagcctgattac

SEQ ID NO: 52536 - DNA, 6633 bp, Oryza sativa
ccacctaaaccaagcccaaaatgtgcaataatcagttccaaggttagctgacgaagagaaaatggggaacgagcaaataataataataataataataataatcctgacctcaaagacgagacgaatgccgtcacgggtgtcgacggcgacgggcatgcaggagcggaagaggccgctctcgacgacgcggtgcacgtcctcctgcacctcccgcaccgtgagcgccgcgttggggcggcacgcccggagcgccgccgccgcggccgcctccagctcgggccgctccaggggctccccgtccttccccctcaccgccacctcgctgatcagcacccgctcctctccccctccaccccctccgccgtccttctgcctccgcggcagcgcgatgggcgccgccgccgcccccgcccccgtctcggccctcgccacgggtagcctgggcagcgacctggccacgtggcgcaccacgccatcgatggcgcggccgatgcgcgcgaacgggagcgccgcggagagcagcgtcggcgctggcgctggcgccggagccgcgtcggcgcaggggagcttcacaccggaggagacgaagcgcacgtctcggcgcgtccccatggcggcggcggcggcgctggaatcgagctagggtttagggtttccgcggcgacgaggagagggtttcccccgccatgggcgatgcggaggaggaggaggcggcggcggaagagggagaagggaatggtggtgacgtcatccgcgttggcctctcgtcctcctctcggatgatgagggccgccggatcgtctcgaatttcgttctgatggcggatacgtggatctgatccgttggatggtttcggggattacatccaacggcgagtattagaggtagagatgagaagtaccctctcacgctgtcacgccatgatccacgtggggaataaggtcattgtttagttcgtgaaaagaaaatttctgcgtgtcacatcagatgtttgagaagatatcgaaaagggtttttagacacgaatgaaaattttaattttataactcgcctggaaaccgcgagacgaatcttttgtgcctaattaatccgtcattagcagagtgggttactgtagcacttatgactaattaggtacaaaagactcgtctcgtgattttctccccaactgtgcaactagtttttttaatctatatttaatgctccatacatgtgtttaaagattcgatgtgatgtctttagaaaaaaaatttggggaaactaaaccaggcgttaatttgacactaaatcttattttcgtccttaaaccgaaaaaccaaatacaataggttcccaacttacaaaagcagtacaaacaaggtccctcggtagtattgtccccggtttttggctaacgtagcacatacgtggctaatttgactagtcttcgtcccacgtgggattgacgtggcgcttatgtggcaatttgatttggaaaataataaaattcgtgagcccacatatcagctacacaaaaaaaataaataaataatggtgagacctaggtgaatctcacatgtcattctcactcccctcctcttctctctcatctgtccccatcttctcttcatctctcttgaagacctaggtgtcgcacgactggaggacaagcgcggcggcggcaacggtggtcgtggaatcatcgggcagggacacagacgagggcctggcgatgtccgcgtcgaagagcgccagggtccaacgtgggtcacactctgcgcggaccaggcggtggaggtggtcggtggtgagggtcttgggccatcttgtcgacgagaggatggtcgatgacattgggtggcggcggcagaatgggcaagcctgcgagtacaagacatagtctgaactctgaagaccgagtctatgccacgtcatgtgcatgtaccgagtcaaattagtcacgtagacaccacgtaagctaaaaccaccatccaaaccatcgtgggatctatattgcaccggttttaacagttgagggatttgttgtatctggtattgcggttaaagggtgacaatcgaattcgctgtcaagttaagggatctaaagtgaacttattcctccacatcgccgtacgcttccgaaattgcaattttgcaaggtttcggcccaaaaaggaatgaaattctcaaatctcaactgaagcccaatacagatagaagttacggagaattttaggcccaaataatgggatgaagcccatattgtactatcgggattccttcagaatttgggtaccgctctaacttttttggttttgtttttcaggacatggaaaaaaaatcaactgcatttgatttttttaaaaaaattactgcgtttgaattttgaacccatagtggccagcatgatattagaacttgcacggtaccgtttttctttttcttcataaattaaccctttgtccatatcattccattgtccctttctgtctttcatgatgcatgctagcttttggggaaaaatattgaccgtcatagagtactgttttctttttcttcacaaattgcaaagattatacttttctgaaaggaatgcaaagattatacttgctctcaatcttcggtattggtatatagtattttcccaatgtagacattcgcacaaattacaagttaaaacatgtcaaattcaccgtggttgttacggcacgaacgacaaagagccacggcgaattcaaagcttgtgtttggactggtatgtgttgatttgacaaaaagtttttgaacgaatcgtgttggtttgacaataggaaaaatgactgcatgacatatcgacaacgatttgaagcatatttgcgtcaaaagctaggaaaaagtaggaaattcgtttgtgcaaccacagtatcatattctcatgtgaatggttttcctagaacccttcatttttgacacaaatcctcgtaaaattacacggtttgaaatgcctcgaacatggtacatgggaattggttttcctttcacaaaataagagaactttcagatgggatcagtcagggcatccacaatgtgagacactcctagagtgtcctcactaactgaggacactcgtagagaaacttggttcgcaatggagggtgcccctggatgaactccttaaaatctgaagcaacccggtgagggtactacatcccacagtgggtgtcctggcccaaggtagcccagtacaaaaatttcacccatacccctcatcagcccactagcccagcaacctcttcctctcctctttctagcattttctcgtctcctccgcccaccgtctcctcctcttccgatctctccctctctctctcttggtcgaacgaggcgcgaacggcggtggcgaacggcgagcgccgcgcgaggtggaagacggcgacgggcgtgtgcggtggccgacggcgatgggcgtgcggggtgtgaagcatctagacccccggtgttaattttggtaattaatgacaagcgctaattgtggactaaccgttgtctttgagctatacattttaagttaggtccacgtcatatgtgcgcatggatgattatcaatggattaacattgacggcgcaaagcaaagagaaagaagacggtaaaactagtgctttaatttagaattgatcgaggtgtagggcgatcaaaattgctagtttattttctagtttcgccgtactattaagaggggtaatgacctagcaaagagatgattgaattaccacattaggtcattgcattttcatttgtgctctatttttcatcacacgcacattcacttgcaaattcactgggttcggcctgaccagggggcggcaagaccggccacatagtggcggcctgaccggcgtgcccctggccggctgactggccccaagcaggcggtctgaccggcggcacttgtccgatcagaccggccctctggatgccgagatgatgctgctcgggatggccgaaacagagccgacggagccgtagtcggtctgaccgagccgaggccggtctgaccgcccactcaactctggtctgaccggccaggccgatggggccctctgacagcacttcaacggctagttttctagccgttgcagagtagcacggtctgaccggccacatacctccggtcagaccagcaaagcacaaagttgggagatttcgcccccaacagctagttttggcgggtgggagtataaatactcccccaccagcagcaaggggactctcttggcacccaattcaattgcatacatcccttgcacctctctcacacccacttgagctttgtgttcatccatctagtgtgttaaagggttgattagccaagagtcaagtgcattgcttccatttgtagagctagtgtggcacttgattgatcatctccacgccgggtcattgcttgttactcttggaggttgccgcctcctatacggcttgtggaggagttgccctgtgacctttccgagaagattgtagaggaagcccggcgccggtttgtgagtggtttggaattcaccaccttcggagtgaagaaagaactaccctagtgatcgaggcttgggtagtcctctccgtgggccagctcccgccttgcccaccccttgatgaagggggtgtgcggtggcttcgtggttgagcggtggagttgagctcgcctcaacggggagtaggaaaccggcgagtttccgaacctcggtgaaaaatctcgtctccttgtctcatttgatcgtcgcatttacatttgtgcaaatttacttttctagaaacaaactagatatcatatcaccctaggattgctaaacattgacataggagtgtgatttactttcttagagatatagttgagccacaatcaccctaggtttgcaaaacataacttagttgcttagttagagttgaccctcaccaagcctagcgacttaggttagttttgattaggtgtcatttagttttaaatcgcctattcaccacactctagtcgacatctcgatcctacaagttgtatcagagcttggtctctcttgattgggcttcaccgcctagagagaagatgtcgaacgaggtgaaccatgtagggaaggctcccatgtttaatggcacaaactattccacttggaaaattaaaatgtctactcacctcaaagctatgagcttccatatttggagtattgttgatgtaggttttgctatcaccggcaagcccttgacggagattgatcaccgcaacctccaactcaatgcccaagccatgaatgctttgttcaactctttgagccaagaggagtttgatagagtgagcaaccttgagaccgcatatgagatttggaacaagttggcggagatccatgagggcacgagtgagtataaggatgccaagcttcatttcctcaagatccaatatgagacattctccatgttgcctcatgagagtgtgaatgacatgtatggaaggctcaatgtcattgtgaatgatctcaaggggcttgggacaaactacacgatcttgaggttgcccaaaagatgcttagggctctaccggagaagtatgagacccttgtcaccatgctcatcaactccgacatgtcaatgatgacacccgcaagcctcttggggaagatcaacaccaatgacatgtacaagttgaagaagaaggagatggaggaagcctcaccttccaagaagtgcattgctctccaagccgaagttgaagataagggcaagggcaaggtgaatgaagccaatgaggacttggaggaagagattgcccttcttgctagaaggttcaatgatctcttgggaaggagaaaggagagaggaaggggctccaactccaataggagaagaaatagaagacccaacaagactctctccaacttgaggtgctttgagtgtggtgagaagggacactttgcttccaagtgcccttccaaggatgatgatggagacaagtcatgcaagaagaagagtggaggctacaagctcatgaagaagctcaagaaggaaggcaagaagattgaggccttcatcggggaatgggactcaaatgaggagagctccgcctcatccgggtccgaggaagaaggtggtgatgatgcaagctccaaaaagaagaagatggccgttgttgccatcaaggaggctctatcactcttcgctccactttgtctcatggcaaagggctcctctaaggtaacatctcttagtgataatgagagtgatgatgattgtgatgatgtttcctatgatgagcttgtgagtatgtttgaggagctccatgcttatagtgagaaggagattgtcaagttcaaggccctaaagaaggatcatgcttctttggaggtcttgtatgaggagctaaagacttctcatgagagactcaccatttctcatgagaagcttaaggaagctcatgacaacctcctttccactactcaacatggagctctcattgatgttggcatatcttgtgatttgcttgatgatagtgctacttgccatattgctcatgttgcatcatctagcatttctatctcttgtgatgatcttgtggatatgtctagctctagctcttgtatttctatctgtgatgcctcacttgttgttgagaacaatgagcttaaggagcaagt

SEQ ID NO: 52537 - DNA, 1893 bp, Oryza sativa
cctgcagcccctataatgataaaaggtgatggtttgatttgaaccacaattaggtgatgctgtagaggctaatgcagtcaaatctgtctttggtgaccatgcaacatcaggtggtcttgcattgtcctcaacaaaggtatagcccccacactcatgtgcaactaattcatcacaattccttcgtctcccattcacgacaaatggcacaacattcttcagggagcaattggtcatctgcttggggcagctgggtcagtggaagcaatcttcaccgtattagccatccaccatgtatgttgtctacagttactgaccaccaacagtttgagttcaggagttctctgcataacattttatcttcgattttcagggcatcgctccaccgacacttaatctagaaaaaccagacacgctgtttgaaggcgcgttcatgcctctatcttccccaaagaagatgcctatccgagctgccatctcgaattcctttgggtttggtggaaccaacacgtcgctgctgttctcgtgccctccttagttgtttctaacagcaccctgtctgttttgcctgaagagctgtagctgaacatccacagagattttttttttccctgcacaaacaccgggaggcaccatccgcgtgcactgagcagaagctgagatttcagtcattttttcaccctgtgtgcggcatgccccattgttcttgtgtttgctaattttgtgactcggaggagtatctttttttttttgttttcaattttatcttaagttaaatcataaattcatatattgtctcgctggattgtgaattacctcgtacatagagatgatgtatttgtaattttgttttacatgtgaggctgaaaatgcctgagactgattttgcaacaggcagactggatgacagaagtgtttaagggctagattgatgcaaaataaactttttcaaaatttggcaatgacaaaatttttgtaagttaacattatcaaatttcagtagaatagattaaatgtgttattgtcaaaattctgtaggcattaccaacgtttggtaacaaactaaatacatccatatatttgtcattttttttgaaaaaatgatatggttcaaaacgacgtccatcttacttcctccgtttcacaatgtaagtcattctagcatttcccacattatgacttatgttgtgcaacggaggaagtaacaggctataagttgaagttggctatagagcgtgccttgccaaccatacaagactagatcagagtttgttgctggggctcgtttggttaagggcccttttgaaacgcaggataggaaaaacacagaaataggaaaaacgtaggaattgaagtggcgtgttttcctaatcctacaggaatggaaaacacaggaaatatgaagagggtccctttgatagcaccataggaaacaaacaaagcaaaggatagttttcaagaggttgaacctcttgcttattttcctatgaaattgagctatatgaatacaatcctaaggaaaatttcctatactttcctatgaatcaaagggtttcataggaaaaaattcttagaaaattaaatcctccaaaatttctatgcaaatcctccaattgaagggagccctaaaaggaaattttggtttggtttgttgtgtggatgatgatatcttctagaagaatctggacacgtaggctggctggctggatggatggatggatcggatcgccggtgcgtgtggtgccgggcggttggcaacctggcacgtcactcattcgtgctgagccctcacatgtagccgcgatttctctctccaagcatgggagaagaaattgtttttcttttccttctaaaacagttcatgatgacccctttttaaacgaaaaggttttacaa

SEQ ID NO: 52538 - DNA, 2268 bp, Oryza sativa
gcccataggaaaatcctttgtttacaacggctctacatgacactgtgtaaatttatcgaagttaaattaaaattcaaaagtttagagacggttaaattaagcttcataatccttggatagttttgagttttgacaccacaaaaatccacacaaacgttttagataaaccagaaaaaaaaatcctacaagaccatgtctctatttagaccctcgtcatgccttcatcgaaacataaccatgtaggctaactctatttgtggcaccaaatataattaattcttttacggtacaaattatatgtatttacactatagttacatgtaaattttaatacttatattatacttatattatagttagtcttgtaaaaaccaatcaattatgtgctcgaaagagaagataggagagtttcaaaacatacataaaagtgatcacacgggggaaaccaagctgaaatcaaattaaagaatatggtgctatatttttaccgtgactatatccaaaagcatttaaatctattactactccctccatccaaaagttttatacatattctatttgtttagtttttctaaataaaatagacatatttatagactttaagtacataagactgaaatgaagagattgtcttttctttttacaatactagattaaattgttgatcggaacccaagcaacatttttaatgcccattggttacatacatagtatagctcttgatctttgttagagcaaggataatagtgggctatataaaccaactataagctaatgtgaaagaggtaaagaaaaatgatgggtgttggctctaatgcaaaagctagttctacacatgctccaaaatatcacattaaaattatagcgagagaaaaaaataaagtgaaacttatagttaatctattatgcatgatagctctaatatgaactaataaccaatagttagctttacttacaatcccattgtttcgcttattcatatgcttattcgaatcacttatttgcaaatataaatcatttatgagtaaaagttttatttgtgtgttcttaacaattcaaaaccaaatgttgtaaaataaactacgatgagaaaacaaaaagatcaaattcaaaatcaagttctaaaattaaaattttggcttataaccataagtataagcataacctaaacaataagtcccttattaaacttgctcttatatgcatgataactttttttcttagtcttaatgaatggcaatagaaatacttaagttctaaacttttggatggagagagtaagagcttcatcggttgatctaataagctaaagaaaaaaaccaaagtttgaattttcgaacttaattttaaagttgatcttaaaatattttcaacgtaattcctttttagctacaaacaaatatatcaaagtttcacctatgaattaatttgtatttctcaataaaccgtttaaaattattagagaaaatgtggataatcgatgaggctttaggctgcgttcggaacggagcagcgattagcacgtgattaattaagtatttgctaatttttttcaaaaatagattaatatgattttttaagcaactttcgtatagaaattttttgtaaaaaaatataccgtttagtagtttaaaaagggtgcgagtgtgggggcgcagccttaatactttatagagtccatagaaagagacctgatcgtacatggctccttttttttttttggataaatcacgcagctaatttttctttttcttttttaccagtagtaggagtgtaggacacttcatatcgttgtgctagtatccggcgccgcttccgttcatctgcgcctatttattgcggcctcttcttcctcctctcctcgcctcgcctcgctcttccactgttcatctgcgccacgacacgacacgacacgacacgagacgagagaggagtcggcaatggcggaggggtcgcggtcgccgctgaggtcgttcgtggaggtggcgccggggtcgcacttccccatccagaacctccccttcggggtcttccgccgcaggggctcgccggagccggagccgccgcgcccggccgtcgccatcggggacttcgcgctcgacctcgccgccgtctccgacgcgggcctcttccacgggcccctcctctccgcctccccctgcttccgccaggtccgcaccctgcctaccttacctaccttaccttacctactcgtcttgtgttgcggttgatctgctggtggtgagctaagcttagcagcaatttgcg

SEQ ID NO: 52539 - DNA, 1196 bp, Oryza sativa
ttagtaatgcacgatgagtagcgcggcttctgccccccaaattctgatgctgatgagtaattctacctgtagttgtgttgttagtactatgttgtgccaatgtatcatgatgcaagaaagtatcgattaaccgcctatgttcaaaactgaaagtatcgattaaccgcctatgttcaaaactatccaagaattatgagatcctgaggtagacttacacttttttttaatgggttctctaatctttgcagctgatgagccggttttgcgtgacaacgaggccttgaagaagaagtgccttgttcccatggtgagcttgatcaactactcttttctttgttacgagaaacaggatgaccatttatgaaatcactaacttctctgtttttatcatttagagcgacacagagatgcttctgccaatcacggtaggagactacaccgacttcttttgttctgtgcaccatgcaaggaattgtgggttcatcttccgtgggccacagaccccagtcaacccaaattggtaatgtattttcttgaccatgccttgtgctgagacttgagacttgggttttgacataaacactaatctgcaatgtatgtttgcttcatcaggtttcagcttccagtaggttatcatggtcgtgcatcctctgtgattgtatctggaacagacatcattcgacccaagtacgcatcccatagattcggatagttatcaaattcctgtcagattacgagatagttttattactattgtttgaatgattgaatatattagtgttattggatagcgggtagctgtttctagttttacataacctctgaagtctgaagtgtctattttgcttaattattgctctcaatgccctctttcaaataattcactatattcgatgatgtttgctgcattcaactttttgttgcatgcagtgatgtattgtagatggatacatatgtgtagtatattacattttatttttgtcataatatccaattgatatgtcaataatgtcctctttctctgccttttagagggcaaggccatccaacaggagattctcgaccttattttggtccttctaagaagcttgattttgaacttgagatggttagtttcttacaaacctcttgactcacagtatttggtattcttgaactgttattgacatacctgttgcatgtttgttaaatttgag

SEQ ID NO: 52540 - DNA, 6895 bp, Oryza sativa
gcacgttctttgagattgatcgagaggtttagcaacaacaataagacagtggaaggcaactcgatcaaaatggtggcatagggtgggtgtgctgaacaaagcgcctgatcatctcatgcctcctacgaagttcacttcgtgaaatgaagtgaagaagaagaagaagaagaagaagaagaagaagaagaagaagaagaagaagaagaaaggcttcaagctagctggagacctgcagttttgtgcacaacggttggtcatattgggagatggacttttgaaacagatactgctcattccgttttatattataaagcgttttgattttttttaaaatttaaacttttttaagtttgattaaattcgtaaaaaaaatatagtaacaaacctaaagaattttgatttaaaaaatcaaaacaaattgtaatatgagatggatggagagcatatgacatttcttcgccgatctagaaaagaaacaatgccccatctcatcatagggccccgttctcaagaagcactcgcattggcctggccagaattagcatgacatcactattatgtttttgcattgcaccaccattgctgtgtaaagttcactcaactttttgttgttttgacggaggaaaaaaaaaggatattgcaggctgtatgatattctgaaaagcaggtgttatttctgaatttacagtctaacgagttactgttaaattcatatgtttatatatggttacctcatttagcatagccgacatggggtacccacgctagcgttaaggatcatactattgctctattcgcacttcttaaagatatcaaagtctagtcttcatcataatttttctcttgcaccattggagttgaactcctactgatggatagtagttcattcattaatgtgtgttacacattaattgatttccttgcccagaaaaaaactaatatatacactagattttcagttggttttagactgatggggtaaaaagaaattcctagagctgccaggttatattcataagcgcgtatctgaccaatttttattcccgttcaatgatggggatttgaggtaaacaaggttacaaattgacacatgcacatcttcaattgaatttcctgaaaatgttttcgtaaaggttaagatgatgcattgaaaatgagaactgtcatgtgctttgcatgtgtttttaaactatatatgaatgaatgtaccatatctgaatatttgatttagatgacgaaaggtatcgcaaaatcaatatccaggacaccacattagtgccgcttcgtaagggccatcactgtcagttttggaacagtgctaccaataatgttgagaaatctagtaacaccaacaagatttggctattacataaccaaatatcggtagaaaagttcatcgtcaaaacacacacataaactatttttggtcttgctcaggttagcattacacaaatttgtttagttttgttacggaacaaaacaaacacacccttaagcctcaaaccaacaaatgtcattctttccatctaatataactgaagatatgccaaaatttcgacaaaggccatcatttcaaggtgaaagaacaggcttccaagattgttatctggtgccaatcttcatagagtgactgtatttagtactttacttgtcaagcttcatgcattatgcgtttggtatctggaagctcaatcccagggctccaagcagcatttcttctatgaggtttcatggtacgtcaaaatgaactcacataaagactgactgccagcgtcatttccttctctgaggatcccgagtaaggccgtgctttttcaaagttgtgatatagcttcgcatcagaccaaacttgttagaacctaggtggtgcaagtaatcccatgtaaagatccctgtcttgtgcagatcatcaaacaatatcctgcaatacaaatactaggtcatattatagacatactgtattcttgcggaaaatcaaacaagaagtgcatataaaaagccacaaagaattgcttactatttttttttacgaaacaggatcaattgacattatgtgggggaaaacctccacgaatttgataatgcaagaaacatgaccctcaccgtactccgtaatttcctactgattcagctgacattattccaacatgtcgccgcccaaatataacctgatcaaagaaatgcagattggcataatttccaccgtaaaaacttagtagaccgaaattttctagggcaccgaagcgatgccaatattaaagatacagagttaaggtctctgtccggctgctcagctttccaaggctaataatctacaaacgttcaaatttattcataatagaaagtgtagccctttagaaactataaaatgcacgacagctccactgtgaatggatataacgagtgaatgggctgatctgatacaacaagtgaatgagtaaaaatgcaccacattggccatccaacaagctcagaagaccatgtgtgccactgagtacagaaagtgcatggtgcattaccttctcaccagctactgatctgattttgctatcagctgctgggctgtacactctaagaaactcagcaggcagatggaatgagctgccatcctcaaattcaacttctacctgacaaaaaccagtagcacatagctcatgtcaaaagacacacaaacccataccctaatcaacactcatatgaacaattcgagaagaataatggtttaatgataagttgagaaatgagagttgaacattttttctacaaccaattgtctgtttaattgttcctaaaaaaaactaatcatgggatcactacccataacatttcaaaatttaggcatgtaacattagaacacattagaattacatggtacatacgaacaagaggagtacacatattgcacttgaacacaatattacaacctatgctgctcagctaataaaattggttttctcatgagaaattttttacttgcttcaatcatgcctgatggcaacaaagttcttatgcatccttaagcaatcaagtacaaagattgtcatataccctcgtaatctcgttcaccagcaagtcgccgcgacgttgaacaagggattggaacagtgcaactgcttttgggaggggaaggaactcacgaatttgggcgcgcgaagcgcgagcttcgtcagccgcgggggctgcgcctgcgcttgcgccgcgtggagccgccggaccaccgccgcgcccatcgctgcagccatggacggccagccggtgaagcggccggacctagcgggaggaggggcgatgtcgcgaggggcggaggaaggtagggagaggggcggcgacgcggccgcggcgtcgatgcggctacggtggccggcgggcagcggatgcggcggcgaggcgaggcgaggcgaggcgaggggcgcccggagattcgggagggagaggggtagcgatggtgacgtggcgagagaataattggagtattgatttggaattttggattaaaatcataacgggaaacgctacacgagaacttttatttttcttacaaactcttactccctcctttttgttttatatattatattatttgttttgattttttttcatagttaaacatatttagctttgatcaaacttttagaaaaaaaaataacatcatttacaacatagtttcattaaatgtaacatcggatatattttgatactatgtttgtgtgatgaaaatgcagctatgtttttctataaacttagttaaaattttaaaaaattaactagagaaaatttagagcgacttttaatatgaaacggaggggtatcaatgttgatgtgttttcttgggagcaaatctattcgtctagctaaattaaatgattatttaaaaatttgtttcttaaaagttttataaaattttagtagtaataaatcataatcgtgtttattttccttttaaaaaatacactttgatttaacatgtctcgatttaataaataaattgaattttaacatgcttcatgtaaaattttgtttaaattctataggaagtggggacatatttacgcatttcaaaaaaaacattctcaactttagtggtgtaaatcatctctcctctaccaaaattatacatgtgtcatttgtcttttaccatcttttaccttgataaccattgtattatcttgtttttaacatttcatatattttatgtagcattttagatctctatggatttcttttatccttttctcgaatgttgtttttgatgtttgttatagtgttgttttttaaagtgctatcacactaaaatgcgttgttttagcgtcacaactattgtgacactaaaatagaagccattcaaatttcctattatagatatctaagaataataggttatctagtgctagtcatgcatggttacaatggtttacatatattatgttcttacattcatcaattcacaggcacattttaagtgaacttttttttctaccatgttatcatcatcacacggttcttaataaaaaggcaacgataaggcataatgcatagtgaattccaaattgagcgaaggcggtcactttgcgatattgtgccaattccagttttgaacgaccgcatacttgtttcatagctttcaactgagcggtagacccgacacaactgacggataagcggattgagcgcaaaagcgcatccgttttcttgctccttggcttcaagcaatcgattgaatctggattcctttgcttatcctttctggctataatctctcttgttccgttttcgcaatgtgttcgctataaatatcatataactattacgaataaacaacatcaattggtttgccaaaatttaaaagcctccatcaacaaataagcgtagtaatgcataatgtttatatcgtctcaactgactagggaatttggagatgcattgagacgtctatttttcattaatttttagtgaattttgacaaatttcaaataaaaccgttagagatgcacattttaaaatttgaacgtgaaactcgtacgcaattcgtttaggctgtgagaatcgtacctatgcgtaatacttctacaacttgtgtcaacacggttaaacatgcttcaaattaaattatactcaatacacaagtttgaatctgattcgaatataaattaaaaaatatcccacgtgtaaagcacgacaaaacgttttaaacttgccccgacaaattttgttttgttcaagagacaaaaaaaaaaaagaaaaagaaaaagaaaagagaaagctattcccagtttcccaccgattacctcggcttcgttaacgttctcgtttcccacggctattgcctcctccttccctctcctctcctcctctcgtctcgccctcctcctccccacctccacaacccaaccccacccccacccccacctcctcgcggagatccccctcctcgccgcgctccccgccggaatccgcggcgagcggcgagcgtcccgagccccggatcgccgggaaccgcgccggatcccgcgggggctcggccgccgcgagcgagctctccccggcggcgtttccccggcagatccgatccgaggaatcctatcgcgagggcgttggcgctgttgggcggggtggggggaaaaacttctgcagaggaggaggaggaggaattggggggaggccgtggcgacgcctaggtcccttgcgccgtggacgccatgattgagcagttcgtcaatttcgtcatccggccgccccggtacccacattccgtcgcccttgtttgcttgtggtgtgaatttggcatggttggtacattggcatgtggccgtacgtactgttgtgaattgggagatttgcatgattaatgcgagcctcacgtacatgcagcttgggttcctcgattgctagtagattaggtagaatctaggttgttttgagtttatgttttattcgagcaaaggggaaccacgggcattatttattgaaaccagtcattagttcgtacagaaccatggaagcaagatgagcattcaagctactaggatatgctggaagcgccaagttctagctcgaaattcgatacattatgcctccgtaatccatgctagagaaaagaagcaaagaaaccaataatgtgcttgaaagtagcccaaagttactttgacatgtttcagtaaaatttctgtagaaaagatacaaaggaaacaaaaaggtgcttgaaactagcccaaagttacattgtctggtttcagtacaacttttgtcaatgcaatatgctggctctgaagcctccaccctgagcagtttgtgagggaggctgaaccggtcatgctaatcttaccaatgattcatttcaaaagtttgcatgtcaagtgtgagaacgaggatttgtacctaaggatagtcatcttggatatgatggtacattggcccttgattttctttagagcacagtaacctgcttactgttaacagaaacctgataggagtacatgggctcttgatgttgtagatcggtaccatgtgccataaaagctagagttaggtacaatggaatggtcattgcagttggcattgtgtgggtagttgtgcatgtatgggcatgctctataatgcctataacatataccattaagaagtagctttagtgtggcacgataatctagcccatgctcacatgacaaatgtgggcaacctgctgagtggagggataacgagaaaactgttagcagttgaccttcttaggtgtcggattttttcattctggttgcgaatattatggatatgtctttttcaaacttatctttgtttaaggggaggtgttttttgcattgagttttgaattggaacatctgcacatggaaatgttttctcttcactgcatttcaaagctgaaaaatctcataataggtgt

SEQ ID NO: 52541 - DNA, 1365 bp, Oryza sativa
aagtttgactgcaattatggacatctttgttgatagccttattctgcctttaccagcttacgaatgcaagaggccttacaataaaatgcagccactatgttcctgctttcattccagagaatacttctcttccatgtgtgatttactgccatggaaataggtatttaccttgtgtgctcagtgctagcatattagtctgagtcgtgttttctttaacattcagattagtgtattttgatatattaatatgtgctcctaagcctttggaaaccaaattaatattaagttagtagcacacgttatgagctagcatttcctcttaactgatgagattcatctcaagcaatcaccgatatcttttggaatctttaacaggcttttgctttgactcaatgcagtggatgccgggcagatgcaaatgaagctgctgttatactgcttcctgcaaatatcactgtttttacacttgatttttccgggtcaggtctatcaggtggagattatgtaagccttggttggcatgaggtatataatcagtatcacttttgttcttctacatttatatcatggataattacattattctgaaattttctagaaagaggacctaaaatgtgtggtgtcatacctacggaccactaagcaagtttcctgtataggcctttgggggcgatcgatgggtgctgttacaaggtaccttttagtttggatatactgcatgctccttttacttggtggtggagatttatttatttcacttcacgtgacttgattgatatgttacaccaaacagagatcaacattgaacaaaattatctgtacttaagtggcctctgattctcccgttttgctctttgataatgtgctttagaaggtttttaggctttgagttcatgtcatgtataagatgtcttaaatatgtgatctttgcgtaacggatccatcccaattcattcgttgttttgtgaactaatgtaatacagcctactctatggagcagaagattcctcgattgctggaatggtattggatagtgctttcactaacttatatggcttgatgatggagcttgtggatgtctacaaaatccgggttcctaaattcacggtatgcacatattctgtataaagttgcttttgttccataacaaaatgacatggaatgctgcaatattgcattggcataatttgtagggtatcatggcttataatagctatgattctttcttgtttctttttgggaaatcagattgttctattgtggcttaatagctcaatatttgcccatcgaaaccatggttttactattcagcactcagtcacttagctcttagttgcaattgttattttttgagcaattattcaa

SEQ ID NO: 52542 - DNA, 1415 bp, Oryza sativa
  unsure (1)..(1415): unsure at all n locations
gggtagatgttcctctttagggggagctagtgacgactcattccctggcgatattagtgataagcaagaggtaagttgcctctcttacttccctttcagtttagttgtgtgtactaaaaatactatgaaagcaggcacattggatgtgaggtaattatgataaatattttgcatgatatttagattaatactgttatatagcttaagttgattagcttagtgttactaatcgtttatttgggtttctctcaaataagttcaatattttttctcattataaaatctcagatacagtaaatgtgtcttgtagaatatgactgtaaaggctctggcaacaccgctaagacagaaagacagcaaatcgacaaccccaaaaacaaaggagaagaagaagtcactatggaagaagcttaaccgtgagagggcaggggtgggtgatagtctatcgcaacgtttgaagatgtgcctcagtcattcttctcgtcacaagagagtcaaatcatctgggatagtgtaacaacttattagccttgacaaagtccatctcaacgaatcactgacactgatcagttccgtgaacaccgaatcgccttgatttgattctgacttacctgctggcactaccagtgccagattgtaacttgtaacactggtgagtacatactcgattgccatggctcgtgtcaagcttcgcaggagcccatgagattgagcgacacgcccttgtatttgctgtctcctgtaattgcgatctctggctcgctgtttattttccttttaccacttgaatgctgtaaattacaatgctgtagtgcaagagtgcgactccagcttgttggtgagatgaaagggatgtcgtgcgtcgtttttttaactgtgtcctgttcatatttatttaatcattctgctatttaactttactggaagggacggataaattggatcggaggcataacaattgttgagctcttgaaagtttatacccaaaaattgtaaaaactctacccaatttttaaaacattcaacttaaaatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 52543 - DNA, 785 bp, Oryza sativa
  unsure (1)..(785): unsure at all n locations
nnnnnnnnnnnnnnnnnnnnnnnnnnnnnnnnnnnnnngacgcagagaagctcgcctcgtctgccgcatgtcctcaaaacgggaaaagcaaaacccccctttccactgcctcgtcctccctttttccttcccgagctcgaccgctctccctctgtcctcgtctctttgcacgtggaggcagagagccgctgacgccggtgcgccagctcgcggcccccactttgaccgcgccggcccgcgctccgcgttcaaattcgaccgctcgatccaccgaccccgccgcccaacgcatcctcgccgtcgccattttcgggtcgcctacgaaaccgtcgccccaccgccagccgagcgccagctcgtgtgcgatctcccccttgcctataaatcctacccaccgagccccaaatcctccctcaacctcggtcgccgtcgcgcggtcaaccccggagcaccgccgcctccttcgtcgccacggacaagaacgccgcgccgacaccaagccgttccaccccacgtcccctccttccctggtgcgcccgcttcggcgtcgcattcgtccccgtgcgccgccaacggccttcctccccttcccatcctcaaatcgccgccgacgccattcctcgccgattggtgagctccccgtccccttccccttgccgtacgccgtgttgcttcggtctcgttttcactcttctcgccatcgccctgccaccatcgccgccgagcgctccgcgcgccgtcgtcggcccttctctctcgtcgaaccactcgctgtcgccctcccg

SEQ ID NO: 52544 - DNA, 5664 bp, Oryza sativa
ccctctttttccctcccatcgcgtatccacgtcggcaatccggcgagcttcgccaccgtcgccggccgccgtcgcgccccttctttccgatctgatccgtggaaccgattccccgcctcctcctctcgcttccagtgcctgccgcccactccgattcgccgccgttcgccggagcgcgccgagcgccgtcggccgtccgatgagccgcccggcctcctctcccttccctgtccgacgtggcgtccacgtggacgccacctcagccgctgaccccaccagaccaagtcaacccctgcccagtcagccaccccccttctctctccccgttcgtgggcctggcccatcgaccagctccccctcctcggcccattgaaacaaaggaagtccatttttactccctccgccaaacacaatgaccaaaagtctatatatgctccctcccaattcacctctctctcaccatatgttggccccacatgtcaatgagtgataaaagggtattcttgagaatattcatttccataaatgcaataaatcatatctcctgctccataaaacatttcctatattccaaattccataaaatccttcctcttaatccggggatttcaataattcaacccattggtcctgcatgttagtgactgtcaataatactcttgagaatattatttctataaattctataagccatttctcgtactccaaaaaaatccgatagatcatttccttgtccagaaatccaattaagcttccaaaatccatatctcctcaaccgctcgaccgattgactccgttctacttccagtagttccgtaaaattgagatctatttaatgtcactattaattagtctaaataggatctttcttttggtcttttggttaggtttttgattgtttgcgtatagttgcggttaccagattttcatcaagcggatttcttgaagattcgtgaagatcaagaccctgagcaaggcaagccacctttgaacatattgagcctatatttgaacttaattatattgcttgcaaaatattatgcattgataggattgcaattaatatgttgccccgtctgcgaggcagatcggtgggcatacctaacttgttgcatttgatccttccattgttaattgctatatcatgtttccttgtaaccacctggtcgcgcctcggtattcgtgcactctatgcgagtatcgacggtcgccttcaaacttaaaatatgataaacatcttgggtaaaacttggtttacaaaacgattgggaaacccgacgcctgggtcggtgccttgtgaaagaaaatgagctttaaaaataaaactcgcgacacaagaccattcctgggcgggaagcttgtgcggtcgcatttaagggccgattccttcggaattacatccgagcatataatagtacaaccacatgggtggaatgggacacccctggctgagtaattagctaatcaggggagccttgatgccgagagacaagtggattcgccggggtggtgtcggggaggacccctggtcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgccgtgtgggtaaagtgtaccccctctgcagaggttatcaaactgttcgaacagccgtgcccacggtcatgggcagatgtgaggtgattccttagcgtagttttcgttttaccctgctttgtgaaaaggtgttaaggtctgggaaacctgatttttggaaagcaagtggctgtcagggagacagcgggacagggagtccttgaaagtgattggttgtttggagacgacctaactctgaaagtttggaaaattggtttggtttgggaaaccagcttcgaggccaactctgggagttgtgcaaatcttgataaataaatttggtcacttctcacccccctccccgaccaagctgagacttgtctcgctctggttgtggaaagcacacacttagattgttgaaaacttgcaaataaaattgattgaaaaataacagccttcccttgaagcttgcattaaccacctaagttcccatggcttgctgagtacgtaagtactcacccttgctctctatataaatatagttctgccagctctgaagatgaagttgaagcaaagattagggtttcgtcctagttcccagccgtcccctgtggtgttgagtgttagtccgttgtttccgctgctgctgccgttgttggtgttgcctcgtccgtgtcgtcggttgtaatctcgggctgtcctgagttgcaacctaagttaaggtaaataagtcctctatttattctaaggattgcaatgattcatatttgtcactgtgggtaccggcgctatgtcctgggactggtactgagatcgcggtttcgtaggaagcggttcgcgccgtttttcctacgacacgctctaatcaggtgccgctgtacggcggtgccggattggggtgtgacaatattttgttttcaatttttctcctttatttttttcgaatcaaaacatcacgtcaatgccatgtgggatgaggacctagtcaaaaggaaccacgtatgtgccacgtcatccaaaaccggtcacaatattgccgagggacctcttctgcatggttttgtaagttgagggatgtgttgtaaccggttttgaggatgaaaattaggctgggtgacaaattgaggaacctagagtgaacttattccacaaacaccgaagataccttcgttttcactggtatgagttcgctcggtccagcccaattaaaattgtgggctttactccgcgaagatttgctacgcttaatttcgttttggaccccgtgtttcatcacgaaggccagcctatttggagcacagctttagtaaggcaaagtcagtccactttatctccctctaatattggtccaaacttatccgtatcccccaaccgcaacatcagatatcttggctctaactattgaagccggtgcaaaatagcttcccgggtggttttgtgagcgatttccgttgacttggcccgttgaatttgatccaactagctgagtcaacatatgaggggcacgcatggtcagtgtctcatccttctctttcttttctctctctcctccctcatcttcctctctccacatgttctctctgcaaacagccccttgcatctccaaccctcctccatggcagctgatgaggaggatgtggtggtctagccagggagctagcagggccgagacgatgggctcatgtgtggaaggggtcgacaacaggatctggcgccatctccatttgtggccgacgggaaaggaacaacgcatctcatcgggtggtgtcggctagaccaggattaactctctaccgctcccagacctaccgacgagcgtggacaggaagccgtggctatctgcagtgcgcaaagtcagcgcagcgggtatagcgcaggaatgaccagaccaggtgtaactcctggttgctcccacacctgtcgacgagcgccgggaggaaggtaggatgccactttgttcccttgtcgctatctcgctaggtgcctttcaccaggcgcgcatactgatgggtgcggcacggggggggggggaggtggtgccggccgcaagggggaggatctcaagcggcgagaccctccatcgacgatgcggagccgggacgaggagtggcggcttggagcatgctccccatctcccccaatgccttccaccatgccatctttgtctccgccgctggaatcgtcctgctccatgccataactcctcatcgaggcaccgcttgatgcggaaggctttgtgctgtcgccctgcggccaccctctgcacgtgtacccctctgctaccgccaagaaaacatggggggagagagagaggggttatagaaggaaggagagagagagagcaagggaagtgtggctggtgagtcatattttattttttattttgtttgacgactaggatgacacgtggatgtcacatcaacaaataccactatcaattttatcatagagttaaatagtaatggtttcaattgttacgggggtcaagatttctaatattgtggttgagaggtacaagttagattggacccttatttgagggactcaatctagacttatttctaaggaaaatccatccaaaaattttaagctctatctagactgtgctcaaggagatcacatatgggccaacaaggcttcggttggtaccccaaactaagatgtaagcattttccagcgctgcacgccgttaatcccccccccccgcccccgcacgcgctgtagcttgtggatgcctcgtgcctggcataaactgctatcaaagtgacatcatcgatggggcattccggtgacgcacaagtcatgacgcatttgatagtagtaggtactttaactaaaataaataactgatcgtatagtagctaaccgttgaccacagatgacctatactagcccgtcacagatgagtcatctgtgacgggctatagttaatgcccgtcacagataagggtcatctgtgacggacgctagttgtggcccgattgagataggtcatctgtgacgggctatagtttgactggtcgtctgggtcaaagctatcggtgacgggctttacttagggcccgattgagatagaatcatccgtgacggccgtttgcccgattgagatagctcttcacatcagtgacttctagcctgtgacggacgccatgcccgattgagatgaggcttaccgcccgattgagatgagggtatccgttatagtggttgtattaaatgatccatttttctagcttcgcttcgggctactaaattgacaagacaagcctggacataacaaataatcttttgttgactgttgttatgttcttagctttcaaaattaaccaacaagaaagtcagtctccccaacaactgaagcaaagacatacatatagataattaattaaagaggccgatcatgagaattgatacaaattatacaaattaagtaattgatcgatctagtagaccacaacgcttccttagaccgatcgataaatatcaaatccattacaattattactggcttcacgacgacacacaatttcattttattaattactagcttgacgactcaattaatttgaaacaaaggctacggactgcgtcggcctgcacagttcctgcaagattatagaatcatacaatatatatgttgttagtcaccattaattcccacacgtagataattgtctaggaaaataactgttaattaacttgaccaagattatattttgatcagtggtcgatcaccttgaatattgtggtagagacgcatgcatatgatcagtcgtggatatgagcaccgctgataatgcaaatggcgtagatgatgcccggaagatagccgaggcaggtgaggaaaaggcagatccagaactccttctgtacgtacatgtatgtaacacgccgaatcaggtcaggacccatcacaatacacatcatcagatcatgcagctacgtctatatatatgcatgcatgtgtgcatatatatgcacatcttgatca

SEQ ID NO: 52545 - DNA, 7393 bp, Oryza sativa
caggtgcagctcgttaataatcaggggccgttaatcgcctctctaagctactatagccccccttagcttgccgatcacacgctggcacaggtgatacgtacgcgaaggcggcacaagcaggagtgatatgactgcttctactgtgtgctgccaacgccgatgacttgagttgtatcatcagcgcctagccatacatatacagcagagtcaatcgccagtcgtcaacgatttcttgttaagttaaacccaggccaatcatgtttcgattatgatctaacataatccggcggcgtcgtccacagttttctcgttggtctgaagctaggagtagactgcacatgtactgacaaccgttactctccttggctactgtaccaggactcaaacatgccgtgtcctgctgccatctgctttctcggctttcgtgtgtacgcaggtatctctgtcgtgtgtttaacgtatagcgggttggtttctctcttttttttttcttttttttctaggatcagacctatcaacgtgtaccaacgccacaaagcaagtccaaccgtcaatccaaattagacacttcaaacacccgtatagccaagtttctaacggatttagcaagttaaacttgttactcactctaatggcctctctattaaccttctccaaaataacaactggacctgtatatcagcctctactccccttctacttcctcccactccattatccaagaaaccaacatcaagaggagctagcacgatggcagcatcgtgcaagggccaaaagtggggatagcggcgcaaagaggagccggagatggtgggactttggttggcggcgaaagtaaatggagatggcactgtggtggcctttggaatcggtgctaaggattggtgtcggagagagagagaggcagcggaaattggcggcacgggcaagggctaggagacaatggcgaggcgcaacggcggatggtggcaacacttatcgatttgtttttcgaaagcggatcggatggcgtctgaggcgaatgccgcaaccgtggtggatggtgcatctccaaacgacgactcgggagagagactgtggggacaggagagagatagggagatacagacatggagcgatgaagccaaggccagcaacggcgaggcacaccttcttcctgagcttcggagcagtagaggagggtgccgaccgacggcggtgagggcaagttagggtggtcgtggggtcaagaaggtcgggcaccctgtcatcggccatggcgacaggtagagaaaagagatggagatgcgaaagtgagagagtggagaatggcgatgagagagatggtagcagctgaccaaatttggttaagttgagcgcatgtttggcgagtaatatggtcagtatgattgagtgtattttttatccatagttgctaaagttttttttgcttagagagtgaaataaagagactattggtgacgctttaaattaacacatgatatatagtaccaattcagctaccacatgatctgcttttacgaagggggtgtaactcaaatggataggtttctagctcgttgtgaaacctaaattcatgggctcgtatttgattaattatttttcagtggtaaacgatgtaccagtaaacaaacgtagctcgtacattgtacatatatatttattggtactctacaatacaaccaaagaggcaatgaggaatgttggcagcgagtcagcgactggccaggcgtagcaatcagcagatcagagcaaagtcaacgtaactcaaaattactactaagatcctactccagtatatatgtgaagatgtcaatatacagctggtacccgttttctgacgatgtacgagagataagaaagtcgaaacccagctacgtcgtcggtactaattagcgcgtggggcaacgtgaaagtcaccggcgccacgtgaattcacatttgttcgttgccaccggcaattttttaaggaagccatcccactttattaatctgcaaacatatagttacatcattcgctagaacgttgagaaaaatatagagaccccatcgacccaactataaaaatttttcaacttagaaacatgattagctagaacatgtgccatgcaattaacttccctattacaatactcaatcaatggagactttaacataatcacataaaaaaagtatggtatttatagaaaaccaacgccgacgttgttcttgaaaaacttccatcttgcatcgttgccaccaccattactgtatcagcaacataaggtaagtatttgcaacaaccagctacaaaatttccatgtgcatctcatatgatcgactactccggttcctcctatactagtggtggatctagaaaattaattcgttaatgtcatagcatgcaaattatatttagactatagtgttataacatatggataaacagtttaaccataagttttaccgaaagtcgtcagtgtcgcttgacatcgacgctaacactttagatccgcccttgttatgtactcaagacgatgtcaaagtaaacatctacatttaccttgaggatttctttaggaggtttatgctatcctttccatgattttgcatctgtttttttcttcgtcatcctataatttagtgtaagagcaataataaatatagctgatctagcagccacctgaatccttttaccgttcaccacttgcttctttcccaccaaagaaatcatccccgataaaaccagttcagcaaaacccacttcataattatttctttgccgccggctttgctttgcgttggcttttgatagcttgtactattattcttcgtacgcttcccggcccaaaatcccgcacaactacacccagcagcacggcccagtggcccacccatattgatgggccggtagtaagccccatccaaacaagttgtgggccctcatgtcctacgggcctcgcggacccggcccggcggctggtctaccctccacgccgccggcctgtccgcctacgccgctctcatctccctcttctctctcctcctcccggtgcgctccgtactaaccatccatgtctccgtcgtcttcaccgccgcctgtgctggcctcctccatatgtccacggtctccaggtgcacgcctgcgccggcaaggtcgtcgtgcggcctggggatgtgttcgtgacacgccggccgatgtggctggcgtgtgtatacgccaagtgcggacacatggtggccatgacgaaggcgttcgacgaaatgccgcaccggggcgtgccgtcctggaacgcgctcatcgtggggctacgcaaggaacggaaggtttcctcaaggctcaaagggtgtttcatggagttgcggcgcagggacaggaagtgccgctaatcggtcaggtgatagtgccaagtgcactgagcgcaggtccgtacttatattacatcatctaattataaggtggaactgtaggtgtgtgcgctgtgcctgagcaacacgaacgcccttcttgatatgcatacaaaatgctgctgctaagcgcttcaaggaagcctgtgttgagtttcttgagttgaggcccatggttcaggggtggcgtggcgttttgcctgatgatatatcatttgcctacttcattgcaagattcagcatgcctagcatcatatattctggatgaacttgtcagagtataggatgctaggtttatgaggcctgagagatgctgatgaacttttcaggtaggaaagctcgataggtggttaagactgaaaagtgagaactttagagaacagagaagagagaggttaaacgtccttgcaaaaattaagcatcttcttcagactgaggaatacagaggtgaatatccttgctaaggaatctgtaggagatatgctagcacgagcagaacatatgctgtgctctgcctaatttctttactgatttatgcagacatgctgatcagctgatgtacaccagatcaggatgatggacaaggagagcatccttcacaacacgaagtcgttatttggagattaatctgacagccgtgtgggttgggcctaaaaaggctcacctgcagcattccagggctgattataaagtttcttctttgatcttgtaggtttggcagaaattgtgtttttgtgaattgaagtgtgacatccattgctagactaatgtcactaaaaatttgtgttttcaggctttcaacattcagtagtggaatcgtagcaatttgctgaatcatcatcaagcgagaaaaagcaatctcttgggataggcttggagaaaactgacaattatatatcctaaggcaatatcaaaaagatctaccataatatttctggtacttttcttttatggaatgaattcagttagttatctttgattcatgcctagatttctcatactaaagttttctaaataatactttacctttgaaatgatggtagttctgtgtattatctttttagagaacatgaagaataagatattgataccaaaatatttcttccatacgtttaaattttttttaaagaacatgaagaatattggattcagatttttgcaattctaataaaaattttattaagtgctcatagaacataaaaattgcatttttagctgcgggatgggaggaatatgttaaaggccacaaaatttgattccactgaggtaaaatggaacctttgtgttatcaacttctctactctctttaacgaatacatgatatttacaaaccagttaaagaagtagaggaaaaataataatcagttctgctatacggtaggtagctgataatgctacacttctttactataatgtacactgctagtaagtataatctcagcttcagcaaaaatctttttcaactaacctacatataataagggccctccctccaatgggaaaaaaaaaagaagaaacaaagagaaattcaaatgcaactgttttagcatttatccatccttgcaatcctgagcttctttacgctgctcaggaagagtctgtaaaaacaataaaaaaatgagtaataagttaaatcagaagtagaatgaaacgcaaatggatcagttaaatatgttaggatacgtactcccatgggacgtccccaaccatcatccagtccccgtcctggtcttcataggtgaggacatgggcagccttctggccaggaacttgttgatggcactccataacatcagcatctaatcatatcaaacatatatgattatatacaacacccgacaaccatcgccatgtgtatatcatgacgaggtgagattggaccacatgaaaattgaattaatatctatcgatcgatttcgactcgacgtgccaaacaagaactcttgaaacaaaagctttcagactcatccgttggtggcctgtcaaattgctctagcaaaatggtactagttgctaatactactcgctgccgcgcgcgctcaagaaatacaattttggatgatatattgtattgttctccaatgctgaactgttcattcatatttactaaactaattctctctttctcatgttttatacaatcttctaacccttcgaaattgtagtgaaatgcagattaattggttggttgcatacttacaggtgatgggcgtcttgaacatgtggcagagcttgatgaggaggctgtcatacccatccagcaagagcaggtcgagcttccggccgatcgggacgccctccatgtacaccttcacgaacagcgttcgccgtcggcgagcgccgccgccgccagcggccgacgccttctgcaaggcgctcctgaggaacggcttgatcggcggccaatcggcgtgcacttggctgttcctgcatacgccgcgatcaccgggcgcccattcatgttgaaaggtctgttaattaatcaactaattgatggagatgatgggtacaagcgacccaattggccaatgggatggagtactgttgcgcaattaattttcgggtgcactgtatctccaagaaacagtaatggcaacaggaatcttgaagtggttttgtagagacaggaataatcgaattggtctacaagtttggctcatgtgagaaatctgactgtagctgttgatgtgtgtatttgtactgatgatgatcaagtcccttatcagaaataaaagcgtacgatgggtcattgacatatcaacagattggtgcgtgtgatagaacggtttgtctcattgtctgatctaattaaactgcagtgaacttgaagcatttctcttattttcttttatgtagattacaagttttggtttgtactatagtagtctaggtaaatatgcagctatgcactgtcgaaatgatcgatgcaagtgatcaagatctacttatgtgaagggataggagaaagcgcatagtaagatctgaaagatttacatatgcatgtgggaacagtttgatcaaatcaatcgtgtgtttcacaacaggtaaaaactcagataaagtttttttttcccttaaacttaaaaaacttacataagccccatcagactacatatacatgagaagcatgcacgatggattcgtataaagaaacggagatttttccctaaaacaaaacaagatcgatagatagaagaacatagaacatcaaaaactagtataattacatatcggagtatgtatatatgttcgaatatattttaaatgaagaacaaagctatatgtgtttcaatattgaatcgaaagaagaaacgaaacaaaacttatcaaactaaacagcatgaatctttgtagctagggagaggtaattaatcaaaaagcaggcttcgcggcaagaaactaagaaagaaagaaatctaataaccttggagtagaagggatgctatcatcagcagcggcggcggcggcggcggcctgcaggagggaggacgacgacgacgtcgagaggctaagccctagccggagatcggtgctgaggtcccgcctcgccgtcgccgccgacgacgtcgtggacagcgccgggtgggtgctgctatccatggaggaggacggcgacatgccaccgcccttgcactcctccatagctacgaatgcttacgtagaaattaatggagagatcgagagagagagagagatggatcgagttgagaaaaaaacaagcaaggaaagagagcagctagcttgtgatgtgtatatatagctggaggtgagcactagctagaaaaagccaaactatgctgaactaaaaatttgtgcgcatggtagagagagagaggattaattaaagctaaagagggaggcattaatcaatctgattagatagattaattaagtagttaaaagaacggtggaacaatttggcttgctttatgcaagcgtttttgttctcaattaaaaataggctgattctttcctgtgcttgatatctaggtggacacaactggtt

SEQ ID NO: 52546 - DNA, 5974 bp, Oryza sativa
aatttacaaattttgagaaaatgaaatttaacaaatccttaaattattatgtattcctatatatcaatctactctattttttggaatataattgaaggggccaatctctctttttcgattactgtgctaatttcatattttcacgataaattgggtgctttgtttaccatgtctgaagtataataataaatattttatataatattatgtctctatctctaaaagtataatagtatttcctatacatatagctatcaatctacacagttataacttagtccatctttctttcttttttctctcctgctaaagtagtaatttgagaacttagagtgaatgggatgtgtacttctaataagcttctctacaatgtaatagatgattaggtaaaaaaaatgtgatgatatcttcttaaggaggtacaacttgttttgatgttcagttggtttcaacaataatgtgacttagatcgttaaggataaacattgcatggttcacgatcgagcactgttttcatgcagtgatgggaattggagagtatagtattaaacattattctgcgtatcaagtccagaaataatgatgcaagatatcacttgggagaattaaggccctgttcagttcccaaaacaaaaattttcacgttgtcacatcgaatgtttgaacacatgcatggagtattaaatgtagaaaaaaaactaattacacagattgtgtgtaaattgcgagacgaatcttttaagcctaattgcgaaatgatttgacaatgtggtgctacagtaaacatttgctaatgataaattaattaggctaaataaattcatctcacagtttcctggtggaatctgtaatttgttttgttattagactacgtttaatactttaaatgtgtgtccgtaaatccgatgtgataaccaaacaaaaaaaatttcccaactaaacaaggcctaacaagcgctctaagcttattcaaacaataagagtcaaagactacttttattgattgcatggtagatgcgtagacggaccactatatactacatgtgtgcccacgcatggcaaagagtactactagaaaaatgattttttatggctaaacgctccgcctgctatttagggcatactgttgatatttgatatggtcacggataaatccgtaagcgcatatatacgtttgtagcatttcacccagagtgtttcatgagtatagtatttgtttttccctgcagggaagacgacagtgtaaaaaataagttgatatattcgtaatcacgctatatttaatatataatagtctatcagggttaaataataataataataataataataataataataataataataataataataataataataataataataataataataataataataataataataataattgggtagtgtgatacacagaagaatcatctcaataaatctactatctagtgaagagagacaaaggagatagctatggttctatgtatctaggcactaccaagagaccactccatattggtcggccagcgtggttataccactttatgaactcttatgtcatacccaaatgtgtggaatacaaaggacaaattaacatggttgtcaccaccacctctcgcctaccttactttctgtggtgcatggcatttaatcaatctacgcaccatgcttacattgctaaataatgtcactaattcctctgggactctcactttttgaatggacaaaagttagaactagtgcaatccactaagatcattggaccgacgccatagcatatatcaactagcctaaacgtgcatagtttatgaaagaggtataaactactgaccatatatatgataaagcagtatatgaaatacgaacacaattaaataaaaaagataattctattattgagttcatagtcttacaataggaataggagtataatactaaagacatacccaaatcttcgagaagtctaggaaaccgaagaactattctaagcctaaactccactaaactagagagtaatacaaatgtagaatagacaggttgcttcttaagtgtgtgttgtgaactgaagaggtgatctcctttttatagcctacttatgacagttgattaggtcgataactcccacaactgtcattaggaggtaattagtgatgtccacatggaaggtggagatgagaggcagcgatggcggttcaaccaaaccagggttcagtcacccctgggctccacctctctccaccgcctttctctagaggttgccatgtgggcccctaaggtggtgcattgcagatgtctgacttgtgtgccctttaatccgtgtgctctcacatgattcgctggaggtgtgttcctttgcatgccgatttatttctctttcacttttattgtataatccctacatccatagtatttctccaaaacaagtggaactaaattatttgtaattaaaatacgtataagaaaagttagttctccttttatttgttaaggtaattggaaatcggcacttaatgtctttcaacacctgcaaagcggacaaggagaaccttcacccgtctgtgaaaattgaattttgcaagctaccaccctaaaagccccgtatgtgaaaaatatgatttttcacaggcggaacagttaagtggcccaaatgcaaaagcaatttctggcataaaagaatgtagatccaaatatcctctaattaacataattcactatgcaattccaccatcacaaattcaaaataggtttgtctaaatcacaaaatttcagcaaaggacatcgtcattggcatcccagcgttggagttgtaccctctgcagtgtctttggtcagcgtcttggggaagaagttaaagcaacgcaacgcctcagcaaggatggccttgacgacgaggacggctgagagcttcccacagcgatgaggatggtcgcgacaacaagggagagcttctcgaggcccggcagcggatgatccatgctcatgaggcccaacggcgacggatccaccgctcccgaggcccgcggcgccggcagacccgcacgcttgatgcctgatctgcactctcgaggccggtgacggtagatccagcatgcttgaggcccagcggtggtgaatgcaccacgccgttgccatcatggtatcggttgtggttgttattgccgttgccatcacggtggagatcctttagtctcctaggggcccgctagttgcgggcgtggtcgacaatggtggcgatgggtgggagtggaggaggaagtctgggtgcgatgatgagagagaacggaggaggaattagaccgaggagagggaggtgttagggcaggagatgaggatgtaggagagcctgctcacttgggagatggagtagagagagccgagggaagagagatggaggacttagccatggttggctcttgttctgaatttaatagcacgcttatatttgcagttgggcctctttagtcctgactgcgaaaatcaatttttacacgtgaggtctaaagtgctctgcctgcaaaaataaaaacaatgttttgggaaaaaatcgttttttatagttagtgtggctcttttaacacacgtttaaagaaatggaggtcagggcaaatcccaagccttactaaatatctattaacattacactgaaatatgccatgtgtgtaatcgtaggtaccaacatgatttgaatcctaagccaatgggtagactcatatatatatacacttacaactctaccctcacatctctgatgcttccagagaaaaaggctatttagccacacgttccgttgcattcacacattttatccacacaatctcctctgaaaatggacactcgtatacctgtatcctgaaaggatccccgcccccaaaagctgagggctcacagataaggtcaccaaccaaagcaatcctcacatcaaaatcaaagtacatatatacacgcgactcacgaaagctccacccatgaatctgtcaatgatcaagttcaattaagtgggctaaataatcaggtgtcttggtttagatatatattgttttgctgcgggttgtatgaatgactagtatatgttaattaatataagaacgacgagggttaaaatattatgaaaatgatgtgaggaagatcatttgacatacttatatgttgaattttatgttataatattgtagataatgtgccttttgtttgtatgagatttaatatgctttaaaatagtaattactaatagacgatgatgtaacatattaatgggtaccaactatataagtatattaatggggttagctttagggtgtttttgataggaggggaaaagagaaatggagaagatgcgtaaatcgagatgaactattagcatctgactaattaagtattgattattttgattttaaaaatagatcaatatgattttctataagcaattttcctactacgtacatgattttttttcaaaaaaaaacataccatttaccaccaggagaaacgtgcgtgcagaaaacaagcgaatttttcttccaatccgctactgcaatgcagccttagttaagccgaatggaggtggaacgttataccgggccacgaatttggccgtgggcatgtgacaacaaccctagcttagaatctgttctgttccctatagctcgtcgtcgactggtcgtgtctgtcctgtactatttggttaccagcagcactagtgctgtagtgcgcgtacggcctgtggagtgtgggatcgtgcacatctcgtggaatatgttctctctatatatactgagtgaggtcccctagaagcatctaacaagcaagaatggaaaggctagaattaagacttatttcaatccctctctggctgtgtttagtttctaaaattggggaaaagtttggaaaaaattggtagtttggaaaaaaaagttagaaatttatgtgtgtaggaaagttttaaatgtgatgtgatgtgatgtaaagttgagagttggagggaagtttgatgtgaactaaaccatgcctctgtttattgttcatccgtttcaacgattgatcttcgtggagaagcacacctgcataagaagacagtggcgtagtcgttgatgtatatatgactctgatatctactaaagttttgttaattttagctattggctactagattatcatgtgcacggttttttaaatattaataaacgatatgattattttctacatggaagtctcttacaaatttaagtaaatctaattttaaatgtataacaagcgacactaaattaattatgtaggatatttgtcttctccgatgagtccagcggccacttgctccaaccgctgaaatggaactgtgccggaaaatctgtcactagcttttatctctttgagcgtacatatttatcaatcggtaaaaaaaaaaaaagaaaacaagagattgatctttacgtttttgtttccgcgttcatcaagagaaggtcagcatccaggcatttccatttttctctcctctgaaaacttcgtctccgtgttcacccaagcaataattccagagagtccagactccagagaactgtggtagacagtgatcatccctcccggagaacctgcatgctgtcgatcgatcgagcaagcgatcgacgacggcaagttgcgcgcgattcgcacaacgacaggtaattctcagagctagcaagcgagcacacaccgcgcgtcgcgatcccagcttagcttgttcaattcagaacgccccgcgcgcgcacccggccggcggctaggctagccgcgatcgatcgatcgatcgcggccaaagtccatatattattcttccgggcagaagctccagcgacggcgacggcaccggcgtaccagtgcgcgccccgcgtcgcgcgtcgccgtcgttcttttgtctagcgatatcgagcacgcgaaaggacccgcgcgcgcgtcgccgtcgccatcgcgcgcggggggggggggggggggg

SEQ ID NO: 52547 - DNA, 8711 bp, Oryza sativa
acgcgcgtcgccgtcgagctccggcattctctcctctccgctacctttattcggggcgatcgacgtcgcttgcaccgagaaaacgaagcgattttgctctactctagactagctagcgagctagttaccgctgcttggactacatgggatgggatcgatcttggccttcttcttgggcagctggacttgttgaggcctctcgttgccaagtcatcccttagcaatgctatctctttaatgtacatctctcccaaaaaggtgaggagttctgcagtgtccacgcatgctctttctgctttgagaatcaacaggggtgatgtggatgacacctagctacatataaatgtgtaagggttttcatggtctgcagtttcgaagccacatgattcctgtaggatatcaggatagatgtgtgtggctcttgttataaagtataacattttggttagttacatctttgtttaattagttttccgtacacgaaaatcacttttggtccgtctggaaaaattgtttttttatagtgtctgtttgggtcggtgccaaactcaagttggaaaacttaaattactgtgaacgtttttgccgtgtattttgatccttggcgacatttatggcattctacacacatattttttaaaaaaacaataatgacccacatggcatatattatcttctccacatttttgcataattagtcttcccacactttgccaaagtaatgtgtgtgaaatgttgtagccaaccagatcagtactagcaagttctctttatttgaggccactagtagaataaacaaaataaatatttatcttatttttcggtttgttggtacctcataaaaaactatgtatatttactatttattatacataattttgctgctatcagttgtacaactacaaattgaactcgctttggatcaagttgcgtagtgcgaaagaattcaagtacatacatgcatctcaaccaagagccacacgtataacttttgtgtgatacttgactgacacgtgtcttcatggtgactcatcaattagaaaaaatcttcgtagatcgtgcgacggggttcaactatgtccacactcaagatgcgcgacaaattaactttgtcttatatggttgaagtcaattttaatatattttgtgatgttggcatgatggatcaattggtggtgtacacattggagatgcaaaatgttgaactcatagccatagaattcaacttatcccttatgctctagaaaggatgtgaattggcatatatgcactatttaccacataaagtaaaaaaaaatagacatacagaatcaaaggcaatgtcctatatgctcctacaaaagaatcttgaacaatcttatgtgtatataaagtgaaaaaaacagtgtatatttatatctttatatactctttaactatgaacaaaaatcatcctaccactccaaacttttaaactaacatttatttcctgtcaccctctttctcgggtgaacttcgcaattccgtccatataaccccctaaagcactttacgtaaatcatccaatatatatgatacttaggcaaaaataattttatggagttatatggacagtgttgcaaaatttgacaggttgcttagagcaagtactgtaagcccctaaacacttgcctcaaaatgccacataatcttatatcatgaggtggaggaaaaaagaaagtagagatagtaggagacacccctcatgcaagggtaacctccacatgaatttcaaaagaaatgagaggaaaagaaagagtgaattggacaaacaaataaaatgaaattattgggactagctagtgtgctagaaagtttaggggagggggtacatgaatgtatttttcagggttaattagatgactggttttctaactttgggttctaggcagaactttggatatttttcctatttatatttgcaaaaaacaattaatttgaggtttatctatatatatatataatatagtttcaacctctaaaccaacaccattacgcgtattaagtagtgatccactatcagaacactcagttgatatttacatttaatcacatgttgtacattaatgcatattttttcacagcttttatttttgagatgagtatatgacttcaatttgtctctgacttgtcctggactcctgctggttgaccatcagcagaagtactttaaagataaacactatggcaattaatcatcaacacattcgacattagagtattcaactaaaccataattcactggtagtgtttggaataatcaaactaatgctaggtgaaatgtgtattcaactaaaccataattcattgatgatatgtgttatggtcataatctagaatttccacattacaaattaagtccatatataagcattgtgaagaaaaaaatatgtattgaaaaatttatttgtgaagcacctaaacaaatccaatgtgggaatggatatataactaacaaattggatagtgcatgatcttcatggcacatatcatataagtacaggcacatcaatggttaggtgtactagttttaaaagctagaatgtttattttaagaaataaggtgatcattatcattactgtgagttcttgcattggcaatttcaagaccaaaccctcctaattacattttttttctattgcctcatgctactaccacacaacatcccttaaccaccgattaataaccagcatcaatgccggttacagaatgcagcaagcaatcgaaactatcactactagttgcccaaccacctccccacaccccacataacgctgatgcaccgccgttgttgttgccgtcgtcttcatcttggagacacggatgccatctttgtcaccaagacatagctgccgagccgcaccctactcctcccttaccctgccaccgcccccacatttccatctctctacctcctcctcctaccaaatatagcaacctccaaactggatcaagcatggaattttacgaattcttaggttttcaaaatagtgtaatgaaaaaaagaagtgttttgaatcatcggagaggccatggaggtcctatctcctagcggacgcgagatttggagatagaggatgtagtttttgtcgttgtactaaatatatgatacccttcaagtatggaaacatatctaaatacagaatttcctatatataccacacctggtacgatggatgggtatgaaaagaatacaacctaccacacctagtacgatggatgggtatgaaaagaatacaacctaaggcaaaggttctattaggatatgatcacctcatatggcaagactttgaaaggcctactcggacaagaccaagatatacaaagtttatctccaagaatcctacaagaaaaccaagattatgggtacaaatatacagacctcgtggtgaagagaggattgatcttaacaagccaagtcgatgatcatgacaagttcctgattagaagatcccaaagagatacatgtaggtataaattagagcctctctacatattgcactctatacacatctacatatatacaataactaaaaggatgtagggttattatcctaagggaggctcgagcatgtataaaattcttttttgtctcggtgtgcatacgagggtctacgaggcattgcctttacacaaacaaccctagatagacttaaaattgtagtcatggcatcaaagtgtttacacttttattgttgcaatgatgtgactccttggaaataaaatagggtagtcaagcatagagcagggtggagaggtgaggaaaatcagtgcacggaaagcgagagtgggggaactagaggggccgataaggagaaaacaagaggatggcagtggttcgtgaactctagcctcagagcggatagggccgctagatctactgacccctagctggatctggcactaaaaggcgacgggggagggagggagtaggcgtggtggaaatgatacatcctcatctctagttgggtggatgtaatgttgattaaggagtcacttattggctatctactattatgtccgtgtctttacccaatataaaagggttcgagggctaaacagatttttgtaaaataggactctaatatttttaagataggataacgtaaatgggttacaatgaaaaatggattatactatgttgcagtatatatatatacccatcaatttcaaagagctaagtttcagagtaaactttattatgtttatttagtaaaggcacgaggacagcgcatgctctgatcgtacggtgtgaatagaaacccaatggcaaagcttgagctgtcttgtggaaagaaaaaaaaaaggaaaaatctctcgtgatgcgtacagctaccaactgtagcaggtacatgcacctgattcagttgagcaccagtacactgcactactcactcctagtataggatcatatcatattcataggagagagtcatatgaaaacacactgagtaataaaatcataggactataaataagtatatatacttctacataaactactccggagatagatagccatgcatgcaggcagcattacctgctgctggttgcctctgcctcctcaatcctgacgccccggggttccgtctccggctgagaaattaggctagccgacaagagctcgccatactccctcgtagctcaacatggcttatgtttaatgccccttgcatctctccctgcagcgcatacacatgcccggctcccgagaaagtaagtcaccgaggaatggaggagacgaagatatctgattccctgcgcctgcttttgtagcaaccggtggccgggcggggccgggatggtgatgccattagcgctgacagtggtgttgtttgttgttgttgctgttgttaggaccattagaccgatcatgcaaattaattaagggctaatttggattactaccctactaaaatttgccctaccaaagttttggtagggtagcaaactaaacatctctactaaaactctaccaataccatacatttggctttgtctatgaacttgtctcttatgggtaaattgtggcttcaatccaaataaacatttttaactctaccctactaaagttttggtagcccaaaatttggaactaccaaaattttagtagggcagcaatccaaacatgccctaagcaatcaaagccaagccccaagtcaaagcaaagctagggggtgtagtactgtacagtagctgcagcattctctctcttctatctcctctggcggcagtgtcaatcattagtggaggtatgtggtacatgtgtgacgcgagggggggcagctttatttatcatcgagtggaagcaaggactagcagtagtactactactactaccttgctgtgagtgtgagacagtgtccgtcgtccttgagccttcccatcaccggtcagccagtcacactgccaggcagtcatgctgccatgcacgcacctggagtacctgggctggatctccgccgagcaaaagttgctttggcagcagcaaccaccgccgcttttgcctttcccgatcgagcctgcacctgcacgcgccacaaacgaggaccaaccaaaccaacccccgtggcaccgcagttaccaggcacactgtgttggctatagtttcactcatgtcatgtcatgcttctgcgctgcggtctgcattgtcacgacggatgccggagctggacctggcgggggagtatcaccaagtacacactagcgcagccgctgccgctgccgctgccagtgccatgccaaccgcggggcacgggatggaggagtatcctgtagtattcatcatgatgcatgcggcgatccatcgatcggtttggtccccgccaatcaccccaaccatccatttatgtcgtcgcgccccgccccgcccgcgcgctgagacacgcggctgcgtaggtgtgtaccggtggcggggggtgccccgagcgtggaacgtgaggcagaggggcagggcctcgttttgtcactggtcctgagtaccaggcgaggcgacgccaagcgagggaaaaaaacaagggagggttagactaatgacggtggagtggtggatacagatacatgcacggacggacggactcacgcacgcactcacgcatacataccgtggattgacgcgagggcggtgcagggaacccggggcttggggctgcggctgcaaccgctgcgttgcgttgcgtctttcttatctgcttgtccattccgttcccgtccgctaggtccccccacgccacagcctcttatcccacacgcggaccaacagcgccgccccgcccgtcccccgcttcaccttcggcttcgacttcggcttcgtttcctcttctcttcgtctctccctccctccagcgaaagaaagagagagctcacctcgcgttgcccggccggccgcggaggagagcacggcttcgcattcggctggagctctcgtctctgcactcggagtacagctgcaaactcctccttccttgatttcttcaccctgtctccacggactgcacagatgtgggtgcaacgcgatctttcgctgcctccggtttagctctccggttgattccgatcgaggaagctgatgcatgtgtttgtatatggctcggtgttttgtgtgtgcaggtccgacggcaacgacttcgccgagctgctgtgggagaacggccaggcggtggtgcacgggaggaagaagcacccgcagccggccttcccgccgttcggcttcttcggtggcaccggcggtggcggcggcggcagcagtagtagagcccaggagaggcagcccggcggcatcgatgcgttcgccaaggtggggggcggcttcggcgccttgggcatggctccggcggtgcacgacttcgcttctggcttcggcgccaccacgcaggacaacggtgatgatgacaccgttccgtggatccattaccccataattgacgatgaagacgccgccgcccctgctgctctcgcagcagcggactatggctccgacttcttctccgagctccaggcggcggcggctgccgcggcggccgccgcgccgccgaccgatctcgcctctctgccagcctccaatcacaacggcgccaccaataacagaaatgctccggttgccaccaccaccaccagggaaccctccaaggaaagccacggcggcctgtcggttcccaccacccgagccgagccgcagccgcagccacagctcgccgcagccaagctgcctcggtcgagcggcagcggcggcggcgagggcgtgatgaacttctcgctcttctcccgcccggccgtcctggcgagggcgacgctggagagcgcgcagaggacgcagggcaccgacaataaggcgtccaatgtcaccgcgagcaaccgcgtcgagtcgacggtcgtgcagacggcgagcgggccaaggagcgcaccggcgttcgccgatcagagggcggcggcgtggccgccgcagccgaaggagatgccgttcgcgtccacggcagccgctcccatggccccggccgttaacctgcaccacgagatgggccgtgacagggcaggccgaaccatgcctgtccacaaaaccgaggcgaggaaggcacctgaggccacggtcgcgacatcgtcggtgtgctccggcaacggagctgggagtgacgagctgtggcgccagcagaagcggaagtgccaggcccaggcagagtgctcagctagccaagacgatgtaagtaaatggtatgagatagatatgcactgcataaccagctgactataccttcgctgattctcatgataaaaaactggttctattcaggatcttgacgatgaacctggagtattgagaaaatctggaaccaggagcacgaaacgcagccgcacagctgaggttcacaatttatcagaaagggtgagtagctcacatcttcagtgcatggatcatcctgcatccatttgcttcaaagttcacatgtcagtgcattgatcatcctgcatccatttgcttcaatcccatgactcgactcatgctgcaattttattgactgtattgcaacccaacaatctttgcagaggagaagggacaggatcaatgaaaagatgcgcgctctgcaagaactcattcccaactgcaacaaggtaaagataagccattccatcgtcttgctccctctgagatgcctctgaatgaacatttggtcaattcaggcatgctatgttttgcagattgataaagcctcgatgctggatgaagctatagagtacctcaaaacccttcagcttcaagtacaggtacattgaaactgccttcgaacaaatgtaccatgattgtcgggtgaatatgtacatagatgcattgacaaggtgcagttgtcattgacacagatgatgtccatgggaactgggctgtgcattcctccaatgctattaccaacagccatgcagcacttgcaaattccaccgatggctcatttccctcatctcggcatgggattggggtacgggatgggcgtcttcgacatgagcaacactggagcacttcagatgccacccatgcctggtgctcactttccctgcccaatgatcccaggtgcgtcaccacaaggtcttgggatccctgatacaagcaccatgccaatgtttggggttcctgggcaaacaattccttcgtcagcgtctagtgtaccaccatttgcactttggctggtcttcctgttaggccaag

SEQ ID NO: 52548 - DNA, 5841 bp, Oryza sativa
  unsure (1)..(5841): unsure at all n locations
gcaaactgaaaataaaaaaaataaatttctgcaaactgtccttctccccgatttatataactaacctgtatagatgatcaattatataagtacatgcatgtccgtccatatatactcccatttaccaacaagctccgagatgagatgacgacgacgtctcctgtacgcatatgtgctgtttgttgatgtgaaccggttggagggttttagatccgtcctccgatcaacgcgagaggcccgtggacacgtttacacgcgaccacccagtagtacgtacacatgtcgtgattaatttcgcagacccacgaacaactactcgcgggtcatgtcaaatcgatccatcaactgtttgcgagcagctgagaccgttagccttgtcttccaaagcgccgcactagctaacggccaggtttgatccggcaaatatagtccaaacgagatcgatcggtttcaaatcggcctcaaggactttcaaatcaaagctcttcgattcgatctagctagctaattcgaatcagcaaaagatcacaactaacgccaaagcgcggttacatatatatatatatatatatatacataataattcatatgcgcctatacatgtcgtcgtcgttgttgtctgtatatgtacgtataatctctccagctcgttgttaatcaagtgctattttgacatcgacgtgtatggtcttaaaacgtccgtgtgatttattagttgattgatctgataatgctgcagcgcatctgtaacatggaaataaacctgtcaatatgcgaatcggtgcttcgatctgttattcagagttatttcagacaatgggtaagctaaggggcctcccctcttattgataagcattatatatggcaattgccgtaagttttctaggattcagcttattaaaaccctactccataaacattagaaatcaattaatacaattagctagtgttttacaagtccatgtctcctaaaataaaggatatcacaccttatactagcttaattaatttgtgacactcttgcatggaggaaagttctccattaattaggtgctctctctgtacagtaagctggccggaagtaatggtcaatagatttaattatgctgcgtgctacgtacgtgtctacgtgtgtgccttttaattatctgttccctcttgcaccattattctgcccttttcaaatcgtgcctgaagtgtaggtatacagttggtgaccccaggaaaggctacaattaagtgctgactagctagacggttactgtgttggtgaagatggcaagtgctaactaatctgcagtgcatgtatagttggtagtgtaccctgcaacgtccatggccgttgttagttgtttggcaggtgatcgagccattcggtgatgtgaaggtctaaacaagtggtaacgttgtaacgagacgtctcctgccatggtgccactgccaccttcaactatctcctaattgttgcttgttggctactaccaactagctagctaggggtttagatcagtcaatgtgcatgcatggttcaacttaaatgaatgctctgtgtggttttctttgttacatgcatgcactattccattgtgattataactgaattagcatataagtttgctaataagcattgaacatcgttttctatcttaattagtacagtaaaacacgtgtttgtcctctctaattacaaatgcagtctctaattacaaatgcagttaatttggtcttgttatagtttccaattcttctggaaatttagctttaatttgtaagcatgacttcttaggtactttgtttccaaacatgtaagtactcgggacatataagataattttgacacattctacatgttatttaattagcataacttcaaaatggcctacctacattttcaaccggagcatgcgacaatatttcgaataataagttaattattataggaggcgtcttcgtccaaggcgtcactagcgaaggcaataatgtccacagctcaagatttcatcgacgcatgcagctgtactacgccaccggtttggtagcttgctagctatacgaccgcgcgagagctagctatcaatcagatcggtgcacgaatcctgcagacacgtcatcacggcacgctacggtagtaaatcagaattttcaccagtgatctaatctagctagcactatataattccaagttttgagccctgtcaatcgactgatggatcgctcaataactagttaattaggtatagttacatatatgtaggcagcgaatcccccattaattttgtctacgtagctatagctagctagcgtggactttatattggctatattgttaattttttgcacgcgcgcgacgggatcatctggcgtcacgtatatgcatatttatgtatctgcgagaggtagcagtagcagacgtaacacgagtggcgacgatcgaaatgaactgggccatccccgttcgacgggaacgcgcgcgcgcctgtatgtaccgcaccgacagtgcggagaaagagtactactcgcggcacgtacgtccccgcgcgcgcgcggccgagccatggctgttggtatcgaccactccacctcacgcttgtcaccgtcgacctcggcaacacgtacccacgcttgggcgagctagctagctagctagtgcgcggccccgcctcggtcgatcggtggctggatggatgtacggtggattggtggcgcgcgcacggattatttgggcaggcagcgcgtggtgcactggtgcgtcgcgcgcgcgctggtggcgaacgtgacgacgtactgcgtgggctccggccccgcacgtacgtacgacgacgacgcgcgctccccgtgcagggcacgtcggcgtcgtcgggaagggacgtacgcggggtacgtgggggacggcgcgcgtgatagggatgctcgaccgccgcggcaagcgacgtcccacccgcgcgaccacgcacaccgtttcgcgcgcgcgcgcgcatgcatatgggggccggaggatttagccgggccggaaggccggatgcagggctgacacaccgcccgacaaaaacggggggcgtgtagntgtagcgaccgccccgccccggccggacgtcgtccatcgttatcgctagtacgacgcgacgtttagtactgtacctgcacgtaaacccctgcgattacagaaacagacccgtaacattagtctcaacggttttctgcctagcaattactactaagtaatacactctcactggtggagaaaccctttgtagtcccggttcgtaacccccctttagtcccggtttccaaaccgggagtaccaatccgggactaaagatcgctatctttagtcccgggtgaaataaccgggagtaaagatcgatctccaaccgggactaaagatagagctgaccttttttttttttttgcatgcccatgttgctgcatggtttatatatatatatatatatatatatatatatatatatatatataaaccatgcatatatatgtttcaatacatatatagaaaatctgtacacatgcatatagaaacatatgtagtcatgtattaattacaattcattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacagtgcaggcctccaggtcgatgagtaaaagcacccagtggaatctgcaatgtgcgtgggatgcattacatatgaaacacttagcaagttcgtacgggaatgaaatttggtatgtaggaaaacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattaatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttatgtgggcaagcggtggagctggggggggcccttgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaacaactcaacttcgaccttggagtatcctgctggaatcggcctgcagtggtaagtacctgaagggtccgttgggatggccatgcccgacgccaccttcatgttgtgagagattatttattagtaatcaacatatataagcagcaacta

SEQ ID NO: 52549 - DNA, 2785 bp, Oryza sativa
cgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgtagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttattccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttcccttcgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgttaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagataaaaaaaatgtgttaggataaatgcgaagtaacatatatatatatatatatatatatatatatatatatatatacacatgtatacatgtatatatacacatgtatacatgtatatatatacatgtacatgtatacatgtatacatgtatatatatacatgtatacatgtatatatatatatatacacatgtatatatatatacacatgtatatatatatatacatgtatatatatatatatatatatatatatatatatatatatatatatatatatatatatatatatattgcatttcacgttaacgttcgtcctcgttcgttcgctcgttcacgttccctagctcgttcacgttcgttcgatcgttctcgttctcgttcacgttgtcgcggcaacgtacgttgacgtgttcgttctcgctctcgttcgttcgatcgttctcgttctcgttcgataacggcggtgtggcggcatcggggcggcggttggcgcggcggcgtggcggcggcgtggcgttgtggggccgtggcggcgcggcgtggcgtggcggcggtggcgtggcgtggcgtggctcccggcggcgtggcgtggcggcggcggtatttgcgcgcgcggcggtgaaggcggcggcggcgtg

SEQ ID NO: 52550 - DNA, 4749 bp, Oryza sativa
cagttgttgagaacaaccgggagtaaagaaaagatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattgatgacaattacttcgaaaaattatttttgtctgtaataaattaagtggataaatcgtaataagcaaatatatgacttataattaataaaaattccaatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaattgtcaccgtgaaagggggttacccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggtagttgttccatcgtgtcccatggcatcgacacgaacagcgctgttttggttcgtgctcttcatgtcttgggctctcatgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcctggacattgtctggaaggataccccttattacaactggtagcagttgtgtcatcaacacgtgacagtcatgagactttaggtttgtgaacttcttctccttcgtgcttattattcgcttgatattcgtggagtatccaaacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttataccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccaggggggaggttgtagatacacatcgtaacgggccaagtgctatggccgctgctcatctctccaaaaggattcatgccatccgtactcataccaaaccgtatgtttcgtgcgtcctttccaaattctttaaattttctgtcgatgtttcgccactgcgaaccatcggcggggtgtctcagcatcccgtcctgttgacgctctttaagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaattgttcggacatgcgtgaatcttatgaacttccagtcctaacgggcagactatcttcttagcctcgtatgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccataagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaaatttggagacaaaaaaagtgtgcaaaacataagtgcaaatgtagtatgacaaaaaaaaacattggaggatgaagttgcaaacctttt

SEQ ID NO: 52551 - DNA, 2270 bp, Oryza sativa
cggccttcacttgggacagtgcagcaggaacccttatgagtatgggtgaaaacggtatggaaactttacggattctggacctatttttgaaaatggaattggtcggtccgaattttttcgaaatttttcggaaacgcaaacgaattcggaaaatatttctcagaaacagaaacgaaaatgataagagtagcttccgtcggaactcggaatcggtcggaaactttccggaaattttctcggaatttccagaaattttgtgactgaaataccctggattctttttttaagcaatgaatagtgaataccatggtatttggctgttattttttaaaaataatatttgttatgcaaatctgaagttacataagaatatttttttcatgcattgagatttatctacaacattactctcttaaacatagataatttattttatagattgtgttttgtgatgtactgttaagacttaacaattggacttatatgattgtgttttatgatgaattgttgactgtttgaaacttgagaattggatttatcagtttgagggggttttttactctaataaatttccgttaccgtattcacgccggtttattttcgctccgatttcagttttgataatatttgatttcgttttcgtatccgaggtttccgattcccaaaaaaatatgaaaatgaaaatgataaaggtggtttccatccatttccgtaccgttttcacccctacttgtgagttgtgacaccccaaaaaaaatggaggagaaaaataaaaagaaaagagggttgcttgagctgcttagctccttgggcctgaaccagtgtgcagcaagttgggccttagcctggttggtagcaagtgtgcgtgcgtgcagctgcagtagcagcctagcaggccggccggtggctagcagcagcagcgagcggagcagcagcagttctggagctcggcacgcaccagctagtaccatgtaagtttggagagaaagagacagcagtagtgtataagaatgctcgagcaacccagactaaaggggttacaaatcgaaacctcgaatccagaactaaagatgatagcgccacgtgaataacgctaccatctttattaccggttaccaaccagaactaaagtttttttttcttttttttattggtttattttgctgcttgcaaccagacatcaatactgccatgggaccaaaattccacggtgatgtcatataaactccacgtaaagttgaaagacggctggtgaacttattccttttccaaacgcaaatgatggtccagccccgaaatgcccagtgcttaggattaaaggattagttcatcttaggtcccttaacttggcaaggaatccgattttcgtccacaaacgggaaaatcagatacagccgtccctcaattgtcaaaaccaaataaggccctcggtggttttaatggcggttttggctgacgtgacgcctatgtggctaatttgacttaatcttcatctgatggggcattgacgtgccggttacgtggcaattcaaacccgaaaaataataaacctcatgagacccacatatcagtttcacataaaaaaaatagtagggcccacataggccccacatgtcattttcagtcccccctttttcctcatcattctctccccatctccctctcttcaactctctctcccctctcctctctagcgacggtggaacggctccggcggctgtggccctggctgcggcgcccggcggagatgagctgggcgtcggtgcccatgccaccgcctcctccattgacctcgccgtcgccggtctcctccagtatactcaactgcatcaagaggtatatactctttctaagaaaagaatggcaagataaagagctgacattgcagagtaacaacactgctactccagtaaacactgagaggcagagtgtacatgtaaaccaaactcattttcccattcaactgctatttgccatgctaattactaaattgagcaccgaaaggatcaaagaattaattaacccgtcgctgccgcggctcctgcaaccaacctgcaccttcgtgctggcgccggcgaccaagaagcacccaggcttgctcccgagctcgagcgagacggagccgggcttcccgtcgagccccggcacgacgttgaacatgcaaccggctcctccattgacctcgccgtcgccggcgacctcctgcccaaatctggcctgagcttgccacgctccttgtgggcggtggcaaccgcttcttgaagggcggg

SEQ ID NO: 52552 - DNA, 14261 bp, Oryza sativa
ccaccccggcccccgccgcggcgcccaccaccccaggtccggccaccgcgccacccaccaagtccaccaaggcacccggccaaggccaccccgccgccggcctcatcatccccgccgcggcacacgccgagccaccgccgccggagctcgcccacccggctcgctcgcctgctccgccacccacccgcgccgtccgctgcccgggaagaagaagagagagagaggggaagacgtgaagaagaagtgaggatgaagaagagagaagggagagggaagaaggcagggctgaggctgacatacggggctcacgtgggccccaccatttagaaattactctctccatttcaaaataagtatagttttagcactgttcatgtccaacatttgaccgttcgtcttatttgaaaattttttatgattactacttttattgttattagatgataaaacatgaatagtactttacgtgtgactaatttttttaatatttttcataaatttttcaaataagacggatggtcaaaacgatgaacacggatttctatgtctgcacttattttgggacggaggtagtatttttttatgaagctgacatgtggggacacgatttttattattttttcgagatataattgccacgtaagcaccatgtcaatgccacgtaggatggagacctagtcaaaccagccacgtaggcgccacgtcagccaaaaccaccttccaaaccgttgagggacctcgtttgcaccggttttaatagttgaagaaccggttgtatctggttttgaagtttgaggacgaaaatcagatttggtgtaaaattaagggacctcggatgaacttattccaaggattaaataggcttaaggtccaatcgtcaaaatcctaatgtgggtaacaggataactagataatgcccatttgcctaaacataaccagaaaagaaatgtccattttgattcccttaagggtcaaatctagtttgtatccctcaactgtaatcttgatccaaactattaaaacaagcgtaaatgtctccctctatgtttttaggggtggtttttgctcacgtagctcgttgacctaatccaaccgacacagtcaacatgagtattttctttctttctttttttctcatcctctcggctcttgttctctccaaccaaaaaaaattattcaaaaggaagcaggcagggcagcacattgtgagggaatcaggcggcggcgcacagttctctcccttggcaccctcctttccctcatatgcaatggactcaaaagggcggctgcagcgtatgccggtggattaggtttcgagggtggatccagtgagagcaaaggtggtggggtgacccaaggacgctgcttcgctcaagtccacatgtgcttcgcctcaaggccaggatgccgccgccctactcgagactaggtagctgacttgagactaggccgttgtcgcgcgtcggggccgcccagccgctgctccaccttgggtcacgctgtcactctatctcaaggctgggccatcgccactatgcttgaagccgcactaccgtcccacctcaaggccggcaccctgtcactccacctcgaggctacctagacgttattttgttccgctgctacgccttagagacaccccactgccgctctaccttgggctatgccgtcgctctttctccaaggcgcgctgctacaactccgccctgagtctccatgtgcctgtgtggagaaaggagagggaagaaagaaagaaaggagaaagaagtgggaggaatcactaacatgtgagctctgtatattgatttggtcagttggattaggtcaacgagccatccaagagaaaacaacccttaaaatcattgagaaaatcatttttaactgttttaatagttaagagatgaagatatatttttttttatagaaagagatgaagatatccgatatccaatatgataggaatcagaaaacgtatatttttgagggagtcaatgcggacttattcccaccagaaactgcagcatattggacgcagtggttccttccgcggtagctgcgcccgcgcccacgggaatgcgattcccagcccattccacccccttcccattccggtgggccattccgaatccaaccaaccaaccaaccatcgaacccgcacccgcatcgtatccactcctctccagtctccccgccgctccgcatcccgcagccgctcgtcagcgacggacatggccgccgccgccgcagccatggccaccgccacctccgccacggcagcgccgccgctccgcattcgcgacgccgcgaggaggacccgccgacgcggccacgttcgctgcgccgtcgccagcggcgcggccgaggcgcccgcggcgcccggggcgcgggtgtcggcggactgcgtcgtggtgggcggcggcatcagcgggctctgcaccgcgcaggcgctggccacaaagcacggcgtcggcgacgtgctcgtcacggaggcccgcgcccgccccggcggcaacatcaccaccgccgagcgcgccggcgagggctacctctgggaggaggggcccaacagcttccagccttccgaccccgtcctcaccatggccgtacgtcttcttgctccccttctcttctgattctctcgcggcggagacgacatgaatgggaatggtggtgcatggattggggcgcgcaggtggacagcgggctcaaggacgatctcgtgttcggggaccccaacgcgccgcggttcgtgctgtgggaggggaagctaaggccggtgccgtccaagcccggcgacctgccgttcttcgacctcatgagcatccccggcaagctcagggccggccttggcgcgctcggcgttcgagcgccacctccagtttgtgtgctctccccgctgtgcattcttgattcacttgtgaaattcgattgtgctgagcgtttccggcgaaggtttcaggggcgtgaggagtcggtggaggacttcgtgcggcgcaacctcggcgcggaggtctttgagcgcctcattgagcctttctgctcaggtgtttattgtagtgtgcaattgctgttttgtttttgatgattcagataagaatacggtgatttcggtgcttaggtgtgtatgctggtgatccttcaaagctcagtatgaaggctgcatttgggaaggtgtggaggctggaggatactggaggtagcattattggtggaaccatcaaaacaatccaggagagggggaaaaaccccaaaccgccgagggatccgtgagtgagaaattgccttctttgttggattaattgtccattgtgttacactgatatgccttcaccatttttagccgccttccaacgccaaaggggcagacagttgcatctttcaggaagggtctgactatgctcccggatgctattacatctaggtttgttatcattgtctttgtaatttacctagttcttcaactatggatattaggtgctgtagattgttcagatagatgcacattgtacaacaatctaggtagattgattgctatggcttgttgaattaactgtttcacttgcatcattgcctcagcacatatgaagcatatggatagattcttcaatcatttatccctcaataacacaattttgacaccagtgcttctcctttttttcatcctgcttcatctggctatccacaatataattaagcatacaaaagaggcactctttgatggacaattcatagtgttgtgggttaatattcattgcattctttgagggacaattcgttacaccctaacatgaactagtaatgattggggtgcttaaccatttgttctgcatttcctccattttcaggttgggtagcaaagtcaaactttcatggaagttgacaagcattacaaagtcagacaacaaaggatatgcattagtgtatgaaacaccagaaggggtggtctcggtgcaagctaaaactgttgtcatgaccatcccatcatatgttgctagtgatatcttgcggccactttcagtaagttatatatatttaattaactttctgttcccaaaatacactgcagcacttcattgcttcctgaggtcctcgattcatttttcggtagacaggaagtagtattcatttgcactttttaagggattaattcaacatatccactggaaatatacatatcctacacatcctgtcaacatacttgctaaacagcattttgtttgagttgactggcatctcagcagccaattactatctttaggggacaagccacattcttaataaatcctgtcggaaatcactttttgatttttatagattagtgttgtcatagaatttggcttggtgatctacttggtaaggttaactgattcacaagtcggacaatttcttcaccaatctagcagtatgtttaagtgtgttggtacttaattctaaatgtcctgcgcatggtaacatatcatatgcaaaaattcctcagtaaccgaaatttatactgtaagttttaactgtctttacactgttaattttagacatacttcttccttgcttgttcattgaacttgtttcccccttccacagagtgatgcagcagatgctctgtcaatattctattatccaccagttgctgctgtaactgtttcatatccaaaagaagcaattagaaaagaatgcttaattgacggagagctccagggttttggccagctgcatccgcgtagtcagggagttgagactttaggtacttataggaattcaaccttattattcttctaacatataaatgaactaatctttcttgtctagtttgcatttattgtggattaagtttggttatattgttcttacaagtttgtggtattattttgtataggaacaatatatagctcatcactctttccaaatcgtgctccagctggaagggtgttacttctgaactacataggaggttctacaaatacagggattgtttccaaggtatcgctgtcaagttgtttattttgcgactatatgattacagtatcctgtttttcaactccagctgctgttagactgtcataataaatctgctactacatgtttgcacactatttgactgcatttaaaaactcagatagcctatatttttagttgcctgctactgggtgtatttctaatgatcccatcatgtttgcagactgaaagtgagctggtagaagcagttgaccgtgacctcaggaagatgctgataaatcctaaagcagtggaccctttggtccttggcgtccgggtatggccacaagccataccacagttcctcattggccatcttgatcatcttgaggctgcaaaatctgccctgggcaaaggtggttatgatggattgttcctcggagggaactatgttgcaggagttgccctgggccgatgcgttgaaggtgcatatgagagtgcctcacaaatatctgactacttgaccaagtacgcctacaagtgatcaaagttggcctgctccttttggcacatagatgtgaggcttctagcagcaaaaatttcatgggcatctttttatcctgattctaattagttagaatttagaattgtagaggaatgttccatttgcagttcataatagttgttcagatttcagccattcaatttgggcagccatttactatatgtagtatgatcttgtaagtactactaagaacaaatcaattatattttcctgcaagtgacatctcaatcgtcagcaaattcagttactagtactactgtgtcatacaggaacacatgagaatgcagcaatctgtttagactcttcccagacatcccccactataccgtttcagtgtgatctttgtgaaaagaaaaagaatgcgactattgatacagtatttgactacctagattattgtatactagtgtcaagctatattcctcatggctcttttctaaaacaacaatacaaattgaagtacaagagtacttaaaatttatatatcccaaggaccgtgccaagcagtgttcttaattaatttgagataacacgatcctaggaagaactagtactagcaaacaattaacaatcaacacaaaccctttggcttgaacttgaaggatgccatcatcatgcatgcaaaatgtacaccacacacacatgcatgtgctagctgtgatcacttctgaaccctttttttttttttaaaaaaaagcctagcatgatcacaggatgacaactgaacacacacacaaatgctgaaatgcctctagctgcacacacattgtcatttgtcaaaggcagcagcaatgaatgcagtggagggatttgatgcacaagaaactgaagcaggtcaccgaggatgagggatccctgcctcccttgctatgcctcttttatctttgactgcatcgatctgcaattctgcatctctgtctgcatatcacgtccctagctgcagcccggccggtgaacagactgaagacaaccatggagatcatcggccatgcatggacagacaacaagggcacaatcattattagctagggttcattcttgcatggatccaacattgcaagtttatgccagccagtagcttttgagccttttgtttctccagctaattggtctggaatggattactgaaattttcagatctctgtcagctggccagccctgcatgcatggaaacaaggcaggcaaggaggaaacagcttttgctgcacagcatgcatttagtagtagaattcatggagaggccaaggagttgtgaattgtgtggttatacatgaggagcagctaggtaggggtcctcagaatgatgtcttgcatcttttgtcgtgcacacatctcaatgcaatgttgtatgtataagttatagctagtccaatgtggcatacagctaaaatggtagctagctcgagctttgtgtctaccgttcatcgaccagctctttattcaggttgatgactctattagctaggtgcatttggcctctaagccaataattgttgaaatgtttaattctttgttaatttttaattaagaccgatgttgaactgtgcatgaatgatcaaatgccttggggtttaatttgtttactctctccagtgtcctagcagctagcaaagatgattctattttgattaacttgactacacattctactatgtgaaaacacacactcacatattgatccatcttctggccatcatttgctaggggatccagatctctgcgtatgtaggggattccgagaggcagggagcagcattacgtgaaacatggatgcctagcttagatttgcaagcaagcttgctctgcacataaagagcagaggaccctatgtttgtactaacgaatggaattatatttaggcattggacattcggtccgagttgctccctccgttgagaaattcaaggcgtattagtttttgacaatattcaatattaaagtgtgaccattattttttataaatagaacactgacaactatcatattaacttcatgtaaaatcttctaaatatgaatccattgacaccacttgtatcacactaaacatatatattgtttgtttatttattagtcaaagtttacaagtgttgacttttacaattactacatgcatggtttatattttccaaaggagggagtaaattatcggatagtcaaactattttagttgatcaaagatgaaatattcaccaaaatagagtgggacaaattataaaaagcattgaatcatttttattaaaaaaagaatccagtgtgtaaattgcaacattaaaaaaaaacttactaaaacattcaaataacaccacatgcaacatttgcaaaatgacatgctaaaacatgtgaaaaatacttattgaaatatatccaaataataccatgtataatgtttaaaaaatccattgcacttacaaaagcgtaatgatccaaattagcattctctccaagcaaatcgctcagctcgaaccaacccaatcgtccacactccatacatggcgtctcctcctgtggtttggctgttgttttcctctctgcccctaccacactttcgcgtgttaggaacccgttggttgcagcggggcatgctaacgtgctgtgagagatcaggggtgctggatggtgatggtgtaggagtcggtacatgggaggacggtgttaggaacctaagcacttcatggggtagttgacactgaggatctgacaaacttcctgtatggcaattgcaagcaggtgctgcctggaacttccattgtgacgatgaaagcggaggcagggtagtatggagacaccgtgccattgccactgtgttggatgaatgagccgggtgagaggttggtggtggcacacgagaggaacaagcgaaagagaagtgtataaaaaaatagttaatccctaccggttcaaaacggtatcatcgatcggtttttaaccggcagtgacacgagcgtatcactatcggttcgttcaaccaaccggtagtgatacaagatgcataaatagatcaattttattgggttcaatcctcacggtggtccatgccatgaaccagcagtgaaacatcacagccaattcatgccatgggtcagcagtgatgctaagcatctctactggttcatggcagtttggacaggaaaattcattcaacccctatggacggatagggatggagaatcactgctagctcaagccaaagtggcagtaacaataagccaattaatatgtgaactcatcaaagtattattagaaccgtatcaatatatgcgtataattatgggcattaggatttaaaactagtcagtatccacaacgactcaatcactatactaaaagtgattctctaatttccaacattcagttatgagtttgctcagaaagtcgcaaagcttaattagttccggacaatcgtgtgccgcgcggaaaagaaaaggaaggagaggttgacaaccgtgagcccgtggccacaccctgttttcacaggccacgacaacgtgagatgaaatgtgatgatgcgaattgaatcagcaggcgatgagccgatcgatggatgatagaggcgaccgaccgaccgaactgggaatgaagcgaagcgacgtaagcgatgtcgcactactgtcccaatctgctccctgctcaactacgcttagaaaactgtcaaacttgtaaaggagatcgagcttagctgctgctaatcgcaagagcaagacaacgttcttttatgtctcgttgctgtcataacccaagtaatctttaatgatctagttgcagcgcgcacacacacacacacgcaatgacgcaaattgatcataattttcttttcctgaaaagaatcgaaagggcctgcactgaataaaagaatcctgcagcctagctaatgaacattcagatacacaagcccagagatagatatatatatatatatatatatatatatatatatatatatatatatatatatatattgtttctttaaatatgattgtcccattgtcatctgctatcctgatgagctcgaaaacgaggcagcccgggtatgtctcatgtgtgcctgctaaaagttggtggtgagctataaaacaatgcgccgcttgtctgaagaaaggccatgcaatgcatatatgcagtttgatctgcagcgagcggtaggaggagagcagtttgcttttgcttccagctgaatgctgctgcatatgctagctgctcgttccctcgatcgcaatcttcactcgcacaaaaggggggagatcgagctggctctgcctgctttatgattcgtcttgtctccttcgatgcatcgatcggcagcttctcgaggaaaccttaacgagaacattttgtctggttaatggccgtcgtttcgatttaatttgtctgattatccgatcccatcagttaattgacttgtaattagcctatacgtcgcccaagttgttaattagtattgatatataaagttattagaagttttaatcatatgacgcatcgattggttattttttaaatcatatagagcttagataaaaacaagactccatgttggtccaccttactaattattgattttgaattacggaattaacttaataaaatgctaaattgagggttcaaaatggtacaacttaatattcattaattttaaattattgacttttaaaaattagaactaaatagtccacaatatttacaagaaaaagttcattttacttccccaaactagttgattagataacttagtacccaaaaaatattttacccctaaactattgaaaatagttcactttactatttaataatatttttcttttatattatgctttatacaagttttattctataggctgaaattttttaagccatagatgacaccattatctaagttcaaaaatattttcaaagtttttcatgactttgtttgaaatttaaaatcttaatgtttaaatcacttttaagtgtttccaacctatgtaacaacgaggaaacatcctttaaaaatgttgagatgccagttataatgcatctatcattctttcaaaatttcaatgtaaaatatgacttatatagagagaaacgaaaaaggaaatatataactttagagatgaaagtggaccgttttcagtagtttatgatgtaaaacaataaaaaacacttcagggggtcaagcgtttcggtgaaattgtctgagaaagtaaaaaggactttttattttttaatgttatgttttatttaattacaggcttttaatatgatctacggttatcataattagatctaactaactaatcaatggctcccacatctttcagattcgcatagaagagtgttcaatctatctatctatctattatattattaaaacagctttgaaatgagggaccacgttcgctgcgggggctaaaaattcccacattaatcggagaaaaagaaaagaagagtccaagtagaaatactccctccatactcgtaaaggaagtcgtttaggacatcgatacaatctctaaaacacaactttgacttcttatttctataaaaatatttattgaaaagtgatacaggtatacttttatgaaagtatttttcaagacaaatctatacatataatttttatattttcaaactcaacaacttgagagttattcatgatttatattcccaatgtttgacttaaacattgtcttaaacgactttctttacaagtatggagggagaacaatttaaaaatagctgaaagtcggaattaaaaataagcaatattgaaaaaagagtccatataagaacccaacacgagattaatcaaaattcggaataaaaataaaataaaatacaaaattagaaaagaaaaggagagttcaagtaagcatacaatttaaaaatagctgaaattctgaattaaaaataaggaatattgagagaagagtccatataagaacccaatacgagattaattaatattcaggataaaaataaaaataaaatctgaaattagaaaaaaaagagaaaagaatagttcaagtagaaatacaatttaaaattaactgaaattcggaattaaaattaagcaatattgaaagaagaatccatataagaacccaatacgagattaattaaaattaggaataaaaaataaaataatatccaaaattagaaaaattaaaagagagttcaagtaggaatacaattttaaaacaactgaaaataaaaaataaaaaataaaaatattaaaagaacaatataaggaattaattaaaattttaaaaaaattctgaaactagaaagaaaagatttcaattaggaatacaatttataaataactaaaattgttgctaaaaaaaataaagattattgaaagaaaagatcatctaaaacacatgacgagataaattaagtaacaggcctataaaagagttaataaaaaactgttaatacgacatataaaaactgttaataaaacaccaaatagaatactaataacgattaaaaggagggacaacaaataggccatgaagcaagcaggcaaggcggttgccgggacttctagaaagtaaaaacaataaaccccattgataatcatattcgatttttaaatctcaatgataataaaaaggagaagcaacggggcatggtgtataggagtatagttgcagagctgtcgacggttggcgggacttctagaaaataaaaaaaaagaattccaaagatagttatattcgatttttagaatgccaatgacaataaatagtaggcggcggatgtgccgtagaggagtataggggcatcgtttaacaagacttctaaacattataaaaaatgaaacccacgagacaataaactctaaatactacaaggtccaatttttaaaggttcggaacttctaaaaagtaaaaaaaaaaacccaatgataatcatatttgattttaaaatctcaatgacaataaagaagggagacaacaggcgagccataaaggagtacaatggcaaagcggctgacggtttggcgggacttatagaaagtaaaaaataaacccgaacgataattatgttcgatttttaaaatcccaatgacaataaagagaaaagagagtggacgggccgtagaggagtataatggcagtgtttgacggtacttctaaaaattataaaaacaaaacccaacgagacaataaactctaaaaactataagatccaatttttaaaggcttaataaagaaggatatgacagaagtaagggatagcagttggtgtgacattaaaaactatataattagaaatacgtggatgataaggtttgatcttttaaagtcttaagacaacgagatagctatttaataaattttaagtaaaatcataccgaaaaatatatgattttgtttgtgttttagtcgcgcaattgcgcaggccacccagctagttagtaaagaagagggagattggctttgttgtgtacgttgcatcaagctttgcacgtgaaaccacaaggatggacgagacttaattttgttttgctcgatatgaattgaatgcccggagtatgaatccaaaaaacctagcaagaatcttatcaggggagaggagaaaatgtagaagctggttcagtgtaggtagctagtgcgtgcccccttgccaaaagcccaaaacttctctcaatggtttgtgcgtgttctctctaaatattttatcctcttacatcggtgccctagctaatataagttaaccatattgacgggctttgccccccttgtcaaaaacccaaaacttctctcaacattttgtgcgtgctctcttaaatgttttatcctcttacattggtgccctagctaatgcaagttgatcatattggcgggctttgtgggggagggcgttccattctcttttaccgtctctccttcaatcctaaagacgtggatatatagttgagtgctgctcggctgttagggtttgtttttgaacggttcggttgtaacttatttgttggtccagtggtggttaatcacacttagcggtgaccggtccggtgttagccttctcccaagttctgtgtaggtacttgatatcggtgcgtagaggtagattatttttaggaaaaagtacgaattacctcccccgaactatcgcggttgtccgaattaccctcctgaaccacaaaaccggacattcttcaccccaactatgcaaaccggacgaattacccccctcaacccaatccgcggtggttttggtctacgtggcgtacgcgtggcagtctagtcagcattttagttattaaaaaaatgtggggcccacctgtcatactcatattcctctctcttctctctctcactcttcctctctctcttctctcactctctttctcactcaggcgctcggcagcacgggggacagggagcgacggcggtggtggggtgcggcgaaggaggcgaggcgaggcgacgacggcgagccgcacgcgggcgcggggtcgaggcgacgacggcgacgggcgaaggacgacggcgcgcggtgcgggcgggactcgaggggagatggcggcggcggcgggggatgaggcggcgaggtgcggcggaggagacgaggcgaggcggcggtggcttacgcacgcggacggggatgggaggcggcggcgaggttggcggcatgcacggcgcggcggggcggggcgcaaggaggcgacgcgacggcggcagcacgcgggcacgccgcacgcgggtgcggggtcgaggcgacgacggcgacgagcgacggacaacggcagtggcggaggaggaggaggagaggggtc

SEQ ID NO: 52553 - DNA, 7257 bp, Oryza sativa
taaataaaatgctgactggactgccacgtatacgtcacgtagaccaaaaccactgcggattgggtcgagaggggtaattcatccggtttacatagttgggggtgaagaatgtccggttttgtgcttcaggggggtaattcggacgaccgcgatagttcgggagtgtaattcgtactttttccttatttttattcctgactgttgtcttttcaaggtgctagccttataatttttattcaatgaaacaacgcatggtctggtgctgttttttaaaaaagaaacgtaggtagatagtgatcaatccattgttcttacgctcaattagccgcaaaaggtgaaacgaatggtttttgttaggtactacctccgtcccaaaacactcatcgctttaagtttttttttcaatgtttgattattcgtcttattcaaaaattataaaattattatttattttgtttgtgacttgctttattattaaaactagcatggtggcccgcgtgcggctagctaccaatattccttacttttaattccgaatttcagctatttaaaattatatttatatatttactctattgttatttttaatctgagtttttgatatttctaaattatatttctacctagactcttcttcaaattttcttcattttatattcctaattttagatatattaaattttatttctatttctaaatagttttctttttctctaggtagttgaagataattctttattctgaatttcagatatattgaaatatatttccatttgaactctatttttctttttctctaattaatatggaaatttatagaaagtgggagcgaatatggtggcttttttcttttacattaagatataatctctactattataaaaattgaagatgattttgccggtaatttgatacgtcatccgtgtattagtcagattttaagtttgttcgcttttagaaatagatatatgtatttgagtaggtttttaagttcattcttttttgaaaatactgatggagtcatataagaaatctaatttaaaaaaattcgcatgctaagttacacggttggactctttactgcagctcataatttttttaaaaaaacatatatatcaaagcgaattcctgcagtgaattttaccttaataactataatccatataataataataaggttaaaatagtttttacccgttgcaacgcacgagcacttttgtagtatagatagacatataaatgcatcaggagtgtgcacgtatgaacctgccattagagatttggtttgttgtaacggagagaatagatcgagatatgcaatggaaccaatacctattacggatgcacacttgtgatttgtattgtacacggtcactgtagccagcttaggttttctttcctagcaaaagactaatcgttctatgcagctgtccgatcggacacaatttttctctaaaaaggaaagagaaagagtccttatctacgatgaattctccttatatatattttttattttattttacttcaattaatatggaaatttttagacgttgagagttaacgtggaggcttctttttatattatttattaagttgatagatttttaattcccaattttgctatttttaaattgtatttctatattgactctattttcttttttctcgattaatatgagaatttttaggcatgagagcaaatatggagacttctttttctattactttaataagataatagttattttaaaatatgacttattttttttatatttgcactaatttttcaaataagacgaatgatcaaacattgcaagcaaaaagtcaaagcgaccattaatttaggacggaggtagtagtgatcaattcacttatacctcatcatcagtgcgccctactttgtactccctctatcttaaaatataaggattttctggataggctagaatgtatcacatctctttaaaatttcttgtattttgagacggagggagtagttagctagtgatctatttgccttggcgaactgtgtacattacatcggcgataataacatagcaattatatactctctccgtactcgtaaaggaagtcatttaggacaatgtttaagtcaaaccttaggaatataaatcatgaataactctcaagttgttgaatttgaaaatgtaaaaaattatatgaatatatttgtcttgaaaaatactttcataaaaatatacatatatcactttttaataaatatttttatagaaataaaaagttaaaattgtattttagagaccgtgttactgtcctaaaggattttttttttacgattacggaggtagtatatgccacaaggactacgtactttaaggtctaagctaatactagcagtacactgctgctgcctgctaccatcatcgttgcctgcatcagaggcagcagctacttgggtcttgaattgcgtcttcgtgaacctacgtcctcctgccgctgggaagaggaacagaagaagtgcaagcaagcaaataaacaaagaggaaagagggaagttttaattgtgctttttattttttgctttttttttctgtcttgctgcaggggaatagtagtggataaaaaaaagtagacatagctaggcaggaaatttactggcaaagcggtatataggtgaggtggtcgccgtcccttccttaatctggaagcctgccttttcaccgaacaccaaactaatttattaaccaacatgttgatactatatatatgctgaaataatttaatattacagcctataggttacttgtatatcgtgctagttgatgtcatggattaattttgcacaagtacgtatacgtagtgctcgcttgcgtagttgctttggccctggtccaatgagaggaatagaggtaaaaaggatccatcatcgaatgatcgcggccgggggcctgccggggtgggacaatggcagatgggtagctattagccaggtagttaagggcttggtcagttcattgcccaaaaaaaaaaaacttaccattcgttcgtatgccaaatttaataatgttaaaattttgaaaaaaaaaataaagatgtgaaggtagtgtttagtttgacaccttgccattggtagtggtgcaatttttgatataattttgtgagtagaagtttctaaaattacaaaatgttagtaggaattgacaaaattgtgatggtaaaatatcatttagtttaggaaaaagtacgaattagctcctgaaccacaaaaccagacttccttaccaataacttatgcaacagacaaataatcctcatggctcaatctgcggtagttttggtcctacgaggcagtccagtcaacattttttttaaaaaaaaaaatcggctgccctcacctgtcagtttctcaccctctttatctctacctattttatttctttccccaatcccctttatctcttctccctcccctaacctccatcactcactggcactgaggacggcggtaggaggggacggaggtagctgtgtggcgatggagggggagccgaggacggcggcgggcggtggcggagggggagctgaggaaggtggcgagcaggggcgtgttgggaaattttatgtcttggcatggaaatcgagaggaaatcccacacgattgttttccacccgctacctgtgggattaacgcgattaatttgtgattatttccataattacgtgattacgtgcattgatcggtagcactaaatctttccatgttttggattgcccccgactccctcagtgccatattaataggggagaccagtttcgtggaaagatgacgatctctccacgaacatcttctcgaaaaacctaaaaccctatccgatcagttgagcattggagggagaacgtgcggctgttccgggacagcgtagatggtgaccggaaggccgctgctaccccacaagtgatcgccggcaaccccttcgggatcaagctgctacgactacttccgctacgccgacgatcactggagcagttcgaaggacttcgtcctctacttccactttgactgacggcattgcagagggaacaaggagaagcacatcaatggcttcaaacaacggtcagtaaccctaagaattccgcagtagggtgatcatgtttaggataaccagtcatgttagtatatcacaaattctagagggtggagctagctgggagcggcggagggggagccaagggcgacatcagaactccacccgagcgagctctgcctccttcgccagccgcccgagttcgctatgcctccgcctctatctccaccgccggctactcgagcaagctctgcctccgtcgttggtcacccgagagagagagagagagagagagagagtagggggattggagagggattttgttgagggagagggatgacgggtaggtccagagaggttatttattttctttgctgactagattactacgttggctacgtgtggaagctcaagtgaaaatcgctcagaacaatgttaagggtggttatttttccgatatgaatagacgagggtgtaaaatgtctgttatttgagtttatgggataattcgatcggccgtgatagtttagggggtgattcgtactctctcattttagtttattgcttttaacaataccaaaaattagtatggttgatttttccacatgtaggtggactttcaacaagactttagtgaaatcagggaaatgtgcttgtttctgtttcttagagcatgtgtcaggggacgcatttacgggtgtgtgagtgtggtgttgtgtgtgtagtgatgtgtgcgcctatgtgtctgcagtgtaattaaaaaaagttgggactagctatatttatggcgtcatatttttcatcaaaaaatagtcggtatgtatttacattgtaaatctctaaattacatatgtaattttagtatatttatagtgtaagtcctaaaattacatataattacatatctaggtcttaaaattacatatgtaaatcccaaaattacatatgtaagtgatgtgtaagtggggtgtaactagtatttaaatttgtataaaaacataattacaacaacaaaattgactgctacaaaaccatagcaattccggatcaacaaataaagtaaaaaaattgcaaagggataaacaggtggagaaacggatatgcatcgtgcacacgatgtccagcgcagcgcatcccagccgttaaaattcgactgtactcagccacataatgtggcgacactttttcagcaaatccgaaaaagtttagtgtggttgattttgacagcaaactttaacaagtcctaacatcctagatcttcactataggtctatagctcgtgcgaaacgggcgtagaaaaaagtaatcgaagaaggggctagcttagctgcgtcgcggtcacgagctaggcggcaatttggttggcgaaattggacatatattcgacgagaaaacgacccccggcgaccgagatgtgatggacgcgacccgcgcgcggccggccccctctccctgtactgtctgaccgaccgaccggccgcccccgcccctctccgtgtcgatcgcaaaactagagatcatcatgcataccgatgaacgacttgaagctccgatcgatataacgacccatcgcggttacgtgctggaacgggcatgcacatcagatcaatctatcgtccatcacccggggggtggctagtgtggcttctagtctactactagtactagtagtagtaccctgaatgacacgacgtacgcccgtactgcaccctcgcgttatatagctggccgtagcggaaaacgcgatcgcgatcgcgatcgcgagatggacgatgtgcgtgagtgcggcgaggaaaaaaaaatgagaagacgatgtggctgggtcgtcggtgtcaaagagctataagagcatcgctttcagcgagcacggggttgtcccctcccgtgtcgcctgcgtgtgtccccctgccgcggcaaggcgctgccgctgtgtcaaccacgtccccctcatctcccccccccgctaccgcccgcccgcccgcccgcgcatgcattcacccaaccacgaacgtacgtacgtagagtacgactacacacgccgctagcctaactgctccctccgtaagtacctatttcctcatgtttaggccggataagttcaattacaacttcatttttcaacaccttttcaaagttatttttttattatgaggtaaaattcataaaactgcatatatttcttcaaaactgtcaatttgttataactttagcgcatattgggcaaaagaacgtataatgatagctaataattttataagagaactgcacactttgttggataggttaggtccattcttaaacattgtaaatactcacaagtttgcataagttgggtccatccttgaacgcgcatgtaaatactcacaagtgtataacatgagccccttacatgtcaaacacatatcacataagtgagataaggttatgtttttttttaaaaaaaatagtttgctattattgtagtattgtgaaatgtttatctaaagttactctaaggtactcctttctaactgcatcataccaccactactacatattcgatttttccgttcggtcaaaatggattttcccgtgcggaggtccagtccatctgcgccaggtgtctgcgaaaatcaacatttttatgtgcgggtggcccaaccgtgttacgtggtccgcactggataatcgattatccatgcgaaccgtcgatcacgtgacgaacgggtccgatcgatcattcgtcaggtgtgtgtgtgtgtgtgtatatatatatatatatatatatatatatatatatatatatatatatatatatatatatatatatatatatatatgtggatagatctgacggacgaacgcacactgttggttagcttcatttattccgagcgcgcacacatgattgatggctgtttggcatcgtatccatgatcgatcacacaagaggagcacgcacgctatctaaataaccaaagcttggtgtacaagcgggagaggggctcacacagggagattttggttgtggtggtggtggtggtgtcacatccgctgcactcgagtgcgtcccgtaccaaccaaacacgtccgctgtcatgggtggcaatctattgggcgatcgattagtttatgcttaacactaattgcactgctcccacaccttaatcgatcttcattaatcgctaacctttatgtcatgtctagctag

SEQ ID NO: 52554 - DNA, 960 bp, Oryza sativa
agtcagaagttcttaatttttcttctgtataagagagggcgtcgtgaccaataattaatttttgatgtacactcctataaatatgtttcagaaatgctagaagtattgcgaggactggattagtagtttttattgtcggaaaatgataataaccacccgtgccatttcagcctcgtgatgcatgaactgattgacagatcgatcgattagtcccaaaagcaagaaagcgattctgtctcaatttaatcgcgacataacctctctggctagctaaagctacaaagcttactaggacaatcaggcaggtaggcacacgctaaactcaaatgacccattatggtacgtacaactgaaaacgggctgggggaggacgaatatatgaacggtcctttaatttgcgccatctgatcgacgatcaatcagttgggttacggcctgtcgcgataatgctgccactgagtgcatgaaatccaattaagcgctgacaaagaaagaactcacgccatcgtgtatccaggccctacaccaattaatttagcactgctttgcaagaaactccatgagagaacttccagtgctcaccaaattatcatgtgtagactgaagcaagggcatgcaaacagcccacctgcagctgcctagctacattataatttataagaatttctcatttcaaatgttgcaattctgttaggaaaaagtacgaattaccacccaccaccgaactatcgtggtcgaccgaattaccctaataaacttgaaaaccagacatcattcaccctcaactttcaataccggacaattaccctcctcgacccaatccagatcggttttgttctacgtgacgtacgcgtggcaatccagtcagtattttatttattaaaaaatataggacccacctgtcatactcctcttcccctcttattctctctcttctctctcctatcttcctctctctcg

SEQ ID NO: 52555 - DNA, 2960 bp, Oryza sativa
gtccccgcgccgcgccatgagtgccggcgtgcgcgctactgcccaatgactgaccaagagagagagagaaagagggtgtatgacatgtgggtcctactattttttaaaaaataaaatgctaaccggattgccacgcatacgctacgtaggacaaaactgctctggattgggtcgaggagggtaatttgtctggtattgaaagttcagggtgaacgatgtctggttttcaggttcagggggtaattcggtcgaccgcgatagttcagggaggggggtaattcgtactttttccattctgttaccatatctctactattataaaaattgaatatgtttttatcggtactttggaacgtcatatgtgtatgagtcggtttttaagttcgttcacttttgaaaataagctcatcctctatgtaaatttgggaaatagctccttatccccgcacggccgctccctgtgcccgtagccattgtattctaattggttaggaccgaactacaagagagttcatctgatagcaccggagatagaagataagcttattggaactcaaactgtataatagatcataaggtcaagaatttctgagatatattttttaatttaccgtaacttttacgaaaaaaattactaaagtactttaggacagtgggtgagattcgtgctctcataagggtgttaacagtgcgtcgctcatatttgccgttcctcgcatgccacacagaccaagaacgtgttaagctacatgtttcacagtgcaagttgtttgtagtgggtctcaccggtaccatctttttcacttttgaactctccctctctcctctccttttttgttccccaccaaatgaagcccccccctctcctctctcttttcttcccctagcggaggaaccgaagctgacggcgggagagaagagcgacgacgccgacgctgagcggccctagcggtgctggtgccggcagcggagtgagggcggtgcgaggcgcgagcggcgacggaggcgccgggcggcccgagcggcggcggcgccgactacggatcaagctcgccgtcgccgaatcgacgtcggtttgtctccttcttctcttctcctccgccgtgcctcccctcctcctcctcctctggcgcgggagcgagggacagcgggggcagccgcgtgaaaccactgcgacctgccccacggcgccacccctcctctctccccgtgggcggcctctcccctctctcctctctcccattcttgacgtcatggaccacgaatatgggtcccacccgcgacgaggaacccgtggtcaaagttggctacacgatccttaagaaactgcacggatggagaatgtagcaaggaatattcgccttttggtatcgagactaaatgtcactgaggccactgtgaatggccttaaggcagtgaagtagtatatctgcgtacattaattgggggagagaacagttggggcattcgctgtcagggccggccttggggcagtgcggacggtacgaccgcactgggcctccaaaaattagaggcctctaaaatatgtatactataatatcaggcctaataggcttagaggaaagatagaaaaccgatcggcgatcgaggatatcgtgagtcgtgactgcttgattgtattttaaacttattagtgtgaaattcgttaatgacaatgactttttaaatattaccttgtatttttatagtgatttaggagcctttatttttttgttccgcaccgtaccgggccaccacaaagtcggggccggccctgttcgctgtgttgatttgaagcaggtgtcccgacaaagatttatattccatcatttcggagagagccgatatggtgagtgctgccgtctgcaagacgccgggtacaccgagggagagagcgacactagtgacaattcgaggcaccagccaaaggaataagttaactttggtccctttatttgtagcctagtctgattttcattccttaaccgtaaaatcaggtatgacctctcccccaacttacaaaaaccggggaaacatggtccctcggcggttttgaaggcggttttggttgatgtggcgcttacgtggcttgtttgactaagtctacgtcccacgtggcattttggcgcttatatggcaattatatctcggaaaaataataaaaagtgtggccccacatgtcagctgcacacaaaaaaataattttaaaatggtggggcccacgtgggccccacatgtcagcctcactcctctcttcttccctttcccctctctctctctctctctccttcccgggtagcggacggcgcgggtgggcggcagagcaggcgagctcctgcggcggcggcgggcgtggtccgcgccgccccccgaccggagtgccgccggtccgcgtgaaggcgaggagagggagagccgagaggggaaagggaatgacgaggaggaggacctccttgtcgggtccgcccggggcgccgccgcttttttctctggggcagtgctcgctggtggggagcccccgggaatccgacgccatcaacgccgccatccgtgtcgccgcggcggagagccgagagggggaagggaatgacaaggaggaggacttccttgtcgggtccgcccggggggccgccgctacgacggaggcagcggctgtcgcgccgccgatttcttctctggcgcagtgctcactgctggggaggccccctagaatccaacgccatcggcgctgccatccgtgtcgccaccgcgaagagccgagagggggaagggaatgacaaggaggaggacttccttgtcgggtccgcccggggtgccccgccgcggcggcggcggtggccgtcgcgccgccgccttcttctctggcgcagtgcttgctgctagggagcccccccagaatccgacaccatcgacgccgccatccgtgtcgccgctgcagagagccaagatgggaagggaat

SEQ ID NO: 52556 - DNA, 7706 bp, Oryza sativa
agccaagatggggaagggaatgacgaggaggaggacttccttgtcgggtctgcccggggcgccgccgccttcttctctggcgcagtgctcggtgctggggagccccctaaatccgatgccatcgacgccgcatccgtgtcgccgccgccgaccacccggacgccctcctctcgccgccgcttcctcctctctcgccgccaacgccaccacacgccgctccctcttctcccgccggcggccatcagggaggagggtggcggacggctaggcgagcggcgcaagagagagatgaccgccgccgcccgccgtactttacaccacccagcaagaggagggagcagagagatggggagagctggagagaggaggagagaggaggaagaagaggattggatttgatcatttgagaatgacatatggggcttacgtgggccccaccattttttttagctgacatgtgggacccatcatttttaaattattttttctgtggttgagatgtgggcctatgatttttattatttttccgagatataattgctacgtcagcgtcacatcaatgccacgtgggacgtagaactagtcaaacaagccacgtaagcgccacgtcagctaaaactgccgagggatctcgtttgcttgttttcgaaagttaggggatgggtcgtacccggttttgtagtcaaggatgaaaatcggattacgtgacgaatagagggacccaaagtgaatcccagccaaaccgtgtcacatctaatcctactcccaactcgacataagttatcagaaaatgagagatgggccgggccctaatgagctatacgagcaggccgataaacggtccgtaagtgggccgaggttacaaaatatgcgggcccgaacggaattccctcctctctcgttcttttccggttccttcttttccccgacgcagcgcccgcgtggggtggtgacatgggcggcggcggcgacgaaaggggagagtgggaggcggcggtgaggaagaaggtgggggtcggcgggtggtgggacgatcccgacggcgacgagctccgcgccaggttcaaggccttcacggggcagcgccgcgactggccccagcccaagctcctcttctggaagggcctcctcctccgcgtcgcgcgccgcctccgcctctgctccgcccccgcgcgcctcgtaagcgctcgacgcctcctcctcctcctcctcctcccgctcccaccctgcatccggttcgcttgctccctcctctgacaccgcggtggcgctgacaactgcaggtgctgggtgtttggttcgcgcgccctggtggcctcacgccgctgtgcttgccgcaggttctggtcagtatccacgacgatctcaccctatttgctgttaatttgttgccaaacgggggccaaaatttgtcgtcatttcaggaagagatgcgtgccgatggggagattctgctcaaatcggagctaatcgatccgactacagggagcttgtatcagctagtcaggaggatgagccagatggctgtcatctcaaagcagccgattgcgcaggacgacatcctcgtgtttaaatcgttgattgaggtatataagagtttctattttattttttttcatgtgattattgtgccagttctatcgttgtttatttggatatctgctagtcaattgcaggaacgggctgctgaaattgttgatcagctgaggaactctcattggacgtcaacgtgcattgttactattagtaaattcaatgccttcttccatgggcaggaggattctcatgttgcattatgttacttgacacaatgtgggaaagcacggtatattgttgataggaggcaagattctgttgaggtttgtgctctttgttgtccattatcagcaatttcattgcaggaagtgcattgtggtactttacttcatcccatttgtaccttcagggtgtgaagttttcgctcatggctgcacaagttcctgctgtctcaaagcttgaccacaacacattgcacttaattttgacggaagaaaagttgcagcagcagcttgatgtacttgatcgccaatggcaaatgttagtctactttccaactttgtttctgcaatttggatgcatgactagtgcgttataaaaggatatgccatgttcagacattggcgttctgttttagattgcatagaaacaaatagtgtacatttcaacagatactattgcataggacagttctaaacttggtactcaggagtgcagttatctttaagactatcacctgctgcatcgtttgtggtactgtttacttccttttgctagtttcgtttgttatgtaaaagactggcactacacattccattctaggtattatctaactttgtttcatgctaaatgaattgtctgttcacattgttggaaattatgctataattactgtgttttcccttctttatccccaagatgaggggacctattcataagtactaaataaaattatgtttctctaataattcgatgtaatgatagttcaagaaggagggcattggtatccttcaaatctggggataaacagtcagcttatcgatatgtgcggcagtctaagttgttctcagaaagcaggaaaagattcacaccactgctggagagggttgaagaagttataagcctaattgctagtgctgaaacaactaagaaggtatataacttttggggaaaaaatgtttactaaatattaacccttaaaaaaatggggatgctgcattcaccattattcattataccttgacattctctggttaggtaatgaaggcattcaaggcagtattcaggcgaataatgaacattatgtgagccgtaaagaaggtaaacaagcaccttaaaggaggtgatgacccttgttgcaacacacaagagaaattgatgctgcctttacgtgaggtttcatttttgttgttcttttacaaagaaattccagtttcccatccagcaagtttatattagacatgcaagataaggtggtctttttttcatgtggtgatgattttctttagggaaaaacaatatgcagtttttggtattctttgacctatgtattagatttagggctctgtgatgcaatggggaaaagatggaaaacttctgttattcccagccaccaagagaaatttgggaaagatcgcctattttttgacatatccaaaatcaacctagccaaacttgattcagctcaagttcccaaatccaactaacccacaagtccttgctcaagatctcaaatccagctcaatcccttgttttgcactcttgttgctgtcgacagaatgattgctggagtccacttgcatggtctctgccatcttctgcatgttcctcaccagatccactccacagctatacatggagtgaagaaagaagaggacatctaagaacatgcatgtttgtgtgcatacacacggctatgctaaatatgccaacatggctgcagtccgcagctggtccagtgctaacctcctcacaaactggccttacccaagctgctggatgaggcagaaccagaggttgaagaaggtgcaggtggtggagatgtgctggttgctgtggtggtcactgctagtaatctgttaattggatgcggtatacatgcccttctaccaattcaactggtgctgcagcaattagatcaaccatggtaataaagtgatagatggagcataatggaggagtctaggagtgctattgtagaaagactgcagtttagagtggtatgtttgcaaagggggtacagggtactaaaagggcaagtttccgttgttcttttggtggtattttcctgacgtgcattccttctggtgctacagaactaaaccttttgctatatatgtcttctcatctacagcatcaatttgtttccctctgtttgtaaaaggatttgtggatgtttgtttgttcttttcaaaattctgatttcaaatatttttcaggatcagtaatactccagtcaatggattctgaagaaaatatcgaggaagaattcatgaagctggaagcagaattgcaggatgagtttcctcacgttcaagaagatccagtttcacatgccaatgaagaatttcctaatgatgaagatgttgattcattgagcaataacctttcaaacattaaactcgaggccatctagattttcacttattaagtgctacttgtacatatcgtgatctagtcacatcttttgccccatcagtatgtgttgtatttcttatgacaatgttcctaccaaaacagaaattctctattgcagaaatattccttacagggttgccatgaatttgattttttttattctttgaacctcaacatttttgggatagtattttgcatgagtgtctgctatttgaaatctgcctgccctttaccatttgaagtgtatggttgccctctatgtttacttgtgttctgtgtaatgaaaccaaaagaaatatctggttcacatttcatactgcatctatcttaaaagctcgatccttgttactacggtatgaggtcatggaaatgatatatgtgcattttgataataaggcagatagatcagtatcttacatgatattgttttctgatttggcaggttcagaccttattatttcatgaagtgtgcttattataatgacatagccatattatgtgtcagctcatctgatcattgttgcaatatgaagggtggctgcgaagtatggaaggaccttaattcttaactatggaattgattggtcagtaaattgtttttctctgcgcgatactgacatacgagaaatggcttgctcctttacaagaaaggccagcaattgtaaatgtagaggcactgaagaatctgtctggctggtgagtctgttgaattaagtcttttttggtgggacctgttggattgaatctactttaatgtttttgtaacttgtttctttgtatgggatgagtgtggttggacccgggtgtaataggtgacccattttagttcaactaaaacaaactaagttctagttttgaactcctcaaaacgatatttggttcatttagttgacctaagatggggtcacctattacccatgtgtcgacccgcacccgtctcttgccagtgccaataattcgtcacaggttcaggatatgaacatatacccttcaactgactagtgtttagttgtgtcctttgaacgagtgtatcatgaaaaaacactagaagtttcctgtaagcaacggcattggagcatagttttctatctagtcagagagctggctaggaaacacactgtacttctgataacctaataagtactcctaataaatatcacatcagaaagttaggataaagcagtagttggatccaaaatagtttggaaatagaaaattgccatcaatgccagtttttgatgaattaagtttttggcaatgccaaccgaagagaacacagtttgttgtaaatagttttggatgctaaacacaataaacatatgtaaaaggtgctataacatttattttgtaacaatcgtgttagttcaagtcgtaacaatattcctcgtcaaatttcaaactgtaggagtccaaaatcaaaatgtgtatctggcaagatacaatgacatgttgttgtgtttctgactctggattcagctaatcctggtaacagcaactttggactattacaatatatatagatagtgtgtgcaagtaatttatgagtgcccatttccatgtttgtgaaaacattgtgagggggcttctaaaattatccagacttggtctagaagtgttgatgtgaaacttatcctgaactttgtggttctgtttgaacattggaaagaatcttgacaagcaggaaatcaatctgattaactgtgtaaggtgattgtgattgttgtgcccatcacagtatacctctgggtttggttccaataatatctagaataaagacaatagagttctcttatcatgtgcatgtccaaggccaactatcacaacatgaaatgtttcccaggccccatttcttgggctggacccactccagtccttgaatatatattaacatcaatgttgccgttctcatacatcactgtccacaatttccccatactgtagatgatcagggcatacatagttgctgacagacttaaagatgacatcttgagatcgaactaagctaactgtacgcattcaatggaaagtaaaatataggtcataggaaaggagaggtggagaagaaaagagaagcatacgataagctggcaacagtgaataatcttgcaaggcgaagcatttccttattttgagaggagcaaaagatccttcaatgggcgatctgaagataggactgaaaactgacgacaacacatatgtctgaaatttcattataagaacttgaattattggaggggaactttgcttgtgctttctccacatgcaaggatgcatgaatctatcagatgcctgtccacaccagtcttcaaagctacgtcatatcaggaataaaataggagaggaaagcaatcttgttcctccattaagtgttacaataatgctagataccacatctagcttatcctcttacacatgttactgtagaacgatgtgcttgggtaatgaaaaccgtacaattcaagatgtcagggcaaatgaaccagtaacctgtcaaacttgtggagtacaacgaggtgagtactttgttccttttaggcaaaaacggtatactttaagactctggattggtgcagcattttagttgtatctttcatctttgatttcctgcattgtactacctggttacttgttgacatctgagcttattttagtactatgctgcttaattgtattataacgataacacggccactgattgtttaatgcttgtttccttaagggctaacaaactaagctgacggatgaagtcaacagactgatgcaaacatgtaatcaagcatatgtaaaatatgctcatgattgagctttttgcatgtttctgcagtagcatgtgtccttgtaaccgaacaacatacttttttagaaaaaaaatgaaacagcgtactgatttatcctttgtctgttgtatggctaactagtaggctgcaattctcaggtaaattctctattttctagacgtctcatatagtcatatgtctgataaatatgcatttgttctgtgtggttgctaaatccttccctgatgtccggttatattgaactgacatttcactgttagcataattttcagggttgtgatgatatatctccatgttcatataatttgtagaagaaagtgcttctaagtctgttccttctagcactgcaaataatctgaccaaacttgtaagcataaacaactgtgtcataataattcatcattatttgcaccagaaagcgctgtacagtaacagcggtgcaagttaaaccgcgtggagaccaagggatcccaggctcccagtatacagtcataagataaccatggaaaataagatatattggtccaagatttcagatagggcaaaaactactcataggaaactgcactggaagtcaagaattacagcttgtaacctggtagcatcttctaccatctacattttacacaaaattttggggcatcttggctgatacatctgcctcgtggatcttgatactcaagtaagttctcccagtatgaattgctaactttcatatctggaaggtgttagttg

SEQ ID NO: 52557 - DNA, 2176 bp, Oryza sativa
tagttgataagataggaagtgttaaaggcctcataatagcattttagcatagtctaatattgagattatatttttatatcggtgtactcagtatgttgagtccccccaactttttgtttctggatccgcccctggaagctagtgatgctacaattgaacatgattagtagtatatggttctattggagagaaaaaacaattgctaaaaaatatccactatagtttttcacttccaaaacattcaaacttctaatggttgattgcctcgagatccatgcagaagagggggaaaaatagctagtgcgtgcatcttcaagggtttctacttcatgaaaaacttacccgactagccaacaggccacgttacatttgtaattacactttactatagtatagttacatttgaatgattttcttaaaaaaaactgttgaatgttatatagctaataaaaaaatctttggcaaagcacagtcaagctagcttcccatgcgtgcgtgaaaaggaggttgagattaagttattgtttgttactacttattttaggtgcgggtctaccaaagatatgtccctatgtatatattccagaaatcatatagatactaacttatacatcctcaacacatagatgcaccaaccggttttcaatgaataacatactttttaagcataatacatacacagatgcacatattcacgcatatactcacttatgtaaatgacacatgcgtacacatatttaaaacgatcccactaccacaaaattattcaaaggtaacactctattagtaccggttaaaaaaaacctagaacacaaccgctccgctcgcgccctctttagtgacagtactgaagcaaccagccgtgatgagaggtgccggtttaaatctaattggctagatgaccagggtgtttcctaaaatgccggtttatgccaccaatcggcatttatgacccccacttctgtgaccattttttctaataatcctacactaaaaaatgatcgagctgagctataagctaaaccaagcagtgaaaacatgttttaagtcctctcctctactcttccttaccatgttacccataaatttcttgtgatctccatctctccctcttgctctctcggtacctccttcttcctctctctctccacaatcaacagcttgtcatctcactagacaagctctattgcactgccaccgccggcgagtgaccaccccagaaaggctaaatcctacctctgacgtgcaatgacgttagcctctccctcaccaccgtcgggtgcctgcatcttcttattcacccacctctccccttatgagcctatctctccttcgcctgatccatatcctctccggcacataggaggcggcagcatggtggccataaacgatggccccgaagctccatctagccagatttagtggatggactgagggcacgccgggagcagtggcgggctgtgggtggagagggtagtagggctgtgtgggggggggggtgcaacggcgggtccatgtacaggcttggtccttggcaggaggaatgacatcaatatagctggaattttttgttgaaattgttgttcgatctattggatgaatattttgttaatgatctctgttggatattaaaattattgatttgttggagtaatttctatctattatttgtgattgaatttgttatgaatctagctatttgtgattgaatctgagattaatgttttgagaggttggttctgtgattgaatttgttatgaatctagctatgatggatcatctcgaatcaagccgagctgcctgttttttaaaaggaaaaagtatgaattacccccctgaactttcgcggtcgtctgaattaccccccccgaactacaaaaccggatattcttcaccctcaactatacataccggacgaaatacccccctcaatccaatccgcggtggttttggtctacgtggcatacacgtggcagtctagtcagcattctatttaaaaaaaattgtgggacccgcgtgtcagacactactctctctcactctcacttctctctgtcactcttcatctctctctccatcaccatctcacggcgagcgaggcatggtgcgagcgaggcggaggccgcgtgcggggacgggcggtgggcggtggcgcacgagggcgggcggtgggcgg

SEQ ID NO: 52558 - DNA, 18725 bp, Oryza sativa
agaagaagagaggaagagtggaggagtatgacatgcgggtcccactatttttaaaaaaatagaatgctgactggactgccatgtgtaagccacgtagaccaaaaccaccgcggattggattgaggggggtatttcgtccgtatgcatagttgggggtgaagaatatccggttttgtggtcgggggataattcggacgaccgcaaaagttcgggggtaattcgtactttttcctttttaaaaacatgtgtgcaaactcatccgtgctagttcaacaactagcactgttgcccacacaattagtgcgtaaacttaagtgacgtttagggaacctgcactaaggacgttttaaattcatacactccctctattttaaattaattgtggttcttttgtcctaagttaaatatttatatttttaactatcaacttttaaagtgattaaaatccacatactgttttaaattagttgtcgttctaattttgtcataagtcaaatatttatatctttaatcatcaatctttgataattagtgtagtttaatgacatgtaaatatatatattatgaacgtatttctcgtgatgactattaaaacagaaacattatgatgttaaactaagtttttttattgaaacagatagtcacacatacaaattaatgtctaacttaaggtaaaattaatttttttttcataatggaatgaaacattccgacctttgcttaaaagagctacagctaaaggtaaaattaattagaatcacaaataattcatttttgaaacggatcgagtaatctctcagccgcatgcgcgcgccttcggatttcatagtagcatcaattccatattatgaatgcacgtctaggtacagtttaacgaattacgcacgcgaggcccagccaaatagcgagcttttgattatttgacaatgatgtatggcaaaagagacgtagctatgagagctagtgcagtggcctctgaatagtacgtatacatagtactgtacgttgcagcgaaggttcacccgacggagagacgcgatggatcaccgatgctgacagccgctcgctggcttgctcgcggtcgcccgcggctaaatgcacacttgacacaggaccatatgatatttggcgcgcgctagttaatttctctgaccgatgatggacaaacagtcgctgttagctacttagacccgcgcgtgatcatcctcgtcgatacatgcacgtataactaatgagctagagctacagagacctagctatgctatgctatgcatcagccatggagagccaagagttttctctataggattgaataccattgcttcatattttgttagagtttattcaattttataaattttaatgggtttacatataaaaaaaggagacttgcaaatgcgtttatgaaaaagcaatgattcaattgatcaccacacaagcttatacatgtcttggtatgtttttgtcataagaaacccacacataccagctatttatattagccaagcctacatcaatgtgtgcttttatgtggacaagagaggcattgaaagatagcgaaagcagatgctttctggagtactcctctagctagcgtgtgtcttttatgggctcatgtattatatcacccaaccatactcaagcaatctcgatctctagagctaagatgtaatcgctaatggtgagtttggtggtactaggcaaatttcatcggatatggttgggattacctcaataacgaacgagaacacttgtaaattaagcgttgtgctccaccatcaactgtttattgtaaaaatgccatgcagttgtgctagcaccatggccccatgagaagttattggtggtgaagttggtatctaatagccggactatgtgtcgacatatgagcaccgacaaatgtgagaaatcacttgtccaagatggaccaaggctctgggtgcacttgtcttgtccaatagtgctcggaaaaagatgaacacatataacatatatataggtttaggcctcccgaaggtgacaaccggcttacacctgttcttgttcaccatatgcaaagttcgtacaaagtatgcgaagctctcgagctagctaaggttgtgttcgggagtgaccctccctggcacggaaaaaacaagatgggagagttgggaacaactctaaacgcaccgtttatcagtttaaaaatcgtgcgcgtggaaaacgagatggaagaattgggaacattagttctaaacgaacacagcctaagaagcctagagttcttgttgattataccgtccaatcatttctaccaatccctaaatactttctcttatagggatggagccatgcatcgccaatttcattgctgcatgcacttgttaatttgttaagcccacctagcccgaactatctgggggtacgtggctccgccgatgtagactctttaacattgttttcggctgatgtggctactctcgtagatattatgtactcctatattgcaagccaggtgtactatcaaacttgcttttatacacgtcaccatctatatggaggcaatcatgtaagcattgatcagcaccgttgaaacagtggacgcaagttaatcaactgattaaactcagcgaattttataatctaagtcaagttttgaatttttcaaacatgtataaattaaaccaaaatctgttccaattaaaactgcccaagggtaaaatcgtttttaaagtttcatctttccattaaaaatatgatgtattaaactaatagcctatgtatcttttactagtaattaaacaactaaaaaaaattagagtaagactccgtcccgaaaagagagaatttctagcgagaagagtttgtcccgtaaaaagacgacttctaaaaaaacaagaagcattcaaccgctgctgattacgaagtgactgctcagtcggctcattagcatcgatgggtgagaaaaaaattaaagacaactgcattcacacttgctggatactagtactactccagagtagcttctttatgggacggagggatacacattagcgcttcaagattggtggtgcacgggggaaatgaaaaccaatactccgtacttcgtactggcagaatggaacacatcatctctcttataaggcatagcgtgtcctaccgctgagctatcaacacttctttttttagttacattgactatagtacagtatagtatagcgtaactacatcataagggcatcctcaatatttgtggtgtagtgtaaccttaaggtgggccctatgaatagtgagtcattgttaaagccatacccacaatgttatggttagaatttagccataagatggacccacatagaatggaaaaataattgtttcatctcttgttcatgaagtgaatgagagagaaaaaatattttctttttgcttgtggtagaccttaaacataaggtgcaccctaaactaatgctactttccacaatgtatatagctcactttacaagtgcaatcattaccttaaggtcacctttttcatacattgtggttgccctaattatattatagttatataagtttttcactcataaaacttgcgaaagttttttaatataactgcatcataataatataatacttatatttgaaagtttttcactcgtaaaccttacgtttttagatagacctaaattatacatatggtggtgtttgaatctcttaaagataaagataaagatgaaaattaaatgtttcacgtaaaacgagatggtaatagcgtgtgattaattaagttttaatttttacaaacttggaaaatggattaatctgatagtattttagaacaactttcatattgaaagttttcgcacaaaacacaccgtttagcggtttaaaaagcgtgccacgaaaatccaaaacttaatccatccttttaattatagagttgagagagatctctcttgaacggggagttacatctttgatctaaccttttcatgtacaaacatgaccaaataattaacttgcatggagagctagtaagtcttaccggatatgataaactgaatttgatcacgacactgcccactactagtatactatacactaatatgtgtacatgtgtattatgcttagcacaacttaattaaatagagcaattaagaagtgtaacaagcatagcttctttagtttctgtccggtgtatgtatttcttttcaaaaataatatttaactttgaaaaataacttcttgcaaattaaatatgtgctcctagctcttgataatatatatcaagcactgcagaatagaacatatatatgtgacggattgtaaccctcacccattcatcacatacacttacactccacaattacatagactcatcttacataggaataaatcgccataaacttaaaataattaaaagtgacaagtctcaaaaccaaactgtgcatgtttctcgaaaagaggaccatcacattatgcgaagttaatttaaaattgaaagaagtaatattatgatttatgtaatgcacagttgaaacaagaatgttgtagttaaatgccacataattatttgtttgagacattttagaaacaataattgttctacacgaaaattgcagtagttctctctgtttcatacggaagctgccttgtctttcgaagatatgacttctgcaggtaagaagatatagctatatttatcctctaatagccgcaagatttatctctccaattaatgctcctaacttgtgccggtaaaagaataaagttagtatgttaaatgcaataatatcgcaaatttataaagcatagacataagcacaaatcacaaatttaacgaggtcaatatgatgaagttccacacatgtttcgcccaacctgttgatagcataagaagtcaatatgatgatagagggtaatgtaattttttggtataattaaattttgagacactcttcgtcttcagcgcctcctcccccgcctcgccgccgcctgagcgggcgctggcaaagccgtgcgcccgcaaagacggcggcggcggggcctctctccccttcgcgcccggcggctggggacgccgctcgtcggcgacggtggtgcccagatccgccatggctggccggatctgggggagcggcagtcggcggcggggaatgaaggtggcggcggtggacgacgcggcgcgggaggtggcggctggggacaccgctcgacggtggcgatgcccagatccgtgcggtgctggctagatctgggggagcggcagccggcggcgaggaaggaaggtggcggcggtggacgacgcggcggcgctagagttggcggctgcggctggtggcgactgcggctggttggcatccgcgtcggtgactgcggctgccgacggcggtagaggacggcggcggctgactgctggcgaggaggcggctggtgacgaggcggcggttgctatggtgactgctgaggcggtgacggtggcggcggctactgatgcaccggttggcgacgaggcggcggctggcgagctgtggcggcgagcggatggctgctgtggtggcagctggtgaggcagcgccgcggcggtggcggccgtgtctggcggcggcgactgccgacggtggcggatgcggcgacggggaaggtgtggagaagtaggcatggcggcggggacggatgcggtacgggggtacgaacgcggtgttgacgaccggaaacgggcgttgatgaccgcgaaagggcggcggtggcggtggaaggaggcatggcggcctcagacagctagtcgagggcgtggcagacggctgcatttggccggcgcggcaatggttggaggagggtcggaaaccggcttggcgcagaaaggcgcaccgatggtagcggaggccggctcggcgcgagaggcgcgggcggtggagatggaggtcggcttggcgccaaaggcccggccggtggtgggaagccggatttaccccaaggcgcgtccggtgaagaagcccggcttggcgcgaaaggcgcggccggcggtgaaggaggcgaccttggtgcgaggaggagctgccggtgaatgtggcgcggtcttcggtgcacgaaggctggccggcgggggcgccggtgcagtggtcccacatgtcggcagaggttgactggtggtggagcatcggtgcatcagccgtggattcgcaggtgttgagcagcgggtgaaaacctagcccggccttggccgggcttgcaacgatggttaattccccctcctgagggcgttgtcgtgctgtctcatccctcacgggtggttgccgggcgaaagcccagtcttggctcctttgagccctgacggacgggggcggcggttttccgtcgcttctcttcttgaagacgtcgttttgacatcccctagccgaagcctctcgatcggtgcaagcatgctttaggagttggctttgcgttggttctgagggtgttcttttgggggatctcgtctgtattcctttgtcgtctagcggcggccggtcacgcttagcggtggccggtccggtgttagccttctcccggttatgtgtcttggcgctgtcggtgtgtgggtggcggtatatttttttctttttccttgttacgaccctccagggttgtaatcttgtaattttttcctgctctatcaatagaacttcgcaccgtcttgtgcgagtcgttcaaaaaaaataaaaaaaatttgagacattttacggtgcttggaaggtatcctgggtaccttcatgtctaataaatattcaccgttgatcataaaaggtaaattaggaataaaaataacttgaatatgggtaatttggtaattgtttacaggcatgttaatcattagctctgtcgggcctgcggcaacaactccctattttagcgcgctcgttctagttcctaatccttattcatgtgtttcagcgtttgtttaactgtatattgctgatccaaaattataattctttctgctgtgccgctgtcccagaatcgtctaggaccctatcacgtatttcctcatccattcatctatgtacacacgagagacgaatacctatcaatcctcgttagtgagagagaaatcaatccctgtttgtgaagccttcgatgataatcagcttatgattaatttggtgagttgtaattggacacggaatactcgacgaatcgattactagagtttagttttatatcagttgtacgatcaccatgcatctcagtttggccgccggacgaaacaagaaaacaccgtacgtgatagaagaagctatcagtttacacaccttttgaagcgatggggagaaatttacttatctaacctcccaccaaaacttttaagttaatacctggcccacactttaatacctttccatcagtaccttctatcttagattgtcagattataggcaatgaacggatctcatttatccccagcaccggagaaaatctaataaattttatgtactaaatgtacacgtaatttgatttttttaagtaaaaatagtatatgacttctaaaattaaaaaatgtcttctaagttctaataataaatggagtattcagcagcatgcaaattggagcctacaccacaatccattggattctggcagttggcatataggtgggtgcggcttcacatcgatctccaatacaggtcgatatatacaactagttatcatggacaaaaaatatcatgtagtatgaaccataattttattatgtagaaatttgaaaagaacattcgataaaggtattttaaaaatataaaaaacaatctcatataaaagggaatatgttattattacctttccttttaaatatatgacaccactgacttttcttcatttgaatattcgtcctttctagaaaatttgtacaaatagacaaacatacaagacacactcaaaatacttttgatcataggtctagtagtacttatttcactttgcttaactaaattattgaatagatagtagtgatgaaagtttgagaaaaaaatcaattgtgccatatatttaattaaaaccggagggagcatcatagacaagacaaccatacaaattaaattccagtatcaaactcgaccatgttagtgaaaacactattcctgatttttcagcttttgattcattgtttgtcaattttatctcactagctagccttgaaattttatatgactatacaatgtcatcttacctacatttataattttgaaagaaaatattctgtgaatgtggttttatatatgatctttccactgatgtatatatatttacccgctatcatggtctcaataactgatgaagtaccggttaacacatgattaatggcacgtaagcagaaacacatacacacgaaagatttgctcaaatatgagtttttgggaaattcatcgcaattttacatggagtagaaaatttccaccacttggttacaactgggctacacacatatacttcagctaatttaattgggttgtgagactaatagctggagtgcgtgtaaacgtacgtggggcgatcgaaagatacaaatcaagggcgtgattagccgacgatgctgactactcacgtcactaattgggtagttgcatcctaattaagcagcgctaggtactgtttaattgctcttgactcttctcgattatttatcactcgacagtccctttgcctttcagttgtggtcaccgtggtgtagcatcctggggcccctccggatttacatggatacgtacgtagaaaattaattaatgtacatgctacgtacgtgctcgtatctacgtatatatgctagctttctctatcttcttattccttttcttctcctgctgcaacggttggtaagctctcttcgaatatgtcttttaaagatgttctttttttctaaataaaaatatattatgcatgtataaaatttatatcatgatcacttaatgacattagtagccgtcatggatataaacttcttaaatatataaaataaactttttcaatatgtatagaagcaagtgatgtactcctggtcgacaatcaagctagctaattgggtgatgatctagttaaatagatacggccacctcaagttttattgtggggctaagctagccacccatacctttttattttaacggtctacacactaatagccattcccacatatctagaatcgtgattaaaaaattactccctccgtttcaaaatctttgacaccgttgactttttagcacatgtttgactgttcgtcttattcaaaataatttatgaaatatgtaaaactatatgtgtacatgaaagtatatttaacaatgaatcaaatgatataaaaagaataaataattacttaaattttttgaataagacgaatggtcaaacacgtactaacaagtcaacggtgtcaaacattttgaaatggagggagtattagattgtcctagccgctcacataaagaaaaactgaaaccaatcatatcaaggaatcaaaagggttaacccgtaaacatgagccctaacccatacaagcctgtaacatattaccaacatacattattcacttatttatatatctccttatcaccaaactaataataagtatagttgtgtccatattatcatctcacatggaaacaatgatggacatatttttttctttcccgagtgcgctactttaactatactttcttttaacctctccctctcacattgtcttggtgtattcaatttattattatctttcataagatattgtctttcaaacgtttttctctttccacaacattctttatccttggcaatactctatttaattcaatgcaaacactaacccaagttatagcattaagtgtgtcttaaacctctcttctaattgttattctttagcttatcacctcatttgaaatactcgaactcttttttttatcacgatacttcttggaagtttttgtcacctccaagtcgttatttatatgtacccaaagtaatatgcatcattgacatgagtaatacactaagaatcatccatcttattctagaaagtatatcctagtgtatctactctcttgtttggttcttaaccaccatgtggctcttcaagctcgatttgttcacctaacatcctaggccccgcaagaccttggttttcttaaccaagttcaaaccacaccactgatgaaaaagttggctccagtgccaccaagtagtcaaatctaggttctaagttcttcatacttgaccatgtccatcaaaatatgtatcatggagtccaatgtaacatatataacatatggagaaaccttaaacaaagctagatcctcaaacctaaatcctggtatataattaccaacctaaggacaacttgacaagcataatatcatttgatcaactactgatcaagccaacaccaatctaaatgacaactgatggtctccttagacgaggactatatagccaacataaatacaatgggccaacactagccaggtccgattacaacccttgccgacaaaacatggtgagaacagatctagtacaactcaaatctttggcaattgttcataaacactacatcgtccctttcaacatactatcacatccctccttctctatacaaagtgtacgcaattaattcttcatggtgataggtgtgaccatgacaacagtgaatgacaaaaagagaaaggtgaaagagaatcactacaccatgtcccaaaattggtgtcagatggctgttgaaaaagaattgacgttagcttcaaacgatctgtcatgaaaagctcagtgtcagatggtctgtcagtagttcttttttaaaagacagactgtctatcggcaatgctactgaaagcgaattcctagcacggcccctaactagttttacggaaagatttatgcaaaagtagcttgaatctcataataaaataaggttaagaagcgaattcctagcctctagccatgaagttgggaaaaccaattcccgactacatggctagttaatacgttacattgggtactctgacatgaccaattttggcatagtcaatcgaccctccagcacctaactaatccaatagtaccaagtgttcccggccaaggttataagacctggtgatagttaggcttaacgtaataggatgaaaagaaacgactgcaaccagtagcgatatgagaaaacatgatcaacagacaatattgcgcattggatatgtataaaaacttacataaattaatgcatggggatgataggatcattacaacactggtcgagaaccaggtgtatagtcataccctaaccactcgtagaggtggtaggaggatcgctactacgctagtcgaggaccaagtgtagtcgtacctcacccactcgtagaggaggtgtgaggatcgcacattggtcgagaaccaggtgtctactcgtacctcgaccactcgcaatggtggctcgaggatcgatacaatgttggtcgaggaccatgttgtagtcggacctaaccactcgtagaggcagctcgagaatcactacaacgctggtcgaggacaggttgtagttgcacccgaccactcattgaggtggctcgagtattattacaacgttggtcaaggaccaggttgtagtcgcaaccgaccactcgtagaggcagctcgagaatcgctacaacgttagtcgaggaccaggttgtagttgcacccaaccacttgtagaggtggctcgaggatcgctacaatgctggttgaggaccaggttttagtcgtacctgtacctacgcaccactattgtcgggctatacccacggatggtatttctagagtatggggatcgttggaaccagggtatacacgagattgaggtaaaaaggatggagacatggatttttatacaggttcaggccccttaactgacaggtaatagccctactccaattggctgaagccggtgttgcccttatatatcagtatcacattacaatatttgggatgacctaatctagtttttatcagcttggtgacatggagctctaacacgtagttgatagctagtgtagtcttcttccttgaacattaattcaatgagattggagatagatctagatccctcacgtcggtctctgtggctcctacattagatttatctaaatctatattggcttgtcttttgttggtatgtaccctctcatcctaagggttcttatattatagcaaagatcatcttcctctccaaatagaacttagagaaacagaacaacatacggactaaatagaccttatcttccccgaccaggactctaacaccttctattacgggaagataatttcgttctttatccgccgtatttccttagtcaaagataccttctcgtatactattaggtatatggtatttccgtattccgtgaaaacccatgtattggaggcatgccttatccttgacattgacagggataaacccattgtatcacccaaaaaatattgtgtttgtttacaaaaacacccatatcaactccaatattgtgtacaatacccctctcaactatcaaaaccattcactttaccgctggttccaaactaaggtggtatcaccatgcttatgtggtgtctagtcaacccaagaaagatttaaaataggaaacatatgttaacgcctattcatctttgtcaaactccatctctcccatcttccctcgagcctatcatgagctcataggtgttggccaccctccatgagctagccacctactcagctgtcgtctcactctaaaagctagctattgcggtgcgtatcctccttgaaaaaaaaaacatgtgccaatagtgatgatatccaagctaggggtgagagagagagaaagagcaggtcaagatcagtgctcgtggttgcctttcgaggtgattgcctaactaatacagttggattagggaatatgaggcaggtaaagtgaccttgagctcaaccacaactccaagcttgaggaacagagcccaaggcatgcagtataggtggagtggaggggccttggaagattcggtggcagagctagcgagagctctttgatttggtggcggtggaagcggaaatcttgtgcagagcactattttccatcatttgtttctctggtcacaacgatggccaagacccctgtcctctatggcagcgcgctctatatttatgtggtcttcgtcgaggcagcaacttctcgtgaccaacgagtagggagctaggtaggagagcatcaacaactcgactaatttgccatttgctgccaaattagtggagacaggttgggtttcgactttggctccatcgcatcccgagatccatgagaatgaggaaaacatcaatcttagcttgaggacgagaaggacatttattcaccgactgtggtcactatggctcaaggagacggtggagcttttgtgtcgtctctgtgttatcaccatcgaggggagaaggatagaagggatggaggaggaagatcaagtggttagtaaaaggaggggcctatagtttttactgtaagcaccaggtaggtaaaagatgaagtgaacaatttcaatagttgagggggggggtattatatccggtattggagttgaagggtgcttttaatacaaaggcaatagtgacttatcctttcacagaaattctttacgccctagatttttcgctcaatccataatatacctaaaattttcttcatcccttacgtgctctcaagtattcattttgatccttccatacctactatgttggttggccatcatatcttcttcaaataactatatttcccttggcatatagaatttgtggacaatgcatttggaattgatttaaactttgtttaaattcactaaaaaagccaaatgttatttttaaattcatgatgaaaatactgtaagttatagtgattaagatgttttcaaatcaatgttttgatattggtatgaggctttcaatttagagttgtgagccaaaggccatatggtcatttagaggaaaaatataacggtcaactaataggattgacaggaaggtgattaaaatgataactcaggaatgtacggaatgaagcaaaacttaagagtaaaagagaggactgagaaaataatagtagtgcataaggattattctctatattttaattacgctggaaccttttcaaaggatgacattttaaaacttgaagactttaagttttacattttacagtgtaaatgtcaatactattaaggtctttcttttttcataaaatttatgggaccaggtgactccacaactattacatggctccgcctctaggtacttcgtatgtgaaacaattcaattttttgtttacatgttgaatacatatattctaactttaaagttgaagtttcattttggaaatttacattttaattagtctggctaccaaactctccttatcactggatttctttatttagtttttcaagcatagtagattaggttggagcgtgctctctctctataactacatactcctccggtcataacaatattttgagtgttaaggataagatttgattacacttttgaaacattagttattaatatattctcatatgcttagtttacagaaaatggtataggaagatttatcttgaaaaatacatcctatataatatcataaacttattgatattatagctagattaaagtttatgacgaaatattgtcttaaatattaaatatttaattatgatcggaaagagtacttagggatataggtggtgagacatttttttgaatttgatatcctgttgccagctattaaatcctcacaagatgttagacaatttcacgcaaaagggattctaccaaaaaaaaggttgggtacgatggcccgctaaacaaattgttctcagctctcaaccaagctctaatacatactttccccatattttaatgtatgacgccgttgattttttattcaacgtttgactattcgtcttatccaaaaagtttatgtaattatcatttattttattgttacttgattcatcatcaaatattctttaagcatgatataaatattttcatatttgcaaaaaaagtttaaataaaatgaatggtcaaacgttggttaaaaagtcaacggtgttatacgttaaaatacggatggagtatatggcgaggacagggtgtagcaactaccaacaaaaccgtcgctcatgagaaaatgtgtatacgtgtgtgggcatgcatacgtacatatggccagctagcaatgaaaagagaacaaaaaggtgacaacgacccactatgacttatatataggtcatggacaaactaattaattaacacgtttcatctcttttttcttctccttgatctttttcttcctcgttgcaccacgtaaataattaaactcgtaaaaaatagctgcatattttcctttaattatttgcagtttaattctagagtgatagcaagatgttgatacacacaaacacacacataattcaccataagtgcacatcatatcgtgttagttggcaacttggcatgcacatcatggccccctgctaggtttcttagcttcctacctcactaattaagcatgggtgtgttaacttcactattataattaactatatggaaacctgtatgttactggctgactgcgaagaatttatacggtgaaatactacattatagctgaggtacagttcgggctccatttgaaatgcaagaatttcacaggaaaaaacttaatttccatgaaaacaagaaaaatttcctatgttctaaacgagactagatttttctagctttagacaaacaaataggttttacaattaactgtgtatacaatctgcacctatattggaacaaaacttacaaaaactaaaatggaaaaaagtctatatccccccccatcccctattttaaactcttgatataagtccgtcatactctcaactttaaaatcggatatccaaccccataaattttataatactgttcaaaatatcctgtaaggtggttttttttaatatttgggagcttaattaatgagcgggtttaaataactgatatagcatgtttacatgtcgtcaatcatcgattattaatttatattctatgatgatgtcatattagtattatattaacatatgtttataagtgagcaaaaaataggggtaaaaataaaagatttgaagattttaacatatatgtccaattcatatatcatgtaaccaaactcatccaacatatatgcaaatcagaccattctgcaaaattagcttatggtgttacataaatggtactgtcactattgggaaaacaatttttgtagacaaggtgcatcgatctttctaggcgggtaaatattgttttcaccatctgtccgcctgcaaaataggggacgggggtcgaggtggccatccgcctgcgaagatcaatcttcccaggcaatgacataaggtggggaatagctacaaacgagggagaagttgctagtgcatatatactggacggtaatactctgcacacatatttatttaaaacaatacctgcaatatataactaattccttctatgtgtatgtcatgaagtatcaccagtaacctaaaggcagtgtcctttgcggatattacacatgcgagttccttagggttaatgggagatacatgaccaacgtagagaatgtacgtctcaactcaacatataagtcctgcgaagatggaatgcacatctaatatactcatgctttcatgcatgcaattgcttagaatcgaacatcgaactagttttgacgacgaagccattataaacatacaacgtgacctctgccactttatccaccacgagtgttgtcataaagatggacttttcttcgaccccgaaggcagcttagcgatgagcgacgaatacaagtccctttaggagtggagccacatgcttgtgtaattaagggaatgacagtattgtaaataacacttttgcactaattaatgcatccaatatatgtgtattatatcctcattatatgtttgttagctgctagatgtatttatgtactaattaattaactaattgcaatattactgattaaaaattagtatttaaaaaatttacggaaatatttaattttggagtgaatattttcctaggcggccgtaatgaacgccaagctacacattatcgtaaacggcatattgtggctatgtccacatagaaagattcattttgcaggcggactatttaagaggtccgcctgcggagatggatcttcctaggcggactggccgtccgctcacgaaaatgggtgattttagcaggcatttacctacaggaggaccggccgtctgcttgagaagaccaattttaaatgcctgcaaaaatagttttcctagtagtatgtatagttcaaggggttgaatatccggttttaaagtttcaggctgttagatggactttcaatcaaaattttgggggtatttaaaatttttctaactaaaaataattaaaatgatatgggttcataagaaaatagagaacaatatcgactttgtcagctaagtttcaccaccttttttatagcaaatgtttcatatactacaatttttttaacgaatcgacgcaccgccaatttcattgaataatgtttcatatactataatggttaccgtggttatgagatgtggtacactttctttctttagtcgccagccttccctgtcatattaattctcatttctacggcgagcacaagatatatcctaccataatttctgcatacatctcataaaagtaccatggaagttttctgaaagcatatatgtgtgccctaccaacggcgtcccgttgcatatgccaatatatccggccatagtatatagtcccaagaacatgacgccaagacggaaccggccgttccgttttgttgttggcttaatttggtccagccatatgcatatatagcgtgtgcacacgcactgttgctttcaatctgtgctcccacatatatttctagagtactgcatgtagctagctcgatcagggaccatcttgttattacatgctaagtgctacaataatatagctcttaaatgcctcttaaaattttcgttatcgtacgtcagccgttgcattcagatcaagctgtgaccggttgtggcaaaggaggtagtttttagttagtttaattttttgcttgaaatgaaaattttaggttattaaaacggaacagcatgagctaacaaaaatattttcatttcagaaaactcctttcaggtctagttgatttctcccgacgccaaatatttttaactaggaggagtaacattttgggatgcaggaattttataagacttttttttgtagaaaagctcaatcaattctgataaaatttctctaaaattcttctgattcaaacaaatgtggctgaacttatgaatcaaaattgcaatttgggtttcccagagtgtacagtacaactaacaactttgattctctcaaagaaagaaaagaaaagagtgtaaaacttggaacacaagcgaccgaatgcaagttaagcaaagttaagcattgagattaatcattgcagtcaccagggaaggttgggccatgaagtgggacccacagaaaatgccttgtttgtcaaacctgctttttcccgtgacccccttccaatagaaaccttgcaaatggcctttcttttttcatcaggtccgcttctctaatccgaatgcctttaattattggggccctcgattaatgg

SEQ ID NO: 52559 - DNA, 2733 bp, Oryza sativa
  unsure (1)..(2733): unsure at all n locations
ctagagcaagagaaggaagctctgaaagaaattgtggtgataatgagtgatagctaagtccatgaatgactaaaaacctccacttattaagagaatacattgtcaaaaacaattagcaattgcatgcacaactgtttatcataattgcaaggtgaccccgacaacacacaacctactgtaatcttcatgtacacacataaacaaatactataattttattatcatcaggtcagtctaaaggtgcagaaaatctccagaaaagaacaagggaagcttcggagcatcatgaaaaggccgaattgtacagatcgtccggattataaaatgtacaattccatataatagtttctgcgcctgtttaatcagaagggtatccacaatcacatgggcaccaagaggtgccattgtatcttccaatcatcaagtcaagaatcaaacctttttctttcaggcatccaagcaaggataagaaataaaattgcctgggttagccacctcatcgagattattatacctccactgttctgtttgcaaaccaagcatcatctggagttttcggcattataaccataaaaaattttaacaacaagcacacttctctccataataatcagaccaatgctactaaacatgtgccctggtgttattgggatttgcttctgagcgagaatacggccagtgaggaaatcatgctgtttgtaactctgcaaaagcaatcatcagcataggcctggttctcacagctgattgcttagcatcttgagaggtgccagagatgatcttcttggattggagcacagatttgtgattggaactcagaggtcctaaagaaaaacaacatagctggctgcttgagataaagaaaagggaagattctttctgtcctgggatacaaacattagttgccgcccctcgatgattgatgcaaagctttctccaggtaagaagtgatccactgactttcctgaaaaataaaggtgaaacatggtatgtactttagcctggcacagcatttgaagataagaggtacagaagcttataaacatgcagatatactataaatctaaggatagatgcaagcaaactgggttttaatgagaatcacaaaaaaaaagagagaacttcaccaacagtgcgctttccctgcatggaatactcatgacgcagaggttgctgagggaaaaaaaagctcatagtagcagcgatggactagctgctgcaggtcgcattcaataatcacacgagaaacaacattaatccttttccaaattatgtaactttgacaaaacatcctttacttttaactggcttgtgcaaaaagtaacatacctgatatgtagaggaagggtgagctatcaagagttccctctaacaaaaaggctgcggtaattaagtcacagtaatctattatataattaaaggaatagaaaaaggagcctccacgttcgctctcatggcctaaaaattctcacattaatcggagaaaaagaaaaagcagagtccatatagaaatacaatttagaaatagcttaaattcggaattaaaaaataaggaatattagaagaggagaccggagtccatatagaaatacaattaggaaatagctgaaattcggaattaaaaaataaggaatattagaagaggagaccggagtccatatagaaatacaattaggaaataactgaaattcggaattaaaaataaggaatattagaagtagagtatagagtccatgtagaaatacaattaggaaataactgaaattcggaattaaaaataaggaatattagaagtagagtatagagtctatatagaaacttaaaactaactaaaatttggaataaacataataaaattaaaagtagagtttagagtccgtataaaaatacaatttacaaatagttaaaattcgaaattaagaaaaaatgggaagaagagtttaatgctaatataggaattcgaaattaaaaattaaataatattgaaagatgagtttagagtccacatagaaatataattagaaataataaaatttcagaaataaaaataaataatattagaagaagaacatatagtctatatagaaatacaatttacagaaaaaagaaatattaaaaaacgagtctagagtccatataggaatatatataatttacaaataactaaaattttatcttaaaaataattaataactaacacgtatataaaatgcaatatgaatattacacattagtagttttgtaaagttattgcaaaatttaaaattatgttgttattttaatatatttgaataatataatgagaaaacatatatgctattatatgagagaaaatataatgatgctagccgcgcaatctgcgcgggccatcatgctagttagaatgtaaagagacaagtggaggtacaaccccaccgacgttttgtaacggacaaagattcttagggggatgataagacaggagcccacgcacgcacacgcttaagagaacaaagggaagaaagctcccacaaccaccagctttaaaagaaggggcaaatggggagggaggcctgcaaagaaaaggagaagagtgccctctaacctacctatgccttcctccaaaatcctgatatcttgagccacttgttgctgccactctgccatnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 52560 - DNA, 1104 bp, Oryza sativa
gccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagtgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccactcaggtggcattcattaatcgtgcataaattgagggcaggtagaaggtagagtttctcgaacgggaagtctaacctacatctaactagggaagtgctttgtatttgaggatgtgcggaatctggggttct

SEQ ID NO: 52561 - DNA, 775 bp, Oryza sativa
tcatggccaacttcttttcccatgggcataaagagacaggcgcggagtcggctaatgaacctgccacccgcgtcggtccactcctgggaagatttgtgccaacagttcaccatgaacttccaaggcacatatccgcgcccaggcgaagaagcggacttgcatgcggtacagcgaggcgatgatgagtcgcttcgctcgtacattcagcggttttgccaagtccgcaatactatactgacggagctcgtggctcctcaccgggagaccgcgcaggcccccctttgccagttcggccgggggcttagggtgaaatctcaagctctcgctctccctctgtatctggaaagatcgtctgcccgcaagacacacgagacacggtgatgtatacaggttcgggccgctgcgaagcgtaataccctactcctgtgtttttgtggatttgtgtatgaatgagctccaaagtgtcagccaacttcttccccgttctaagctctaaatctggaaagaatcaaaacccctcctctatgggcaaggtcctccttttatacttcaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctggctgtcgatgacgcgaccagtgccagaccggtcattcttgtccaccacgcgtcagcctaaca

SEQ ID NO: 52562 - DNA, 6588 bp, Oryza sativa
ttttggcgtcccggaggcctcactaacaaagtagaccggccgcttcacctttccgcggggccgatcctcttcgctaggggccgtatctccagggcgctcttcatccgagaggcagcgcggggcgccctcggcttctgcgccgatatcctcggggtaagagggcgacaggcgcggccttcccgcagtggcccgaggctatcctgagggtcgggggcgcctgacaccgtcggacaagcaggcggagggccaactccggccgtcgggggccttgggccgccgttcggcttgggggcctctcggaccctgacttctccccgtgggtagcgctggaagagttcccttccggaaccgaggacggcgcacgcgcgcaggtccgggacgccgccgaccacatcgtccacagcttcgagggtatggcccctcggctcgcgttcgccctcgactccgacgaggagggcggcgacggtggtgcggacgacagcgacgacaaggctggtgacccgggcgcgtcggagtgagcccccaggcccccgccaatcttgaatagctttttctttcttcttccgaggccttcgggcccccttcttgtatagacttatttaatctgcaaccaaataaagaggaaatttctatgtcaattctatttgttgtgtgtatgagacgaggatggtctgtgccgcggtccttctgcgtcttggcttgatcaagggctcgtgcccaggtcctagtcctcaaatggctcgggtcggggctagtgcctggggagatccacatgtcgagactggccaggccgggagcgtggtgaccgagggttatgggtgacccgattgtgggtttttgccgattcccccccggagttcaccacgccccggggcacggctcggttctgggccccgtttggcgattttagccgacccgagcccccgaggacaggatcgagcacgagcgtgctaattcaagccaagattcttcaaaaggaaacaatggcacagacatcgtccttaggaaatcgaaaatgcttttattgaaatacggaagagaaaaaagataagcccccggccaaccctgcacgcccggggggggtgcggggttggcccgagcccaagacctgacacccgacccccactaggggtagaagcgacgagggtgttcgatgttccacgggttaggcagctctgtgccgtcacccgtggccagccgaacggagcccggccgggggacgccgatcactcgatacggaccctcccacattggtgagagcttgctcaatccagcacgcgtttggacgcggcgtaggacgaggtcgtcgacgtagagtgatcgggcccggacgtggcgctgatggtagcgccgcaggctctgctggtagcgcgcggcttggagggccgcgcgccgccttcgctcttccaagtagtcgaggtcaaggagcgccggccttctttctgtcgctcgcaggcctcccctttcgggtggccagcgaaacgccctcgacggcgaggacatgaccctcgtcgtcggaatgggccgacctcttcttcctcctcctgtcccgccgccctgtctgagcagcggatccgggggcggccgaagctgccactccgggaccggaggggttccaggtccatgcctcctcctttcgagccactcggtccgcaagctgaaaaagctccgcggtagtctggggctctttggaggcaatcttttcgagcatgcggttgtgccgcacaccccccctgaacgcgtagatcaccgcgtgtgcagggatgcatggtatggtgttgcggacttgacagaaccgctgaatatacgagcgaagcgactcatcatcgcctcgctgtaccgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcagtggggttgacgctcccatcgtacttctcggtgatggtgggccggaaccttgggggccaacggacattccgaagactcgccacaaaggctctacagccgacaccacccgccgggggcacggagggctggtcctcacgtccgtgtcgaggtgacactctggacgaggaagcgccctccgttgcgcggggagtacgccggctattacgccggcgctcgatgtcgaggcgggcatccggctctccatgctgatcctcccgagtcgaaggtgccgacgagggagtggcagccgaatggcgtgcaacagccgccgctcgccgcgccctccgccttgatgacacggagccggtggtagcggcgccggaggtcttggtggtggcggaccgtccaccagcacccaggcgctgctgtgccgtcatgaccaagttggccacgtcgtccagccatcgttgggctggagactccgggtcatggacgacgggcgggtgtcgtaggagcgcgccagcagcctgaagcgcgccctgaggcgtgctgccgtcgccgtagacgaggaggcgacgctccccatctcgccgttctcctgcatcacctgcgactggtgatgctacggatttgtcgaccctctcaagcgcctccccctgcttagggctttggtgcggaggaggtgggggagtacgagctcgacggcgtggattcggctccccgtcgtcgccgctcacactcggagagaggtcgtgcgcttttccttgctcggccattaggctgaacaagaaaaacttggcgcacacggaagagtctgagagctcagaaaacacacgctgagccccctacctggcgcgccagatgacggagctcgtggctcctcaccgggagaccgcgcaggcccccctttgccagttcggccgggggcttagggtgaaatctcaagctctcgctctccctctgtatctggaaagatcgtctgcccgcaagacacacgagacacggtgatgtatacaggttcgggccgctgcgaagcgtaataccctactcctgtgtttttgtggatttgtgtatgaatgagctccaaagtgtcagccaacttcttccccgttctaagctctaaatctggaaagaatcaaaacccctcctctatgggcaaggtcctccttttatacttcaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgaccccccccctcgggggaaatcaggaggagggcggacacctcaccctcgggcccgacgtccccgaagtgccaggccacgtgggcgattgcgtctgcctcaagcctctggtcatgatactcccggtcccatatcaccgacatataccatgcatccctgcacacgcggtgatctatgcgttcagggggggtgtgcggcacaaccgcatgcttgaaaagattgcctccaaaaagccccagactaccgcagagctttttcagctcgcggaccgagtggcttcgtaagggaggaggcctggacctgaaactcctccggttccggagtggccagcttcggccgcccccggatccgccgctcagacagggcggcgtgacaggaggaggaagaagaggccggaccgttccggcgacgagggtcatgtcctcgccgtcgagggcgctccgcgggccactcgaaaggggaggcctgcgagcgacaaaaagaacgaggctggtacacccagcagggagcgcctcgccggcagatggtgctctgtccacaacacctccctccacaatctcgcgaactgtcgtgcggtcaaaaacctggccgagcgaacgaggaaatgggaggaggacaggaggcaggaacgccgtgagggcaagtccccggcggttccttccggcaaacggcgaagtgaggccaagcagaaggcccccgctgttgacatcgatgatggtgatgatgacctaggtttccaagaacctggggccaccattgccaccgtcgatggaggagcatgtgctcacgtctctcgacggagcttcaaggctatgaagcgagagcttctggccatggcccctacccatgaggcgatgcgtcgggcgcggtggtcggaggttgctctcactttcgaccagaccgaccacccaccgtgcattgcccggggagggcaggttgcgatggtggtttcccccaccatctgcaacgtgaagttgggacgtgtcctcatagatggaggagcggctctcaacatcctttcccccgcggcctttgatgctatcaaggccccggggatggtgctccagccgtctcaaccgatcatcggtgtgacgccggggcacacgtggccattaggtcacatcgacctaccggtcaccttcggtggacccgccaacttccgcacggagcgggtgagcttcgatgtggcggacctcagtctgccctacaacgcggtcctagggagacccgcgttggtgaagttcatggcggcggtccactacgcctacctccagatgaagatgccgggccccggtggccccatctctgtctgtggcgaccttaaagtcgcgcttgcttgcatggagcagcgcgcggaccgcctcgctgctgcgtccaagcccgagggtggtgacgagaggcttggcccctctgcccccaccgccccgaggcagcggatggccacatgcgacgaggtcccggtcaaggaggttgccttgggcgacggcccatccaagaccacacggattggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaagccccggaacgtcaagccttcatccgcgaggaggtggctagacttttggaggccgggttcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatattctggttaccatcagattcgcatggctaggaaggatgaggaaaaaactgcgttcattacccccgtaggaacctattgttatacatcaatgcccttcgggttaaagaatgcaggtcctacttttcagcgtactactcgaatttctttgggtagccaaataggacgtaatgttgaggcgtatgtcgatgacttggttgtaaaaacgcgcaaccaagagaccttactctcagatctagcggaaacttttgagaacctccgctccgcccgcataaaactgaaccccgataagtgcgtgtttggtgtacctgcgggcaagcttctcgggtttttggtctctgcccgaggcattgaggtcaaccccgagaagatacgagctatagagcggatccgcccccccagcaaacttagggatgtgcagtgcgtcactggttgcatggccgccctaagtcgtttcatatcaaggctgggagagaaggcgcttcccttgtttaagctcctcaagcgctcggggccgttcacttggacggaggaagctgaacatgcccttactaagttaaaggcatatctcagctctaaaccctaaaccctaaaccctaaacgctaatcccagtcctcgaaaagcgcgggtcggggctagtgcctggggagatccgcatgtcgagactggccaggccgggaacgtggtgaccgagggttatgggtgacccgattgtgggtttttcccgaatcccccccggaagttccccacgccccggggcccggttgggttttgggcccggtttggcgattttagctgaccgaaccgcgccccc

SEQ ID NO: 52563 - DNA, 3000 bp, Oryza sativa
gaacctgtatacatcaccgtgtctcgtgtgtcttgcgggcagacgatctttccagatacagagggagagcgagagcttgagatttcaccctaagcccccggccgaactggcaaaggggggcctgcgcggtctcccggtgagaagccacgagctccgtcatctggcgcggtcgtggaagaatggagacctgctggagacgcaagtcagcccctccgtcatcggcggcgctcgcccgcgccgtcgtggcccttaggggctctctcctctgaggccccgacccccatcataatggttagaatggaggcgcggtcgggatcgctgcagagggggaggatctcctgaggaatgcgagacacctccgcggagctaagattcagcaccctttggaccacgatcttgaagtcctcgggagcccaatcccatctggctccctggtgggtccgcatgtagtcttcaggcccagtgtactcccaggcgctccgggcgcgccgttggagcggcgcaatccggcggcggaggtaatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgcttcgttggcgaggggggtgtagaaccagtcgctcttccagtcgtcccacttcttgcgaagggcgcaggggatgtagcggttcaacaccggcccccgcggctggaagtagcagccgccaaccaccgacggcggtgacaccgactgcacggtgaagaaccaccggaacagctgaagagaggggcgcaccccgatgaacatctcgcacagatgcgcgaagatggccaatgtcatcaccgcattgggggtgaggtgcgccatctggaggtcatagaactccaggacatccatgaagaaatgagaaaatggcgggactagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcattcacgatgcgggaaggcggtagtgcactgccgtcgagcagagcagagccccgtgccatggcggcggaggaagagatgattgagaacgagcgcgtgtggcgaaagtagggcgtagcagagaaagagttagagctcaggtggcgaaggcaagaggaacaatggcgaaaggaaggaagcaaatccttttctcgatgcttttatacccttgccatcgctgggcctgactcctcgtttctcgcgcccactacctcgctccctcgtatctcgctatctcgctccctcgtttcccgtgcccacgcttccactaatcccattcgcccgcttacggcgcattgagtggatatgcggttgtggcaatcgaaatggattgtatcgtgcgcgcgttaattacgctcgccgaccgaagcggcgttaccatatctccgggcgagacgaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcacagggtggcgtcacacctgaccgcttcccatgggaagggaaattgctctggcataacgccgggggctactgtcggtgatatgggaccgggagtatcatgactagaggcttaaggcagacacaatcgcccacgtggcctggcaccttcggggacgtcgggcccgagggtgaggtgtccgccctcctcctgatttcccccgagggggggggtcgggttgcgcttgccccggccccgagggccgaggcaccccgacccccttaaggaagtctgcgccacacatatgggataagtgagcacagctgtgctcacctaacagcatttattgcagtctggtcaagcgtgtcacgctgtatgcagcgcagtacggcgcgttcctttatccggtctgtgaccagtcacagaccggtcagatcacgggttaggtggcgactggcggtctgacgcacgccttgccccatcccgtcaagacgaaagcctctaggcaactcgtctcaagccggagctagcgtgttatctcttagagatggcacgttagccctggttagatttataccaggcttcatcctaaccattacaggcaaggtgttacacgaagaagggcaaacatgcatcttgttaaactgacacatggtggacaagaatgaccagtctgacactggtcgcgtcagcaacgggcagccacgatcccacgttgcgcccgtctccgccgggagtggaggtaggtgtgggctgtcccatcgaagtgtcattcggacggcgaccataccaatctccgtccataaagagaggaaaagtccagtttggaaagaagagggtgcatgtggtatccccttgaagtataaaaggaggaccttgcccatagagaagggggattgattctttccagatttagagcttagaacggggaagaagttggctcacactttggagctcattcatacacaaatccacaaaaacacaggagtagggtattacgcttcgcagcggcccgaacctgtatacatcaccgtgtctcgtgtgtcttgcgggcagacgatctttccagatacagagggagagcgagagcttgagatttcaccctaagcccccggccgaactggcaaaggggggcctgcgcggtctcccggtgaggagccacgagctccgtcatctggcgcggtcgtggaagaatggagacctgctggagacgcaagtcagcccctccgtcatcggcggcgctcgcccgcgccgtcgtggccttatagggctctctcctctgaggccccgacccccatcataatggttagaatgga

SEQ ID NO: 52564 - DNA, 2470 bp, Oryza sativa
ggtggacaagaatgaccagtctgacattggtcgcgtcagcaacgggcaaccacgatcccacgttgcgcccgtctccgccgggagtggaggtaggtgtgggctgtcccatcgaagtgtcattcggacagcgaccataccaatctccgtccataaagagaggaaaagtccagtttggaaagaagagggtgcatgtggtatccccttgaagtataaaagaaggaccttgcccatagagaagggggattgattctttccagatttagagcttagaacggggaagaagttggctcacactttggagctcattcatacccaaatccacaaaaacacaggagtagggtattacgcttcgcagcggcccgaacctgtatacatcaccgtgtctcgtgtgtcttgcgggcagacgatctttccagatacagaggagagcgagagcttgagatttcaccctaagcccccggccgaactggcaaaggggggcctgcgcggtctcccggtgaggagccacgagctccgtcatgggtctttagccactaaataatctggaaaaagctcttctagaggagattattagattatagtaatctggcttatagattataataatatagcataataatctacttatttgtttcagcttactcctaataatccagattataataatcctaagctgaatcaaacagagcctatatttactttagcaaaaaactcgatgcatgcaccatccccactatttactagccaatagcaaatcaagatattgcatatgggttataagagcaggtacaatagcaggctataagccagctataaacatattttaaagagattaataaagagagagaagagcagaagggtactgatctgtagccagctacaacacggacttcaatacgtaatgtgtgtatgacaggtgggaccaggtattaatagtatagtaagcaactattgtatgaatcggttattacattggctatagatgaataggagctagtagtgggctgcactattgaccttgctctaaatacttgtgtgcatggatgcatgcatcaatgtccatttactccaatgcacaaataacgaatagacttaatgaatgaacacaaatatgtagatcatttagaaataatttgaaaaaaactatatgtagatcaatttggaatggagggagtatatagatcaatttgaaatggagggagtaccacatactctaccaaattgttttcttcagacaaacatggcatcaaacatggaaaataagacggtgactttctttcaccgtgtaccaactttccaattaattctcagcacaagctgtttcacactaaatctcctgaatgaatgctggctgttttgaagatgccatgtggtaatcacaatgaggaaagcagctaaacacaccacacactgaaatagcactatttcagcaaatgtagcacatgcatctacacctactagaaaaagactgagcaaactgttactatctttcggcagtcaccagcaacactatgaggttgcagctcaagcggtcaacaaccagagtagctcaatgccaggaataaaacaactggaaaatgcctaaattgttggagctaacaaagtaacaacaaaatcaaaccacagaagacagcaggttatatggaccatttatgaaacaagacagcaagtaggtttaatactagatatgaagatactacttcgtagtagaaaggaacagagcatccaaaaggaagtcagagtcattaggcatcatgattcatgaacagacaatctcttgttcccagtgaagatagctagaaaatataaggatgaaaagagatacagttggacaagacaacactatccatttgaagaattgacgaagcatgatagtgaagcacaaaaatttctgaacattgaccatcaataggctgtaagtaaattacattagtagaatacaaacactgaaatgactagagttgaaaagcaaccacattggttgctacaaacaatcgaagctctaactatcccaattcccaaatgctcattcaagtaacaaattctcttgctcatcattgaataggcaaaccaaagatatatgatatttgaattgtaatgttacattgttacctgaacaatctgctatatgtacaaattaagcagcaattttgctatgcctacaaacaataatactcatcatatctttcttgatattatctactacttacacaaaatcatcaagcaaaaggtagcaaaaagatgcaggtgatgatcaatttccaaatcataccaccattatcatctagtagcaatggcatcggggtggccatcttccgatctccagctcgtgatctggctcctcaggctgcgggtgaagacagaggaggaggatctcctcccacccgtgaggaataatctcctgaatctgcagttgcatcatgatgcctaaagcatgcaaacatgttgcgaaacaagcgtgggatgatgc

SEQ ID NO: 52565 - DNA, 4283 bp, Oryza sativa
ggaaattaaatatttaccatttttaaaatgtgccatttaataatttatcactcatatctacttattataaaaattgaatatgtttttgccaatactttgatacgccatccgtgtattagttagtttttaagttcatttgattttggaaatgcatattcatgtttgagtcgggttctaagtttgtcctttttggaaatatgcaacgaggcgcgcaagatatctctttaaaaactcacatactaacttgagatgatcggattcctagttgcaactcatgattttctatatatatatatccaagcaaattcctatagtgaatttcaccttaactaaatcgtataacaataataaaattaaaataatcttcaccaattgcaacgtacgtgcattttttctaagtattatgtgacatatgtgtcttcatgtatatatgatatttgggttaagtgatgccacatgtaaaagtgacagatagttaaatatctcatacttgtagccaggtgtcgaaaacaagatttatttgtgctttttttttccctatacctctgttcaatactccatctttccatcttaagatcacattttccgaacttgtaaaccgtgcatattacctattatttttaaaaaagtttataggaatttgcttttaaaaattatattaatctacctttcaatatttttagctattaattaattaattatgtgttaatgagtcgctttatttgacatacatctagggggagaaatcccatattctctagactaacacagctttaattggaaaaaaaaacacatatactccatctttgaaagaatgtacttttgaacttaatttttgtctcgcaaataccatatttttaaaagctactagtgtacatatcggagcaagaagcttctctagcggaaagacaatataccctttcttgagagttcaatcatgttgcaagttccaagctcatggtcgggcgcgtgagaaagaaagtgaagacatgtggcttatacaggttagggccactgagaaacataataccctactccaatgttcttgcgctatacataatgattaaatttacattggaagaggatgtacccttcttcacacagtcaatggttacgaatggtcaaatgttacgcgaaaaagttaatggtgtgttatctagagcggttgttagcgcagtggtagtgtgttatcttttttttcaagggaaatagtgtgttatctcttaggaagcaaaaggtttgaatcctcctacctacgcatgcttcggaatcctgatcaaatctaatggtctaaaatttaacaaattttcttcagaatttctgtcgagatgtatctagcaaaatgataaattaaaaatttataatggacaccaaaataaaaatgttgaatagcatattactggaggtagcaaatgtcaaccctcaaaatgaggaaagagcaaaaagaggaaaaggagcgccatatccacatccattacggattgcagtagcagcaaggcaaatttgcgtttctttctgttttaagcaaaaagagatgggaggtgcgtgtgctccccatgtgcgcaaccgcaaaaccctaggcccccaaacccctcggcgagatcccatccgtccatcgcctcatccgacggcccagacctcgccggccgttgtacttaacgcagccgcaatccacttctctcgtctcttctcttgtcacaacacaatactgcagtgcactgtaaaagaaaggaaagggaaggaagaaaaagcttttgttcatctgctcctttccccccctcaaatccctcccaaatcccaactaatcgcccgatttatcagcccattcctcgcgcaaatccgctccgttagcttctcgccggctattcaaccttggggccatcttttttggggttaaatttggtccagagttgaggctttttctttcgggaggagggatttgggtagcaatggcttgtccaatcgtggagatgtctcggttctagtcgccaaaaccatctagaatccactagtgttttgggaggtcgctgttgcgggagcagccgccgccttttgtgtgtgtggagtggagatggtgaccgagatggcgatgcgaggtgagccgtggcggcgccaggagggggagcaggcgcaggcggaggccgatcgggaacgcgagctggacctcttccgcagcggctccgcgccgcccacggtcgagggctccatgggcgcgctccacgccgccgccgccgccgacgtgttcctggaggacgagctccgggccgacccggcctaccactcctactactactccaacggcaacatcaaccctcgcctcccgccgccgctgctgtccaaggaggactggcgtccgcgcagcgccttcgccccggcttgggtgggatcgacgacgggaggaagcccagaggtggaggtggaggccgcggcggcggcggcgctggagggatgggtccaggggatggcctcattgggatgcccggtctcgagattggccgccagaatagcttctccggtatctttcaggtggtgcttcttctacactagaacaacttatcctatcttatttaactgccattgcattgcttgcacctaagctttcatgacttgattatgtcagtggttcacgcagtagatgtcgagtacaagcattggcataggagttttattacttttggttccttttttcgttcattcaagtagatgagttcgtttgagtcaatgttcatgtctaaattttttaccagggtatacgcttctctgctgcttttactgttacggagttagattggtttattgtgattgataactccaatagttgagttagattggtttattgtgactgataactccaatagttctccaccttcatagctactttgtatgataaaacctcaagttctggctgacgtttgctaggttttggcactataaaacgcctttctgtcgcaaaagtattggtcctgaaacttcgtaagttgtcgaccaatatgctatttgcagccaaaattgttgtgttactgccttgttgtttgttaccacattcttggatctgtacccattccctatgctatgtttgtctcggtcatctgagtaatgtgatctgtacatggttagggagatgctgaatttagcatgcatacacaaaattggtctagattccacggaagctgcataatattcaggaaatattttctgcagtatatttcgttacaagtagatggaaatggttctgagaaagcttcccttgccacacatgctagaatagtgcagtatgataattggccagcaaatgtcatatttatatcttcttctgtttttttttgcaataaagtttatatcattattgtattgatattcggtgcaacatgtattggttggcttctaaaactgctatctagggatgtggcatcgcatttcttgccaaatgcactgcatcatgattacaattattatcttacattgacatgtaggtcatttcccgtatacgtgtgcggattgtataaaatagggtagatcttaactctcaagggaatttaattactcttttcttcagttataattctattcaaggctaaagaaataacttctgacctatatatgatgcaggatgactcgtatcaacacgatacggatagacagggtgccaactgcaatggtacagacttgttgagttcttctaaagtgcagtatggtctacatcgtgagactggagctattagtggccttcactcagacagcaaagcaccatgcttgccagaaaaccagaatgaatcatcacactcatatgcatcaataataggatcatcactttcaagaagtgcatctccagatcctgaactagtgaggagagttcctagtccttgcctccccccaattggtgtgaaacttggtgctacagataagaagaataatgttggttcatcttctttcaattgtagttctcccaatattattgaatctgatgatttggtgtctgctctatctggtatgaacctgtcgtcatcaagagcaatgaacggaaacacaatggaccaatctaagctccatcaggatgtggatgatgttcgtaagttcctttttgatcagtacatggatcaaacaaatggcaatcagcgccattcctacatgaaacgttctgaacaaggacacgtgaaggttcctcaagaatattctggggcttctatgaatccttctgttatgagaagccagatcaatgctggtggtttcacatcatttaacaactcatcggtgggatctggctttgcttctcctaggcttgg

SEQ ID NO: 52566 - DNA, 5467 bp, Oryza sativa
ccactgtatgttcagttccttcgggcagcagaaattgctgcccttgcagctaactgtgaggatcctttgatggatagggctaatctaggaggttcttacatggatctatttggccctcagaaggcgtaccttagtccattgcttcagtcacagaagcaatatagttactacgggaatctcggggttggtcttggctatgctggtaactctttaacaagtcctattcttccctcgtcaccaggtggacctggtagtccacttaggcacggggatcgcagcatgcgctatccatctgggatgagaaattttggtggttcctttggctcctggaattcagatctcggtggtaagatggaggccaatttagttccatcacttctggaagaatttaagagcaacaaaagcaaatcatatgagctctctgaaatcgctggtcatgttgttgagttcaggtactccttctcagtggattaatatgtttctgtataacccactaaattttaaggatatgtggtagaatggggaaaattgaaatatatagaaaacccccataccatattggatagcgctaactttcatatattagttctagattggaggattcagtgattgcatgaaagatgtttaatattggtaactgcttcattccataattgttggaagagctatgtacacagatctctcatctttattggtctaatctttttttttttttggtttacattcagtgcggatcaatatggaagtagattcatacagcaaaagcttgaaacagccagcactgaagaaaaagacatggtttttgctgaaatcatgcctcaggctctcacattgatgactgatgtctttggaaactatgttgttcagaaggtactgataacatttttttgtcagtataatagccatcatgattttacccgctgacagtaatcctttgaaccagttttttgagcatgggagctcagctcagataaaggagttggctgatcagctaattggacgtgtcttagcactcagcctccaaatgtatggttgccgagttatacagaaggtgcagataatttgaaaacccatctgttggttcttgaattaaacccataatgatcattttgcttagtcaaatatattttacttttccaagtaggcaagtactaataataaaaaacttttacaatctgatcacatggatcccttagcaacctatattgtggacaaaagagagtacaagttacctagttgtcagcaaaactcttggtttgcaaggcatgacagattgaatttatatttatacatgtgtgtcgattcctattcatcggtctttgacatataatgcatctctggttatctaagtgcatattggcaaccacaggcatgcttgatcttatccagttatttgtgtccatgcacatatacccttatatattgcatgaagggctcaaaggtgcagcaaataagatgtttaactgatgttatggacaatattcatgcaggccatagaagttgttgatttagatcagcagactaaaatggttgctgagcttgatggacaagtgatgcgctgtgtacgtgatcaaaatggaaatcacgttatacagaaatgtattgaatgcattccacagcatgctatccagttcattgtttcaaccttctatggtcaagttgtgatgctatcaactcatccatatggttgtcgggtgatacaggtacacttgtagtgccacagcatgctatccgttgattgcttcaatatccagtctattcatgctacttcatagctacactaacctttgtcatgcaaattcactggacgcaaagggtgctggagcattgtgatgatcctaaaacccagcaaatcatgatggatgagatcctacaatctgtttgcttgctggctacagaccagtatggtaactatgttgtccaggtcagtgacaaaattttcctttttgtttttatgggatttgccctgtcagcacctgtaactgtagccgcttgctaaaaaaagggtttctgtacttgaaatactgactactacatagatactgcccaaatgccatcaattacatgtaagagattcttaatatttctttagcactgtgatgtgcaaacatggttatattaaattatttcaaccactttctatgacatgtctagatattagagataggatttttatgaggaaagctcagtttgcttggaccttgccgaactgtgtttccccaagagtaatacactcgctcagttgaacatgcttttccttccccttttccaccttaagctattttgcatttatgtatagggtgaacgatgaaaatagtttgcatatactgtgattgattgatcagtggaatttagcagttgtgcaagtagacatgataagcctggaatgttgatgcatgtgcttctttcccctcatttgctctctcactgcaaaaggcgttttctctcttcaataaccaaccttatttgacagcatgttctggaacatggcaaaccccacgagagatctgctattattgagaagttgattgggcagatagtacaaatgagccagcaaaagtttgcttcaaatgtcattgagaagtgtttagcctttgggaatcctgtggagcgtcaagtcctgattggtgaaatgcttggctccagtaatgagagcgaacatcttgaggtttgtgtctgttttaacttgtgggcatatttcgttatttctatgcggtacagttttgcaacatctctgcttctcagaaaattaagcactaatatgaaaagttgatggtccttgctaaaagtgacttgtctttttgtttgaaatctgaaggtgatgatgaaagatcaatttgcaaactatgtggtacagaaggtgttagagacctgtgatgatcagcagagagagatgatccttacaaggataaaagctcatctgaacacactgaagaaatatacttacgggaagcatatagtggcacgcgtggaaaagctcgtcgcagccggaggtacgggacataacacaaagagagataagttttgtgtgactaggatatgatgatttgttatatataacacaaagctgtttttgtgtgtgcgcaaaaaagcggcttgggcttcaaccatcaactgcagcttgaagaataagcgctatctagttgtacagctaacagtggctaggtttgcactggcgtcatgtttttctatctaaaccaacccctactagtacgaggctctgttctgaatggccttgttagaaataaagagagagagtagtagcttgcaccggagagtgtacattctgtagctgaggaactagcacaagggagggagataaaaagaatcttcatgtgtaccgtgtactatgagttctcaaactgtgtaaaaagaggaggagcaaggtgtacaaattttttagaactagagcgaaagagagggctgttgttagctgttttattaaacttttaaaaagccagtcactagtacttttttctttttgaaaaaaaaagaattaatctcagccctgcccggtatcgatgattcgatatcatatcagggcgtcgcgttttgttgtaacatatactactactactgtaccacagatgatgccttgagctgttctgtgggtgaagctggagctattaatctcagctttgctcttttttactactacatttatcatctactggtcgcttgcttgttcttttcagggtagatcgtgtatcattatcgtcatctttcttgtttctggacatattattataatctaaatgcagcaatttataacagtactaaggtggtgttctttttctcctgaagatgaagattaagtttttttacgcaaaacgatgtggtattaacttatgattgattgtgttttaattattacaaacttgaaaaataaattaatatgctattttagggcaacttttatatagaaagttttcgcacgaaacgcaccgtttaacagtttaaaaaacatgccacgagaattcaaaattccatccattcttttcattagaaacgaatgggacctaataaaacactacatcctaaaatatacagtaacagtataacatttgataggatacattcgtactagatagatgaagtctatatttcatttgattcgaaattgctagtatattatttatgggatatgggtgttactactaatgtaatttttatttggaacataggcagtataaaagaaggatagactgtatagactaaggttaggagagtttattttggttgctgaagactgaaggggagtagggtgggagaagagaagagaaatatctggttgctccagcttggcatcgttgaccgggccatcccaacccaatccaatccacagaatcgcatcgcatcgcccacaattttcaattattatacaggaagaagaaaagggaaaggcggagagcagagccacgccgtcggattcgccctatccgaatcttgaggaaatatctccagtcctaatcagcttgaggagtgccccgaaaagagcacgggaataacgatcgtgccactgcaaaagggcgcgggcggacggccgggatgcaaaagcgcatcccccgaatcaaaaatatccggctcaccggtccacgtggaccgtgatctccctttgctctcttctctccgtccccacccacctccactttgctctttattccccttttcccctctttttttattactatttattcgtcttccccctcttgtcttccacctcgactcaactcaactcgcacaaatatcttctctcttctcacccaccgcccgattcttcgagtccccgatttggttcggcctgaagaagggtctgggtctctctagagagtgagtagccatcgatttgagatttgattagtaattcggaggaggaggaacgagtggtttttttgatttgatttgatttgattgagaagaaaatccgagtattatgggcgaggaggcgccggaggagtacgagctgggcggcggggaggacgagcgggtgatggagtgggagacggggctgcccggcgccgacgagctgaccccgctgtcgcagccgctggtgccggcggggctggcggcggcgttccgcatcccgccggagcccgggcgcacgctgctcgacgtgcaccgcgcgtcggcggcgacggtgtcccggttgcggcgcgcgtcgtcgtcgtcgtcgagctcgttcccggcgttcgcgtcgaagggagcgggaacgggagcggacgaggcggagtcagggggaggcgcggatggggggaacgggaacaccaacaacagcagcagcaagagggcgcggctggtgtggacgccgcagctgcacaagaggttcgtggaggtggtggcgcacctggggatgaagaacgcggtgcccaagaccatcatgcagctgatgaacgtggagggcctcacccgggagaacgtccccagccccctccagaagtatcgcctctacgtgaagcggatgcagggc

SEQ ID NO: 52567 - DNA, 7585 bp, Oryza sativa
ctgtactctacacattcagttccataaaaaacaaaactaatactacgaatatagatgcgatatatactattactacaaatctatctagatggtacacatacttttctctttgtgtgatggcaaatgaactgaatagcgaataaatacatatccattcatcatagataatactaataaaaccctatcacatcggatgtttggacactaattataaatattaaacatagactattaataaaacccatccataatcttgtactaattcgtgagacgaatctattgagcctaattaatccatgattagcctatgtgatgctacaataaacattatctaattatagattaattaggcttaaaaattttgtctcgcaaattaactttcatttatgtaattagttttgtaagtagtctatatttaatactctaaattagtgtctaaatatagagactaaagttaaatctatggattcaaacaccacctaatatggtactaggttgtggaatagcaaggacagagagatttgttctagatagatattgggtacacatgacaagattgattgctgcaaggaagagcaagtggctagactacttatttgatgaagaaatgtaatgtgtggagcagcggagaacagcactgatggtgacgagtcccatgaggcatgaggagcggaggagacaagtgcacgtcgcctgcctctctgtctgtatctctactatgtatgtaggagtaaatgtatcagtatcacggtcgtttttatcctttccatgccatgcctgagagaaatgaattggcttcggcttcggattggatatgcttcttcctccaccacacaaccagagcacaagccaaggcaaacctcactgttgcttcccttcccttcgccctgtaccaatagaagttcggattgggtttcgttcttttcttcttcttttttttttcccttgtaccattagaacatggccatgccacatattgccatcgctccatcgctaacatttccacgacggccggcagcctctctcctattaccaaatttcaaaagcttctatacaaactagtgtcaaactagtgtagtactctattcgttttttaatatatatggtactgttgattttttaagatatatttaattattcatcttattaaaaaaataatgtatttatttattttattatgacttgatttatcgtcaaatgctcttaaaattttttatatttgcacaaaaaattttaaataaaataaatgattaaatatttataaaaaaatcaactgcatcatcatgtatttaaaaatcaactgcctcccaacaacatctatcaccggtgaaagcaagaaaaatagttagttcagggatatcatatgctgcctgtaatgtattggatccatctgtactccattatcacgcacgcctctccaagaaatcataagctcattagcggtcaacacgatgcgataccgccataatcgactacagtctacaaatttaggccaatttcaaaatttgtgtggagtataaattacaacgaattttctgcatttgctcttgtttgttcgtacggatagatactactagtccgtcaattgccaataggcagggagaaaggaaaaaaaaaacaaaaaaggaaaaaagagctttgagttgactgacatggccgtgctctcctcttcctcccatggcctcctccacccaccgctccgtctcctcgccgccgcctccgccagtagcggcagcagctactcgattccccatgcgcgcctccgcctcgccgtcactactccgtcgaggctaccttcccccatctcatcctcgcccgacccaccgcccgacgtcgcccacgacgaagacgaacaggaaggtcagcaccacaaggaggagcgggacgagcggtacgggttcgagatccaggtgcgcaagctgcccaagcgcaaccgccgcctcgtccgcgcccgggtccgcgtcgacgccccgctcgacgccgtctgggccacgctcaccgactacgagggcctcgccggcttcatccccggcctctccgagtgccgcctcctcgaccagtccgactgcttcgcccgcctctaccaggtacccccaattcctcctccaccaccaatcaatttaggttgaccttatctgtgctttcatccgcaggtgggtgagcaggatctcgcgctgggtttcaagttcaacgccaggggcaccatcgactgctacgagggcgaattgcagctgctgcccgccggagcgcggaggagggagatcgccttcaacatgatcgacggcgacttcaaggtcttcgagggcaactggtccgtccaggaggaggtgtgagatgctattccaaatccatgttgccgaatcatactaccacatttcattccatgccatgatcccaacagcatgattttttctttctttctttttgaagaagaagaagagagatagtagtgcatagtaagcatgaattgagaaaaggaatcaacccccattcatcccaaacatacgacatactgcattgatttttttagataatggatagaaatccagcctctatacatgtcgcattgatggtggttcagatttaagatttttcactttttcatacaatcagctgctcattgcattaaccatcggtacttattctcgattaaatctgattccagctggtctggattctagaagcaagatgctatgaatttcattttctgaatcttaatctcgagactagggttagataatatgatgatttgggtgtgctgttcaggttgatggtggggaaatatcagcggatcaggaatttcagactatactttcttatgtggtggaactggagccgaagctctgggttccagtgaggctactggaagggaggatttgtaatgagatcaagaccaaccttttttcaatcagagaagaagctcagaggatccagagattgcaagataaggtaaactgtaaacaagggtgttgctcaattgctgttccaacatgctcgagtcaattagtagtaatttctgaacattcttcagtagtactggaaatacaacattagcctgtggaaattatggcaatggtacatttgggagtcatatcttttcttgttatataactccattttgttcattccactgttatcatactgtaccttcttaattctacagagaaatccatgctgaagtttggcagtatgttttcagtgattggtcatctcttaaggcttcatcccaatattacacgtccttgattctcaagaatacacttcagaaaggtaggtatttagcactccttagttttttttttcttttttgaaactttagcacttgttagttagttggacaactgccatgaacctaatgagtctcagtcttgcagggggaaaatgggcgaagaaagatgatgacgcgcttcatgatgttagtggaacacccaaaattatgacttaggtcactgggcatgtcttgtgacaattggattggttgatctttctcaatagaagagaggaaaaggcaaatggattatttggaattcggacagctttggacgtgcctgacaggcaaatggatagagggtcccaaaacctaatcttgcttgtatatctaggattacctttttgccactcaatggagaaatgattaacgtttcgtgattaactacacgatgttgacatatattgcaattttatttgtaaccaatcctaggcagaaagctgctgaattggtactcacttagtcacttgcctcttgtgttgaagcggaggggaggggatattttgggcttgattgggggtgcttttaacttctgtagcttctccgagaatcagaaacttctctaaacagttcagcttttgtctggattctaaaaaactgtagttataaaatctagaaaatgaattaaaagctagaaggtaggaaacctacttttccagatcatcataagctagctaccaaccagttgcttcttagaatctcataaacatgccttttgtcatcttctgttagcttacttgtactgtggaatcatcatctaaatcaaacttgtttgttcataattaatcaaacttgtttgttcaaaatgatgagaaaattgcaatattaggactgtaaacattggggtttcgcacttttgacacaagtgggtgacaaataggcccatttgtgtctataaaatgtgggtcctgtgtcattatagcaaatgttaatatttgcaacgtcataattgcaaatcccccgaaaatgagtcgttcaccatctttgccactttctcgcgaggtagcatagcagtgctcactgctcagtgggagggagcatctcgccgtttcaatcggatcgggctccacaaatccaatcccgaattgaatgatgaaatgcgcggcttcctccgccacgccgagtcgcgaaccccgcgggccttcgtccaactcctcgccgcccagccgccgcgcccctccgccgccgaccagtgccatgccgccgccaccaaactcggtttctccgcctccaaccccttcgccaacaccgcgctcctcgccttctactgccgatcccgccgcctccgtgaggcacagcacctgttcgaccaaatgcccctaaggaccgccgtcacctggaacacgctcatctacggccacgcgcagtcgaccgcgcccgacctcgccgtcgcggccttcgcgcgcatggtgcgcgccggcgtctcccccaccgcgtcgtccgtgtccagcgtcctggtcgcctgcgtcaggctggagaatgccggtgctggagcaatgctgcactccgttggcctcaggtgtggcttctttgcttctgtcgtcgtcggcactgccttggtggacatgtacgccaaatgccgtcgtttgggcgcggcgcagcaggtgtttggggagatggaagagaagaacgtggccactttcacggcgctcgtgacagggttcgttctaagcagaaggcctcatgacgccgtgctgttggtcagggagatggaacgctctggtgtggcaccaaacttgatgacgtacagcagccttctcagctcattcgcgagcccggaggacatagatcatgggaagcaagttcattgcgcagtgcttaagaagggcttggagcacgatccgtttgttctgtctgctcttgtgacaatgtactccaagtgcggcatttgggaagattttgtcaaggtgcagatgtctgtttcatgtcaagatcaggtatcattcaattccgtcatttttgggctctcctgtctgggaagaggtaaagaggcgtttcaacacttcttggaaatgagaaggcacggcactgatatggatgtgttcacctttgccagcatattgaaggctataggtagctcatcctcgttgctagagggtaggcaggttcatactcttattctgaagattggatatgattctgttgtggatgtccagaacagcctgatttccatgtatgccagacatggtgcaataggggaatccaatggcgttttcatttcaatggaagcacccaatttgggtttttggaattcactaatgtcgggatgtgctcaacatggccatggaaaggaggtagttgagatgtttgaacaaatgaggaggctacatgttcagccagaccacataaccttcttgtcagtcctcacagcttgcagccatgttggcttggtagataaagggctcgagtatttcaacttgatgaaagataaagggtatcttgtgggagcaaggacaaaacactatgcttgtatggttgatcttcttggtcgagcaggctatctcaatgaagctgaatacttgattaatggcatgcctataaaacctggtgcatcagtatacagagctctgctcagtgcctgccagattcatgggaaccttgagattgcaatccgagtgtccaagcgtctaatggagctaaatcctcatgactcatctgttcatgttcagttatcaaatgcctttgctggtgatggccgttggggtaatgctgctgagatcagggagaccatgtcaggtaaaggaatagtgaaggagccatcttggagtcgtattgaggaccagatgcaacatagataataagcagcctgtgcttacaagatgcatgccactgtcttggttgctacctagaactgaattatagaccgaagctctgagggtgatgcttaccgaacgaagcaagctagaaatatgtgtaagaaaaggtatgccaaagttagtgatagatttgactacctgctcgtaaatttttggaggtttaaacagttaaacttccttctgctttagtatgaacctcattgcgtttatcattagtgagtaaagcagcaccagattggataattctggtgttataacgatgagttctactggaagcaagataactgatcgccgtataactggagcctaaattaacctgatgtaatgaaccctttagcctatttcttgttttgcataagcataagtgcataacagaaagtgtatttcagttaaacaagaaacatccacttccttctgtacataaaattaactcttttttttcaatctttttttacagggcctttgcaggcctctatggctgtatgtgaggctgtgagctaattgtaggccctttacaatagaaccagcaaaatgtttcatcctaacttgctgtgctattgttgcatgatatagcataaggttctatccatgcaatccttttgttcactgcacattgaactcatcccttgtagttttcagcttgcaatgttctgtgagaagacaaagataagagttatttttcttaaaactgcacattgaactcaccccttgtagttttcggtttgcaatgttctgtgagaagacaaagataagagtttttcttaaaactgcacattgaacccaccccttgtagtttttggtttgcaatgttctgtgagaagacaaagataagagttttttttaaaagagtttaagaaagagtggaaggcgccagtacttatttgacccatatatagcttagtacccacggtgcattttcttgtttgatatgtgcttttgttattgtttcctgcacatcataatttggacccagttttgcaggggaacttccatagaccgagggaagagctggtaggactttgtaccaagcaaatcgaggagcgtcaagaccgagtggcttaggttggtccatcgaagtgggcaagggggagaaacgaatcagaaaacgactggcctggcctgatggtagaatccatgttgtgtctgcctctcttgtgggcgctccagaaaccaaaggggatcactttgagtaatcattcatacacaagtaatcttgcttgatggccagtcatgttacagactgtatcatgcagtttgatgcctgtttaagctaagagaacgggggttttccttcagtttgctgcttgagagaaagcttgtgacaacaagacgaaaaaatgtcatgcttgaggcggtttgggccttgatggtttgggccgaggaagcaaagaagcccaccgagaggatgaaggagggcaatcctccgataccaccgacacgggagagcctccacacctgacctcagcaaaagcagcagatcgacaaattctccccgacacag

SEQ ID NO: 52568 - DNA, 921 bp, Oryza sativa
tcctcccgctcgctcgcaagtgccaagacagactgccatgtctctatcgattccaatggtctgttgcggaaaaggacaatctggtagaccggctcgcacgatacagacacatgcacttcttggggatgctcgcccctccttcctagtaacattcttcaccccccattttctttggttctacttctctttccctttcttgtgctccctcccctcctcaatccgtatatataagctagctgctcgttcttgttggctccttcttcctattatttctttgtttgctccctccccttgctggttggctggctgggtcggtcgggttctttcttgatctgcatttcgccctccgccaccgggatggagaacggacacgccaagaatcttgtggccgtcatcggcagcggcaactggggcagcgtcgcctcccgcctcatcgcttctaacaccgctaagttgccctcctttcatggtaggtaccttccctctcacaattctccattaattccccatgtgttgcatttctgaattatgcatctccctatgtgggctctatgcatatcagcatatgcattgtgtttgctacaactgttgggtcatttccatgtctattgttgtttgtaattgtcttctctaagactctaaccattcaatcagagaccatatataccctgtgttttgttgggatctttctacttgtaacaaaaacaatcttactgcattccacttagcccctgtaagatgttcttttgaaagcctatcaatgttatccaaccgcatgaaaccatcaaattgactttattatttaagattgaattgccatgttgtagtctgcaaattatctaccacaaacgtactactccctccttccttaaatgtttgacgctgttgacttttttaaacatgttgaccgttcgccttatt

SEQ ID NO: 52569 - DNA, 9012 bp, Oryza sativa
ggtcaaacatttttaaaaaagtcaacggcgtcaaacattttgggatggagggagtagtatttattgggtacttgggggaactctaatgctagctatggttcttttttgcatgagttcttttgacaaccctacatcctgcacctatttgtgctgattttgttgtaatttattcgtagatgaagtaaggatgtgggtgtttgaagaaatattaccaacaggcaagaagctctctgagtccattaaccaagcaaatgtaagagttcaaactaattccccgtgctttattttacttctggaatcagtaaatgattctagcatgatcctcgcatattacaggagaattgcaaatacttacctggtataaagctcggagctaatgtaattgctgatcctgatttggagaatgcaggtaaacaccgtaaattgtattcctaattataattattcttaattggatacattgctcttggatgctacaataatgcttagagatctagttaatgaaggaagttctcttcaccaaaaaaaagaaaaagaaaaagaaaaaagccagcagctgcttcagtaaaatgaaaatcaacttatagatacactcaaaattattagctttgatgtgctatttgatactactttggggggtgggtgggatgttgtaatataggtttcataagcaaaatgctatcatcattgcagcctccctgtctacatcatgctttttttcatcttgacaaacaaacacccataaaagtctcctttttttttcagtgaaagatgcaaatatgcttgtttttgtgactccccatcaatttgtggagggtatatgtaagaagcttgtgggtaaactaaggccaggaactgagggtatctccctcatcaagggcatggaggtcaagatggaaggaccatgcatgatatctaaattaattacaaacatacttggaatcaattgctgtgtccttatgggtgctaacattgcaaatgaggcaagcatcttctgaacttcccatgcaaagtttctttgtactccctaaaggtgaaaagtaaccaggtgcacctttcaaatgcagattgctgttgagaaattcagtgaagcgacaattggatataagaaagacaaggaagtggcaacccgatgggctaaactttttacaacaccttacttcctggtttctgttgtaagttcaaccataaaatctcattgaaacaaaccctctcaccagagtgattcctagcagtggttcagcagaaaatgaaaaacctgtgtccttcatgtacaggtagaggatattgaaggagttgaattatgtggaacactgaaaaatgtcgtggccattgcagcaggttttacatgtttgttaatttgtagtagtcattgtttcctttcaaattttaatatttaagtgatggaatcaacttgcaggtcttgttgatggtttggatatggggaacaataccaaggtatgctatttttattgaaaacataacagagaagaattttcattgtatcatagagtttaatgatctgttttatctatttgtcaggctgcaataatgaggattggtttgcgggaaatgcgtgctttctctaagcttctatcccctacagtcagggacaacactttctttgagagctgtggtgtggctgacctaataactacatgccgtatgtatctcattgttctccttttaccattgagctgacaaacactgacaagatgagtgtttcatggcagttggtgggagaaacagaagagtcgctgaggcctttgcacgaaatggtggcaaaaggtttcttgtctaaaacatacataatgtcttttgataattttactctatactttaactttgttagagaatcaaaatacaaagtatgtcgatgttgatggcctatactaaagagttttcacatagatttttttttctgttttgtgatgattacataataactatggtatttcatcattcttacaggtcttttgatgagttggaggccgagatgctacatggccaaaaacttcaggtaagcaaatatctggaaccaagcaaacatggtgaattcgttgccttcttagtgcatctaatctttattagtttcacttgcagggagtgtccacagcaaaagaagtttatgaagtcttgacttatcgagggtggcaagaattgtttcctcttctgtccacagtgcatgagatttgtattggtcagctacctcctacatcaatagttgaatacagtgagcacacgcccaacctctccatcatcaatggttctaatgcgtattactgagctagattctgcaaattgtattattgccactattctcagtatcacttgttacaacagaacaagttgaaacatacctaatgtctgaatccgttatatatataatattattattcagccatgtcacctcataaagtgcatgactgattatgtgtttctgtcccttgttgtttggaaattgagtgaccttgccagaaatccatggattggaataaacaaattcagtttatatggaaaatagagtgaaagaatttcatggtataatttataagggtgcttcttgaatgaaacaccacaaacaacaggccatgcttaagtttaataacctggaagtttaaaaagttaatgaccctcgcccaaaaaaaagaaacaatttacatccagtatgcagttcactgttcacccatttcataattttgtaatatagtgtgtttttacaaacacgctgtgtacattgtttccaacttccaagtatcacaaaagaaaactaatatttgagcctttatatttagagctttccacatttcaataattcattgtatgtagtaaagaccaaggaaatgttgagtgataatttgggaagacttaaatagtgttgttttggattcatggagtgctgatttgatattgaaatgttaaatttggaaggattcccaattacaaactgttgatcaggccttgtaattttggagctgcttttgctgacagacagagcaacaatggattgtagaactataataccatattcctacttcctagatggaatgtttcatccgaaagcctcactggcctggaatcatgatgggtagaggggtaggtggaggtgtgcaaggaacttgagagcgatcactgtattgccttatatgataagtaagcaatgaactaactgaatattccaggaccaccaggtggacttgatgcctgtgctgatccagttctgggtcattgggtgtactgacgatatcattggacacaaacatggagaacatttctaatggaagaaattgcattctaatacagtgaaacacaggaataaaatattagagactgaatttgaacaaataatcattctactataattttctgaatcaattggaattcaagttcctagagttcacactatgacatggagaagaagtttgcgagttatgtaatgaaagaagttaaaagtgtactttctatattttaagtttcgtccaatgacttcatttaagagtagcagattttgcacctagcttttgtcatgcagattttgttaagcttctcttagctgaacccattttcactattatcgaagtttgctagttgaaaatttggtctttgatacaaaatgctgcttcctttcagtaaattttagtggccttagaattttacaatccaagtaccttaagaaccttcagataatgcaactttctgctataggctacttgatacagtgaatagattgttgatttcctttttgaatggcatgtgtttctgatgatctattttaatataagatgtatttcttttactcttaacacatgcaggtattacttagaaatgatatttattttaggagtgttttgtattccctggacagttttcacttgtagttctccaatttcatctcaataatcaaatcttaaacatattgcaatagcatttgccaagataaaattattcatggtacagtatccactatatgaagatgaagcggaaacacgctaatgattgttcatgtcctgtcttagatgcaaccaaaataaactatttcacctttcacggattagttgatttatcatattttagtggattaaattgtccacaacattttaaattccaatcttcctggggaacaaggaccaaaagaatctgccaaacacatcactttcatctttttatgtctacaaagtaacttttggtgttgagcctagacaagacacaaacaagataacatgaaatacctccaaaacttgaacagcggaatttatttggagtcatggcaatatgctcatcgaaattcaggacctagtttctttctttaaaagaaaactgtgactcatgtttcaattccaactggcataagtttttatttctattgtgacctgacatgaacccgtttcaggaatccactgaatgctgttctctgaagatgtcatcaataacagtttcagcttgctaaaggtcttgaaggacctctgctttctagtggagcaaggctcaggaaattcttcatgtcagtgttcttcgttgcggggtcatcaactcatctgtcagatcttggacatttccaggccttcagcaacagtccatgcaagaagtcgtcagaatgcacttacatttcacatctgtttatgactgattacacattatgctcatatgtgctttatttttttaatgatacaacgcatcagtatgtgagcaatatagtttgctcatatttgttatcgtctaacagtggcttgttaactatgttgaggttttatattcacaactaaaaactttgtacgctgggaatacttaaaccccttaacagttcaagactccaggctgtgtttaatattagtccaacatttgcctgagaattgttacttgcttgatgcacttggtactgaaatctgcaaatcgttgttatcattctacatatgcctgagaattgttgcttgcttgatgcacttggcactgagatctgcagatcgttgttgttatcattcattctacatttctctgataaggagtccctcccgttcaaatatgattatgattcgataaaaacaattgaaagtagatgaattcaaaagtcatcaggctgaaattatctgacagtacagaatctgtaatgctgcagatacatccataagcatatctggttgagcaaggtacagaaaatgacatcaaattagagcagccattctggaacattcatcagtaccatggaaaatatgatcaaatatccatttgatttagtcacattttaccagtattagtcttagaaccataacaaacatgacagaccatgctggtacaaaatacgcaatcctcggatcctcactaacttattaagttcttgaccttttgaaagactgacaacaatactaagcagactctgacttggtgtagatccttacagcaacagccaatcccaatatcgccaagggaaccaaaaactggaggatcttgatgatgaactctggtgtcttatcctggttgtagtgtggttgcttcgggggcgtgtacttcaccttggtgggtatcgtggttgcgtcaatgtcgccgacataatactcatccatcatcgcccgagcagtggtgctgtgccccacatcttcgaagtcgtcggtagcatccttggctgcaatattcaagtaccattgtaagctgaaatcagatttcctgaaaccttatcgatcaacaagtatgcaatgcagcaatggggctttaccagtcgaagacaacaagacatcatcacctccagggtgatcctccaaaaacttggtcacattgtacacctgcaagtagcaaaacaaatacttctatgagtttgatttgtgtaaaggggatttttttttcaccatataaggcctcgtcaatataaaagcaacaataaccaagcacatttcagtgtataaaaatgagcaaatgaccctagcaacctcccttatagaacagtttgttgaaaaaatacatatcttttgatcagccaacatcatgttcacagagtcaaaatagcttcttgacatatactacacgagaacatataagctccctaaagttctgagcatattttaaacaggcttgttcatctgattgaactggaaatagagaagtaagcaaaactgatttttccttggctctatgaagtaaaagatcttgcattattctttagcgtttgacatatcaacagaattgtgaatcctatggaataaaagatgaaacaagagctgcacatttagattacaaagaacagtttctcgcattaaaccacaaaatatttataccaggactagtgaggtacattcttatataggctccatgaaaatgactggttaagaaaagatgttcaggaacattacaggaaaaaaaatgtgcagtaggagattctcaacaaaaattaaggtcaggataggctaatttatgagggatgtttgctatcctatcctatctggaaagccatatccgcacagtgatgaaaagtttgtccctaaaagttcccagcaagaccgtgtgtcatactaatcaaaagaaaagagaagagaagagaaaagggagaagaccttgccgccgatgatgagccagcaatcgtccttggtgttgtgcttggagacctcctccagggtcagcaccttgttgttggacatgttgatcttgatcgatcttgccctcctcttgctcctgcctcctgctcctctctctcccaagtcccaactggcaactaccaagagatgagatgagagatgggacgagagaagggacgaggagcgcgaggcgaggaggaggaggagctttggatccaacgacgaaagaaagagagagagagagatcgcgaatgaggaggaggaggaggaggagaggattgaggagcagtagagttgtatagtgggagtaggtcgaagggcccaccagtcatagtcagtttggttggtgggtaagggcgcttgtctcaccgaccccaaccacatggttccttttttttttcttttctgtgtactccacaccaacaaccgtagcagctagccagctagtctgtggatccgatccgtatgcgactagactagtctggtgtgtgggccctccctccctgtatctgtatgttgtacaaatacggtactactgtacttcatgcttttctgtccaacagaagtagtggtggccaattggtttacagttatactacacggtttatacagtcttttggaaattcaaattctctttctgaacgaccaccaaaacttattcacgtaaaagagaaaaatgtgcaaaaataattgcttcttttttcctactggtttatgtttttacccaaagtataaactactccctccgtcccataatatatctagtcctaggatggatctcatcccatcctaggttgctatattacgagtcatgtctagatacattgtcctataatagattccatcccatcctagattgctatattatgggacggaagccaacctgccaagtctgcccaaatcctatgcaactctcacttgcttcccatcatgtgccactaactctataattatgaactactccccacgtccctaaatataagagattttggtgggatgtgatatatcttattacaatgaatctggacagaagcatgtccaaattcgttggactaggatgtgtcacttccaaccaaaatctcttatattttagggacggatggagtatctctcattcagctatatttatatcttttttttttgtcttcttggataacatacataacttagagtgtgtttggttcacggtcatgcatggataggatatggccatccatattttgttggatatggcgatctaattgctttattatgctctactcagttgttatctctctagctaatatcgacatggttcaataatcgtatccgggtgttttcctttttatcgtaaccagacattttcacattctatattttttttaaaagcaacagtgaagacgatataacatggggatcgatgtgggaagaaggttgatttttcggctttctaaagatgggaaactaacagaaactgaaaagcaaactataataagaccagaactgagatgatcgaaagattttaagagagagagagagaggctagtttggtcgagttcgttcttcgttttttatttttacgaatttgtgacagccccaaagtagccaccgattattaataaatattacaaagaaacaaagagggaatcccagtaattattacatctatccatcaccatctttaattttcaccgatgaaaaataatgagagacaaacaatcttgaaatgtggatgggaattgaaaatgaataacaatgaatacgagtactgagaaacacttggaagtgccgagataacaacaacgaactttacaagcaggatgaattaagagagtcctcttcttgtgttattattttgtatccttgaaattaagaaactgatttaatttaagcgttcttggttgggtaggaggccatcttgttgatgccgcagaggccgtcgtgcttgccggtgcccctcctcatccggatgtaccccttctcaccccaatgcgatccccacgagttcttcacgatgatgtaatcgtgtcccttgctggccgtcccgtatccaacggccgtcacgccatgatccagccgcgtgccgcacggaccatcaaacacaccctgaccgattaatcaccattaatttcaagtcaggacaagaagaaaatggcaaattaagaagtaattacaaacaatttactactacaattaaattccattaacctatactcctataaagtctctagtgatggtggcagtgaatcaaacacccactgctgtttttaaaaattgactggtgatatcttttgttattatggaatagcccaaatattcagttcaaacaaataaacaagtggtactaatatgttcgataatttttataatatttattacatactataatatattttcttttatctatagcaaagcatttgtgtttttttagctattgaagagagaacattgttgattaattgtttcatacccg

SEQ ID NO: 52570 - DNA, 1309 bp, Oryza sativa
aattgtttcataccccgctgtagaactggaagttcctgcctgaggcctcgatggcgacgctgaccggctggtgggccagggccttgagcagggcctgctgttgttcctcggaccttctcgtacccggagatggtcaccgccgccgccgcctcgccgtcgtcgtccccctccgtgctgccgcggcggcaggtgccttcctccatcaggtacgggtaggactcctcggtgtggaggccgccgttggcggcgatgtaggagaaggcgtagtccatgaggccgccgctgcagccgttgttgccgtcggtgtcgcagtcgatgagctcctgctccgacaggcgcgtcgggttgccggtcacgatggcgttgatcccctccaccgccgccaccgtcgagaacgcccagcagctgccgcactgcccctggttcttcacctccgtcaccgcccccttcttcctccagtccacctccttcggcaaacttgccgcctccacctcctcgtacctgaacaactgatcgttgctgttcctcctcgccggagtgagggtgaggccgaggtaggcagccttgaactcgtcgtgggtgaggtcggcgaactcgttgaggcccagccagtagccggtgatcttcttgttctcctcgtcgatgtggttgaggttgtccttgaacacctcgaacctcctcagcttctcctccaagctggagtaggccttgcggtacttggccatgaacttctcgaacagctccatcagcctctcatgcgacgccagatcctcctccgagtagccaactatggacaattcactgggcatggctaccgctacgcatgcgccgccgcacagcaggaggagcacaagagccaggggaagcttcgaattcattgaagccgccattgttgcaagctactactagtaggatgatacaagctgctgctgctgtgcatggtagagatgagagaatgcatgtgtatatatagcttagcttttctttctttcttagatcgattgttaattttgcttgaaagcaaagacacgatcgatcgatcgatagatcaactgcgtgtgctacatgttgaaggttatatgaaccatgcgagagctttaagacatggttagcatcttggatgatttggtatctgaagaactagactttgcttttaagcatgcatatgatatgaacgctgggcgcttactcttgtagtagtagtagtattatatggagcatcagggaaactgttttaatctctcgaggggatatcccctcgttttttgtatgtcacttaaatggttataaaaaatttaaaaaaaattgg

SEQ ID NO: 52571 - DNA, 26329 bp, Oryza sativa
tccatttgtacccatcatctgcgagcccaccattattcccacagcttttcatcttcagtgtgtacttgttctccatcgtcttgctcaacgtcttctccggcgagaaaaccctatatatttattcattcttttaattaattttatcatttttccaccaagtaatatatatatcactcctccaacgagcatgtcacaagtaaattaaattacaagcatgcgcaggagtaacatatatataagcatgcagttaattaagctagcatatatacatgcatatgtacaaacagagacagaggtagctacacttacactgggctacagctacttgcagcgaaattgtgaccgtcggcgagtagctgatggtcgccggcggcggtgaaggagagagcgctctcgatgtcgctgatggttggcccagaatacaccgtggagatgagcttgttcaccatcgactcccgccgccgccgcccgcaaggagcctccacctgcagctgctcatccgctgcagctgcggcaaaatattctctctcatcctcctcctccgcctcctttgaattggaatttgaatttgaattggaattggaattggaatgcaccgcggcggtctcatcgaggatctccctcaagagctcctctccgacgacatcgccgccgtcgcgccaatactctttgttctcttgcatcgcaccatccatatgatcaacctaagctgctgctgctacttgcttaattcttccaagataggatcagtttgtttatatggagtattaactggctggttagctagctagtgtgtgagtgtgactcattatataatctaccaacccagcccagggtatgcgtgtatatatagtgagagtgagaggccggagttcgatctctcttcatcgtcccaaaatgacaaatgtacccctcatggtagctagatggatagatcgatcgatcgatcgagtgttagcctgaattatatgtctatatacatatattcactgatcattatgtaaacatatatacatatattcactcatgatcaccaaacagaacaaattacgtgttgagagagatgagtaagcgcgtgtggtgcagttattaataattaaattaattcaatcggtgtaggttgaagcaggccaaaatggattgaattgaagatgggtgcaggtatgtagtaggtgacctttgattgagattttgatatcccggcctgcccttaagtagtaataatccagctagctagctcgatactatatatgaatatatcggacgtttgcaggatgaaacatctggagatgtgtttatgcatgttcaggaaactgcatatgtatattaagttctatatatgttactgccaagaattggcaatcgatggaaccaactgacccaacacaacatatataatggtgcaactaatatgcaattgtcaacaactaaagctagctagcatctatgattgcgaagaattgacaatcgatcgatcgagacttttaaccaatgcatgcatgcaccacctttttccactagcttttacccctgtgctgctacttctcctaattattctctgatccatttgaactgctcgaataattaattagtatgcagctaggtagggcatgcatgcagcactgcctccaaacaatctctagtatgtagcgcgccctaattaaactatgtatatatgtgggcgtagattaagctctctgagacgatatcctcttgacatatattataatgtcaaatattttttaaaatttatagaagttaaatttgacatttatgtttgtggagtgagatttatcacatatttatctatcttattgaactttataacaaaattttataattatttaaagatgacatgtaaacaacgaggagaatagtttctcctcgagtgtttagaatagtttcgccatatatatcaactatgaagtatatactactactgtatctagaaagcacatattgttcacgtctctatcgatggatacgatcgatggaaatattctgcacgcccagcgcagctaattaatcaaccaccacactgatagaaccatgtatatatatgctgaatatgtggccggagaaataactaattaagcgcaagttcagcggggctaggtatgcagctggaaactatacctaatctcatataatatccttgatttgtcccctaaaaagagccctacagagctgtcgagacgaaagaataaatgcaggaatgaagacaaactatgtttcttaataatttgatcactttggccaaacgcaaacatcagctagattattggcatgcgtgccaattcagtacggagtaccatgtaaaagctccacccatcttcaatatattccggcatcatacatttgattatgtaattgcaattctggcaaaatcttgaataatcagccttgtctccaaattaatgtgcagatcaacggcatagttatacatattcttaattaattcttttgtacttgtgcatattgattaattgatccgtggtgtaaatactcgatcaaacctttgaaacactggcgattaacaaattcttaaatgataaattagaaaataaataaacaattgatgtaaagttgcgcgcataaaaatggaaaatactatcataatgtcataaacgtattatattactttattatgatataaaattgattgttgaaattttacaagtccgatcaatattttacaaaatattgaatactacctttattttttaatgtatgatgccgttgactttttgatcgatgtttgactatttatcttattcaaatttttgtgcaaatacaaatataatagttaaatcatactttaaataaataataaaaattatatatttttttatataagatgaacgatcaaacgcatcttaaaaagttaacggcgtcatacattacggagggagtattaatttatgatcggcgcgtgaggaggggggaggggagagttactgtgttcgctagctcagatattgcctattgcataggcacaaggtgaatgatcgatcgaattggatagaagtatgtaggattcatatgccactagttcttgtgattctgtgaaggaagctgatgagctagctatctttatcagctacgctcgtaccaaatccaacaaaaaaaaaagtttgtacgcatgcatgcgcacaccgtccacgggaagaatacagatctgccgcctttggcgtcttgcatgcctttaatttggaggaggttgacttttgagagggagggcaattcgattggttgatactcgtaaaggaagtcgttttggacagcgacacggtttacaaaacacaattttgacttcttttttctataaaaatatttattgaaaagtaatatatgtgcacttttatgaaagtatttttcaagacaaatctattcatataatttttacatttttaaactcaacaatttaagagttattcatgatttatattttaaatgtttgatttaaatattgttctaaaggactttttctatgagtatggaggaagtataattaattagcagggtcatccatgcatgcatcgtcagactcacgtactgctggccaagctagcttaattaattacttgtcgatatatatgatcgttgatgcatgggcagtgacgtgcgactgcatgaataattaccaacaagctgatcgattgatctagcagctgccatactgatactgtactgctgcaaattaattactgtgcgtgtaatggtgaataaagagttgacttataaagaagggtactgggcgggcggtggaatgatgagatttatagtagtaacagtgagaggagagcatgcagtgcagtggggcactgacgacagtggggagcaaagcaacaagaggaattaattagggagaagccatgggatacgacaaggggttgacctgctgcatgcgtaacctgctagcgctagcttgcatggctggcgaccctgcctctgcatgcatgtactcgcctccattcgatcgattacctcgcgtttgcatgttactaggcgcgcagtagcatgcatatttagcttaatttgtcgtgtgcattggccgggactgatctgtgatccatccattcatcttgactcttgagtcagatcgagtcgacactagctagtactcatgcatcttcatcgatctactacttcgtatactccatctttctcgaaaaaaattcatttcttacattctaagataaaattagtgaagatggagaataactaaaatacccttaatcattaaaaaaacagtaatagtgatgggtaggtaaaaggtatatattgaagagataaaattttctgctttacgtgctgagggtaggcagtatggtaaaagttgattttctgtagaacaaaatttaatctgaagttaaattttttttggacagagggaatacaccattggtaataatatataattaagttaaccaagagatcaggtcacctgcatgcatgtatacgtatactgaccaaccgatcgatctcagtcgatcaacagcaaagtcaaagcactacaagctattgatattttcattttgaaggacagggttaaattaaattaagatggatcgagatatcggcggatctaacacgacgagaacgatgagggctcgagcctctactacggataattataggatcatgtgagtcatcactaataatttttttttcatatatatacaagcaaaggaagggtcataattttatttattttatttaaaaccctgctattattttctggatccgtatctcatctagagtcagcttgcatagcatatacacgcatggggtttgttggccttagcgagctggaccattcctgcttcctagctacatatatatattgttgggtggtgcgtgcaaaacagtagtccggagtagtgttacaagtaaagacagtatagtagacataatagccaactagatcgatcgatcgatataattaatgtacagtacatacacatagggtcaacgcatgcatcacaacgttagtactctcttcctagtaaaaagtacccctctctctctctctctaagcaataaaaagtacttggcatttgacattttttatggtcttcgagttatgaatgtaatcagtattatttgatattgaaaaacaagtttataagattatgacggatatgattttccaaaaactattatgagggattctaagagataatgataactgaggtttcaaatattcccaaaatggagtatatataattcaaaacgtaataatgtcttaccagatcgatggagggggcgcataatgttgtaccgtggattgaaataagttcactttagatctctcatcttgacatcgaatttgaatcgtgtcattgaaccataatactagatatagtgtgtcccttcgatttgcaatatcggagtacctaaggtcgcatgactgtattgtgcctagttttagcaacccggcaaaatcaacgtgggccccacacattaacaacctagtcttcttccacctatcaaccattccctcttttctctctctctcagcaggatgtcgggtggtacgaagaatggcgatggttgctaggagaggaattggatggcggtgttgtcactgcgagcacgagcagccgcctcgactcctctctattctaactggcactttattgggagagaggagtcgaggtgaccgctcgagagctccgtgccgtcgtcgcccatctcctctcccgttggctggcgcttgctacccttttccccattagccattgccttaggtttggtgaaatatgggaaagagatggaagaagggagagaggaagagaagaagactaagccgctaacatgagggtcccgcattgattaagccggttgaccacatttaactcgtgacttaagccaaaacctggtataatagtaccattgagacatcggatgctccgatattgcaagttgggggacgtgtggatatgggtaccccatacccacatggcatggttatccgactagttatagaggataacttaaatctattagataaggtaacagatcatgacttgggtattacgtttccttgtatattacggaacggcctaaagtcctggtttgataatattgtagagtagatttaggaaaccaatacggtattggttgaggtttctattttgtaaccctgccccccaacctatataaggctggcagggagccccctctaggggcatgagacaacctgatcgtcagatcaatgcacactcggcggattcaaatccccaaacaggagtagggtattacatctcattgagagggcctgaacctgtctaaatcctttgtctccgcatccatccacttttaggtctcgtgcgctacccccttttattattgccgaattcatgtttcgacagttggcgcgccaagtaggggtgcgtcgagttcctcgtcgaagagtgcgatggaatcaatttcaggagaaacggcgagatcaatctcaccgaattcaatggcttgaactttgaaccgggtttgttcattccaatctaatttttattagattatttttttatcatagatcgatcttctggtatattttcttgtgtcgatcttgtgtcggtcggcggagatcaagctgaagctgtcgacgacgccctcatgcatcgagactttcttcgtgttttgctgacggacatgtggtggctatcgctggtcacagcttaccaggagaaaacactgcatgagttgactcaactgatcaacatacatgcacgatccaaccaacatgcacattacatctacagagttaatctgtttactagttgattctaaccagcaattattttgttgctatctgtcttgcatgtacaccgccggccgtatctactgccggctatatccgtcagcgccgaccggctccaccgtctccgtagtcggtcgccttcgagctgttatcattaggctttacagctgccccggtcggtcatctacatgctgccgactctccgaggtcgcagggccgttgatggcttccgccggctactgctgattgcggcattgcgacccaagctgatcgacgcgcacgacgtatccaagccacgccgtacaacttgggttggctgttccaatttaatttttattagattgattattaattaatccctaatcgccggccgttttgatttcctggcaattttttgttgtttttcacatgatggttgagatcacgacacggccgtcatcgtctacgtcttcaccgaccggccgcttcgtccgccgccgactggtgtttccgcctgcacggctggcttattatgccgccgttgttgggcgtctacgacttcaccgccggcctgcctccgtcgccgccgactggtgtcctcgcctatgcggttggttggtcacaccaccgttcatgggcgtccacgtcttcaccgaccggctggccttcgccgccgccgactggtgtttccgcctgcacggctggcctattatgccgccgctattgggcatctacgacttcaccgccggcctacctccgtcgccgccgattggtgcctccgcctacacggctggcctattatgccgccgctgttgggcgtctacgacttcaccgccggcttgcctccgtcgccgccgagtggtgcctccgcctacacggctggcctattatgccgccgctgttgggcgtctacgacttcaccgccggcttgcctccgttgccgccgagtggtgtttccgcctacacggctggcctattatgccgccgctgttgggcgtctacgacttcaccgccggcctgcctccgtcgccgccgactggtgtcctcgcctatacggttggttggtcacaccaccgttcatgggcgtccacgtcttcgccgaccgactggccttcgccgccgccgactggtgtttctgcctacacggctagcctattatgccgctgctgttgggcgtctacgacttcaccgttggcctgcctctgccgccactgactggtgtttttgcctatacggttggcggactccgccgttgttaatgggcttcaccatctacaccactggcttggttccactggcgccgactggtgtttttgtcaccattgatggactgcttcattcccacatcggctacttctgctgtcaccgagggaatacgacaaagctaagtcatcatttattttattctttatatgatatttttccttttcctctgcctcactacaccaattggtcttccattgagcagtgagtcgggggctacagatgttatatcatattttccataatatttatcttgattgcttgcgacataatctgagtacaaaagtacctatcgagttatggagttctatcttcctatgctttccgtttggtttgtcaatggatggttgcctttgggccgattcctagcacccgggggctcgttggatggaccgagtaacgcaaggtgctaagtattattcggaataaatcaaaagcatagagataagataatttattttctgctcttaataattaaaagtacccgagtagtaaactccgatccgtgaaactttgttccattaatgacgaactcatgtcactcatatgcatgtttgggaaatgcctaggtcgactcccgatgcttgggggctatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgccttgaccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtctttaccgaccggcttgccttcgccgctgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtctttaccgaccggcttgccttcgccgctgccgactggtgtttccgcctgcacggttggcctttatgccgccgttgttgggcgtctacgtcttcaccgaccggacgcctcgaccgccgccgactggtgcttccgcctgcacggctggcctttatgccgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctacctacgtttgccatggctgccgactggtttcttcacttccatgactgcatgattctgccagtgttgattggccttaccatcttcatcgctggtcgtctcgtctgctgctgactagtgccctcgcctctacatctggtttatacagctaccactactgatggacatcatcgtcttccgccgccgactcgtcttcactaccggtttgcttctgttgccgccgactcgtgttcacttcatcacggcaacacaactttgtcatcatggtggagcgacttcatctttattatcttcggcactggcaaactctattgctgctacttcacaagttttgctacatcaccaaccataacgttgttgtgaatctcgacatatcggcatgcgacgccgtgttatttaattacaacaagtggctctccaacattcatgatttctacttggacatcttcaacacatatcttcaatcaagtgatgactactcgacaacaagaagctataattctcgactctatgttcagttgtttcccaactaatcaaagagtcgggggctacacaaatacatggctcaaaatttgacaagctttatgtcaagatgaagcaatcaattaatcagccaacaagtcaactctgggagtcatcaattttgtcttcgcttcagagcagtaggtcaagattaaatttacatgtctgggagtttggagtcatcaaccaatcaactcatatcagattcactgagttgaacaacagcatatactttcctccaagtgaagcatctacaacagtttgatggattattgtcactgacatcatcaccagcacctctgcttcatcggctctgacattccgccgttgctaatggatgattaagacttcgccaacttgctatttcgccttcacggttgaccaactatgcaaacgctgatgagcgtcttcgtcattatcatcggcaattacaccgctattgactggatcaccgacatcgtcatcttcatgattggtggatttcgtcatcgcctttgatatgcctcgtctgtcaccgactgattatttcgctgccatggctatacaactttatcgctgggcaccttcatcttcattgatggctgacctgactgttgccgactggttgcttcgcctccacggctgtgcaacttcatcacttttgattggtatcactatcttcactaccaccaatatttttgccacctctgttgggcaatattatctctatattggtcgtcttgtctctatgccaactgcgtcagctaccatcaatgaacaatcgtgactacgtgctcaggggcttactagctcaattacaagtattatatcttcaatttggacttgctccggatacatgcaacatgaattcatgatcataggtctattttatatgctcaaagactggactatttattattccccgtaagggttatcaactgaatacttgcgccagtcgggaatcaattgttacatctattttggagtatcccataagggataatcactcagattagaagctattcatatgagctacgcttggtctatattacccggaagatttattactcgggagcatgttatatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatctagtgcccaataccttaaaatccttttataccgcagttactcaactttttaggagttggtacaatgcatcttaaaaggtgtcaaacagtaaagctttatatagctgccccgctgactttttatatagtcatggcgctgtttgggtttatcaagcaattgattgaatacaacatcattgctttttgccacgtaagtgtgcatttttattgaccaatattatggcttaggctgattatatattttggtcattttccagacgattgataaatccttatgagtttatttactcggattttataccacatatgccatatatttccaggtgtggtgaaaccatgtgtcttttagggactaaagcacgtctgttaaagcagtgtgcgcatggcgtatgcccaatactttggaaatttatttattcacaacatacaagcttctttatagctgttttgctatgtgaattttcaataatgtagccaactttaggttacactcatcatattttacaaagcagtcggtatatcacttggatcatgttatttggaggattcacaccgcatatgctatatattgatatcaagtcacttggttgattacaattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccacatggcatggttatccgactagttatagaggataacttatatctatagaatatgtaacagatcatgacttgggtattacgtttccttgtatattacggaacggcctaaagtcctggtttgataatattgtagagtagatttaggaaaccaataccgtattggttgaggtttctatcttgtaaccctgccccccaacctatataaggctggcagggagccccctctaggggcatgagacaacctgatcgtcagatcaatgcacactcggcggattcaaatccccaaacaggagtagggtattacatctcattgagagggcctgaacctgtctaaatcttttgtctccgcatccatccacttttaggtctcgtgcgctacccccttttattattgccgaattcatgtttcgataggacgttttatatctagcattacggttttggaggatggtatttaaactgtacgtcaccatgagggatttaaggtgaactaattccataaacatatggccacgaggcccgataaaagaaagagtacgtcatggggcctacctctcccaagagaaaagctcatacatctcgctcgctcggtttcttgcggagaatgtaatgtttgggggctttgggcccaattttgatcgcaagcagttgcgggcggcgaaacgatttccgtgtggtgtcctggcccactcagattcacgggccgaatttttgctttgatgctccgcctaggggtgagcgatggatgggccaagtaatctgttgggcgaaaggtgcatgcaagggcccatttcgtgttggtgagctagctgtggctgcttcttcttcttcctcttggtcgtcgtcgtcgtcgtcgtcatcgcttggatgtaccaaactcaagctgtagagacaaacgatatcgatcaggccggtgaaacttggtttttagacgaaggacgtaactaatattcagttggtttaataattaattaacgtggtctttctttcactagctaagcttgagaaggaaaaaagaagaagaaggggggcgtactccagtgtactacagggcagggaaaataaagatgcatgcaagcatgtgtcagccaaataatgggagcgggcgggcatgcatgcatgtcgtcggtcgatcgaggccagggcagcagagcagagccggcgggcggggcgggcgggagtggagtggacaggtcatggccggattctcatgcattttatttctgcagcagccagcagggcagaggagcaacgcccagccggcgctacgtgcatctgctctctgctagctcgtgcatactgccgcccttgcctgcgcatgcatgcatgcactacgtactactgtgcctgaattattcacaccagctgttgtagctactccctccgttccgttttagatcacaacacgttttgattttggtcaaagtcaaactgctttaactttgacttagtttatagaaaaaaatagtatcattttcaacccaagaaaaatttattacgaaaatatattcaattattgatttgacgaaattaatttagtattataagtattactttatttatctataaacttagtcaaacttgaaacagtttaactttaaccaaagtcaaaacgtctcgtaacctgaaacggagggagtagtagccatgcaattcaagcttaaaattgcaagctagtataatcttagtaatgcttaaaattttcatatttagtaaatcaagccatataacaaaacaaaagatatttacataaaccttttaaataagatggatagttaaatatgatgtaaaagtcgacaacgttacacattagaaaacggtgatactccctccgtttctaattctttttttaagtcaaaattatttaggtttgaccaaatttatagaaaaagttagcaatatttataacgccaaaattagttttattaatttaacattaaatatattttgatactatgtttatttaatattgaaaatgttaatatatttttctaaaaacttaaaaaagtttgattatttaaaataatcaaacaacttataatgtgaatatgaaacagatgtactccatccgtgctaaaaaaacacaacttagaaggagatgcgactcctcctagtactacaacgaatctaggaaagagaatggtagtcacatactgttctaggttattattattatttctttggatggatggagcagtatattgcagaccaattaatctggtgcgttgcatgcctgactctgatgcccccagctttggtagctactccctatagatcgatatgactgacagaaggatgatcgatgcatggaacgacgacgacggacatggcttggctgatcgatctgcttcccgccgctgtcaagcaccagctaccactgcatccatgcgcgcacatctcacatgcatatgttctggttgcattggttgggcgccagcactagcaaagatggatgaggtgtacgtccaacaccccagggccagcatattgcagcgcgctgattgcagagtgatggcctactacaaactaatagcagccagccagccctttagctatctatctaactccaacatgcatatagtacgcactttgtaagacaatgtctcaagaacaaaatatgtgctacataagtaccactattttccgcgaacacccaaaaggattgcacatcaatatataattagaaaaaaaaagttgaagttacacgacgtaatcagccagaccggcttatgccagggaaagcgagaaaaagcaaattaaaaactgaagcttagaaaaaaccatgaaccattaggagggtaccacctccgcaatgtaggcaacattcaagtgatttttatatttcggcccctgattatttgttattttcagccactgttgtaatacttgtcgatcattaacgccaaatcagttaaaacttttacattttagatcatgtaacagacaataagcctacataaatacccctaaccattttgtaggttcacctatccttgttttttccttctcccctagctactttctggcacttggacgatagctcacaatatgcaggagtatataactggtgcaggcaggcatccatgcatgcaatgcagtttgacggtagctggccgggatcggataggatcggaatcgcatggatggattcatcacctagctagctagcaatgcaagcatgcatcaaatcaaacctcgctgtcagcaacaattttgcttgcaaggagctcaccgatcaatccagtatagctatatgtacttcctctattttcaaaatatatatagtaccgtagcttaacaatatactccatctgttttcaaatatatatacttcaggttgtttaagtaaagattaagattaaaggaaaacattctatcaatggttcaatatattttgaattttaaattgcttggagtcattttctaagcatttggttgactgaaaaatgtttacatttttacattgaaattattatctagttgtgcataaaatttggacttgcttatgtttggaaacggagggaatattgtgtatccatctgtgtctcttttttttcacaattacgtagatccgcccttgtatgagtgtatccatcttgatctttagctagctactctctctgtcccataaaaaaatcaatctagtaccggatgtgacacattctagtaccgtgaatctagtcatatgaatatgtcacatccagtcttatattcgtttttatgggacgaagggagtagcgatcggtctttttctaacagccgctggccatcgaggcacatgcaggatcatatcgtcctcgatcggctagacggctagctagcttcattcgttgccttcctcaacataaaataaaattaaagctctaaagtatgagcaatgcttattcccacactaagcaataaggctgaacccgcccgttgtcagctaaagtaactagcaggaagacctcataagagcagggataatagaggagactgctatgggcttatgcaagatgttatagccagtgcatataatagcatgctctgtacacatactctactacaaataaataagcatttttatatgtttggtgggaccgacatgtcatataccttctttctcttgatatggatccaagcagtcagcacgtctaggcgctcgtgcctagcgggcggttgaagaagcgccggcttccttctctcacatcgctttttctcttccacgtcagctcgagacatcatctgttagctaatcgtctacttattagacttgctctaagccttggtgtgacttaaaaaagtgaggtgacactcatcaaatttttttactaccggtaattcggttaattatgtgatctggtagtagctatttactactctcaaaatatttattaatggttaactaacaagtacatatttaatgcttagtatatgctataccactgtggatgcactacttttgggtttgggaataggaataacgattgaaaatttttgctttcatcatacatattcaaaattccaaccatcaaatctatattagaaaatattcgtaaaatccgataagtttataatattatgactaaaattttcgttgttgtagatagtatttatttcttttttttcatgctactaaaatgaagttaatatagctattgagggcccaaatttttgtgtggctgttaggacaggccctgtgttggcttacgtggaggttgaaaacccagcgtgtactgctcctgccgtaagcaaaggtggaggtgacaaactgacggggacacggatggacggtcgggattgatggatgggcaaatagatggacggatacgatggatgggattggacggaaggctgtactcgggccccgcggcccagcggtaacttgacaggtgcagcctttatactgtacagtagtagtggaggtgtatttgcagctgcggcatcagagagagactactgtccagcaacatgtgctagctcgagaacatcaactgcatgcaaacagtacaacagcatgttgttttccaatcgatcaaaaatatttttcttttcaggtcgtgccatgcttgtacagtatacgtacataactgctctctgctcctcctctcttttaccgctcctgcaatccacatactgccaagtaatttttctcacaaccctactacagtagctctgacgagtactccatggaggaggagtagtatttgtttttctttggcccaagtccaaaaaaggtcccatgggccgactattccctagtcggctaaggtgtgtttagttcatgtcacattgaaagtttttttgaaattgaaaccatgtgatagaaaagttggaagttggtgtatgtaagaaagttttgatgtgatggaaaaattgttaatttgaagaaaaagttgggacgtactctccgcagcctaagaagaatactttgattttatatatatatatatatatatatatatatatatatatatatatagaaaaagagagagagagagaaaggagaagtcgtcccttgtaataaggtaacctccacacaaattttaagtaactagagagaagaaaagaagtgcattgggtagaaaatgtagtcaaagataatacattgatctctaggttaactttaaatttgtgagtagatgacgcgaataaaattagatgtaaccatcacctttaccgtaaaacttgctctaattcatcactctcctattatcattcacttatagaagttctataagtgccaccttgctgcttcgcttgagctcctctgtcgcattgttgttcttggcagggtctagtgtagacgaaaagaggtgtattttgttcaggaacataatgatggatcctagaaccccatagtacactattgaagtacagttggaatattcgagaatgaaaaataaaactatatatactcgatcgatggatcgatctccacttggtatatgtggcactacagagatatatgaccgtactatgcatatgggactttttctttttcacaattaccaagagagattgatgagatcaggcagcaagacttgcatccgtgtacgttagtggccggatatccatgcaaagtgttacaaaagtaaggcaggctgtggctgctagctagcttcctctcaagctcatgcatgcatgagaagcggacaaatcgagcagattctgcagcatatataagcatcgcatctacatatatatacgtacgtgtacatgtgccgctagttcgatctcactagctagctagtggccagtgttgtacgtatatactctctccgtttcaaaatgtttgacaccgttgactttttaaatacgtgtttgaccattcgtcttattcaaaaaatttaagtaattatttattcttttcatacatttgattcattgttaaatatactttcatgtacacatatagttttacgtatttcaaaaaaaaatttaataagacgaacggttaaacatgtgctaaaaagtcaacggtgtcaaacattttaaaacggagggagtatttgtgatttgtgatcgaaatgcatatatgcaagctgctaaagagactagagtagagtcgtagtagatgatcaagctagaaatgcccaaattaaagtatactaattacgtatgctttttttttgttaaaaaaaatgaattgatcgattgatcagctggtcgtggtcagtggtcgcgtaaatggcacatgtaggagtatactcctactacatgaagagaaggcatgcagtattgtactacatgaaagaaggatggtgaggtcaggtcatgcatgggatcctgtgcaacacgtacacacatgcatgcatatacgcagagaatcgcatgcagatgccgatgcaatatgtgccacggtcgatatatatcgatcataccatcaattcacatgcatgcatgcatctgtgtgtgctagaaagaaattaaagaaagaagaatcttcttcacatactccacttgggagtagtacatgatactatcatgcatgctggcacggaccgcttcaagtttagttgcgatgtactactagcagctaacagtcaggacacactgtgtactgttatgttagcgtggagacgagccagccatgcatatgtagtgctgtcatctgttcatttgttgcttcagcgtacgtacgtaagtaatagcagctggctgcatatatatatatatatatatacatacatatatatatatatacatatatatacatatatagatacatatatatatgtatctatatacatatgtatatatatatacatatgtatatgtatatatatacatgtatatatatatatcgaccttatctgaatgcatggctagcttgaccagctctacctagcttacatgcagttccctttaattactttccacctgcgtgcatatatatataagctgctgcatgcccaggtgcaggaatatcctactccttacatttctatatattcgataccgttgacctttttagcacatgtttgaccgttcgtcttattcaaaaacttttgtgaaatatgtaaaactatatgtatatatatatataagtatatttaacaacgaatcaaatgatagaaaaagaattaataattacctaaattttttaataagacgaacggtcaaacatatttacaaaaatcaatggcgtcaaatatttagaaacagatgaagggggtatatataagtatggcttcttaatcaaatattgctaaatagcagatctagtactacttgtatgttgcaccaagttttctgaaagtactacttatgtattattcatgggtctctcctaaggaggccacaaaagagctgaaaaataaggttagttacttagagactgtttggtttggtgccacacattgccacaccacatgttaggcatgccacagattgttagcttagcgtttggttacttgtttcagttgtggcaaaccacactttcttgtttcatgggcctacatgtcatatactcattttctaactaaacattgccacacttgttgccaacaaattgttggccacactttatttgtcatgccacatctatgacaaattgagttatggcaatgttaggcaacaaccaaacagacccttaattactgttcggaattccactatatatgttactatctatatatgcttgatggaacgtagcgagctacgtaacaagctcaagctggctatataatctttagcttgtaaacaaacgtacgcatgcaagagatacaagagatgaagatggatggacgacagctgtacgcatcgtcgtcatctatgggtattggaattgcatgaagccagccagctagctagccatggtagctggagtagctagctagaggtcgcataagtggggatgtcatgcattgaagagagtttgtttagtttcctctaaaggcaggccttttataatttctgccatgcctacccgtcgatcgttgcttgcatatgtacgtacacagcacgatcgatggatctatatatacatacatacatcatatatatccaggggcggatccagaaataaaaaattggaggactcaattacacagtttcttaaacctccagtcatctagagacctttagtttatcatttatagtgaaaataatagaagggggtgttccaggaggtatctataggtcttgtgggtgtaggggagactcgagtccccctgcacccgcgttggatccgccctatatcgatgaaatgatattgcatgacgtacgtgacgtgcttatgcatacatacatacatacatacatatatacatatatatatatatacatatatatatatatatatatacatatatatatatatatatacatatatatatatatatacatatatacatatatatacatatatatatatgcagctaacagcagtgaaattcaattactactcttactccagtaagtagcaaaatgcagatcagggaacgcatgcagtaaaagcctccgtgtcttttggcccctcactaccgatggcgatgtctaaccaccactctatgtatacgtatgtatctacagatcgagctagccaccatggctacctaagatatataggagtaatacgtactccctccttccctaaatgtttgacaccgttgacttttttaaatatgtttgaccgttcgccttattcaaaaaaaatttgtgaaatgtgtaaaactatatgtatacataaaagtatatttaacaataaatcaaatgatagaaaaagaattaataattacttaaatttttgaataagacgaacgatcaaacattttttaaaaagtcaacggcgtcaaatattttgggatggagggagtatatgcttacgtatatcaattgcaatacatgcattgcttgcattggtccctccggctagatagctagtcacatgcatcatcgtcatacatacaagtacatgcatgtacagtgacatgaacagaaagtagtgtagtatcgtagctcctcagtccttgatcgatcactcgcatgcagctagcttcatcagctcgaccggtatcatatatgtgtacatgttgatcgatcgagttgagtatatgactagtctgtgtgccacaatagcatgcacagtgcataactgtttcagtttggcaggcagaggtgcgtgcagataagccagctaagccgcccgtttcgatcctctgtatttatatgtgccatcctcacgcttgatggcttggcatatgcatctctctctctctctttctctctcagctctctttccctcttcctccatcgatcgatctcttgcatgcaagagcaacctgcttcgcttcagacaaagctccttgctacctaacaagctatagctgtagttgaacacacaacttgtgtccagatcgaccacttcgtcttctcttttttatttgtttcaattcgttcgagagctagtatgagatagaatattaaccgatggagagagaatgtctagctagattattcatattttgaagatatatatatatatatatatatatatacacacacacacacacacacacacacacacacacacacacctaccaccggcctctccttccccttctgccttgcgtattaaagctcctttttaatttcagcttgcagtgtatgtatatatatatatagctgttctatctttctgaagattcttggtaagcagttagctagctttattcctttggctctacctcgctgttgtctctgctccacctagctagctagctacctcttcctaatcgatcgcttcttcttcttcttcttcttcttcttcttcttcttcttctttttagtatctctaactagctgtgtgtatagagatattcctgggctgccgcaggttatattcgttattcttttcctattcttaaaacaaaaaaaaaagttgtagccactatatatgtgagagagaactagtgaacaaaggggatttctgtagctgcatgctaggtagctacaacatcagtaatctcgatatacgtacagtactacaagatagtgcctcgatctgccggcagtagagagtgtgatgccgcagctagcagtcggtgatttctgacgtggcatcatcaagattcacacattacattgcatgcatgcatatgtctatgcatctttgagcttgttgttctgatctcaacaacctagctagctaatatttctctcctggccctgacctgcatgatgcatggttgcacgcatggagagagaagaaagagatcgaagctaattaaacgcatgtgtatatatgtgtgggaatcttgatgatgctgcatcggaaattaatgactaagcatcagcttaattgtaccaacgccgccggcgagagtgatcctccctccctctttctgtgacacattgactagcaggtaagaacttatttcaataaacttgtttatatctagatgggccatataatttagtgtaggttaatttgtgaaattaattcactcacatttgattttttttttcagttgcatatatgtattcctttttggaggactggttatgacttagctaagctagctagggaggacttcacaagtcataacaaataagttgaatggttaaacatatttaaaaagtatatggtgctatatattaaaaacaaattaaatagagtaagttattactggtataacatcattatttagaaaagagagagaaaaaacagtgtgcaagttatactccacagcaaggagctagtaacattgacttttctttttgtcctgtagcgatggatgcatgcaaaaaaggctagtaggattgatgcggtggggggaatcaatcaaatccagtcgcgcattctacgggcttcaattcgatacgacatgtatgctgatcgatcaatgctgccagctagctgcgtacgtacatactactgtacgtatatactgtatgtacttctgctcctgcagctatatactgtacgtactacgcggtagagcactgtagcatacagtacgtacgtgtaggagttgttgtaatttgcagccatataggagtatcgatctctatcaaccatatggttcacaactccactccaaattataagtactaagctctgctaacattgctaacattgatcgatccatctcatcccaggtaataagtatatacttaacgcaatgtcacaatctatctaaaataagtagaatgtaacattttctactataaaaaattctgatagaggcatatatctagatcctattgcgttagtaaataacatatcttattacaagctaattattttgtgaccgagaaagtatccgggtacgtagtaggagtagtatatacatgcaggtagggtcatcatcacaggtgctagctacagtaacttgcattgtgtcaacaactcaggtcctgggctcctggctacctagtgagagctacgactatactacctagcaagatactactaatccgtactatactatgctcctcgactttacatggcggccggatatatggatcgatcgatatcacattggcacttcatgtactccatctgttaacgccgttaaaatttttaaacatgtttaaccgtttatcttattaaaaaaattaaataattattaattcttttcctatcatttaataaatatactagtactacttaagtttttaaataatatttataaaagtttttgacggttaaatatgtttagaaaaactaaaagcgtcaaatatttaaatacggagggagtatatatgtaacgtactacgacactacgtacgtactatatactccagtagaccactgtacaagtatagttatctcttcttttcgcaataaataaagcacatcatatcaggagtgacgttacaatattcatgtcgacacgtcgtatatgtacgtacgtactctactatccgtagcattacacaggtagctaagctaggactaagagtagtacgtacgtatgtatatatatgtacttaatacatacgcatacatgcctgtatcattcatcgatcctgtacaacgttgtagactactcacttctgattctgacttcttgtctcgtctcttcttcttcttcttcttgagctcactactagactggagtaggagtactaggcccacaaacccacaatctgtgcatgggccttacctagcaatagtccgtactaaagattctgtaaaaagcccatttggaaattttctagcgagggactattttgaattttagcccaacagcaatagcagccatttgtctcaatcccggaacaagtccactttgtcgccctaaaagaatgtactaatgtgatttgtatccatcaaccgcaatattagattagatatcataacccctcaactataaaaacgggtgcaaaacaattctctcgggtttttgctgacatggatcgttgaccttatctaactaagtaagacagcatatgggaccagttgaggggtcaaaatatatggtattgtggttgagggatacgattcagataggacatataactgagggagttaaagtggactttattcctcccaaccccacatgccacattgtacatttgtacacaacccaacccatttggaaaatgaaatggatgtagtagtagtatcatctactgttacgcatagtgcagtgccatgatctagagattgctgtgactaactggtcaggcattaaacaatttttaagcacgctaattaagctcaaaccggccggatccgacactgctacatcctcgagcacagtgccggcatcgattcggtttcgctagctgcaactgttgtccctgctcggtcagcttcagttcgtcgcaattacagcaattattaccaactagtataaattaatacatatgaagaagataacaaagaaaattggactacatatttatgtagctagctacaacaccaactttaaaactatgtatttatgaaaagtgataccgtgtattaatggtgtaatatatacttgtagataaatagattattagattgactatcaataatttagagttagtaattgactatatacactattaaaactgctctatattcatactgactgacagtggcggagccaggataaaattataacgggggctaaatcaaaatgaccaagagcaactaagagagatttagggttggttttaaaactttttgggccttcttagtcttttgggccttctaacaacctcaaacaaagtctatattagcccctcatctataaatatatagattatgggggctttaatggtatattaggaggtagggggtctaaagatccccttgcccccatgctgtctccgcccctgctgactgacagcttaatttctctgcttcccttaattattcttccttgtttccctataaaaacctttgcttttcacttttatcgagtatatattcggcgctcatctgacagtgtcgtcgtcctccttgtgtgtgtgcatcgatgagatgcgattagttttaagtaattaatcagtcattactagctagctgcagtgggggaaacaatatgtatatatataatacatatgcataatttgtactccctccgtcttataatataaggg

SEQ ID NO: 52572 - DNA, 15519 bp, Oryza sativa
tcccttatattataagacggagggagtaggaagcaatgggatccaaccctacctggcctacatatatggatgtctccttttccattgatcgagatcgtcctctctgcaaattttctgttcctatcgcctgcactacactgctgatagtgatagccctcctcccccacaccaacattttccttccttttctttagtttccccctgcatgcaaatgtctcacaaagcttgtcacttgctacatattaaccatactgctctcccatctaatctaatcctcgaaaaaaaatacattatcacgccgatcgatcggtcgactctctatagctagctcaataatgtatatatatagtaggagtttgattcttttttttttactatagtgtcagttgcttaataatgttgacccatgcaggatgtgacatataccagatcaaaagtgcatgcatgagctcggctatgcattttcaatctttaatttttccccctcctttctgcaaattaatactgtgaaaagaattatttgccacattgatgcatgtatatattcctgcactcatccatgtgaatgtggcacttgcattttgattgaaactagagaggcgccaaagggcaataaaagtaaaaaaagaaaagaaaagaaaggctttagcttgggaatgacaggagtacgtacgtcatggtggtaaagtgcaacggctacataataacaagcttggtggatggaggaggaagaagaagaagaggaagaagaaaagaaagaaagaaagaaaggtagggaacacattggcaatcatgtgatgattcagaaagagagatgacacttgactacactggacgactagcagtagcagcagcggcagctagcaaagagagatcgatgtgatgcagagcaaagcatgagggactagtagtggttattggtacactgggtgtgagtactacggttggtaggtgtaggtaccaagagaatttttagatcgaagccaagcctaacgatatagtatgagcgatgagatgcaatgctgcaatggtagctagctcctgctgctgctgagtaggataggtctctttctgtctgtctcaaccatagcaacatcaacaacacacacacaaggactggattattttttatactattcccctttgcaaaaagttatttcacatatagacccataataaacatattgcaaaaataaatccaaaacttggcacaagagtccttggcggtgatcgaggttagacatctcaccgtcaatcttgttttcacggtacataatttgatgaatcggaagagaggttggaggagaaaatgaagttgtttttttggaagggtacacgtgaaaaagggtgagtgacgattccttggtgcgttgagattggcgcgggcgcgcacacggctgtcggatccaacgggctgaggtgggtgagtagcccaagtactcctactggtttcattgggtcccacccactcccactcccagcagaagatagcagagcacacacactccactactccactgcactgcagtctctctctctctctctcgcaatcagcattgcacattttgcattgcatttttattgttattattctcaggctcatcagctggatgtccctagctcttgctcttcttcttcttcttcttcctagtccccagttcattctcgatctgccaacttcattctcccgtctataaatccatccacagctagccacccactctctactggagtagttgtaattgtttagagcgtgtggtcgaattaatatccatggaggacgagaggtggaagctgtcgagcagcaaggggaggagcaaatcgggcagatcctgcagcagcagcagcaactactactaccactcctccgatttcaacagcagcaacgccaccacgctcagccggagctactccgccagcgtcaccgccagcaggcacgctaccaccgcttggtccgccgccggcgccggtggtggtggcgccagcagcagcagcagctcgcagcatcagcatcagcagcagcagcagcagagcaacaattcgcagcggctgtcgaagaagtgcgtggaggcggtgaaggagcatcgcgcgaggttctacatcgtccgccgctgcgtctccatgctcgtctgctggcgagactactagctcagtctcctcttccttcttctttttcttcttcttctagctcagtttgattcaattttatttatttgtttcccttccataatactccattgctagctccatgcatcatcatcatcatcatcatcgatctctgtgtgtttctgcctgcatcttaatttgttctttctgtaattaatcttgcattgctctctctacaagtatatacttactagctagtagctagcattctcatcttcttactatctatttagttccttcctagctacctagtcgatcagctagtccaagtatgtaatgtatataaaggtgaggtgagctagtcgtccgggaatgttgattttggagctagccgatgaattgtgcttgctgatttctgttaaatatttatgaaatgccaatggtatatatatcgatctggctgtctgtaattctcagtatttggaggcaggcaggcagagctagagtggaggcagtcaattgagtgacgacgactgaagccaaaaatgagtcaatgcatgcatgagcatgacacggatggatgcatgctagggatttgaatcatcatcatgattgatgatggaccgataatccaaagagtaccaataataatccagaggagaggagaggaaagaaagggagtagagtacagtaggtgtgggggcattggtgtctgctaatgagtgaataatggttggtcgtagccgtagataggcagaagaataatacatactctactgagtatatggtccagtcccgggggggagctgagtgagaaggaggcagggcgagttgatcagatgaagcatgtgtgcgtagaccaagtgtcgtccttctcctccggcccggccccccatgcatatgccttcctcacctactcgctcctcctcgctaaataccactcactcactcactctagtgtgcagtgcaatgcaatgcaaagtactcatctcttccatttcaatcaattgactagctagtcgtcggtcggtctaggacttactccctccgtcaaaaaaaaaaaaaagtcaaaccccaggtttccgtgtccaactttgactatctgtcttatatgaaatttttttataattcgtattttcattgttgttagatgataaaacatgattaatattttatgcgtgacttgtctttttaattttttttatattttttttaaataagacggacggtcaaacgttgcacacggaaactagggtttattttttttgggacgaagggagtatatatcttgggcgttgacgcctgctttaatcaagccgctaattgattgaccaacgtactagtgactgcatgatctgtacgtactactatctgtctgtagctagcttatcagattaatgcatgcattcatgctcctatatactactccagtagtggagtagtatatgctatgactaggagtatctgatatcatcgatcgagcagctgctaatgctgatgctcatgtcgatgctatggcggattggcaggcgaattgaagggcagtgtgcacaacgtagtagagcttgagatgcagagcagagagcagagtagagagcagatgtgacgggcgggccacatgcggcgcacgtgcgagattctgttggccacgttaattggttcatgcatggatctgctgcccgcccgtacattttcggttgatagtactaccctcatttctccgcctgccaacacgaacaccacacccatgcaaatgcaaccaacccctcttccattttactcctccacctatctactagctagtactatactctatttactgtcctgtaaatatcatcagttactacaaacttaactacaagacacattaatcaagcatctaggagtatgcatgctgttacatactgtatactactacactctgcatatgctgctactaacattgttaacatgtcatgaatgctgagcaatgctagcaaagcaatgcaatgcaatgcaaagcgaccagatctgtgagttggaggcctcaacagtgcgtgccgattacctttttctttctttctttctttcttttgccactcatccactgcaggcaggcaggtcgtgcagctgcagcaacaggacagcaggccccttctccttggctctgtgtgtgtgactctcatgactcacacgctctctgatgactactagtgctactaggacagctagcaatttggccctccatccctgaaacacacacaaatgcatgtgcacgcaatccatccgtctatctgccttgagtattttattatgaaaaataagacttagaagattaaaaaaaaaactagtactgctacattttgctttaggtgtaaacatatatatctcattatctaaaggggaaaaaagaggagaggtatatatatatgtggtctatctatgttgagttttgattataacaatccagattgatcaatgcagttgtgtacaaaatgctattggatttgtaaaatagaagaaaatgcaatatgttataaatataattccacttttaaagaaggagcactctagttttcagtgatataaaaatacctacaaatttcagccactttcactttgtgacggctttgatcatgccaagatttgtataggtgcggcacaataaccttatcctctccccgtcccttctttcctcctcgtaatgcatttggcctctccaccttgccccgcacatttgtcacccatgctcgcaggcttcataagtcaccaatagcgttggcacatttcaccagactccacccttcctcctcctccttatgcttatgcctgagtggccgcaggtttcctcacccttcccgtcttccccttctctgatatagtctcctggccacccctctaaatcccggtgaaccaccctcctcatcttcccctaacccacccctaacttctaattagtaggttttttgtcataatttaggttttgttagtaaagagaaagatgaagagatcgatcatcaaggagagtgtcgtcgtcgtcgcaatcgctgataagcccgggctaccccctacccccaccaccctcttctctctctttaatttctctcttgttgcctcccctagtttggaggatgaaggatgaaggtgactcgaatactatgattagttacattactgacatagggttatgagaaccaacaaaaatcaacatgttgatggaatggaagagagatggacacgaatgtatatttaacaagtgcatatgtatttttataaatatatatatattaatgcaattatatatattaaaaatagatcacatgaaaaatcctatatatatcttaatttattatgctcagtttgtggttgctatgttgtgttatggttgttttattacaaaaccaaaaacttacaattaatggttgtatatgttttcttttacagatcaaattatagccacttcaaacggaattttaatagtagtagtattattgtttgtgacatacagattataaaaagaagggggggaaagggaaattgatgggcccgtgctttgtggtcaggtcgggtgggtcattgtatttcagttgaatttaatttgtgtcggcccaaccccaccactggcccatctgtgctctcgtctgcctctgaaatgcatgggtggacgaacaggtcaggtcgtccttttcctgacgtggccagtccttccttccaaaataaaaccatctcgtataaaataaaatatctttatagtataataactaaatctaaatagatgggagaaagtatgatgagtatggatttggtttgtagaaactgttctcgtttggcccagcttgcaagtgtacgggaggaatggtagtaattttcttcattttcagtgaactcaaatgggtacaattttggtggatttgagtacagaaaacaaagtacttctttgacatattttctttgctatgcttgctaagctgcagctagctcctttctggttcaacttgcagcttggaaattgatttcttctctacgataatgtgtcctccaaaaaggaaaaaagaatatttgaatcaagttgcagtagatttttaagttaattattagaagaagagatgggatacatttcacataattcgatccaaggggaccaaattaaacaaactgtggccataagcatatacttcttccgtttcacaatgtaaaactttctagcattgctcatatatatatatatatatatatatatatgtatgtatatatatatatatgtatatatatatatatgtatatatatatatatgtatgtatgtatgtatatatgtatgcatgtatatatgtatatatgtatgtatatatgtatgcatgtatatatatatatatatatatatatatatatatatatatatatatatatgtatatatatatatatatgtatgtatatgttaatgaatctagccacatatgtatatagattaattaacatctactccccccattctaaaatataaggcataaccaaccctaactcaaagaccaagaaataattattaatccctccgtattttaatgtatggcgccgttgactttttaatcaacgtttgaccactcatcttattcaaaatttttatgcaaatataaaaatacttatgtcatgcttaaagaacatttgatgataaatcaaatcacaataaaataaattataattacatgaatttttttgaataagacgaaatgtcaaacatttgtcaaaaagtcaacggcgtcatacattaaaatatggaggtagtatcatcttgtagtttgtatcatcctaataaatacaatgcatgcatccaatagaattagagaacatgagagtagaggatttaaaaaagtaataatttcatggagaatgggccatagttatattatggattatcaaaaaaaagtggttgtgccttatattatggaatgaagggagtatataaatatggacaatgctagaaattcttacattgtgaaacatatgaagtatatgcgtgcatctcccaatcaaaaccaaaattgtaagcaagagctggctaagccatacccggttaatcccaacgcaatgttgaccatcgatccaacccaattattgagaaataacgagaactacctccatttcatattataactttgactcttttttttcgttaaaccatcaatcaagtttgcaaaagaatttagaaaaatctataacaccaaattagtttaactaaatgtttgataatttgtgtgttttgtgttataaatgttgctatatttttttttataaactttgctaaacttggaacaacttgactagaatcaagtttgtagaagaatttagaaatatttatactaccaaattagttttactagatgtttggtaatttgtttgttttgtgttataaatgttgctaattttttttataaattttgctaaacttggaataacttgactagaaaaaaaaatcagaacgacttataacataaaacagatggagaatatacatgaatgaaattgtggatgcactctccatgtatagtactctatttcttttttaaaaaagggagtaaaatcatggataatgtatatatccaccggtgtacgtatcgaatcagttgcatcgtactatatgattgcaagccagatcgaaaccacgcatccccaagtacaaccttaaccgatctgttatgtgcactagaaataacctgtatgaatttatcattatatcctcgtcgtacggtgcaaattaatcaagagtagctgtcaattgtactccattagaggaattaattaaagatttatgttgccgctgctgctgccaacctcttaagtggtccgtctgaaaaaattgattttcgcagatggatgatgaaaacccatcccggtttatatttttcaggtggacatttggcttcgagaatcataccgtctgaaaaaaataaaagaccagtgtcactaaaaatctctttttctagtagagacagatgggttgatatgacgagttggcgacgccctacggcgcctatgggtttactatgcaggagcgagttgaaatgagttcgtgaatttattgttcatggctatatatattatctaaacaaaaactagctagcttgttgagtttttttccagctagcatgctttaagctaatcgatctcgtatgcttcaaataattaagtgtgttgatcagcgatttcgtgccaggtgacggcaccaccactcttttctggtctaaccagattgagagccgctcggtaactttcctttgcacccaaccttctccttgttatgccaccacgtatccgggctttaagcacggtcctcttggctctcgccgataacttttgggtggggaatattcatggcactctcacggtccctgtcatttcttagttactcgtgctctaggacgcattttgtctggcgttggacgagtgaccaacgatactcgactcgcttggcttgccatgcgttatttctcggccaacaatcctttgcttgcgccaatcttctttggcaagctaaaagtcccgttaagtgcaaattattcctttggcttgcgttccagcaacattgttggatggccgaccttcttctcaagcggggtatcaacagccactcggcctaccccttctacgcccaagagctggagacggcgaaccacatccttctcgattgtgtttttgctcgtcaggtctgacgccaagtcttgtattcctctggctggtctgacctcgcctcttctcttggctgctcgctctaggtctggtgactaccttctagggcacgcctatcagagcatcttcgcaatggtttcgattccctaatcctcttgatatcctagcaggtgtggaacgaacggaactctagatttttcgactactcactctttttcaattttggtggtattggagttcatccgtttggaaggtcgtctctagtcttttgtcggcgctgctgtttttggagtatttctaggattttagtgggctccaccaccaccttccctcatattaggagtcttttcttttccttaaagtttttttttcacagttttcccgtttccattttttcatgtacgttggcgacaatctttctggccatttgcgttgtgtaattctctttttaatatattgacgcataattcttttgctcgttcatgaaaagtgtgttcggtgataatgtgtgtgggtatgagtgtctcatgtaattgaaagggaaagctctgccgtcactagtccgtatatgccatggaggatgaatggataacccgcgtttgaagaagctaagtatccaataatctaattaaacatttaattcagagattattggtgggagagcatataccaattaacaaacttagctaatagtcatcatccagttgttcatacatgacaaagagagagttaggggacgacgtacagctcccaagttgtagtacaacttgaccctcaaaaagtcagcacttgtactgcacaccatgcgtagtacgttcgttcgttgatgcacatatatatgcgatggcccgagcaagacttcacgctttatatagtacaatatatttaatttagttccttacttattgaaaatttgatctgacttgtcaatttagaattcatctcccgctaacacacgtcactggattatatattatatcaatcaatacttgtttcagttataaaacttttgggaaagtgatttcatcctcaatgggatatcctctcgtttcgtgcatgccacctaaatagtcataagaaaatataaaataaatggcaatatagactaatatgaaatatatcgtttcacaaacatgcaagtttaaattcaacttcgataatttgtaacaaaaataacaaatattattgtaatagggggataacgccctccctcctatccggttgaaacacctaaaatagtttacggaaagattctaagtgtaaaacagggaaaacactctcgagttggaaaacactcttgagtggcttcttatcagttatatgtaactcatcttacttaaagatgaattctaactacatggcaggtaaaccggggtgattggaaagttgatggaggatgtgcgaaccctcgagaatagaagacattcggctaagaagaactcgaaggaaaaacctattcgagttgagatcaagtcgaatggaagattttgtgggggccacttctcaaccactcttgccagctggagccaaaagactataatgaccctgagaatatactgtaatacccctaaggttgctgacatggcaagggcgttataggaaattcactaaagcccatgagggtagaaatgtaacatcacatgtaagaccgtaggctataaaagctgatcaaatccctgtagcaagacaagatatttttaatacaaaagtaatcctcaagagttgtgtttgttgtttgagctcatttctaaggataggcgggaaaatacttctttccggtctatccccaatcttgttcgtgacctaaggtcccaataaatatatttgtgaatgtgcgataactattttgagtttaatttgttatttttgttgcaacttgtaaaagtaaaatttggttttgcatgtttgtagagtgatatatatatttcgtattaatctatattatcaatttttttcaaattttttaataactatttagatggtatgcaaacaacgaggggatgtcccctcgagggatcagaatccacatccaaaactttttatgtttatagtaaaaagtaaaattcgatcaaacttttgatatcttgaccactgatattagaacaagcttataaaatctaactgtactttgtaatattatgacttctcatggcaaatttatggacgtccttttaaaaatatggatattcgagatgtaattgatgatcaaagtttaataaaattttgttctaataaactgtaaatatttattactggataaggtaaaacgtacatctagcttaacctaacatcatcgtatcccttctttttataaaactaatatccactgaatacctaaaactcaacgtgaaacatattatttattagcactattaaaacacatatgcaagcatgccatatcaactcattaagcacataaaacttaacatgcaagcatataataattatatttataatttgtttcattataaaactaaacatacacatactggatcatcattctcaaattaatcatctattatattattaaaggaatagaaaaaggagcctccacgttcactcacataacctagaaattttcatattaatcgaagaaaaagaaaaatgcagactccatatagaaatacaatttagaaatagctgaaattcggaattaaaaaataagaaatattagaagaggagactagagtccatatagaaatacaatttagaaatagttgaaattcggaattaaaaaataaggagtattagaagaggagactagagtccatatagaaatacaattaggaaataactgaaattcggaattaaaaataaggaatattagaagtagagtatagagtctatatagaaatacaattaggaaataatagaaattcggaattaaaataaggaatattagaagtagagtatagagccatatgaaaaagcattgtccatatagaaatataatttagaaatagctgaaatttggaattaaaaaataagggatattagaagaggagactagagtccatatagaaatacaatttagaaatagttgaaattaggaattaaaaaatcaggaatattagaagaggagactagagtccatatagaaatataattaggaaataactgaaatttggaattaaaaataaggaattttagaagtagagtatagagtccatatagaaatacaattaggaaataacagaaattaggaattaaaaataaggaatattagaagtagagtatatagtccatatagaaatataattaagaaaaaaagaaattcggaattaaaaaaataaggaatattagaagtagagtatagagttcatatagaaatttaaaactaaataaaattcagaataaacataataaaatgaaaagttgtgtttagagtccatataaaaatacaatttacaaataactaaaatttaaaattaagaaaaacatgggaagaagagtttaaagtcaatataggaatacaatttagaagtaactgaaatttgaaattaaaaattaaagaatattgacagatgagtttagagtccacatagaaatacaattagaaataataaaaattcagaattaaaaaagaaatattaaaagataagtctagagtccatataggaatatatatatatatatatatatataatttacaaataactaaaatttgatattaaaaataattaataactaacacgtatataaaatacaatatgaatattacacattagtagtttcgtaaagttattgcaaaatttaaaattacgttgtcattgtaatatattttaataatataatgagaaaacatatatactattatatgagagaaaatataatgatgctagccgcgcaatctgcgcgggccaccatactagtttttataatatatcaatccgagtccttcatcatttctccattatctaacatatatccagcagcaaagcgttgggcatctctaaacccgagtttactttaacacacctataatatatagacgtgtatatatatataagctctcacaatccagcctcctacctagtggctggcccagaagtcgatcgatcgatcgtgacggcgacggcgcgagccacgaccatggccaggacgatgacgatgagggtttcttcgctccttgtcgccgtggtcctcctcgccgcgctctcgttccaggcgtgcagcggccatggcggcatcaacgacggcgacgggcaggtcgacgccccggcaacgcctgcgtcgtcgtccggcgtgcggtccaaggggctgatcgccgtgaaggtgtggtgcctggtgatcctgctggtgttcaccttcgccggcggcgtctccccctacttctaccggtggaacgagagcttcctcctcctcggcacccagttcgccgccggcgtcttcctcggcaccgcgctgatgcacttcctcgccgactccacctccaccttcaagggcctcactaccaaccagtacccgttctccttcatgctcacctgcgtcggcttcctgctcaccatgctcagcgacctcgtcatcgccgccgtcgcgcggaggagcgccgccgccggcgttagcgacaaccaggtcagtgagcagcagcagcggcagcaagccgagggggcggtgatgagccgcaaggaggaggaggcggcggcggtggcgcacccggcgatgctggtgaggacatcgtcgttcgaggacgccgtgctgctcatcgtcgcgctctgtttccactccgtctttgaagggatcgccattggtgtctcaggtcaggacaaagcttgttgcaatctgattcatttaaattcagttcttttaactaattaaattcagtttgactgattttttttttgctccaagtctctgggacaaaattctgtcagtgtgcaattaatgttcattgctagctgactcatttttaggccaattgttatgctaaaacctagagttgtttgttctgtctccagatatttcgatctctttgatttggctaattgatcatctcatctcactagttacttgaattatttgtcctcttgcttaatcatttttacagctgataagttacaaattttcaaggcattaattaatttcaatacaatattagcctgttgttttagcatgatcaaaattacgggatacattatacatagacagatgatgtaacgattaattgctagctagctagtaaaactgcatgtgctatataatttgaacgatgatatggtttcttgaaaatcttgagtgattactggaagaaaaggaacaaaaattggaatgtatatatggatgaaataattggactctctgatgtcaatatgagatgaattgcagcgagcaagagcgaggcgtggaggaacctgtggacgatcgggctgcacaagatattcgcggcggtggcgatgggaatcgcgctgctccggatgatccccaagcgccccttcctcatgaccgtcgtctactccctcgccttcgccgtctccagccccgtcggcgtcggcatcggcatcgccatcgacgccacctcccaggccgcgccgccgactggacctacgccatctccatgggcctcgccaccggcgtcttcatctacgtcgccatcaaccacctcatcgccaagggctaccgcccccaccaccccaccgccgccgacaagccgctcttcaagttcctcgccgtcctcctcggcgtcgccgtcatggctgtcgtcatgatctgggactgatccatccatcctagtattacactgcttcatttcttcaattcctgcgcccatgtatgtatgcttaatttggcttgtttaattaactgtatgtacacatgctgcatgcatgttcgatttctatcaccccattcattaatcgtggccgaaacagttcatgtccactaatgattgctgtatctatctacatatatcaaaccgtgaataaaagttgttataaaacgtactgttggtttcgttggatcattttttctgatgatgaaaaatatcgcatgaatttgagtgcgcagagaccaacaaagaaaggaataagatcactttgactccctcaactgaccaccgaatctaaatcgtatccttcaaccgcaataacagaaatcttacccccaacttacaaaaccggtacaatttgactctcttggtggttttggaaagtggttttgctgatatggcgcacacgtggcagtattgacttggtctttgtcccacgtggcattgacgtggcgcttatgtagcattaaaatttaaaaatataagcagggtccatttgtcattcacacaaaaataattgtaggccccactgatatgtgggtcccacatgtcatcccctctttatcccttcttccttctccttctcctcccttctctatgtctccctctttctcacatgtgggccaccggaccaatcaaccccgggaaagccatggcgaccacgccgaccaccgccaccaccaccctctccgccgcccgcctcctcatccccaccgtcgccgcatcgcgcgcttccttctccaccctcgccctcccgcgatctccctatggggtctcccgctccaccgccgccggttgccgcggccacctcgccgagccatggcgaccacgccgaccaccaccaccaccaccccctccgccgcccgccgccgcatcgcacgcttccttctccaccctcgccctcccgcgatctccctatccctctcccgctccgtcgccgccggctgccgcggccacctcgccggcgcggcctcaaagtccaagggc

SEQ ID NO: 52573 - DNA, 1089 bp, Oryza sativa
ccggcgggtggtggccaggcgtctcgtaggagatgtcgaagattaggtggccggtgcctggaaaggtggtgggcaccacaggcgtcgtgctcggcgtcatcgcgagctccaccgccgcgctgctctccgtcaacgcgctcctcgcggagctctccgaccgcaccgccgctcgagccctcgcctgccgccggctcatgtcaaggggagagagagagagagagaaataagggagagaggaggaagaagggtggtgagagagaggatgatatgtgggacccgcatgtcagtagggcccacaattattttttgtatgaatgacaaatgggtttaattttaatgccacataagcgccacgtcaatgccacgtgggacgaagaccaagtcaacactgccacgtgtgcgccacgtcaacaaaaccactctccaaaatcactaagggagtcaaattgtaccggttttgtaagttggggttcaagatttctggtactgtggttgagggatacgatttagattcagtggtcagttgagggagtcaaagtgatcttattccacaaagaaaagatgcggcccaagcccaacactacggcccatctctccggagcctcagagctggatgcccctctgcctctgcttcactgcttgcattgcatatttgcatacaaacacttctggatatgagaagctcagttaatttgcatttggaaatatattactccagtaaagactatctctcctccaccatccatgcgtctaaccaacaatgaaacgggtcatctggaattgaaaggtggcagatagcaccacacgattatacaatttttcaactgcaaaacgaacattacctcggacattaaacacgcacgtttcagctggagacatccaaactactactcccaccattttaaattgatctacatatagttttttttgtttatttctaaatgatctacatatttgtgttcatttattaagtctattcgttatttgtgtattggagtaaatagacattgatgcatgtatccatgcacacaagtatttataacccacatgcaatatcttgatttggtattggctaggaaaatattgggg

SEQ ID NO: 52574 - DNA, 5273 bp, Oryza sativa
acctgtggaagtcgtcataatcaaactggtacccaacagcctgcatcatcataagattgaaaggaacaatacttaagagggttacagaacagcaaggaagatatgaacaagcacccaaaaaggggggcaactttgctggggaatagagtaaagcatacagaccctcaaaccggccatggtagttccatactgcttgtagaggaggacgcatagctccaaactgatgctctcttccacaccaagcttttcgatcatataagctgaaacatccaaacaacaccacatacctcatcaacatatctgttccaagaaatgctaatacgttgtgcttgactgtttgtgtaccttggatgttccttacgacgtcggctccaatgccggaggtcaccggatacagcgtgtcatcaaggtctaaaaaggaaaatgaacaaggtatgaaaatcttgcagtttcactttaaatgaaattccttttttttttctgaaatgcaattggagacagcaccagtgatggcaagaattactattgaatcattcgctccgtccctaaatatttgatgccgttgacttttttaaacatgtttgaccatttgtcttatttaaaaaattttgtgaatattattcaaaaacttgagtagtagtatatttaacaatgaatcaaatgataggaaaagaattaataattacttaaattttttaaataagatgagcgtttaaacatatttaaaaaagttaacggcgtcaaatgtttaaggagggagggagtactggttaagcaatgggtagcataccgaagacgaggctgtcgccgttgagcctctgctccttgctgtagttgctctcgcactccatctcgatctgatacaaccaaccaaccaacagaagaaaaaaaaagtaacgactttacgcccaaacaaacaatacaaacacaggattgaagagagatatccgattcagatctaagctttggcgttacaggccggactagtacaagatttgactaggatccccaatgaactgccgccatccttgatacacacaaaaataaaaaaggaaattggctggtccaagaaaagaagggaatgggaaaacagacctgcttgatgaattggttgtgtgaaggcagaagattggttcgcgcggtgagccggagtgaagaaacaaaagggatgagaaaagcaggaaaggaaatcgtgggaagaatcgctgggcaggcaggagattgcagttggaagcggccgtatatgtagatggagatggagatggagatggagatggagtgaactagtcgatgaggcgtcggcgccgcccctccccgcgaggaatgagaaggaaagggagccgttgtgctgtggaaaaaaaatatattttcttctctctttcttttttcatgtctagggctaacaacttttttgacggaaatatttgatgggtgttttctcattgcttactttgtccctgatgacgccttacactctccagaaaaatatatattgttaatttaatatagtattaattattataagaaatagtataaatttgtacccatgaaagtgtttttataaagcaagcgttatactacatgccaaattcagatgatgcaacaaataaatattcatggagatatttaaatccgatgtttattggtttcattagtacttgactgtcgttgacaaattcaatttcagttgatggcaggctgcaaacgtgacaggattattgttactagtacttgttctgcacgtattggtatttggggtcaatgtgtaaccatcagatccaaacaaactactctatcctagtagcagtactaatttttgatgagtaaacagctatagattgttgttaaaagtcaatgtcctcgtagcagacgtactacgtgtgcagttatctgtccaaatcattttctcttttctgaaagattcagttatctatccagattgctccacaaacaaagagcaatgaggaagaagtgaaggttcagctctttcttgcttcgtgctccatacagcaacaagaattcttacaagagaagaaataagcagattgaggaagagatggcggcattattgttccatgaagatgagtcgctgaagcatcattgcacacagctcatttggatcacctacctggttgcacttgaactggatgctggattgaattgcttcttgcatttgcatcggcagctcggcaccaatctgtcaaaccgactacgctaccacttctcatgtgcacccatcactccttgcaggctgccgcgtgtaactcgaccacaagaatcaacttgtttttttttttgggttacttcgtgttagtagttctttaaaaaaaaaacttgctagtattattcatttcataaaataaaataaagctgaacttgtgactgaggaagaggcgtgatcatcatggagaaagtcttcttggccaagaattcaatatcatactggctggctgcttgcttgcctgattttaataagtttggaccaggcttggggttgcaccgaccatgctatatgctggttcgctcttttttcctttatgccggctcaaaggcgtcacccaaattccatcttactcctcttcatctcttctttctcgagaacggtctcagcatcggatgccgtttacccgtctgcacaatgctgctttcaggaagcaacaagaattatactactagtaaactgaacaagagtacaacttaaccagtctgaatgcagcatcctgtgtggcaagctgttgtttacagctcaaggcataaacaaaaagactgacaaaggctggcatttaagcaacaaacataatccagaggtttgatccattttgaagtcatgaaatggccacaaagtgtgtgagaataatacaagcatataagtttgtgataaattacaaggcccttgtttctctgcaatgaaattccaaacaagaaactagccgacttatgagcttctaatacaaagaattggttatgttaatatgagttcttctccctttctctcgatctcacagacacacacgcgcacacaaacaataaatgaataattaggcctcacaatttacaaatcgctgaagaactgcacaagttcagaaaattatgtttcatacaaacatatgcattttctttgcctcctattatggtcaccgtatgtggcttctcgagaatgaccagagcccaatatcacgaacaggagcctggtgcaaacaatatggcagttcaagctacaagccacaaaataaataaaatctgtgttcaacaatagatgcctacctgtgtcttcattgaaggaaaaatattccaaaatctgagggtttcatccccggctcctgttactattgtctgcaaatgagtaatatgcatcatttaggacgattcccaggaatatttttccggatacatgatttgcagtttggaaaaagatttacctgtccatcaggtgacattgcaaggtaaagcactcgcagcgtgtgtccagttagagtagcaacctgtttatcgaaaacataaaatacttagtggtactgcactagtggaaatctttcttgaacagatattaaaaattcaaaggaattattctactcttatccttatctgcaaatacaaatgaaaatagccccctgtgaaatacttcacttggatttgcagccatactgatattgttctttttaagcattacatgctcgtcaactatgttgatactaaattccttttaagcgtttaagcaatccatgagtcaatgtctcggcccacagaaaggaatgagttctttggaaacaaccctaggagaaatcagacacataacttcctctgctttttttcacgtttttatccgaatgagtgattacttgatgcacaattgtctaactggtgaattagtaggcttgacagcccacgggaatttaagcttacctttgacatagatgggtacttccacaccatgatttggttttgggaatacccatgagtgctcacaagctcatttacatttttacaccaggcaagattacaaacctgaaaacagaaagcagctggtgaggatgacagtaaaaattcactgaactactttttagaggcttgttcagaactactcgcctggctgcctgtgtccactgaattcagcatgtttccattaaccgtgttccagaacctgatacacctatcagcggttccaccacctgatgccaggaggccttgctgatgtggtgaccatgctattgctttaactgcagctgtgtgttctgtcagcctcaatatcggctgctgcgaacgttggttccatactagcagctgattatcatttccaccggatgcaagctcacggtcgtcgtgcgaccatttcagtccacagacctgaccaaaaaaactgtcacttgatgcacatacatggttctgaaatcttactgtgagatgggatgattttaacttgcatagttagtgagctattttccaaaaacctatggcttggaagtagttagaagtctcacctctgatctgtgccctgagaacttgctgatatagtcacttgggacacggatgtcatgctgcaatatgttcttgtccctgctaccggaggacaagattcgggagctccatgctaatacaccagtccgtgtttggtgtcctcccatgttcctaatccgtttacagcgagagctatcccaaatctgttggaatttatgtatgcatcaaattctcgatagccatgaacaaattcacagagttgaacaaaaacaataggctaattcaagtataggtagtttgagatttgcagacaaaactgtcgcacacatcctggacacattgaaagaagtatgtacgtgttgtgatagtgatagttagtactagaatcgaataaaagtttagagtttcagcaatagggcttatgtttcaaatctttactagtgtacatctatcatacgagatggtgaacgaagcgaattgcatcagcccaggattcaggatatttggaacaattgatgtatatagtttgtgtaattgttgtgatgaaatctaaagagtgtagaaaacaattactactaagtactagatagataaactgaagacaatcatatgctgcagccaatttattcagtagaaagtaaagaaaagaaaataagagggggaacctggacatcgccaaggctggtgccgatggcaagataggagccttctcgggtccagtgcacagcgcagacgctgtccctgggccccaaatcgcagagcttggtgaccttgcaattggaagccgaccagaggtagacgcaattcccgaggccgac

SEQ ID NO: 52575 - DNA, 1202 bp, Oryza sativa
agtccgggccgaagatctcggcgcggaggaagcgggagtagggggcgtcgtcggtggtggagaagggggaggcgcggtcgcggtcgaggagggcgaagttgtggaggcgggaggaggagcggcaggggataagcggtcgctgtacgtggtcttggaaggggatggcgtcttggggacgtcgaggaggaggcgggccggggaggcgacggcgggatcgaggcggagcccccccgccatcgccggcggcacgttgaggcgcggcggcgccggcttgggggacgcgtccgtcgccatcgagagagactagggatctctttcttgctcgtctgctgccccgccacccaccgccgccggcacgtcgaggctggatgcgccgccgacgacgacaacgacgacgaggaggaggaagaggagcggagatgaggttgcaacggtcactttggttggagtgggcaagtcgcctactttttctagcacgagctgtctccctctgactgtgggccccccacccgagtagccgttgtactctctctgccatgcgggccggcccattagcatttccttcctcgctttctttctttaaaggcccgtggaaaaaccaagcccatggattcgcatttgttttgggccggccagatcttacgtgtatgatgtgttgggccaacatgatactaggcccaaacatatagtacttttcttttctttcagatgctactattatattaccaccgagaagaggaaatgtgaacaagaaagaatgtgatagaggcattggatgagcaatgtgatttttttattagccgcagaaaatattgacagtccgggcgatttaactcgtgcaatatctcatcaatatatgattgatacaaatatagagattatattaattattattgcatcgccaatatttaagccagccggccggcgagagcatcttatagctagatttccatatgacatagcataggatggatctacatatactacttctatatactatactctgatgaagatacatacatatagtagtagatacaacgtgtacctttcgatacgatgcatggtggatcagctggaaattaacaaaagcaacaactatagtagtaatacgtgctgcactagctacgtacgtacagtacgcatacatacctatatatatcttgtaagtactagatcgactagctagctagctagagaatact

SEQ ID NO: 52576 - DNA, 945 bp, Oryza sativa
agtggtgcctccgcctacacggctggcctattaagccgccgctgttgggcgtttacgacttcaccgccggcctgcctccgttgccgccgactggtgtcctcgcctatacggttggttggtcacaccaccgttcatgggcgtccacgtcttcgccgaccggctggccttcgccgccgccgactggtgtttccgcctacacggctggcctattatgccgccgctgttggacgtctacgacttcaccgccggcctgcctccgtcgccgccgactggtgtcctcgcctatacggttggttggtcacaccaccgttcatgggcgtccacgtcttcgccgaccggctggccttcgccgccgccgactggtgtttctgcctacacggctagcctattatgccgctgctgttgggcgtctacgacttcaccgttggcctgcctctgccgccgccgactggtgtttccgcctacacggctggcctattatgccgccgctgttggacgtctacgacttcaccgccggcctgcctccgtcgccgccgactggtgtcctcgcctatacggttggttggtcacaccaccgttcatgggcgtccacgtcttcgccgaccgactggccttcgccgccgccgactggtgtttctgcctacacggctagcctattatgccgctgctgttgggcgtctacgacttcaccgttggcctgcctctgccgccactgactggtgtttttgcctatacggttggcggactccgccgttgttaatgggcttcaccatctacaccactggcttggttccactggcgccgactggtgtttttgtcaccattgatggactgcttcattcccacatcggctacttctgctgtcaccgagggaatacgacaaagctaagtcatcatttattttattctttatatgatatttttccttttcctctgcctcactac

SEQ ID NO: 52577 - DNA, 1259 bp, Oryza sativa
accacgatgcaaccacccgatcaccagctagaccgttggactggtgaaccaacaggttagctaatgttgatattttcttttacattgcatggaagaaacactcacaactatgcacgctcgccacactcgtcactcgttaaggtgccctataacacatgtttgaagagaaagaagtcagcggcaaaattaatccctaatcttattaaaatcttattgaaaatacgtcgagcgtacatgatttttggtgtgcaccaagacttaaactcttgtgtgtacatgatctttaatttcttccgtaaatccgtctatgttcttttggaattggggatgtttgatttgaacagatcacaatgagaatgcaaagaggtgtttcaccctactttcaatcaccgatcgatttcacacactagctaaatactgactgatcaggaagaatgggatgatcctaatctgctagctttgcgtggcgcctgatctttagactcagtttgcactcatcttatcagcttcttattaatatccacacaaaatgcttattattacctcatctgaaccgtgggtttggaaatccctgttctaaactttgtgggggcatgttcaattatagactctagtataaacctacagtacgaggttatttaaaaaccatgtctatacaacagtcaaaaggaaaaaagactctaaccattaactaaaaaaaaaatttgttgttatctttttttcactcatataaccttgtttccattttatggaggctaagtagatgttgagttcgctgttaacccaacaatgatgttttgtctctcatgtttctctcttctaaatctaaataaatattcttaataattagtaaaactaaaagtcatctattaatgatgattgtacataccctgataaataagtagcgaccaactttccatcagataagtctagcgaaagacgaccttttcactctcagtactccagctaattaaattcatacatacatggtataaacacagctttccttctgcaaaagccaagttggcacagatcgaaaagatgaacctgtttccttctctagttcacactcgttttcacgaatatggtgacgctgccatccagacaaacggccatcgtcggcttgacaagctgatgaacacccaacatcgccatctcctgcacaattgccacacagctatagcctgtttgagagggagtaagaataggagatgaagagtttgagaggataagtcatacggattatatacggtacatca

SEQ ID NO: 52578 - DNA, 1623 bp, Oryza sativa
acctttttcgctgcatttgtaatattttgtatttttgtaagacgtggatccgtatgtcaacaattgtcgtttgtgtaccctggctggtcctggacaggggtttaatacacattcagcttagaaattctggttcgtgaatttctgggcgtgacacaacctagctatgatcagttacaaaataccatattgtcttccttgacgagagaggttagacaatgctttgccaattttccattttatagctttataaaacagttttcacaatttcaatgtactttctgcagaacattataaacaactcttctagatttgaccttggtccactgccggaatcaaattttattgccacaaaccgaaaagctgcagtgcagccgccaataacgacagcaaccaaagagggcagggcaacaattcggaagagaaaagctgagccaaggaagagaaatacgcaacccaataagaaatcagagttgaagaaaagggaggagacaaagaaaaagtgaacaatatattcaacttgataaaaaggattagcttataatttagccagaagttctgtttattttttgccaaccaatcagacatgtttcattttggactgtgctctgttacattgctctaagttccaattcaggaacatctcttgtttttcctgtttatacaacagctatttatggtaaaacatttcagaatattaggagcacatttctgccaggatttgtctatggacaagaaaacataccacatatgtctgtacagaaattgctactggtcaaagcaatgttagcaaaattcaggttatcacttggacatacaattccaaaagagagaatacaagcagtatttgctacatcgtgttcaccattcatttaagtagctaaaaaattcatgtatcccttatataacaaaagcacttccagagtatttacaaaagcacctacattgccattattcactcacatactgctttgacagcaacaaagagtcaaagagtcctctcactgtggtacaccagatgcagttatcatgatgctgattccactatggacgaagaatcccataaaattacagcacaaaaaaatggaaggttcagattctcatcagttgaagggaacctactacggccatgggcagcgatggtggcttcaaggtctaacaaccccctgcactggctttgagtcctgacggtgccgtggccgggcttcgtgtcccatcgaccgctgacccacgccggtttcgagtcccgaggaccgccgccaccagctttgagtcccgacgactgctgccgcacgccggctttgagtcccaccgaccgctgcagccggaagctacatatttgaggtcctatccctcatggtgattaattgatcgtactagaaaatgtcctcaaatgggaaaaacaacaggggatttgtgcaaaattaatatgatgtgtaaagggccctcacgtagactttgtccaaggtggaaagctgacgtggcaaaaaatcttatgtggcagtcttttgaaccacaaacgcacccacctagccaagttgttgcatcgatatgtctaattttcaagttcttgtacttaatcgcacccacccgccaagttcttgtaccgtcaacgcaatttactct

SEQ ID NO: 52579 - DNA, 813 bp, Oryza sativa
ttcatccattgggcgtcagcttgtcatggttaattcgccggtaattactatgtcatcgcactgttggcaaccaaaatctactgggaacacgtatgttcttttccttttcttactggtattttttttctcataatcctctgttatcaaaagcagcaaaatatagtacgtactaccaccatagtacttgtattacacggcatatagaataaatctccaatagcaacgtctacgggtgcatgcatcaggctggcattcagccgaacgtcgtaggtgcagtcgcgcgtccagatcaatgcgcggcggcctactacatgggtcacatggcctgtgcgtgcgcccacgagcgccgggggatcatggccttgtttggttgacttgagggctctcgctcaggcaggtcgatccagctgcagacacaaaattagatgtcggagaattgcgtctgagtcaggcaagattttcagggcaagaagtaaccagaccccatgtccttcgtttgatcgactcactctcacctatgtgttctcccagtccctccattgctccggcaaagagagatcatgattatttatcatctagtctatggtcatgtttgaaaaagattcaagcagcacaatgtgtattagtaaatctctacagctactccaaacaatctagatttgaagaatcagcaactgtggaataaaaataaactaaaggcatttttcagcttcgctaaattgattactaagtgattatcattggttaattctcagaatctcaaacccccctaaatagagggtacatagatggttttatatgcatcattgtcac

SEQ ID NO: 52580 - DNA, 777 bp, Oryza sativa
gggcgggcggcggcgccggcgggcccgggtggtggagcctcaacgtggagggcgtaatgctgctgctcagggtcgtccaggcggtcagggggcggaagctgccggcgccggagaagaggacgcgcgacggggcgagcgacgccgccggcctgagaggcggcggcatcatgggcggcggcggcggcggcgccgcgaggcggtggtgcggcggccggccgaagaagctgggcaacacggtgggcgcgtgtggaactcctgatctgaggctttgtgttaatgttcccaaaagtgaaccgagagagagagagagattattaataggtaattaagcggaggattaggttaatgatatagagtttaacaagttgatctgtactgttagatgcatgatcaggtactaatgcttggtcatagtgtttcttgttctgcttctaataatattcatgaatcggtgtttaattagttactggttttacatttgtgagttgtgactgatatcctaaattaaaagcggattaaattaaggccgcttgcgtttgaatcacacaactctagctattgacggctgaaaaaaagaacgggtcattagcgtataattaatcaataataaattgagtattacggatataatcaatcaatattgatcgagtattagggtatgtttggtgcctaactcttcagaaaagattagcgcattattaattaataattagttagtattaggtacgtttggtagcagctaagaattaatcgagtagccacttataagagcaagtg

SEQ ID NO: 52581 - DNA, 797 bp, Oryza sativa
gattaattaactgaagatatagcttggaatgttctcacagccaattgacaaggtatttggacttgccttaacaaactagccgtgcttgcccccgacattatatttgcacatcttcttctgtgcacaggtgaacaaaattctctgccagagtcaatacctgacaaaaacaagcaaaggccaacccacacttgagcacaaatgttagcattacaaatctcgtcgatccctaccctagggtagttctcttttagaacaataaaaatggtttaaatgtccggcctatctgacatatggatacctgcaagataagctccatggacatagccattgtagcgctcgctcgtgtgctcaccggtgaagtacactctcccaaccggcgccttgtgcacagaaacagcaaaaaatacacacaaccaaaattaatctcaaatccaaaccgcatcaatttgtgaattgtgattagcatttggttggagtagtagttcgtaccctgagctggtcatactcgtagcgactgacgccgatgggccagttggagaagctgccccggaagaacctgtcggaccaccatctcgggacgaggatgtcggtggcgtcggggacatactcgtcagggaacatgcacctcacaacctccatgatctctgccttggtctggctgtaccgctgctgctcgatccgcctcgactcctcgtcggtcaccgtcaccaggagcacattggcatccgggtattgcttctcaaactcctgaagaatgttcagatcatcgcaatgtactacaattcgatgtgagtgga

SEQ ID NO: 52582 - DNA, 2329 bp, Oryza sativa
  unsure (1)..(2329): unsure at all n locations
tcaaaccgatgaatgtttgtgagtgacatgaatagattttacagcaaaacttaattaattgtgttttcagacaatagaaacaaactatgcatgcaaattattattgcatccaaaatatatatatcctactagcatacatatgcatgttgcattatattgcctgaagttgaataatttcagcggcggcctctgtcacgcaccatacgtgcagaagagaatcgacctggctgatgaagcggataagagtggggagaatctctccgccacactgcacccaagcggccgggacgacatgtcaatcctttcaatgcaacggctcaacgatcagtacgtgcctttgcccctcaagtctttacttgaaataaaaaacgttaagcacataaaagaacacttcaaaagttatttgattttttttgcgacaaaaagttattcgaattgatttgtcttactgtaagagtatagatagatataganaatcgtttgaaatttgtgtaaggactgaactaatcgtatattgggcctcgaaagatgtaggactatcaactaggcccaaaaagacactaaggcctccttcaagatttatagttggaattttgatagatcaatgaacaagttgattttgtgatagctatttgagggtatatacacaaattaattaattaactactacttacaaatttaaaaagttggttcagcaaaacagtatatagaaaactgacacaaaatatccatttagaagcttagaaaacgcgcaaatgaaaaatccaaaatccagtacaagctagctggcctgaataactggcctgacaagcagtacaacatagcactacaagctgtgaatttactttctgctgtttcgggtgcgtgcaaatgcatgcaattggcagcctacccaacggcccgtcgtcgccggtggacatgcggtggactacttcacctacgactacgagttcgccgagccgccgcgcgtgaccagcctgcagaacaccgttcccctccccactttcccgactttcggagacgacacctatttggtcgcgaaccaacgtggttagaagtccgtcgtccaccacctcgccggccagtacctcaacgccgacaagtccggcaacatcgccgacgcccgcctgaagctcaacaaggttgatcatatcacttctgatgccatgatcttttctgtcagaaaagatgaactgattaagcacgcgatcatcatggtggtatatatgatcgatgcaggtggtgcgtgagatctcctactcctcgaccggcgtcaccgtgaagacggaggacaactcgacgtaccaggcagactatgtcatggtttctgcgagcttgggagtcctgcagagcgatctcatacagttcaagccacagctgcctgtcagtttctatgtccaaatgtccttgcatgttcaacatatcctcttccaaatataaattaagatgtgcatatcgagcagtcaaatttactttacgtttcttgcatgtttccatcagtcttggaagattcttgcgatctaccaattcgacatggccgtgtacaccaagatattcgtcaagttccccaagaaattctggcccgaaggggcagggagggagttcttcctctacgcgagcaccaggagaggctactacggagtctggcaggtacaaaatatgcagcaatatatacaatccactcacatcgaattgtagtacattgcgatgatctgaacattcttcaggagtttgagaagcaatacccggatgccaatgtgctcctggtgacggtgaccgacgaggagtcgaggcggatcgagcagcagccggacagccagaccaaggcagagatcatggaggttgtgaggagcatgttccctgacgaggacgtccccgacgccaccgacatcctcgtcccgagatggtggcggacaggttcttccaaggcagcttctccaactggcccatcggcgtcagtcgctacgaacatgaccagctcagggtacgagctgttactccaaccaaatgctaatcgcaattcactacagatcatgtttttcattgctactttgatgtttctttggtcatgaacaaatgaggtttaaatttgagcttaatttggttttgtgtatgttttgctggtttctgcacacaaagcgccggttgggagagtctatttcacccggtgagcacacgagcgagcgctacaatggctatgtccatggagcttatcttgcaggtatctatgcctaatttgttagcctatgtctctaatgttagagagaccggagatgtaaaccatttttattgtcttaaaaaaatacctgctctagtgattgacgagatt

SEQ ID NO: 52583 - DNA, 761 bp, Oryza sativa
tataactataaattcttagaatctaaactaaaagctaaactgtgtagggagtttttaagtctaaaagatactacgaagatccctagacaggccctatgagcatagctaataatacaaccagctactgagattatagatttttattagtctatctttcaacccactcatatagttgttagcttttcactgtaataaatatatggtccatctgcccttcatagatttattttttggttttttttctaaaccagctgtcacaaattcatagaccgtttctcctcacttttctctcctctctcgtctactttcttacagagacgtctattatgcttgctctaagcccctgattaggcaggccaatgccgccggtatttgattcgaccggcgcgcagcgcgcgaactcgaacggctcggctcggcgcgcgcgcgcgcgcgaagcggtcgcggattcgcggcgcaggcgaggcggcggcatgcaaggggtccagcgctgcgggacgcgtggccgtcgtcgggccacgtcgcgctgcggtgggggccgcgtgtaacgcctgcgggccccacgcctgggcccctaccccccgctcgatgtggcgcgcaggtgtcccgcgtgcgtggcgcgtgccctgcatgcatgcaatgcaatgcaatacgctctcttctcccgcgcgggcgcggccttcgtttcgcgaccccccactgcttcttcttcctcggtcggcgaccatggctatctactactaccactacctccctcttat

SEQ ID NO: 52584 - DNA, 1050 bp, Oryza sativa
ccgcgcttccacccacacgcacaggtgccgccagaccgcatcagcgccctgccggacgaggtgctccgcctcgtgctgttgctgctcccggcgcacgaggcggtggcgacgtgcgtgctcgcccgtcgttggctccaccactgggaggaagcaccgggcctctccatcgattggtggggttatcaggagttggacaggttcatcagcttcgtggatcgggttttcacgctccgcaggtacaacgcgcctctgaatcactgccatttctacatgtatttcctgaggttagtgcctggaagggagcggctcttcgtccgctggatccggcaagccttgcgctgccaagctcgggtgctacgaatctgtttgatacttaggggctgtttggttcccagccacactttaccattacttgccaacaaaagttgtcacaccttacctaaggtgaggtgatcaaattgttagccacaacttactaagtctaagggaatcttgccacacttttttgagccattgacacgtgggacccaatttgttggaggggaatcttgccacaactgtggctacaaccaaacacctgtcaaatctgtctaaccttaggcgttgcaaactgtggcaaagtgtagcttgcaaccaaacacacccttactccaagatgcctaacatgactctcatctctcagcacctcacaaggtctagagcattgaccatgaaggctatcatctctcagcacctcacaaggtctagagcattgaccatgaaggctatcatctctcagcacctcacaaggtctagagcattgaccatgaaggctagtatttgggatttttgtttaaattttgtaattgcctatatttgtgattcttttttgttaaagtaaaaaacatcacaagagatgcttatatttggtcaaaatgctcatcacacaagctgaaatcacaaattaggagcaaaatcacgcaaaactgaaaaaaatagggcaaaaatacaataaccatccaggatataaatgtccttttttttaacaactagcaccgttaaaatcggccg

SEQ ID NO: 52585 - DNA, 1426 bp, Oryza sativa
atcgactatgcttttcgacctgatcttgggtcctcctaagtcctactcaccctcctccaggacgaaccttgtggacaaatgacatcttcaattatcagaaattgtaacattagtattagtaaatttatattatatctaataacaatgatttctttagttatatatttgctttaacaatggcacaatgattggggtccatttaaaagaccgttcccatttttatgtccattttgtctccacggatcctgttttttatcatgctatcataagagttaagtacgattgtctctttcagaaaaatgtttaagtacatttttttgtgacaccctagaagttttgttgtgacagttgctaatgattgtgtgcactataatactttattaaaatgctatacatgctgccagcttcttggagatggaaggaattacggagtagcacaaataactgtgattggctggttcaagacttcaagaagacacaacaactctcaggagcctctctaagctacaacacatgctaattacgattcgtgatgcatcgctttcctgaggaaataaaacactgctggctgttaaatgttactccctgttaatgggactcctatttgtatccaagctgttgaacatcaaattgtttcatcattgaatggtaagacatggaacactaacgtacagttgttggttcgaatactccgataagggttcaatagagcattcagtttataattggaaagagagaagttatctgaaaaatataattgcacattgctgatagtggtaccaattagagtttttttatggtacattctactgctagtatatactaccagtatgtttgatctgacggtgtaaatttatctgatttccctcccaattatactgcagtataatttggatagggtatatttgtttttttatctttttgcatgggggtatttttgtaaattaacgcgaactcacttagtcagatccgtttcaccacatcgactctaaaccgaatccgctcggctcgcatgggtgtccgccgccgctggcttctatccaggagcactccagtggctgcagggcaggcagggcaaccaggacggagatgggaggcgtggggaggctgccggctcgacgagggcactctcgccgttgtggtttgggcaaggcacaagctgtgggaggtcggatgtgggggagaataggctagggatggaggcaaggcgccggggacgtgggagacgccgggcacgtggaggttcggcttctcccggcgccggaggaatcgggatggaggcgtcggcgcgggagcgatgtgcgccaggagcagcgacgccggagacgcgagatgtatcgagaagaagcggatgacgacatccacagaaaaaactaaggaaaattaatccgggtgaaattataattctctaatttaaatgaccaaa

SEQ ID NO: 52586 - DNA, 710 bp, Oryza sativa
ccatgaattcagaaccccagagtccgcacatcctcaaatacaaagcacttccctagttagatgtaagttagacttgccgttcgaaaaactctttacttctttacttgccttcatttaatgcccaattaatgaatgccacctgggtggaaccgaaaggtggaaatggaaggtcttagttcggaggtgggatctctacctgatagttgcattgcattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcaaatacggatgtaaccttggatgtgcccgtgcccaatgaagaagaagagcgcaacatgaaacgtaagtaccaaagtaccggacacccacccaaatcccaataaaatccgccaaatcctgcgggaaattgtaatcccattcaccagctcctacatttaattaacaagagaactattgtatttatctaacacctggattatctccacctttcatttgatcccta

SEQ ID NO: 52587 - DNA, 1235 bp, Oryza sativa
accttcaacacagccgaggaggcggcgctggcctacaaccaggcggcgtaccgcctccgcggcgacgcgggcggctcaacttccccgacaacgcgcctcccgcggcccgctccacgcctccgtcgacgccaagctccagacgctctgccagaacatcgccgccgccaagaacgccaagaagtcctctgtctccgcctccgccgccgcaacatcctccgcgcccaccagcaactgctcgtcgccgtcctccgacgacgcgtcgtcctgcctggagtccgccgactcgtcgccctccctgtcgccgtcctccgccgccaccacggccgagacgccggcgaccgtgccggagatgcagcagctcgacttcagcgaggcgccgtgggacgaggccgccgccttcgccctcaccaagtacccgtcctacgagatcgactgggactccctcctcgccgccaattaacaccaccaccacttcttggctagtactcacgccgtcgttagcctaatcgtcgccgccgccgccgccgtgcagatgggattttagacattttgcaccgcacggacgggcatggattagcagttttatagtccctaatccttttggtttggttcgtttgtgtacgtagatcgatctctctccggacttgtttcctctgtagatgctagggttggttggtgttcttcctcaaccggagacgccgatgctaccggcagccggcgtttttgtgtccggcgtgcgtctccggtgggccggtcacttggtcggttactccggccgtggcgtccattgctctttaagtctgttattaccttctactgctgatcttacaggttgtaaacagtagtagtagcattattattattattatgtcttgtaatattattagcgtgttataagaacttgtaatgtgaattacctctactactactattattattatttagcgtcgctgttaaaattgttgtgtgtaatctttttctgatttcaccttccacttgcgaagatctgcctgttgagttgcttgtgtgtgggggcaaagaaacacttcgctttccagaaaggagaagacgaacaaactcgtctgtctgactgtctctgcatcaacgtcactggatttcggctagcggatgcagatctcatctcaacggcgcgaagctttgggcgaagatgttcttcaatattttccgcttaattttctaccatgttaatccgaaagcgacgctacccgtggacc

SEQ ID NO: 52588 - DNA, 1588 bp, Oryza sativa
agccccatgtgatagctaaatcattgacgtttagatgttggacttcgataacaggatcactagcgtcgggaaaaaaggtctaattttaaatatgtgcttttaagaatctatttacaaaataatttttaaaaggctcgaaacataatagaatccgacagtagtagggtaagtctggttgcttggctgggcttggcgttccatgacttctatccttgctgctacacgggaaaaatatacagtgcaaaccacatgacacatatgtagtggaaacctgaaagctatagttacataaaaaaatagacgtattcgtccacgtcattatgagtaaaattttgacccctaatgatggtagttctcgatgcaaaggtattcatacgtctattttttaatttgatggtagtttttgggtgtttactatatacgtaatttccggtgtatatttatactactctatgctgaatgctgaagtaaatgtgaaatggcaggcacaccagccactggacaaggaggtagggtcggcctcatctgcaactgatcaccggtcaccaccaccgttgggtaagtagcagcagcgtgtagtgggcaagtctcaaatacagtgatccttggtggccggtacaacattcttgatggcaaagtggttgctcacatacagtgatccataactagtgctttatttttgttgggaagtccaaatgatactcttttttgttgaatgaaaaatagggccaattggtttggagccggtttttttgtcataccaaaatttagtgccaaaatgttggtatgtttagtaccactagattgatagtatagaatttgtatagtatgtgtaaaaattgatagcaaacaaaacatccatataacattattgaagttgccaaatttttttggtaggacaaagcactataaaaaaattattttcccatacaatcaaaaccaattttcgcatgtggttgggtcgccgcctgctagggcagcgcacctgtccgcgaaaatccgccttctgcgggcggtaaattatgtcgcccaccctcggaaagaaaaatcgctaaaaccctatctagctcccatccacaggtgacattaacactatagtctgctatcgctcgtcaccgtcgttgccacagaggccccgcagctcatactcatcgtcgtcgccctgcccccatgccttcaccacctccaccgttgccccttctcaccccggtagcagcggcagcgtggatccgcctgtcacggggatgctcgacagcggaacccattgcggcgccacccgacggcggatcccgcctagaggggagttagctgccgaatcctcgtgggagaggagttgagagagaagggatcgactacagtcaccgtcgccgagcttgagcacgctgtcagctgctcgggagggggaggcgagggagagaggaggtgagaaatgagagagagaagagggggggggggggttgagagagataaggatgaggaagagaggaggtgaaagataaggatgagaacttataaaattttgaagatgtggaaaggaagagagaaggacggtcaaacttttcgtaggcggacctcttaatcggcctct

SEQ ID NO: 52589 - DNA, 926 bp, Oryza sativa
agggagtattaccaattcattgccagatcaagaacattatttcacagctttggtttaatatgtcaactgcaaataattgaaacaaataagtaccaagagtcaagaagtatacccccaagacaatgggcagctacactagtttgttgatgatttagaagctttctggatctccaaagttatcgcctcagcaagatcagatgcctcatactctgctccaaagcatcgtgctgtctccaagcatggatctagcaagtacctgtatatttatacagtcaagtgcctgacacattacaacaaggcaagctatatagaataataccgtgcgtgcttacatgttatgagagctttctacaagatagtcctgaccaatgtcatcaacctttttgaagaaaacacggtattcctgtgcaatctgtcttactgcattgatggatcccgttagtcctattattcttgggtcaaactctgccgttcaaagaaacaaactaatcattcccaaatacagtgaatttgaaggttccaatagcatgaaaaatagagagcaacttaccactaagatatgccttaagctgagcaggtgaatcacgttgaggatcaattgtgataaagagtggtgtaatcttggtgccatattttgactctatgaaacgacaaattaagaactgtaagaaaaggaagatcacaaatgtaatacaaacaacagagttcagataaatctaattattataaggaaattatagcatacataaaaattaatattttatagggagaactactaccaatttaaaaagcccagctaacagaatctacatcagtgaaagctcaatgctttcgtgactctcagtaagccacgtaagcagataatctccagccatttgatgcaaacagaaggaaatataaaccgccagattggacaaagacactag

SEQ ID NO: 52590 - DNA, 881 bp, Oryza sativa
aaccaattttcggattcggaaaaattcggtcggaactatccggaacttttcggattcggaaaccaattcggattttttttctcggatacgaaaacgaatacagtaagggtgatatccgatggaaacgtaaactgtcggaaactatctgggatttttcatcggatatccgatattttagcaaaagagagatttttcagccaaaaaaataaaaaaaccctaaaaccctagccggccgccttcgcgccgcccactgccagccgccgcatggcgggcgatagatccgcgccgctgcggccgcctgccgctggccgtcgcggggctgagcgccgaacacctccgtaggacggcagatccggcccctcccgagggcggcgccgctggatccgccgcctgccgctgtcgcccaccgacgctgtcgccgcgcatcgaagccgtcgccgtagtcgagcccgctgccgccgcccatcgccgtgacccggccgccccaaggccggcgccaccggattcgctcatcaccgtcagttgcacgtcgtcgcctcgcgccgccgagccctcgccgtcgcctcacgacgtcggatcccgcggctccgggaccgccaaccctggatccagccaccacgaggctcgcgtcgccgttcgccgcacgccgtcgcctcgcgccgccacgccccagtcatcgccattgcctcacaacgtcagattgggccgctccggggccagcaccgtcgaatccgctcgccgccgtccgttgcacgccgtcgcctcgcgccgcggagcccacgacgtcggccaccccgaggccggcatcgccatccggcgcacgctgtcgtgggaggaagggtggcggctaggagagtgggactgtgggagtggccgggtag

SEQ ID NO: 52591 - DNA, 1220 bp, Oryza sativa
tcacctcactaggtcaccgggttgaggtttagcactatgaaccatagtggaaaaaatcggaccaatagatgacccggtcatcttgctggttcaccgatctgacagtccaaccgtgaaccggccggtcgtaaccaatcaaccagggatcgactccccactagcgcacattttcattcgatttttgcgaaaaaaaaatcaagcctgcgcacaagtatggcccaaacacactaactgggccatcgtgtggcacattcattcactaacttgccttagtctggtccgaccaaaggcggtttattgcccggttcatcacaaaacaggccggttcaagcgatctgaagcggttcaattgtacgtccggtctttctattcgaccgaaccattgcaacctctggttccggttttttcgggttaaaccgctgacctagtctgattttttccactatgaaccctaccagcactagaccgatctttggttttggcgacgagccttgagagtcctcttggccgtgcatctctccctcttatacaagtgctagtgggcttgggggctaaaccgataaggatttaagttggttgttaactgatcaaactacctctagttcttatctactctattttatgttaggaagataacggtggaattatctatcctttaaaagtcatatgaatttatttttaaatttaaaatacttaatggctcaccttgttttatatatgctcttaattttttcatttccccctactctcaaattaagtggttacttggctagaagtccgtactccatagtgatggtgtgtggcaaagttacgatcattcgctccattgaaccgcaatcattctacgagcaatccgttaacaaatctaacaagagacacaaagcacgctgaacagtgaatcggacgaggagaaaatgcatgataattaagcactagccataggcgtggaaccagtgagggtgacaacaaagtcaactaataaccggtgatctggattattaatttgatattcttagttccagctaagtaagttccatctgcccagctgttttctgggatcaagctgttggtttaatttgatcttccagaggtcaggtcaacttccttgcattgcattatgggagagccaacagttacacatgaccaacatctttttgtccataacttatggaccattagtacattatgctagtaccattaatatattgattgatactttc

SEQ ID NO: 52592 - DNA, 1026 bp, Oryza sativa
  unsure (1)..(1026): unsure at all n locations
tccacccgtcctgccgccacgccgcaccggatccagtggaagcagcgcccagtgtcacggcctccacgctgcgttgccgcaattatgcgtcaccgcgtggggcccactcggcagtgagaccatgcaggctccgctgctgctgtcatcgcgagaaagcgattagcgggaggaggagtaacatcgaaggaaacccactaatcccggattattttgagcaattaccgctctaatccggggcgataagacgagggaaattactaattaagggaggggattaaccggtaatggtctttggagctggagagcttcgctataaaagagctccaatggcgtccctcacacctccccgcccaccattcccactttcgcccacacacacacccagatccacagccatcctcccaccgccgccgccaccatctccaagcccacgaacacccacagcccccgtgagctcgagcgaggtaagaaaagctttagatctgagcgacttcgagcgtcttcaaggtaaagttttctcgaaaccctcttcttcttcttcctcctctggctcccccacctgttcttctacggtttcttggttaggttgcttgcagagagcgagagacccagggccttttagatccagggctcccagatctgctgtttttctttcatcttctttgtgttctagtgttaggttggtagccaagaggggttctttttccacacctcacttgctagatctaccaccaaaaagccatctgtttttttactgtggctgtcgatttctccctccttcctgcctgttcttgattttggattcggaaccaggcaaatctttgttactactgttttagtatcagaaaaaaaaatcccaaaaaaaagagtgagagatggctgcagctatagatctgtcaggggaggagctngatgagagcactcgagccttttatccgagatgcctccggctcgcctccggtttgttcccagtttagtcccacctcgccattctccttcccgcacgcgttcgcgtacggtggcggg

SEQ ID NO: 52593 - DNA, 912 bp, Oryza sativa
gggctggtcggttttgcaagctccagtggctttattgtgggggtaatggagctgccgccatttcgggctcaacatccttagagcatggcatcacaacaggtgttgatggtggcagtggtcagcggcgtgccgcttgcaaccatccaaaagggggttggtgtggccatcgcctcgtcatttgttctgctcttctgccctgtctcgtgctcaacgtcctataagtgtcttggtgatggtgactggatggttcgtcgaggcggtgagatggaggtggctgttgtggccggttggacaactttagctcgatgacgacaacttgaggtgatggcgaagtcgtgggcagtgccaatggcatcctgctctccatgtgataataaggtgcctgcacgagaagtgaaaacagtgggatccttagtagtgccggcggcaaccggattcaccctaatggccagatctgtttctacttcttgttttgcaagacaactacaacaaggagcggcattggcaggatgaaggcaagctggttggcaatgctagtgatggatggggtgcgacattggatctggggcctaaatgttgttgtattgtatccgaggtatccgtgcgtgacattatctatttgtgtagtagcaaaggtgaactggagggacttcttctttttctcctctgaatgacattggcaagcgaaggaagtagatgctgggagttactaaatttgaatcgattggatccagctgtcgatagggatatggtggggaaaggagcgaatcaaatatggatgtaacgtggatgaggagtataggagtttggattccatatcaagatcgacttggtgtggttcttggtacggcagggctcgttaagtagaagaaaaccgaagattagtcttctagtccttttctttttttattt

SEQ ID NO: 52594 - DNA, 731 bp, Oryza sativa
ttttaataattttttcggatttaatgggggactggccattcttccacacatgattggctacataggcattgagaaatgtaaatattaatgaattgtttatttacgaggaatgactagtagcatgtttaaatagatgacaagtagaattatttatccttgatctgtgtgccaagataaaatatgtagatagtagtatacattgcatttcctcgtactgatgaaacatgggcagcatcagcggccggtgagtgagcgtaaagctgcctctcgccgcccacacaagttgctcagataaatactatggagcctggagagattttgttcggactaggtcgtgctattttgttattatatactccatccgtttcaaaatgtttgacgccgttgactttttagcatatgtttgaccgttcgtcttattcaaaaaatttaagtaattattaattcttttcttatcatttaatttattgttaaatatatttttatgtaggcatataattttacatatttcacaaaagtttttaaataagacgaacggtcaaacatgtgataaaaagtcaacggtgtcaaatatttcgaaacggagggagtacctgattagatgtaacgcatcctattacaacgaatttggacaagttatccagattggtcacattcaatcaaaatctcttatatttagggacatatgaaataggttttatcttgatttttatttccatattttttaaaat

SEQ ID NO: 52595 - DNA, 1930 bp, Oryza sativa
gtgacactatagaatactcaagcttgtttcagtggaatacaaccagcctagacagaaatgtctgcactacgagatcctatgggaaagagagcctgactcagcacaggtgattaaagattcttggtccagttcgggtgagaaatcagacttgggggacataaatcggtctctcgcaaaagtcatggcggctttgcgttcctggagcaaaacaaaggtgaaaaatgtgggtagagaacttgcaaaggcaaggaagaagctgggggacttgattgcttcagatgctgataattcccaaattcgttttgccactgaccaaatgaatgaactgttatacaaagaggaaatgctttggcttcagtggtctagagtgaattggcacaaggaaggagataagaataccaaattttttcatagtagggcggtatggagagcaaaaaagaatagaatcacaaaactgaaagatttgcagggtactgtgcaccgtacgacaacagcaatggaatcaatggcaactgattatttccaggagatgtttgctgcagacccgaccttgaaccctgaatctgtcaccagattattccaagctaaggtaacggctgaaatgaatgacctgctctgtgcagacttcaaggatgaagagatcgctcaggctttgttccagattggaccgttgaaagctccgggtcctgacggtttccctgcccgcttttatcaacgaaattgggggatcattaaagaggacatcatcagtgcagttagtaagttctttcagactggatgtatgccagaaggagtcaataatacgactatagttctaattccaaaaattgagcaacctatggaattgaaggactttcggccaattagcttatgcaatgttctttacaaagttgtctccaagtgcctggttaacaggctcagaccgatgctcaatgaattggtatcagaggaacagagtgcttttgtccgaggccgaatgataacagataacgcgctcctagcctttgagtgttttcactatattcagaaaaacaggaaagctaacaaggcagcgtgtgcttatgacagggtggattggcgtttccttgatatggcaatgaatcggttgggtttcgctcaccgctgggttaactggataatgacttgcgtaaccacggtgagatattctgttaaattcaatggaacttttctacgatcatttgctccctctcgaggattaagacagggagaccccctgtcgccttttcttttcctgttcgtggcagatgggttatctcttttgttgaaggaaaaggtccaacaaggttctctgacccccccccccttagtatctgtcgcaatgcgccgggcatatcacaccttttgtttgccgatgacacccttctgttcttcaaagcaaatcaggcacatgcagcaacggtgaaagatgttgtaaacacttatgcgcagggaacgggccaattgatcaacccggctaaatgctcaattttgtgcgatgatgcttcccccatcgagatcactgaggtaataaaacagattctccagttagaaaagagcaactttgaagataaatatcttggttttcccaccccggaaggtagaatgaacaaggggagattgcagagcctacaaagtaaaatctggaagcggctgatccaatggggtgaaaaatttctctcttcgggtgggaaggaagttctggttaaggctgtaatccaggccattccggtctatgtaatgggcttatttaagctcccggattctgtgtgtgacgacctaacaaagctcaccaggaatttttggtagggctcggagaatggtagaagaaagactcactggagagtgtgggagtgcctgacaaaaccaaagttttgtggtgggctaggcttcagggattacagattgtttaatcaagctcttctcgctcgtc

SEQ ID NO: 52596 - DNA, 5395 bp, Oryza sativa
aagaaggggataatttggagggtcggtaatggtcaatctatacgcatgtggagagacccttggattcctcgggatcactcgagaagaccagtgacgatgagaggaaattgcagactgaaatgggtctctgatttaatagggcaagatggtacctggatgttgcacagatcaggaggtgcttcctgaacatagacactgagttaatcttatcgatttgtctttctccccgccaggaagaagactttctagcttggcaccctgacaagtctgggcggttctcagtccggagtgcttataatcttgcctgtaggctggcaaatactgaaggatcctcaagttcctttgctttgcattcccgcaaatcctgggatttaatttggaagtgtaagctcccacagaagattaaaatctttgcctggaaagtggcctccaattgtttagctaccatggacaacaaaaggaaaaggaagttggtaaactctgatatctgtatcatctgcaatagagaggtggagaattctgtacacgctctcttcaaatgtccccgagccagtgccttgttgtcggatatggtacagtcaggtaacttgtcgcttgttttggtgaatttccaattcggcaattactggctgtttgattgtttggaatatataccaactgaagaacatgagatgtttttattaactctctggcgaaactggtatgtgtgtaatgaaatcacacacataataagccgcctcctctgttggaagtctccaaaagattcctggaaagttatattgctactctattccaaatcacgctgatctggaaaaaggtaaaactgttgttagcagatctgttataagtgcaattagaagaagaggaccagatggtcctcctgctgcatcgacccgtttgcactaggagaagccgaggctgggctggatgaaacttaatgtagatggctcatttgatgctgatcgtgggaagggaggtatcagtatgattctacgggacaacagtggtagtacagtttttgcagcatgtaagtccctggatagctgcaagaatgccctggaggcagaaatccgagcttgcatggagggattgattttggccctgcagtggactatgcgccctatcttgattgaaacagattgtgtttcgctagtcaatcttctgaaggaagggaatagggatctgtctgaagttgtaatttcatttcatagctagtctgtgaggacgttttgaatgagtaatacacttttttccccgcaaaaaaaatagtcaatccaataccgaaccaataaactgtcagacagttaatttcagatgcactcctcgcaaaaaaaaaatcagatgcacgtactaagatcataataagatattcctatatcgtattcaaatatcaatatatagcatgttctctctctagaaaaaaataaacctcaatataatagaagggctgttcctggatccccgacgacatgatggagtcttgatcaacactgcgccgagaagggcatgaggactaagaccctgtttgattcagcttagagttattataattcagattattacaagcagctaacatcttattctatgttaatccagcttataataatctggctcaataatttagattacaataatcttatgctaaaataaacgggccctaatataattaggaagataacttgatctataactatcgggctgaggtcctcttatattgatggaggactctgtccaagtaagaaccgcgagtgacgttccccttaaggttcctgttcctcttagtcccatgacacataatcaaggtgacttataggtatggtgctgaatagaattaaaccaaaataaaatagcagatagttgggagagctatatgtagatctgtattactctttaaaatttgtactagatcaatcatacattaaaattgcatgccttagtaacaaacgacatcaactccttagggaaaggctgtatgcctacgggcagaggccggagatgtaacacatttccattatctaaaaaaactccttagggaaaacgtaacataaaccacaattactgaatcagtagatagattaatcgggatatcagctagattaattaatcaaaatatatgaaggataatgaacaaccgaaatgcataataaatatttatcttcctctagatacatgcataaaaggacaagtaccacaaaatatcaccacagtgtagtcatatggtgagatgaagagtacttgtccctgctgcatgagttttcttccctaatttgatttatcatccacaataacatatgatatctagctactatagctagctagtgatatatcaccaggccagtacagcaatatagtactggtaggactagtgatggtgcatctttcaacaggggagacatgatcagaacaaagaaagagagagcccagtagcacaactctctgcttcttgatcagcaccaatagcaacagtagcatgatcatgatcttcctcttgtttcctccagctgcattctctcttcctcttctcgccccgcggacagatatcgagtgagagatccagattaagagggccttcttgatggttactaccctcactgcagatcatctctttcagaactggtctttgatggttcatgatattatcatctggagatgaagaagagccttggacaaaatctggatggttgctggtattagctctagctacatacctagcacttgatctgcggaaaggagcttcagcttcagctgctggtgggtaatagggttttgatccaacaagcaggtgatggcctgcagggagccagtatgatccatgacatctccatggggaccatgaattgccaaacctatatatgtaaatatatatagtccattattagtgatcgacgtcaataattagtcagaacaagttataattaattatctactgtaggagttcagaagagaccgagagacttcaattatgcatcccagagtgtgctacatgccagacaagaaactaactaaaggtgtctgaaattgaatggaatttgtttgcgagcaagagttgcatggatctaacaactacctggactggaagatggtaccggagccagcagtgatagagcgatgatggagagcaggcagggaaagatggccaaggttgtacgcttgtcccccatggccaccaccttgcatttgcagatgatcatctgatctccatgactcaccacctatcactgtatatatgcacatatatagcatctagtattaattagttatacataaactaaaatcgatctgttcatgaagaattaattatttggtctgtccatatatgtatatgtgacataccctggccggactcatcgatcttcttgctcctatacatctgaaatcgaacacagggaaaacatatggattatattaattttaggaaattaagagaaatacagatactacttctactgagaataagaaagaaacaagtttgttaggtacctggagatggctcttgacatggcctatgctaagccctctaacattcatcagctgaagaacgagcttaggagttgcgcctgcatacatatattaattagttacatatagatagaaaagtgaataatgaaattatatatagcatcaggatcatatatatcgcgagctagatcaatgggtaaattaaatagatatgcttatatatagggaggatcatatatatcagactgaaccgaagatgatgaaattaagctttctatatatatggcaaggcaaaaatatgtaggaataggatggcttacgatcttggccaccgagcctgtcgacggcgcggacgaaggagaggtggagctccggcgtccaacggaggcgagggttcttggagcggacgtaggggcgcaccgacgacgacgacgacgtgcgccgcctgctctccccggatccctcctcctccgtagtactgctcgtcgtcgagctcccgtagttgttggccgccgccgccggtgcaccgccgccgccgtcctcctcctcctcctccttgcctgcacttcccatatatagcgatcgagacaaagctagatagggaaattaaggaaggatcaccggccggccaactctctatagctttagcaagcttagcttgatgatgaacacgagtcgtcttgttgctgctgatgcggctgcatctgcatgatatcgccggccactgatatgatgtcaaaagaggctataggagaagccaaaagctgaagctggagctgaggtcaccattcaattctatctatctacctagctacaccccatatatatgtccagatgcatatatattgctgcctttttggaagggattgagctaagcatgcatgctcatatacaagtaactactaacaagctactctagtactagtaattaaggtagctagctaggtaattaaaggcagcaggtggattcatgcatgaggaggagaagcaggtaaatatctaattaagatccagggacagacaatcttccaagaagtagctactccagtttggaattggttggaacttactccatccaaagtctttgataggtttctctgagtcttacttgtagaattttcatcgatttctaacttgttaatttcctttttgtctcttagctagtatagtaagagcagtggactaaaaggatcgacccagtgtgaaaatgagagatggagaaaagagtccaagagacaaaattcagatgaagtatgaagaggtccgggtctttgactagctccttgcactacatgccattttgtctctatgcttgtctatgtgaacgcacgagtttttagtaatacttctatgtaggaggatgtacgtgtcaattgtcctcccatcctgatatactcacgtaatttattttgtctacacattgtaccaatttttatttttttaaaaaatattactcctaaaataaaacaatttttagaaggtgacacatgcattaagaaggactagaaaaacttatttgccttctccagatagttgaggtatatgctcggattataatagagcaagaggatattagcataatataatagttaagtagcaaaagttactttttatatatcctaggttgctacatcaacaacaaaatttgaactatcaaacttattattattttaggacggagggtgtagcatgtaaagtatgtgtgcttgtttcaattctaatatcattaacataccaatgggtattactccaggacacctcatcagtatcggttcgtaaggatcatctatatatcttttttttaaccaagtataattttaccagtagtgaggattgagggggtcattaggacgggatgaaggtagaaaccccccccccccctatcagtgtttggtactccctccgtttcgaaatgtttgacaccgttgacttttta

SEQ ID NO: 52597 - DNA, 23252 bp, Oryza sativa
tcctttgatatatctacaaatgtaaattcaattgatatgacatgtaagtgtattataatattaataaaaatattgggtaagtaaatatgtatttattattttctttaaaatataaaattacaattctatataactaaaattgcatttataaattcagttgatatgacatgtaagtacactataattttgataaaaataatatgtaagtaaatatatatttttattttttttcgtagttcgttggatgtaaatcttaatgtaggaaaactctgagtgattttatcactgataaatggataggcaaaaaaagaaaaaaagggataaaaggctttgtgggaggcatgggccggctgcggaccgtgggcctggaacaggttgcaggcgtcaaaagaggcattctgaaaggccagcaggcccaagagcccgttctttccgatcgatcgaggaagccaacagacagcgccgccgcagtccgcacgacgctcgagcagattggcctccggcgaccgagaccgcgagatgaaacaagccctgcaagagaagcggtgccctgcctgcagggagcaccccatggtttgttcttgtatctaacttagtactccctccaaatatttagtcccttcatctctaaatatttgacgccgctgactttttttaattatgtttgactattcgtcttatttataaacatttataaaatatataaaactatatgtatatataaaaatatatttaaaaatgaatcaaatgataggaaaagaattataattacttaaattttttgaataagacgaacggtcaaacatgtgctaaaaagtcaacggcgtcaaatatttcgaaacagagggagtattatttaactggtcctgatagggcatcacacattttagccggttccgtggtagtgatcaagtatatatgaaggtttaagaattagttagaatttcttagaaagtcgatgaaaacataaaggttgcaaagataatttaaggaatgagtcatatgtatggactgaagaaagggaagatcatggtggttggcaaaaagttgaatgcctttttctagccttttgctttcctctcttcctggccccattgttcagctggtatttcctgcaggatgcatatatacatcaatacatgtataacacgtcagtatatctcatcatgtacagttactctgatggagtatattgctgttgctgatgtgtactagtgttatttttcagttgagtaatatgccaagccaagcttgtgaaaatcttcattgtttctttttaaaaaataatcatgtacccaaaggtttttataaatatgttcctttacatttttatatatcctttttgggatacaggtgttttcagtagaattcccagtgatgcaatattgaagtggaggaatcttgcagaataggtacaattgggatttccattagtacgaaagcattactacaatccctcaatccctgtatgtgtgtattagcatacggataaccctgatgagtctaatggacacttaaattaaagtgcatgtactctcaacttcagaagatgttaaatgtagaggtgaggtccatcattggactactcagaagacatcttaactaaacttttgaacgtatgaatgtaattaaaccagtagcactttatcttttaggtacattttgtacaacattaattaattctccctattgaccagctaacctgtttttctttgatacaaaagaaagagagaaaaccggtatatcattgttgaattgttgcctggtggcatgcttgttctctgaaaatttcatgaagcatataagcatacaacataggtttgatatatcaccgtttcaaaaataaggaactaataaagatcagctggcatgatgattactgaacagagagattggagagccatggatcagttacatcagtaccttagcaatgcatattatttgcccttttctcattattattccaatttggtacaatgcaagttcttccagctggtgactctggtttcaaagcaaaagagatctagctttttcaaaatctacattaaacaccttctttttctttatcattccatttcaaagcttaactaaccaccatttgcgaggcaagattaactaactcactttcctaatcagagaacacgaatgctaatcatcatggagaccaattggaagataggaaaaggatcaagtttaattgccataataaatagcatttcactgtatgaggagatcagttaattatgatcacagcaataagaaatcagctggagttgtactgggaattagctaggccttgttgactaacagaaacagtactagaatgagcttatatatttgcaaggccgttccgttcttagtttgtactatgactcaaccaactaattaccacctagctgattgctgcgtgccgattagttcaagaattagagcgatacaagcagtggtgaggaaataaaacatgtcagctgttccaatgcagcatgcatctgcatgtgagaaatctaaacaagagaataataagagaaaaagaaaggagcacacacatttgtcatatcagtccggcaagttcaccaaccttttgaatagctgaataactgaatttggtggtttgtcaaacatagtggctggttgccttacctgcacctgcagaaaaacgttgctgctcttcttcagcacctgacatgtattagacatgtcaccatcctcttagaaatcggaatgtctccaatctccccaactgcttgatcgacgaggtcacggcattagtcactgaaccaaattcagtataagctatgatactttttatgcctctacatatgctcttctgtctgagaaaagcagtattcttgccatgcatagggcatagaattgttccaggattccagaatagttgaaaacagttaaacacgtttccattatgtattccaaacaagaggtcttcacagggtgcactgtatagtgtttctttgatgaaattgcagtgtaaaatcttacatgttgggactcacattagaacatgtgggtctttaacaaaattccaacaatgtacaatactatatgtcgtagcttgcacagtcgatgtttttcaccacagctgttctattgacaatcatacttgaacagaattatcatgtgactgtcacttccactagcatggagaaaagcattgcaaactgatgctcctcacgactttcatttccattttgattgtaaactttacaggtgtcaatatcatatcataggccaggacaagaattcatcacccacagtttctgggcccttttttctggagagattaattgtggaggaagaaaaagacccaaagctgagggtcatagtgaggggaaaaggaaagtacagctattaatcttgtggcagaaagaaattagggcgaagaaaagttcaactgtatccccgccttcccgaggtcataatcaaactgttttaggatgtggcagtaattcacctgggcaagaggggaaaaaattcattcagtaacaaaataattcaatttcatcagttactttagagggatgtcaaagacaaacctctatgcgaaataatcttgttggcacaactacaccaaatcctgcagaactcctgaatgtttgtagaaactcagcaagagggaatttcctgagatcaggctctgttagtttggcaagatttccagctgagacaaatgcatggccatggattcccagctccctgagcggcttcagaggtatatcaaatgacagatcagcaaaggctgtgaccgcaatgtcacctccccgtgcacttagctcaggagaagtggaagcaacattttcagaattctctggggtactgctttgcaagtctgtccccagccctcttttcttgaaacctaatagtgatgatggtccacccaagcggcacataagagacctattgccacccaagtagaactgctctgaaagtggcgatatagagcccgtcgatccccttgccaatgggtggatgatcccagcagccactccagcattaagggcgccattcaacacacccagcggtaaagccactcgaagatcaagttcctgatataatgtgaataaaatgagtgatgccagtgaaaaaagaacaatatgattcctgctagttctagtaatttaggcttgaatcagatcagttgtttaatataaaaaaaaatcagatgtcgagcacattagatattacaaacagggataccaagttgtgccattcaaaggcgaagtagtgcagaggctaaaaagaaagggaaatgccacaaaagaatttggaatgcttgaacaaaacatttaattccagaagtctttggtactttaatgacatgattcatatcacacatgaagaataaactgcttttaacaggcaaaaactatggagcaagtcatgtgatttcccctttcaaggaagtggcagatatagaacacaaagataaagttgttcaatatacctgtctaatgtaacgtgcatctttgctctctggtgcaaggcctccaacttgagaagaaaatagataagcatatcctcgcgtcggtcgaattcttgaatctctctggtcaaccttgtatgcatatttaatagaggacaaaaggctatgccctaactgcccccttatggaattggatgacatcagtgctcggtctgttatagttcgccatgacagattgtaagcgaggttatggttcatggtggagagcaaaccaacagaaacacccatcatgtgttctctgagtgaggacttcaaccagtcctcagagagaaatgatattcgagctaccagtggagtaggtattgctccaattcttggtattgccactccagtacttagctccactgtctgatctaatccaagatcaccggatgcatcccatgtctcacaatatccaaataggttcttcaacttcactgaaccttgaaccgaacatgatctagtctgcaataaattcaaaaggaattatatggatgacacaagaagatttgaaaagcaattgaaatcatgcagcagatattagccatcatggcattctactcccagcaaagtaggttatgaaacttgattcatggttcactagtaaaattgcagtagaaaaaacaaagaaactgcagtggacgagttgttctttatactccaaggaatcaaagcagtgtaattgaagcaaatagtataaccatatgcgcattttagtagtccttaaagagagctgtgtggtttccaccaaaaagcgacatagacacattgaattttttcgaaacaaatcgcattcattaactaagagatgggcttaaactttccctattcatgtccatcatcaaagtcatggtaccagcataacaaattaacacctgttgtctgctgagatcaaaattatggtacaacattgcctcatttccatgtgaaaaaagaacacttcttttcgttggaattggctaggttgactcttgttcctaatgcgaagcaagattgtttggtctaatctttttagtaactcaagcaaagtaagtaatcatgtcaacatggatgttcaattttatactagaaaggagagattttcagtaggaagcgcatacccctttgttagcgaagatgccgagttcgccggcggcgcggccacgagcctcggcgacgtcaacaaggacgatgacggcagcgttaccggggatccctggcggcgcggcgtcgagggtgatggacacggtgtcgaaggcgccgaggcgacggatccgatcggcggcggcggctgcagcgcgcacgaggtctctgacggtggcggcacgcggcaggtccgagccgaccgccgcctccaccgcggcgcggcgcgtgcggcagcagccccggatctccacatcgtgcacccggatccggacctcctccgcggtgaggcggcgcaggacggactggaggcgagcctcgtcggacggggacggggagggttcttggtcatcatcgtcctcctcgtcttcgtcatcgaggtcgtcgtcgtcttggaagtcgtcgtcatcatcctcttgcaggtcggggtaatcttggacggaagcgggagaggatgcggtggccattggatgatcggaaggggatctcaactgaattgggagacgaagaagacgactctactcactcaaactcaaggatgccttcacaagcaacgaataacactatcaacttccttttttggggtaaaattaaatttatgcagagattgatgcaattcaggagtttcacaagtttctttttttaaagaacaacaaatgcatgatagaatatgtgaaaaattgctacgatttatatggtatagaggtaatgcctttgatacttttttttttgccaatatgcaaaagatttgagtatcattatattaaactgaagggaaatgtttaccacaaacatgagaagaaaagaaacacaattaagaaatatatatctagccgcatgagttggtgagcacaatagaacggcaacaacttttttttaaaagaaacacaacaggggaaggccccccgttgttagataaactttattaaagaaataaaaaaagattacaacatcctaatccagttaagaattactacatctttatcactttcattaagaaactagggaaggagacttattctaaaaaaatatagccattcctttgcttctaaatattccaagctcccaatagaaaaatttccatgaagcaacaattctgaaaagtgcacttagtctgcaatagcatatgatcagaggacaaagaagtgtcccaaattatgcccaaagagttccagtagctcaccgaaaaagagcaaagaaagaacatatgcaagagatcctctactgattgagaagaataaagaatacacagtaggtcgcagtttggaggagtatagtgcttatgatccagcatatacttcgtattcaatctattcattaaaagcagccatccaaaaacaacaacttactaagctcgtatttcggttgatcttcgtagcgttgccttaaatgctaggatacatcgtctaccactgaaataataattagttgtaaatgcaaatactcatgtcaaatctagaatttaaatccaggtggttggttccaacataaccagttgagttacgctcactttctcgttgccttgatatatgagagaacacaagcaataggtatcttattataaaaaccatgccttacattgtcgtatgcatgctctaaattataatccaaaattacgtttacattgtgtcattatctacttaaataacttcactaacatgcttattggtactaataagttactccctctagtttttttttacaagatattggctagttcaattttatactagccagtgtcatacatataatggaggtagtatatagtacttcaaatacacacaacacaaagacaagattacatatgggttaaatgctatttatttccttttttttctcacctttacaaacctgcaaactcatttctgcaaagaaaaaaaaatgaaaatatgttgcagagtattcctaattgcctactatgatacaagaaaaaagaaaacacacactgaatttcagtttcaggctttcacactgaatttgaggccttaactgaatttcaggcggtttcggaggaggcgatctcaagctccgcccaccacaggggcttctccctcggcaattatcctttaattagtttatctgctgaaatagtttatttcttttagagaaatactgaagtggacttatcctttaattaatccagtaatttaataactgttttaaaatttcgagtcgttcttttttttctcattgtagtatgacgcaaaatctcgtagagttatccaatcaagaaactataaacgtttcatagccacaaaaataaagaaccctcactttgctaaacattttctgcaatgttcaaatcctccagtaccatcagctacagactccgaaattgtgccaagctctttcaactcggatggagtttcactggaaaacattttctctttgagtaatctgcaaagatcatcatggtggttaaggttacatagtacagcagaaagactaaagctccactgaaaggctgtcattcattgtaaagcatcctatacgtacaatgcaactgacctaaattacttctaaagtatcttgaataactgttaacaggaagtgcagtgatctataaatcttggtgtactgctaaatgtgatgtaagtaggacatcaagaagtttaccctttgaaaaatagtttgtaaatatgtaatgtgactatgtgagatgcacttgatagtgcagtgggaaggggtatgcggtttctacttcgtgatcctgtgttcaatcctcaacacgctcacaatttcttcttaaaaaagtttggagggatgtctctccctccaaatctccttttttttttgtaaatattcatgaaatacatgttcggacatggggatttggattcaaatcctccctgaaaactccctcataccaaatatggtttcagtttagtggaagaggaaagattggatgaaagcataataacttacaagttgagcactctgccaatcaccttcccttctccccgatttgacaaagaatcagttgatttgtctcgctcgctctcgctatatctcaagagagctctccctgaagcacaaaacttaaatatgtttaggttgaaatctaaatccacttgggcctcctttcaattcaatctttagcaatcaaaagaacatctcaccttcttcactgcagggagcacaggacccaaatctcgcagagacaagaaagaaggagaacactatgaagtagaccactctaatggtccatgcctccatttctgattttctgtcccaatctgaatttttaggaagagttggaacctcttctctcttcagcaaaatatcaagggtaagtaacaaaagcgcggtgattatggaagaacactgcaaggaggggaaatgattcgaaattttacctgtgaggtgtgtggaggtggggctagttagccagaaagctaaaatcatgttttggattgtgaaagcacacatgaacatgattgatgattccacagcacctcaagaaaggtatcaccgtgtaaagaagcatcgtctcgtctcccctcaaagattgaattcttgctcttaagaataacaaaaggaaatggcagaaagaaatggtaaataagtgaaacaagagagtaaagcaggacgctgcaaagagtggaatcaagtgaggaagcagggaaccggacacaatcataaatctgttctgcaaggaccaaaaatgtacagtagttacaaaggaaatggacaagaaagaagagccaaggaaggaaagatacctgtaaagaaaggaatccaatccattctacgcgtactagaggtacttaactacttggatctcttggctggtatgtagttggaaagagagaagccagagaattctcaaaaaaaaaaaaagaagcccagaggaccacacaaagtcttgagcttccagagaggagaagagtcgagcagtggctaagtcttgaggaataatcgaaatgttatctggagacaggggcaaaaaaagaaaacttgcaggcagctaggattttcgagaacctcacctgtaaagctttccacgccacgagtcttgataaggtaacaaaacacgcggaatatcgttgtctacttttgtgaaatcggagccgaatgtctgcccttctgtagttacccctgcctgccaggtattatactagtctagtgtatgcaggtatatatggcagtggcagattttgttttaaaccttatggcgtgcagaaaatgaactttctgagtggggctagggcacttactacttctgctttagtaaaagtttacttgagtgcgtttatgtcggatattttaattatccggcagttcgcagctgatggtgtctttctatatatcttggccatacatatggcatgcttcctactaaccagccattatatatcgacaaaaagatgtacttgtcgtagtagaagtagccgttgcagttgttgtatggtaaatattgtagcaaacagttccaactcttcaagtttttgttaattcaaagttttttttcttttcaagatgggcatccttcttactactttcttatgtggaataattctcaccaacaaaagtttgtggaagctttcacacttgaacatttctcaaaatttgcacaaggcgtgcgttagtaggtcaagcctgcctcccacaggttatattcgttgatacaaaacaaaaggtggtagagaagagcttcacaagttgcattgcacacctcacacaccttatacagctgattaaatcaaagcagagattgacaaggcacctactttgatgcgactgaggcagattaaccatcttattgtgtttagtgattagctacttcttgtgcttctattggcatgtttatgtttgagtcgatcgtcaatgagagtaagtcaacttaagaaagcacaaagaaatcttcacaagacatcgagacagtgacagcttcaatgcatatgaaacaggcaggctcctcgcctcctcatctgcaacttatatgacctttactgatcaaaatgctccaaaagacaaaaggatgatgagatgaaaatggaagtggtcagttaacttctgaatttcttttcagacagctgctaactccattagtcctagcaattacctactcgatcgttcgtgtacaatttccacttggtttttctaagaaagattgcagattgtaccatccaatacttggggggaaacacatagaagaaagctttatattcatagaaaaactagatttagttggtattcgtacctttcatgaatcatggaaacatgcacgcaggttaggctacttcaatcatgcaaggcaggccatgatacccagtatatgtgcagaattaaattctgcacgttccgtaatcactagtctatcaaaacaaaatgctgaaattatttctggactagcacattttctatgtcaccatttgtgtgagaatcgtttaaatactgggatgataaaacgtctatcaccagcgggtgtttggtcttagtggcatgattctcgcttcgggtgcgagaggtcatgagttcgattctcgcaaaacacccctaacttttttctatttacaactaggtccttctcttacagatgtgatgtactctttctgatgttgcaagtctctgtctttttctctttccttttttttggtcctgtacatggtgcaaattagaagcactccaagataattggcagctaaaattgggccgtttgctacattatggtgtagctgtgatgaagatgatatggtagtgtatattgcaagagcaggaggagcagctgcatgatccaacgaattccgcaacatgcagacgacaatcaagctggacaaggtcacgttcagaggtaacgaacccatgtggccacgccgtgcattctcattctcatattgaatgcacattccaagcatgtgctccaatctttttgtatattgctctctagagacaatggatcatggatgcacatcagcactaaactattttatcttggagcttctaatgttttctcaaaatggatattcaggtcatcagagaagcaaaagatttcacaagtaacttggtggtgccatacccaccgaaaagtgcacaaggttcgaccgatcaaaagatcagattcacgaaaacagacactaaattgctgttcatcatacgagtcgcaaacagggcatatgccatatctaattcagtcgtacggtatcatcatgcatcaattatcaatatgatggtatcgtatcaagtttcggggatggtaacaaaccacccatctgaacgagctctatcaagatggtagcaaaataaaatcagtaatgtggcttaaacccccacttagtttacaggcaccggtgcaacttatacatcgtctctctgaaaagaccaaatccaacgccatgtcaacggagtgacagcccctacttcaccggaagtagattgataccagtgggatgtcaacgtcgttgtcatcatcgtcctcacaagccaccaccacgtcaagatggcgccggtatgggggcacctccacctttgccacctccctcgccacatcgaccaccttcttgtctagacgctccttgtgcctcgggaacattgagttgtacagcagcgaggtgccgcaagatatgctgtatgcattcaggcccttctccttgagccagtccagaagctccctcagcgtgatgttgccagttatggtccagcggtcccaaacagtccaggccatgtcctggtgcttgatggtcttgggagggaccggctcagccatagagaagagggggattgcaaggtttgcaaatgtgttcctgtagtcttcaaccttgtgcccaccaccgagtaccttgtacagttccaagcagacaagaccagtagccatcgcagttgaggtggcaatggcagggatgatcctgccagctatgaacttcgccttcagcttgtccacttcaggaatgctatagttccttgcccgcatgttagcaaaaccagctatcacgtccatatggtaattggtgtcatcatcctgcacgtacatgaatgcggcttagaaaaccaactctcaaagctaacacaatttgtgaaactctttagggtcacaagggtgttcatcctagaggtgcatggttggctacaaaggaaaagctaaggaaaacaaaatcacatttactctctcgaacttatcagggaaaaaaattgaaactaaccttctcaaactggattggtttcatctggaatcctggttgcagtgttttggaaattgcttctaactttgcaataagctcttcaatgacagcagcatcatcaacagatgcagacgaaagactagtagccttctcatctgtaactatcttaaccccctgttttggttggaaatcaggaacaatcaccttgtcaacagcttcagccatctttgctgggtttttgacccagtcaggtatgggtatcccaaatgtctctgcccttaaaattgcagcagccaaaataaagttaagctggcttggatcagatgtcaagaactccagtggtcgtgggaaacgctttggagcagaccagaaaggagcaccagagctggtcatcgcatcttcagggaaagtgtatgtcagttgcttcacacggttggagaaataatcctcaaacctaagatgaacaatcaatacaaacaaaatgcaaagtgtatgtcagttgctgcaaaatgcaaacaacaatcaaaaagcaaatgctttagttgcaaaatttaaattttggaatattcttgcatattgcaataatgaaattcaagcagatgtacacagcttcaccccctatgcgtaataagctaaaggtgctcaagagatgtgctaacttacttgagccgggcccaggtaatacaatcttggaatgtctcacacttctctctctcgagacattcaataacgcgctcaagctgatccctagcctgtgcatcaccagcagttcttgctacagttgcatatccaccaggattcgataggaaggcatttacttcagtgggggtcttctcaagcaaaccctcaaactcagacctagcccaggttaggcaatgatcaatattatgaggaaatgaatgtacagtacacatcggcgcctgcttttcaggtggatctctggatgcgccatagttctctgttaggtgaggtatgaccatctgtgtgttacatttagcacccagagtcccagattccaagagtggcttctggaaatatacacatcgggagtcaatatacattcttgcggtaacattgtccaacgcattgacaacagcatccaggctctcccaaaaggcatcgttgaacacattttcagtctcaggacttgctctgttctgaagggcctcgacatgaagcttaggattaattgccatagcagcagtagcagcaaccgtggacttgggctgaccaatgttccagtcacggaagagaaactggcgactgagattgcttttttcaataacatcatcatctgtcactatcagctttccattctgattgcaagaaatgcccattagcgctaggtttttcaagaactcacatccaagcgccccaaaaccaaccataaatattttcgcctgctcaagtttcttttgaaggttagatccaaaaacactgatttgtgcatcatatctagtattctctggcttcaactcggctggctccaatggttcaacagggagagattcaacagaatcaaaatagaagaactgcaaaaccaggaaaattacattaatgtttacatgaagagtgcagataaaaagggatttacgttattataatgaaggaaacagattataacctggtaaagtggatggaatttccctgagcatgctttcacaacctcttgacctacaatgccaccaaacattgcagccatagggttcagaacagccctggaaccacttgcaaaatgatgcaggagctttttgtcgagctcttcaagtttgctatcacccagggactcgttaatgctaatagcaaaatctatcagtctttgcacatcatcactagacccagcaatagggaatcgcctcaaatcattcctaaacttatccaaagcttggaaagccaaatgcagaagtggtggacggtcgaatttggagaaatcgctcatgagaaattctcctggttccttaatggcgtctttcaaggttttgaatttaagaacctttggtggcttgacctgagtaacaataccacctctaacatatgtcccatatgaggtagtgtcttcttctagagtaaaagaataaggcctagcgttcttaatctttcttggtttcccatcatttagttcactcattccatggacttctgagaacacaactaaatcaccatcctggaactccagacgctcatcatcaacacaggaaacaagcgcagggttgtcattgctgatcgatgctactattcctgtatgtggctcctctccatcaacatccaatacagtaaactcaggaccaaagtcacaaaagacactgccaaaaaggccacgaatttctgacttaatgaaagcaattggtggctgatggttgtggcagtaactgtcaaactcaactgctttctctaagctgatatcagtaaagaccacagcctgtatgttcacatggaaatggttattccaagaataagaaaatatgcaatacaaagagacagtcattgctcaaaacagaaagatggctctgaaatattatcttgaactactacagaccttttgcaggccatattagtatgaaggatttactgccatgccacaaaattaaagcagactcacacgattgtctctgtagtctactgagatgatgtggaactactacagctttactcttaatttttcttatcagtaattggcacaaatttaatagagctattgtgtgggaatacgatgataacactaactactaagaccaaattcactaagtttaaatagtatgtgttgcactgttgctaaatattaaatatggagttccaatgaatgtaaaagatgtttctttgacaaaaatcaagcaatcaaaggaaaaaggcgataataccacagaaacctgagggctgaaggcctaatgaatgcaacgaacctttatgctattccaaatatcaagcagaagaggaatttgaggaagctagtagtgatacacatgcatagttaatcctaaactccatgaaatttggtgtgtaaatactattttgcataccttgattgtgcacttccttatacataattgttgactttatttcttcattcaaacatatatttagtaaattgtgaaaccgcactgtattgcctaaaagaatttccatactttctatgaagagtagcaacaattcctagactaagatcaaataacaagatgcacagcctgtagtcacagacttgcagctcacatggactgaagtacaagcgaaacgactacttgaaatctaagattaacaggcatacacgatgaagtagaagaaacaaacagcaaggaaggagatcacaaatcaactgcatgctcacatacctggaaattagaaagctgctccttagtcaaatcaccggttatagtagagataataacagcattattgagctcctgtagcttctgaacacaagtttgagcacggttttgaccaacatccttctctgtgaggaagaagttgcttgataagtcccatagctccacattgtcatcatcgtgcaagtttacggacttgacacccgcaaggacaaggttcttggctgcaggaagacattggcattaagtaaatttcaacagcatatctgaaagtatgaaaaaggcaaagccaaaaacttgtacaatcatgtgatttgaatcctcaaaaggtctcccaatttcacaaggtagacattgcattctgagtggttaagcattatatgccaagtctcaagcatcttagcttattgcatagcacaggggactgaccagaactaacacagatttgttgtatcatgcaagctcctaaaatgtaataagggggtaagagcaccacagcacaactgggaaaagtttaaactctggttcaaagaatggactcaagagtcaagagcgtcaatgtgtttgacaatttgagctgctcctataatcattgtttacaaatcttaaaattgaagaatcagttaataggaagcgcacgctaccacgcttcatatttctagtaacaagatgtagaacttgcggaactgagggcagtaacccagcatggagatcgtaaagcacgcattgagataaaatttgataataataactagcgaaagatcaattgtgcacaagtgatatcgattaactgtctacgggtctataatagataagatcgattgtggcaggaaagtggtaattgaagacaagttgcccctttactcaataaggtcgatctgtatgtagagtagatgaggggctttgggaagctaattaaggcgtaccgatctcggcgccgaggccgttgaggccagagacgaggacgttggaggcgaagaggcgcttcatggtctcgcggccatagacggcgagctggcggctgtggaggtcctcatcgatctcgggcgctctgccggtggtcatggtgtggttgtcgtcggcgggttcgtcgtcggcgcgggtcttcttgtgcaagtcgtggacctcgccggcgagctcctcccgcttgcgggtaagcatatagtgtagggcgccgccgaggaggccgacagcgagggtcgccgcgaggacgaggctgaaggcagccggcgagagctgccgcgtcagatccaggtcgcaaccacggcgagacctacacacccgagcggctcggcgtgagacgggagggaacaccgcaccaagagatgagggagttgggcgacggaggaactcacctaccttggattcgtctcgttcgtggatcgagctgttcttccttcgcttcccttgtactatactctatatctagggttttgaggaggaaaaaagaagaagaagaagaagaagggctaatttgtaaattgtggccgcttctcttgtgcgtctgataataagaggagaaggggagaaggggagttgtttgagtttgagacgagacggaagatgtgggggtggggcccagctggcagtgaaagaaacgaaaggcaaagcaaagcatcagtgctttccttggcgttggcgccgtgagcatctgcagttctgcacatcaactccatggaaccatctcgaaggaataagttcatctaaggtccctcaactttacaccgaatccgattttcgtccctcgatcggaaaaccagacacaacggtccctcaactatcaaaatcggtgcagattaggtccctcggcggttttaaggacggttttgactgacgtggcacctacgtggctaatttgactcggtcttcgtccgacgtggcattgacgtggcgcttacgtggcaattcgacccggaaaaataataaaacccatgggacccacatgtcagtctcacatagaaaataataaaaaaaatagtgggacccacgtgggcctcacatgtcagtcaaactcacccttcctcttcttcctcctctctccccatctccctctcttcatctctctcccctctcctctcctcttccggcgagagcagcgagctggaggtggcggcgagaccggcgcccaccggcgagagcagcgagctggaggaggaagccggggcgataaaaggggatcggcgacggcggtgggcggaacagatcgacctgagcggcgacagcccccccccccggagcagcgccggcaatcgagatccggcggtggcggccgagagaagggcggtggccggcagggagaaggggcggcgtgcagcgatggccgccgaaggaggaggaggagatgtagccatgcggggaggcgtggcggtgacagccgaaggaggaggacgtccgccgtgcgctgctccccccggtagtggcagcggcgcgggggccctgggagtcgccgaggatgccgaggtcgacgtcgatgtcgtccgcggccacgaccatggcgtccctgaacgcatccggcgtgcgccacagaagcggcggcatgggaagcggcgcctcagctactgcggcggcggcgttaatggggggaggggaagcggaagctcctcgctccggtgggctgccgctgacgagctcggtggtggtgaaacgcgacggatcgagcgccatcctggcggctaggggccctcctccgacctctgctccagaccgccgccttcgtcctcttcacccgtcgccggctatcatcctcctcgcttcggtgggcggtcgctgacgagctcgatggtggaggcgggttgcggcggagggcggtcgccgctccctctcccacgggttgccgtcggctgcgcacctctcccttcgtccgtcgccatcaagcccccgcccatggcgctcggccatcgccggcctccctgcgtccttcctccctgcccgcctcgccggtctttgcacgttgctccctcctctcctgccgccagccgcgtgccgccgcacgccgttgtcttccgtggcgcctggatagagcagagatagggagatgaagaaagggagatggggagagaggaggaagaagaggggtgagttggactgacatgtgggacccacgtgggtcccatgattttttttattattttctatgtgagactgacatgtgggtcccacgggtcgaattgccacgtaagcgtcacgtcaatgccacatcagacgaagaccgagtcaaattagccacgtatgcgccacgtcagccaaaaccgctctccaaaccgccgagggacctaatctgcaccggtttaaatagttgagggacccgttgtgtctggttttccgattgagggacgaaaatcggattcggtgtaaagttaacggacctcagatgaacttattccccatctcgaaagacacaagaggagtctcgggaaaaagtccacttcacgtctcttgtctcatcttatcgttaagtttaaaatacatccctcaacaataaacccaaatatagcatccttgatcttgcaaaaaccgcagtatgtatgggttggctccgctgatgtgacaaattgactcggtccactcacactgactagacacttacatggcaaaaacaaaatatagccccacatataattctctcctcccttctctccctctcctctccttcctcctcccctttttctccatctctcccccgcaccctggtgatactcaacaccgcgctcaaaggatgtcgccttctccacatctccttgttgtggttcgacagcggcggtagcagcgatgacaacgacaacctatgcgggcgccccaacatcacgtagaacgagcccatattgttccttatctgggaccacctcatgctcgacatcttcactgcagaggaaggtgccgatgaggatcaatgttgggtgctcaacatactgctatacttcttgcttgatttggatggccagcgtcgagcttttacatgtcacttattgcgtgccttcccgcattaggtcactcctttcttcgtcggtcaccacccttccagtccgtcgtgagacaagtgggcggcgtcgacgcccggcttgtaggtgacgaggtgtgccaccactatcgagcgcgccgcatgtcggtcacaatctcctcgctccgccgattgtccgtgcctccactacttttgccatcgccaagaccgaaggatggggagagagataaggaagaatatttgtttcgctgacacgtggatcccacgtgagttttatcattttttatttttttcttttagtgtcacgtcagccaaaaccaccctcaatactgtcatgggatctaatgtgacctgttttgcaagattagagatatgttaacgtgacctgattttgcaagttttagagactaaaaaaatgcacgtgcgttgcaactgcgtagtctattttaatcttattattgttatacgatttagctatggtgaaattcaccatgggaattcgcctggatattttattttacaaaatcatgaattgcaattagaagttcgatcgttagcatacgggttttttttaaaagagatttcttatgcgattcattctgcatttttaaaagcaaatgaacctaaaaccaactcaaacacggatctatatttccaaaaaaaaaaccgactcaaatatgaagacgtactaaaataaaagtaaaaatatttcagtttttataatagcagagatacatgtgttataatgtggagcctcgccacgccagcaaaggtgggctcaaactcaaacataagctgtcacttaaggcccaattattcttgatgggcccatcctcttctctttctttctcttttattttttctgttctttcagaggcagcaaagcaaagggacatatatgcataaaaacttgccaggcttcgagttactaacataaactactaggaacatgacataagcacgatgaaacaagcattaacaccacaatggtttatcatattgttccttattggctgccagcaaaatctctctagcaacaaacgtgtaaatgcccccaaaatacaccatcaccatgactccatgcatagccacaatatcacaagtatcgctacagccagcggcgccatgttccttttctgcgaggacgcgcgacatacacatgattctgaagctctactgacctagacacagggggaagttcatgaccaaattggttggttcattcactccattgctactgcgtgcttaatttgatgaatacacagactcgacttattttctttctttagctgcatgatcccatggatggaagaaacgaaacctactactgcccttcacacagtctcctccattcaagcttcttcctcaagcagcttctgatcaaagtgccacacccctgcaacacaaattacgtagcaaacaacaactgatgagtcaaaccacaggtctatagatagatggtagtacatcaaatgaagtattttctgacaaaacacactaaccatgcccctttcccactcttctcagctgggcgacatactcagagatcttcttgatggcttcaacctttcagagcaaggcagatattttcagcaaaacatacttcactaaagcacagcagttgaatatttaacatctcaagagctagttcagtacccaagtgggcagaaggtttttacctgctcctcaaggaattcgctctcaacgaagtcggtcagctgtggatcattgcaccttgatgccacctgttgattcacagcaacacattttcaagtttcaccatatatttcttttcaaaatagtgttgagaattatacaacacattctaaatccatgttcagcattactgcataacaggagaatatcttacactgtgcaggttgtgcaacttctcatttacaagcttttcgagagccaaggccaactccatagctgaaatcacaagcaagctagagggtaaaacataggggtacacaaagtttgtacaggtatgtacagcaacaaacagccagtgcatgctacttcctggagacactagcaaatgccataaggtgaaatggtggaaaatatacaatgacgttttctcctttaggagcttttagaatttagagaatctttactgtgcagtccaaaatgtttaaaagaaagcttctacaaaacaaagtagcctttattgaaagttactcccttcgttttttaatgtacgacgccgttgtctttttaatcaacgtttaaccttttttttgcaaatataaaaatatttaaatcacgcttaaagaacatttgatgataaattaagtcacaataaaataaataattacatatatacacacacacacacacacacatatatatatatatatatatatatatatatatttgaataagacaaatggttaaaagttaatcgcgtcatacattaaaaaacggagggagtaattgacatcaggattcaacatggaacttttgaagaggaaagtatccctgttgaatctggatggcgaatgagctcattcaccaaggaagttcccctgtttttgcaaaaaaaaaaaaaaaaaaaaaggctcctcccaaccttaaggattgagccacttaattttcacatagataattaacaggcagacactcagactagcacacagtaagcagaagcataagtacatataccatggaataaaaaacatatataggacaagctgaaagcaactcaccatacaaggcatcccctttctcaggatggtcgaactctgtcaaaggtgtgacgatggactggagccgcaccctgcctccacgcatgttctgacaaagaagaacattgcagtattagcatttgggtgcatgattatagtggtacagcgtacagttttcctggtgtgccaattggcagcagaggtaaagttacctggtacttgatgagtttctctgcgtgatccctctcctcatcgctggattctttgaagaatctgaaggaacagaatttgtcgatacatgagtgacaattttcctacttggtgatgactaaatgagggtggtgatggcttacttggcgaatcccttgagagcaacgttgtcacgatcaaagtaggcgaaaagggagtggtacgcgtacgatgcattgtactccacactgcaaagattgaactcttttttaggattgaattccaattcggaatataactagaacggatgacaagctaaatatagctaagcacagtgtcttttctcctatttacatcaattattgtggaataaaataa

SEQ ID NO: 52598 - DNA, 2897 bp, Oryza sativa
cagagatttttgttaaattaaaaaaagaagaagaagaagaaatgcgcacatgaaaggggaatagaaattcaaaaatggaaggcagagtgaggaggaggaaaacagacttgatctgctcgttgatggcggcctcgcactcgtcgacgaacttttgcctagcgagagactggtccttggcctgggggacgagggagagctcccccttgagctcctcgaatggctggaagaccacgccgctgagcacctccttccctttcccggcggccctgcacactgccccgggtccggcaccacgcggcacaggcagccagacggaagcaggggtcgaggccgcggcggcgagataggtaggcgcggcggcggcggcggccggggcaaccctaggaggaagcatggcggagaggcgcgtgtggcgtttgcttccggaggtcgcggcgggtgaagagtgatgagattaattgtgcggtggtaggggtggaggtgatagaaagggatatatataggcgcgtggagctcacggatgggccacacgtggacggtcgagatgggacgaaggcgagggagcgcgtggcgggctcgtggctgggaggatattttgggctggtggtttgttgatgtggagcccggcccggccgcaccggagtcggtcaagcttaaccactattcctttccggattgcttctgcgttctacttgatggatcggttagtctcgttaatttcgtcatcagcattatactgtgagacttttttagtattattcatatttatatagatgttaataaatatatatatatacctaaatttattaacatgtggacaatgctataaagtcttatattataaaacggaggaaatagttgggtggagttactgtgtttattgctttccttgcaagctgatggcgatgagttgtacaaaattccacacaaatttagacgtctagatgcaatgcatgcatctggcaaatttctctccttctgatgattggtcagcagagaagacaggtgggatatcgaggaggagctagatgaggataagaatggcgcgcacagtgtggactgtggagatgcggtgtcgatatcgtacacaaaaaaaagtcatttggaggcgtgtggaggcctcacgcccgctctggaccagattgccctctttctctccaccacaattatcttcttctcttcttttttttttcaccttttacatatctgtcttcgtcagtattcatgtgttgcacagagccacatatacacggtaccctcttccttgcattgcaaccatatgtttacttggctcctatagtgacaaaaccatcttttctccttttaacagcgcatttgtctattgagaaaattgattcatcgagactcctgcttacttctactcttctagaacgagctaacgtttttcatttgaagaaaaaagaaaacggacaaaagttcttctgcgcttcgttggaagcgagttcgttagtgggcctaggcccaaatacaaaatccaatccaatcccatccatccatcgccttcgccttcgtcgggcagagagggaggcaagccatggccaccgccgccgccgccggggatggggacgagcacctcctctccctcttcgcctccgccctctcccaccgcaggtaatcacacacccttcttcctctaccatccaccaactagcattgcattcttctacaaccgctccattcttctcggctcgcgctgctcaggtttggggaccaggagctcagcctactcgacgccgcgctttccgccggcgccgacgtcccctcgctgctccacactcgctcatccacccgctgtctgctgcgcaaggccgccgcccaggcattctcctccgtccccgatttgggtaccaccctctccgtcgctgacttcttcgcgcgcgccttcgccctcaccggaaatgtcgaggtcctcactcaccgacgacttgcctcagcgcctgtggccaggattgtggggccattaatcatgtgcacatatcccctagttttgtttgctctgcaatctacacctaattggtttcgattgcgatgcacatcgggtgctccagttctgtatgttcaatgcaattcgcatcatatgatgatgcccttataatcattcattctcctcgtgcaaatacacattctgcacatgctaccgtactaaactagccgtgttgcaacttttttttttctgctactactttactaattctgctaatgtctgtccattactagagttgccttgctatgagatatgaagctctgctcctgagacaagccaaatactccgacgaccttcatctgcaagtatccaatgaagaatggctaacttttgcaaaggactctcttgataatggtttttacaccattgcttccaaggtactttcgtttcagttctactgtaaatccactcatttcttttattagtcagcattgaaacaaaactgatgacacctccttgctaatactaattctatgttgccttgggtcacatgctacttttgtaccagaatttagactaatgaccttttcaagtggaaaggcatcgccatttggaaatatgttctgaacaatgtgatggatgatgtttgatggctgcctgctgttcatactggtagtattgtctgaacaaacttagcacaaataaacactctcacactggagggcattgttttgtctacctcctttaggagttatgattagtacataaccatgccaatgtgtcaatctagtcatctgtctgtacttaattttgttgaatgactgcatcatagtgcttcaacattatttatgtgcaaaccactgattctagggtttaataccatgtggccatgtttctttctacttatatatgtatttaccttttaggcttttgcaaatgctctcttgcatat

SEQ ID NO: 52599 - DNA, 5281 bp, Oryza sativa
gttcattattttgttggattgatgtagcattccctgtacatagatcaaatcaaggcactaaatcttctattagatttttccaaattcggtgcttatttctttttgcttcaaataaatttccaatacggctacttgtactatgacagttcaggcacaatcagctgaatacatgaaaaggaaagcttcaggggttgatgaaaagtgtaatttgcacttgggaaaaacaaagctacctggaagtttgatgtttaggctaggtatcaaaacaaggaacatacagaaactacgctgcagccgagagagtaatctggaagatgtttgaagcagtattagtgtgacatcttccattaggctgataagagcgatatgatctttcacacaatctgttgtcgatgtaacaaaaggtgaatctcatgccttggggtttactcatttgtttactgagaacttctcagtttattattttggtaactagtggaacatctgcagctgcacatatgtccagtatagattttatcaatctcttatggtttctttgctgactacctctttgttagctcaacatatttccatcctgctatccactcgttttcttccttaaatacatccatactgccgtatgtacgtgtctccttatcagattgctatgataaatgttctttgattggaacagaataggaccactttgaacttcctctttgtaagatagcaatgtaggttatgtagaatttatatgtgagggttgtgttggtacttggcacatgtgcacttttgactcgttctcattttctttggtaagtatcatcatgcatgtgttgtaccatgtaaaaactcttaccatttgtcactttcaagcagtactttcaattagtttcgttaacattatctgtatgaccaagccaggcccaacttctcactcctttaaaatagtactaaaacatctttgctttcttgctttactttcagaacacttgtggaaatgagagcactgagtagaatagcacacctcacttcagaacagaagtttaattatacattaatcatattgaaacaggatacttgtatctgctcacatagttacattgcatcacgttattgcgtaggaattcatgttgtttattcacttggaatgattgtcgatcccatttttaattacatatcattctgatataccactgcgcattttggtctgtccaatgtggctatgtacattaatacttaatatgcttcaacgtaatgagtttgcttctgttttttcattcaattaggtgaaaattttcgtgcaatggaattatgatcctgatgtcgtggatgggtatttgggatcctgagacaatgagggtcacttgcctcttctactgctgtttcactgggaaagtaagctgcttttttccatactcctgaatattgtgacttgtgatgtactaagcaatatgctatacttttgctatacttacgcatctgtattaggatcatatggattaaaatccagcgctgactgcttgaagtattttatttaatttttgagatgatatattgaagaacttcatgttgttcattcatggaaagtttattatgcacggcaccaaatgatatcataagacatacaattagctcaggtctttttttgagggaaacaattagctaagtttcattgaagaatcatgtcatttatttttagtagtaaaatagtaaggaaaaatatcggaagcacttgaaaatctagatgttcggtattgagaaataagcatgtctaacttggaatgtcaggcacttgacatgtggcacttggcagtgagatatatggatagaccaaaatctgaatactgaaacctgatcctagagcacatgcggatgcatgactagatcttaactactgttcagagaacatgaagctaatataattagtggtccagatgatagtgtcttggatctctatccaatagcaagtgtcttcataggaacaagtcattatgttgaggaaagaacatgtttgttgcatatgctctcgctaggaattgaggaaaaattaaagaaaatactggcgttagtaaaagtttgcaaaataaggtgggtagatgcataggcattaggcagaggatgtaaacgagagcctagtctgtcatgtgggtgatcacccagttagtctagtgaacttgcatgtgagggttacgtttattttgaccttggaaaatggaagagttggcaacgggcttatactttccttgacttgcttagtggtaaaacactgtcggcaacttagggtgtcggcgccggccgcctgctgtgattgatgaccattcatatttatgcttgaaattcttgggagaacccgtccttttgagttttggcaacaatggcatgtgcaagcacgaatacggctgtaagaacactgatccattgtactctatttcaaaggttttgaagcaaatgagggcagaatcctcgttccgctaatgtattctacacaagctagacaaaatcaacgcaagaggtagaattttgtgtcttttgtgtgacgactaatcgagaacaatattatctttgtttgctagcattgctccaacatgattttattctgtcatccacattggaaacaaaatctgggaaaaatgacaatataagggattaagggatgtcgttatggactctgcatctatcataattaagctgcaaaatgcattgcatggggcatgggtgtttgtagtacatgtcactcaccacctgattcagactgaaaccacaaccaccggaggtcccattcgcatttacacaggcatgacgtatactttgtctctagccacaacctactgtatgcatgaatgatgcttatcttaagacatcctcgatgctcgacaaagtcctaatctcgtcgttgttggatagcctcttccggtgtttatacgtgtcatctggtctcctagtgttggctactaacatgcacgtatgggataaacaaatagacaaacaggagtactggaatactacctgtcgttttctcacgttttaattaatctatatccttgatttacgattttccttttatatatctagctactacgttatgatcgacatatataaaaacagatcgatgactgggagaggtgatgagatctggtgaggtgtccaaagttgctaatgtccaattgctagagcttataagaagctacaattaatatttttgctggtactgtcagttgtttgttttacgtggattgtgatgaatactagtactgtctagcaattaaaccagaagttaaaatgcaagcgttacatctcaaggtcaactctgagaacgtgcgtaggaactaacattaacagtccagtataccaaaggtcattcaaactgcactagagtccacatttatttatataagatatactagtgcataggagtagtaacttgatcaccagctgtcgtcgtagtcgtagctagttaggatccaactcatttttgtcgatcgcgggggaggaatgttaacggtgcatgtggttggttgatttgattagtgaaacaaaaaaaaagtggttttcggtggtggtaatttgagcttgctttgaactttgaagtgatcgatgtctgcaattcacactgcagagaaggatgaaggcttagctcgtatgtagacttttgatggcttaatcctatttgctgccaagtagagacaaaacaagtcagagaacccattactgtacatatttatacatgagtaatcaatgatatgggtggatgtgatccatgcctccagcaggacatcatgattagcatgttatgagggatcactatacttaatactcctcatatgcttagttgtttagtagtgttaattatgtttgtcgtgacttagcttagttgttgctgttgttgagctataaagggagaagctctgctcccgtgcaccctcccccctgaagcctgctcctctgcatcaactgtttgctgcccagtacagtagaggcctgcacttgcaagttgcaactgcaagcaatggcgggaagcgggagcgggacaccgtgcgcgtcgtgcaagctgctgcggcggcggtgcacgtcggagtgcgtgttcgcgccctacttcccggcggaggaggcgcagcggttcgccatggtgcaccgggtgttcggcgccagcaacgtcagcaagatgctgctcgatgtgccgccgccgcagaggcccgacgccgtcagcagcctcgtctacgaggccaacgcccgtatgagggaccccgtctacggctgcgtcgccgccatctccttcctccagaaccaagtctcccagctccagatgcagctcgccctcgcccacgccgagaccgccgccctgcaactccagctgcagcagcagcaccaagatcaagatgaccaccaccaccagcagtgcatcctggagaatgctgctgctcatcaccagctgatgctgcaggaggcattcctcaagaaagagtccatgtggacataattgtacgtagtagatgctttctagtaaatctttgtgcttcgatcgattgatatgatatgatgttgtatttcatcagggcatctgccctagcttgttatcttctcttctgtaatttccggaaagagggaaaatgaagaagaacaattcggtcacattagcctacctcatctctccatttctgatcaaatgactgtattagcaagacagaaactgattggctttctgaaacacctgttggcttcatgaaccatcagttcagctcccatgcatgcacaagtttcagacaagccttttgctttcggagatatggctgtttgcttggtaagggtcaatgatgtgggacacattaatttggcttcacaaggtctctagtacagtaggatccagatagtatgtacacgaactaagcacctcaaaccaccccaaactcaattaagtagcaggagaggagagctaatgatattggaagtcctgatctcacctactagattcctaagttctctacacgggacatgtgccctttctgagctaggtttatatcatacctggacttcactaattctccaaatccaatatcatacctggagtactaatttgtcaaatcccatgttgtaaaatacctacgcatcagaatatgagttggttgatcgatcctacaaaacaagagttgagtgcctcgtgtcatcaagggaccaacacagacaaaccaaaggttgtatctttcttgagaaaggaataatttccagctatgcttaatttggttgttttgttagtaatgatatattaagatggagtccttttaacagcttgtttttataaact

SEQ ID NO: 52600 - DNA, 4376 bp, Oryza sativa
ccgtgggacacatggtctctactatagtaggatccagatagtttgtgcacgaattaagcatctcaaaccaccccaaactagtcgttcaaaaaaccaccccaaactcaattaagtgtgcaggagagctaatgatattggaagtctcagatctcacctattagattcctaagttctctacacaggacatgtgtcctttcagagctaggtatatggagtaccgtatatcggacagtggcatgtccttacatgaacttcactaatactaatttgccaggtccaatgttgttaaaatacctatgcatcacagaatatgagttggacgatcataaaacaagagtcgggtgcctcatgtcatcaaggaaccaacacagacaaaccaaaggttgtctctttcttcataaaagaataatttccagctggtgcttaatttgctggttttgtttgtaatgatatccttccccggtttatattataaaatattttgactttttttagacttttttatatgtcaaacttatataagattgatcaagcttatatagaaaaatgtagtcactcttaccggatcaaattagttctattaatctaacactgaatatattttaatagtatgtttgtttggtgtaaaagatattgttatatttttctataaatttaatcaaacttaaaaaatgatataaaaaataaaaatatcttgtaatatgaaacagagggtgtattgagttgaagtcttattaccaaggacttgctcatgattggcttggttatgatataatcaagatgctctaatatcaacctgttaaggattcgcttgtaaccctcacatttctgcagatatgaacactgtatcttgaacatacatatgtgtgcattcaaacttttaaggattttagacataagtatacacgcaaatactaaaatcattgtgttgtaaatcattatgcaaatctcgtgagaaattgaaaaaatgatactttgaatcgttgtgttttgaatagtttttataaatacttaggagaaaaatatgatggtgaaagatgcattttagagagctagcaatgtttaatactagtatataagtagtaaaaagggaaggcgggagtaccggcagatagtggtgattttgctctgagtatgaccggccaaccaactgttcccctttgtctttttaccaacatcaatcattgatcagccgataaatatttgatctgacatcttattatgcatgctgtcttggttgacccaaaaatcaatggaacaaagacagtacgaaagcaagcatgcactcacagatcgacatgggccgagcattcatgtatagctggcccagaagctgcatgctaactcttcttaatttcagcccagcagaattgagatctagcttactggtgcaatttaatgcaggtttgccttcattataaaaaaaatattttactcctccaactaatatatatatatatatatatatatatatatatatatatatatatatatatatatatatatatatatatatttgtggaaaaaaccgtatcatacattaagccatatcatctaaaaaaaatagtagcctttgtattcttcttatgtatttgatctcaacccatatatcatatgtatttataatctacttagtattgttattgctttataaatcttactatacattgaaccatgtcacctggaaaagtataataaccggacacgactacagggagcacatgcactcgttagtactaaccagcgaccatccttcttacaaaaagtagtacactgtgtatcatcagttagccttcttactaaaaataatagcaccttgccacgtgcatccccattacccatctaaatttcaaaaaacaatctcttaaattgcttatccgatccacaatttgattgcactattgtgttcgttgtaattaaatctttataacaatatattacatgattatattacgatgaaaaatatttatgtttataaatgacttttattatatatgtaagttatttttatcatatatatataaattactattagattttattaaattacttcttatacattcataaggctctgagttgatttccataatttgtggtgattaaattttatttctagataaaacctatatttttatccctacaatggatttatttttactgtcctgacaaaattactttccttttgttttaagttactttcataatatatgtaaattacttttaggttttattgaatttacttttatatgtctaaaaagtaatttattgaatctaaaattaatttagatatattataaaagtaatttataaattttcatcaaaataaaatcatgtgagatcttgttataaagatttaattgttacgagctggtttggtttgaggcctaaattggccttaccaatatttgacaatttcaatagtgtttagtgtctatttggtttgaagccaaattttggcatgactaagaaaataatgactaagagaaaatctattatattattattaaaggaatagaaaaaggagcctccacgttcgctctcatagcctagaaattctcacattaatcggagaaaaagaaaaaacggagttcatataaaaatacaatttagaaatagctgaaattcggaattaaaaaataagtaatattagaagagaagagtagagtccatatagaaatacaatttagaaatagttgaaattcggaattaaaaaataatgaatattagaagaggagactagactccatatagaaatacaattaggaaataactaaaattcggaattaaaaataaggaatattataaatagagtatagagtccatatagaaatacaaataggaaataactaaaatttggaatgaaaaataagtaatattataagtagagtatatagtccatatatagaaatacaattagaaaataatagaaattcggaattaaaaaaataaggaatattagaagtagagtatagagtccatataggaatttaaaactaactaaaatttggaataaacataataaaattaaaagtaaagtttagagtacgtataaaaatacaatttaaaaataactaaaattcgaaattaagaaaaatgtgggaagaagagttaaagtcaatataataatataatttagaagtaacagaaattcgaaattaaaaattaaataatatttaaagatgagtttagagtctacatagaaatacaattagaaataataaaaattcagaaataaaaataaataatattggaagaagagcatatagtatatatagaaatacaatttacagaaaattcggaattaaaaaaaaagaaatattaaaagacgagtctagagtccatataggaatatatataatttaaaaataactaaaatttgatattaaaaataattaataactaacacgtatataaaatacaatatgaatattgcacattagtagttttgtaaagttattgcaaaatttaaaattatgttgtcattttaatatatttgaataatatattgagaaaacatatatgctattatatgagagaaaatataatgatgttagccgcgcaatctgcgtgggccaccatgctagtttcatttaaagcatatgtggtaggaatatattttctaatagactagtactataactataagattctctcaaattaacacttattcgacaaatatctgagaggtctctcattagcactaaaacgagatgcctctcgatttagattttgccctaatagtcattggattcttctcatacttgatacaaaatgtcacgcccataaatttagcccaaatttccagactattttgtatattaaatccctgtccaggaccagccagggtacacaaaacgacatgtaataaacagttccaaacgtaaataaagcataaaaatacttacaggagaggcacttagtcctcacaccgaaacaaaagcagcggcagcggaaaagacgatcctagcggggcttcagctccactccacaggcaaaactcaactggggtctgagccttggtcctctaacttcgtcttcaactcagaagcactacacttctaaaaagggcgaataatagcaaggctgagtacaaccaccgtactcagtaagccacaccaacgatgcagacatgcaaggggaacacaaggacggtttgtggctatttgcttaaaggaggttgtaaaacattttattgagcaaaacagtaaaactgttgagtaattaaagtaacattaaatctccactgatcaacgctacaccacgttgaacaggcccaaccaacccacctgaactacagtgcattgagtcgatttattaaggtgggactaatcacggcgaatctggtcgaccgcccataaccgcgggcacggctattc

SEQ ID NO: 52601 - DNA, 12017 bp, Oryza sativa
gccgcataggccatcgcagggcccatccaaacttcatcacgcccagccttgcctggatgcgtcagctagaggaaagctacactacaaacccagccgttgcccacgctggcttgtggtaagcacgataaattcttctagggtttcccgcgaaccggtccttaattgccatgggcacgactagcaaaaccatgcacccacatcccaccatgaagtcacattttagttggataattacgaccatgaagcatggccagatgtctcgagcacgcagctcattctgatactaaaaaggtctaatactgtaattatcccatcaactgagctagtgataattaagcatggctaagcatatagttctagctaggtcacataagtaacatgagctagtcgatttattacccaaggttgacaaaggacagatatcaagtaaatatggcacaagcaagcagataggtaatacccgtatcctatgtaattagcaagacatgcaattttatttgcaaacaataaaacatttgtaaattaggatcaaaatgctcaagaggaatgtgtgacttgccttgcttcttcacaacaaccttccgaactctgatcctcgtcaaaagcgatcttccgaaacgacgggaactacacgctggcacgcaaaacgaggaaaaactctaatgaaaaccaatgaaatagtacataaaaagtaaacaaacatgtagagctcaattttagatgaattttgcaagttgaatggctcaattcggagttctaatgaattagatatgaattttagaagttttgagccatttaaatgaatttctagaattattaacgaattattgcgcaattattatttatttttacaaaggaaaagatcatcgctgacgtcagtaaggggcggccggcgccgacatgcgggcgccaccggtcagcgacacaagggcgtcggtccaccgtggaccgggaccaccgaggcggtctaccgccggtccacgggaaccgacagcccggatcggcccaaagccgatcgggcggccacgaggcggcacagccaggacacgggcacggcacaaagccgacccggtcgaacgacggcgcgcggcggcgcgcggccagacgaccgtcggcgacggcagcgcgtcgcggcagcgggcacgcggagcggcggaggaggggaaaaaggaggaggcggagggagagcttaccgagggctgcggcggcgagacaaccatagggaggcgaccggcggcggaaaggatggcggtggctggcgcgggaggcggcgggaacggcgttccgacgacgcccgaccacaacgaagccacggccgagggccgacaagaccttgactttggaaaagcggctcccgtggggttctggacggagtggagcggcagctagggtgcggtggagcgcggcaacgctgcgcggcgacggctagagcggcgagaggtggcggctggaggcggtatagttgaggcggctcgggtggacagtggaggtggaatttcggtgcgagattggggaaaagaggtgtaggacggggtggagctcggcgcggcgatgccgacggtggcgccggcacggcacggcggtggctgaagcggcgagaagcggcggctggagccggtggcggcggcggagagaggtggtgcgcgtggctgcggcgcttcgaaggtggagaggggaaatggagcggtggacggggcgcgcacggcggctgcggtgtcggggagggtgacggcccagtccggggtgaacggcagcggtggcgcagcgtggctggagttcggcggggagcggcggcgcgtgggctccggggaggatgtggtttcgggcacggggaagctcggggaggagggggaaacggaataggagagcacgagggtgctttatattgggctcggggatggagatcgtggccgggagaggcgggaacggccggcaaagtggggaggcatcgtgggaagatggggcatgaaacggcgccgaaaattggggaaaagtgggggaagaggtggaggaggtggtggggaaccgattttactcggtttgggcgcgagggcgcgagcgggagggcgccggatttggcaggacgtgggcggcaaccgccggccatggcggcttcggcctgggaagccgaaggtaggaggagggcctgacgggtggggtcgccgggcccacctgtcggggagggagagagggaggagaacccagggggttatttagactttgcgcgaggggaaggggaaacgggccgacggcccaagagaggagaggggaggccggccgaggaagagagagaggggcgcgggccgcgggagagaaagggggattgggccgggagcggcccaaaagggagagaggaggtttttaattcgtttttcattttatttaattgattcaatgaactttgtgccattaaaattacttcttgagctccgaaaattcacggaaaaatccggagagtgttttagggcataaagaatattacaaaatattctcggccaatgatttttaaggaaaaattttaattctcccaataattcacttgattaaattgattaacttttaaataatttctagaaaatgcattatttaatgatttttaatcccgaacgaaaatcggggcgttacacaaaaccattcaaaaggatcccttcttgtgttttgatcccaactagcatggtggcccgcgcagattgcccagctagcatcattatattttctctcatataatagcatatatgttttctcattatattattcaaatatattaaaatgacaatataattttaaattttgcaataactttacaaaactactaatgtgtaatattcatattatattttctaattgtatttctatgtggactctaaactcatcttttaatattctttaatttttaatttcgaatttcagttacttctaaattgtattcctatattgaccctaaactcttcttcccatgtttttcttaatttcgagttttagttatttgtaaattgtattcttatacagactctaaactctacttttaattttattatgtttattccaaattttagttagttttaaattcctatatggactctatactctacttctaatattccttattttttaaatccgaatttctattttttttcttaattgtatttctatatggactatatactctacttctaatattccttatttttaattctaaatttatattatttcctaattgtatttctatatggactctatactctacttctaatattccttatttttaattccgaatttcagttatttcctaattttatttctatatggactctatactctacttctaatattccttatttttaattccgaatttcagtaattttcctaattatatttatatatggactctatactccacttctaatattacttatttttaattccgaatttcagttatttcctaattgtatttctttatggactctatactccacttctaatattccttattttttaattccgaatttcagttatttcttaattgtatttctgtaaggactctagtcttctcttctaatattccttattctttaattccgaattttaactacttctaaattgtatttctatatggactatagtcttatcttctaatatttcttattttttaattccgaattttaactatttctaaattgtatttctatatggattctgccttttctttttctccgattaatgtgagaatttctacaccatgagagcgaacgtggaggctcatttttctatttctttaataatataactagcatggtggcccgcgcagattgcgcggctagcatcattatattttctctcatataatagcatatatgttttctcaatatattattcaaatatattaaaatgacaacataattttaaattttgcaataactttacaaaactactaatgtgcaatattcatattgtattttatatacgtgttagttattaattatttttaatatcaaattttagttatttgtaaattatatatattcctttatggactctagactcgtattttaatatttattttttttaattccgaattttctgtaaattgtatttctatatatactatatgctcttcttccaatattatttatttttatttctgaatttttattatttctaattgtatttctatgtagactctaaactcatctttaaatattctttaatttttaatttcgaatttctgttacttctaaattgtattattatattgactttaaactcttcttcccatatttttcttaatttcgaattttagttatttgtaaattgtatttttatacgtactctaaactctaattttaattttattatgtttattccaaattttagttagttttaaatttctatatggactctatactctacttctaatattccttatttatttaattccgaatttcttttattttctaattgtatttctatatggactctatactctacttataatattccttatttttcattctgaattttagttatttcctaattatatttctatatggactctatactctacttataatattccttatttttaattccgaattttagttatttcctaattgtatttctatatggactctagtctcctcttctaatatttcttattttttaatttcgaatttcaactatttctaaattgtatttctatatggactctactcttctcttctaatattacttattttttaattccgaatttcagctatttctaaattgtatttttatatgaactctgttttttctgtttctctgattaatgtgagaatttctagaccatgagagtgaacgtggaggcttctttttttattcctttaataatataatagatagatagatcattcattcgtactactactgtacatgtgtaatgttatgtcttcagactgaagatttgcaatcaatctacgtacgtacgtacggccattatataatacctggtctttccttttgtagtttggcccatctggaaagctagcccaggaaggatcgatcgattaattgtcatcagtgtttttgtccttaattaattaaaaaataaaaagaaggaaagaaaaagaggatatcattttcattagagtaagttgtgtgtaaacagtgtcagacaagggggggggggggggtttggtgagttagttagttgacgccttgacggagaaaagaaggggccaaatgagatcgacagcatggcccctcggaggtatataggttaggtgaatgcagatgcagccatgcaggcagaggcaggcgtaggccctctctaatttgtggtcatctttattttcaagagactcttgttgatctaccgtaccaatcaacagctagctaagcagagtgcgtgattgtgattacagtgttgtactcttgtgcgcacaaggccggttaatttaatttgttggtttaactaattaactgtcaacagattgatcgatcgatgatgttgcccgatcgtccagccgatagataaatcctaataacagccgataaaccactttgggttgcagcagattttgatatctcgtccattgtctgaggaatttatcaaccatggattttgccctgtagctcagcccctgattatcatgactagctagttcatgcattgattcaggctttatataatcatgcatagcatggactggggaatcatatatatgtacatggatcgatcgagtaggatgcagaggtcgtcaaaagagtgggacagaccgagaaaatagacagtgctctgtcggcaattaaactagctataataatctttattaatttcatatgatctgtaggttactcactttaggtagctaatggttcaaaatcaatcaatcaagcttcattactattatttgttagtagctagcatcatatatttaataatacaaagtcgtttgcaactaatgcgtgccttcgcagctagcacagatcgaaaggaatatataccactcctcacatgacaagaacacagggacctgcagacatgcatcccaagttgaaacgccctctaattggacttgtgcatgaagcaatccatatttcattcgattcaattcatgcggagcattaggtacaattcatcccaactgctgctactctgcacatcgatctcaatcttactaaccttctaaggctcactagctcaccagctgatgtaccaccaagcagtaataattgtaccattctccacacttgcagatatgttcatcatttttttagagggtgtttagatctaggggtgtaaagttttagcgtgtcacgtatgttattatatagggtgtcgtatgggatgttcgagtattaataaaaaattaattacagaatccgttagtaaaccgcgagatgaatttattaagcataattaatccgtcattagcaaatatttactgtagcaccacattgtcaaatcatggagcaattaggtttaaaaaattcgtctcgtaaattagtcgcaatctgtaattagttattttttagcctatatatatttaatacttcatacgggtattcaacgttcgatatgatagggtgtaaaattttaggatggaacaaaacagagccttactcaaagcatgcagccgatcatatacctgtcagaaacagttttttttaataaagaaaatggaaacatgctatccgattagcaccatggatgaccgtactgtacatgcatatatattttctcaagttttcagcagccaagcattcctattagaccccacttatatattaggacaggataccaaacaataaagcaaatcacaccacatactttttcacctaacccttttatattttggtctttggaggtactcatttcatgctatgtgtggaaagaagagaatgcaaagggagtctactatttaatactgagtagggacatatttcaatatccaccaccataccaaattgatgctagaatgttttgatttatcatgtgccatttacctctaggcacctgcatgcatggtgttaaacaaaaattaatactagtatgtcctatccattccattattgatccggccgtacttttgccagaaaagaaagattggaaggcgaattaagacggtctggaccattattaattgtccgtttctaagtaaatccaagcgcatgcatgctggctggtggcttagttatatatttcactcatcttctagtatatatatttgagatcaaaatcacaactttattattcagaaaccagtctattagagagaaagacaaaccgacgtcagttgtagttgttcagaaagatcaggggcgccgttgcatgcacatcgacgccgggaccaaaaaagtatacattatcatcgctgactcagatgttctgaaagttgctaagaatgtacacatgtaaaataagtagtatgatcatttctttgcttagtggacaaagattaccttatatatatatctcgttaatgcatgtttgataaggaaaagatttctttgctgaatgctccccatcaacttttcgtggcctaagttgcatgtgaatctcatcatttttacaattgatacacggaataatctttttggtacatgtttggtgcgatacagtggtggacttatagatggagaggtgtcggtcaccagaaaccagcactctagctacctcagatcaccttttaattttccatgtttgcttttcgttagctaaacgaggcacagtatatatgaacatgataattaaacagcaagggaggctctactgtagataatttctcaaattcagggcacagtacatgctgcagagggaccaacattcacatgcagagccatttcagtttcagtacgagctaaaaaggctaacctgctctcatgctttgccatgaataatgatggagttgttgcatgtgctgagatgatgaatgtttcagatgaatatataagtttcaccaccacattccaaacaaacacacaaccattccaattctattaattctaacccatttatcatctcagatgaatatataagctcctccattggaggttagcccaagggtcagtgttgcttgagaggtactcactctgtgcaggtgccagtggactcagggcatttagctagccagccaaagccaattgccatgtggagtgctctcttctcccatctgagagaggttcacaagagaagcggagttaaggaggagaagttgataatgaagtcgccagcagcagcaggtgaggccgccggctgccacaagccgcaggcgactgccaccaacaagatgacggtgctgcagtccccgctggggctcaggaccatcctcacctccctcgtcgccttcttcatcgtcgtcagctccgtctccctcctcttcgaccgcagccaggatgctcaggcgcagctcgccgtcgcgcagcatcagcaccaagaagtccagctcaagcagaagccggcatcagcagcagtgggcgagcagaaatcagtattcgtagatcagtcgtcgctgaggagccaggaggcgcaggtgcagtggacatctgagctgcaggacgtggccacggacagcggcgacggcggcgtcgacggcgaggaggagtgcaactggtcgttgggacggtgggtgtacgacaactcgtcgcggccactttactccggcttgaagtgctcctttatcttcgacgaggtagcctgcgacaagtatggaaggaatgacaccaagtaccagcactggagatggcagcctcacggttgcaaccttccaaggtatcaacacgactcatctccattctaatccacatcaattttgacactacactcactactgctgcaaggatctgaaactgcactactacttagtactacactccattcgtacgagctgtctcagtgtttcttaccaaacttccaacttgagctactcatggtaacaaaaacgtttttagttttgtgaaagcaggggaaaatgttctctcctagtcctgcaaaaaaaaaaatcaactttttttttccagattgatcttgtaactcagagcagggttcaacttttcgttttcggtgtttgtatcggacggtgccaatatggcgaaatttctgaaatttgggacaaaatttagtcaaatttgaacaaatattaccaaaattcatgattttttttaaaaaaataatttcggccaaaataatatcgtattggaggggtccaaaatttggaaaatttcaatctgaaatgtcgaaacctgacccagagtcccaggtgccaactggaaaacatatagagaaaaatcggttggttttgagttctttaaacaacggttagttttgaggaataaattattggacagcaaaagatcggttgttcttttagataaccgaagatacagttagtgaaagatcagttatgagagaaccaatcgccaatgcttactagctaaagaacttcagaagttcttttttttttcttctgacatggtgtcgcactcataagaatggacctttcaaatacctatatgaagtaatggtcaaatccattggaagttttgaggaaatataacatgagctccaagctcttggataatttcctttgtgtcatcctctcttcaaattcctgtactgttttgtgaagcatccaaacaacacaattgagtaattcctatattgttcatattccttatgattacattgacacgtcactccaatttctgtgcttttattattcttgtgttttcctgtgtttctcaattcctttgatccaaagagtcagttaatatgttcctcccctaattaatatccaattaaaacagtacaaggtacctagtggaaaaaaaaacgtcgtttataatgtgtccagattgctaaatttataatatatgcatggttgcttctgtaagccaatggccaactagaaaacgtacagacaaactattgattagttttgagttattcttaaaaaaattgttagttctcaggactgaaatattaacagtgaaagatccgttatgaaacacaaaccaatcactattcactaatgcttactatggatcaattgttttttttttctgatatatggtgtcgcaatctttaccctgtcaaaacagattcaatgccacaaagtttcttgaaaagcttaggaacaagagactagtttttgtgggcgattcagtaaacagaaatcaatgggtgtcgatggtgtgcatggtggagcacttcatccctgatggccgcaagatgcgcgtttacaacggctcccttatctccttcaaagcatttgtatgtctcactaatctcttcatcccaacatgcttctgaattcagaaatcagaagcactactctgtgttctctgatctgaacattttcttttgtttgctccaggagtacaatgcgacgatagatttctactggtcaccactgctattggaatcaaacagcgacaaccccataattcacagagtggagtatcggatcataagggcagacaggattgagaaacacgccaatgtctggaaggacgctgatttcatcgtcttcaactcctacctttggtggaggaagcagagggatggtatgacgatgaaagtcatgtaagtacttaattattacttcttactttcctgttcaggaaaaaaaaaggtttctcttttttcttgttccaatgcaacaaagtgagatttggaggcatcagaaagttttcttacttttttcagtcaaaaaaagtttcctttttttttcctctttccaatgcaacaaactcttatttggaagtatgatcagtaagtcattatgcaaaaatgtaggtatggttcatttgaggatggggatgcaaagttagatgaggtggaaatggttgatggttatgagatagctctcaagaaactaactgaatatcttggagccaatatcaacaagaacaagactagaatcttctttgcaggctcatcacctgcccattcctggtgagagaacgtacaactcttgcatcatttctcaactgcgaaacattctgaaaaccaataaaattcatcagctctactcaagttcaaagcttgcttatatttttgacactgaaaatgaaaaaaaaacacgaatattagggaaagacctaatattaaataattagaagggatgagacttcgaacccaggccggttagctctaggcccaccaccttgtggagctagcctgaagaggcccgggtgtttctcatgacactgaaaatgacaatcaatctacactgaaaatgacaatcatgtgcattctgacaagaaaatgctggaacaaaaatggatgttttccagggctagcaactggggaggagatgacaacaacaagtgtctaaacgaaacagaaccaattcagatagaagattataggagtgcaaccacagactacggcatgatggacaaggcgaaggagatctttggaacattggaaccaaagggcatacatgttcagatactgaacatcacccagctttctgagtaccgcaaggacgcccatccaacgatattcaggagacagtacgttcctctgacgaaagagcagattgcaaacccgagcatctacgcagactgcacgcattggtgcctccctggagttcctgatgtctggaacgagttcttgtatgcgtacctcatgcacaaatgatatatgtataataatgtaaccttaatttggccaaatttcttctttgttaacttgtgggtgtctaagtaggtataagtgcacagtacttggcccccatcaattttttctgtttttgacatttacatcattacatgtaaagagaaagggaagaacataatcgcagaaatgaaaaggaagaagataagttgatttgcctatactgagagttactgctacttatcgatggttgtgcagcataaaaagatttttttgtgaataagtaggagtacattctacataaagcaactgctgtaaagataagaaatcaattgccaaactgctcatgtcatgaagctcaccagggagcagataccaaattaagatataccacctccgtttcacaatgtaagtc

SEQ ID NO: 52602 - DNA, 21619 bp, Oryza sativa
cttacattgtgaaacggatgaagtataacttttcgtgcttctgtggatcgtttggttcctccaaacggtcaccctttgccgataggaataagttcactttgtgactctcaaaagtgatcgaaatctaatccgtaaccctaaaccacaaaaccggatatctcgacccctcaactcttaaaaccggtacaatttgactccctcggtggttttgaagggcggtttcgctgatgtggcgtctacgtggcatcccaatcatcaaataaattaaaaataaagcggggcccacctgtcagtgagtcctctcctacattctctctttcttcattgccggcagcggcgggaggacagggtgagcagcggcggctggcggcatcggggcgcagcgcggtcggcggctaggacggcggcggctctgctgcggaggctcacgatagtgggaggacgaggggaacagcggcggcggtggctcgcggcagtgggaggacgaggggaacggcggcggcggcccaagatgctgctcgtcgtcctcgccctcgcggttaccggcgcggtctccgacggctcgcgagtcgctggaccacatctccatcaactgcatcggcgtcgggggacatgtccggctgccgctccgtccactcgcgccgttcagcaccgacgagggcggcgaggctcctcgtccccgctcagccgcggctcttcttggatagtcccgactggaggcagtcggcggctgggagggagtgggaatgggagcgggacgatgacgacgacataagaggaagctggctcgcgtcgggatcttggtggttcgtcggcgatgatgccgcgtgcgctgatggatattttgtaatcttgagctttttaatttctgttttgcatgcacgtagtggctggctcaagtgtaacgaactgctgatggaaatgaataaatagagaagaaaacagaaaagctgcggtgactggtgagacttaagcagcacaaaaaccactctgttcagaactctgttcttcggtttttcagtttactgttcacaatcttacaatcttcagagtttcagagattcagtgaggttgagcgtgtgagctgtgagcgaattgcaagtttcctgacatgcgctgactccctctccgccggcaaccacgtggaggaagtcgaccggcggggtggtttcggggaggagtggttcttggtcgccgtagaacttcgtctctgctacgttgcagagctcggagaaggcgtccgccgtgtggtccgcctccgcgtcgtggcctttgctcggggagcggccgtgggtgaaggcgacggcgacgacgtagacgacgtagagggaggtgaaggcgagggcgccccagattgtcacctcgccggcggcgaggacgacggccacagcgacgagggagacgaggaggaaagacgcgtcgcggtagaagttcaccctgtcaatggcgaccccgcgcgcgccgaggtggacgccgatgatgccgagcacggcggaggacacgagcatcgcgctccccagcacgccgttgagccacacggcggtggcctccccctctcccccgccggaggcgaacgacgcgatggtggagagcgcgtccggcgcgcctttcccgagcgacaggagcgtcacgccggcgatcgccggggagaggcggagcagccacgagaggccctcgaggctggagcagaagtacactgccgccgtgtcgccgagcaggtagaacagcacgacgagccacgccgccatcacgccgtagcaaagaacccgccgctcctcaccgaacacgcagtcgaacaggtacaggtagtcgacgtagccacgcgggaatcgccggcgatcaaggccatcctcctcggcgacgtgctcgcacctctcctcatagctctcaacctggaatacgccgccgccatcgcgacgcccccggatcccgccctccttggacgacgataccacctccggcagcgtgccgccgcgcggcgagatgatgaagaagaaggcgagcaggagcaagaaggccacgttgacgctggcaccgatcagcaccctcgtcgccggctagtacggagaacagacgccgaccccatctctccgagcgctggcctcgccatcatcgactcctccactccgggaccgcttcagctcccgccgggtggcgccacaccgcggcccatgccccgccgccggcccaaggggaagaaggggagagaaagagagaagggagagaaggaggactgacatgtgggtcccacattttttctttgtgtgagtgacaaacgggtcccacgtaaatttttaattttaatgccacgtaagtgccacgtcaacgccacgtggatcaaaggctcggtcaatatcgctacgtggcgtcacgtcagcgaaactgccctccaaaaccgccaagagagtcaaattgcaccggttttaagagtttggggggttgagatattcggttttgtggtttagggtcacggattagatttcgatcactcttgagggtcgtgaagtgaacttattccttgccgatatgggctgttttgtcagcccagcccagcccagcggagggcccaaaatcatagattgtaggaataggtctagttcaggaccctcatattttcgtcaagttcaatttgcatccttaaattcagaaatcttaaccccctacttacaaaaccgggttaaatcagatgagatgtaccgtgggcgacgacgaacttggggccgtgcccgtgcaaggggagcttactatctgcgcatgctccctccgcgtcggcgtcggcggcggcgggctcgacaatgtcacctcactgttcttcgcgtcgtgcttctcacctcgtcacctcctcactgcagccccgcccgtccacgtcgtcgtctccaaccagctcattttgcacaacggcaaaatgaaaaccccgtgttccctgctaaaactagctgccccagttaatgcataagcccttgttttcaggtatttaaattttgatgagtttcaagtgccaaatttgtactgtcattcatatataccttcgatctttcgctcgctcatactagtaggaatcttttcaacgatgatattaattaattaatacaatatgaacttaaaaaattaagttcttagatttagtaaagatactacacatacacgttttacacattttctgtgatccaaccaactaacccttagggtgtgtttggatagtgggaaatgggaggtagaattggaattgagaaatgaatgaagggttaggattaaatggaagagggataacaaatggttagaatttaaagatgggtgaaaaatcatttccctttcccatttaccgaacaatgccttacatgatgtgtaattatcactactagatagtataagtacatagcccttacgaggacgagggctagggcgaaaaatactttgtttttttgctgtcctatgcagtagtaatatgtttgtatattgcaacggatccatacgattagaaatagaaatggtttgggagtatgatcgagtatacatatactaatataaaatggagaagttgttttttttcctacatccccctagtaaaatgtacacacgatttcctatttttttctatagccatcagatccgatccttttgtccaatggctgaaaaagtccattattggttgggtctagcagtgctatatggtgaactcaccgcagaaacgcccacagccagacgcacttctcccacatgctaataccaccaccgtgccatatgctccatggaaacattgccatcacaccctcgcttctccaacaccgctgctcccttgatggcgcaacctcgctcctccaacgccgatgcacgcttccttccaccacggtgcgtcttctctcactacaaatcacttctctcactgcaaaatgcatcgcatctttctcttgtgttggagccgtggtccaatgctgttgcacacatccttccgtggcggagcgcctcctctctttttaaatagtaaaaatagaactatttaatcagtataatttcgtatgtataaatgataaggtattttcaaatataggtacatgtacttgcgaatatctagctagctatgcaattaatcaggtgactaagatgatgtcacttagagcagatacaatagcaggctattagccagctataaacatattttaatgagataaacgatgagagagaatagcagcgggctacagatctgtagccagctgcagcacagactacaagacacactgtgtgtatgacaggtaggatcatatattaatagtatagtaaacaactattgtatgaattggctattagattggctatagatgaattggagctagtaatgggctatactattagacttgctcttagatggttaattaattaatttgttgatgtatatctggtactccctctgtcccaaaacattagcatttttagcatagtgtcaagtcaaacatttttaactttgactattaatagcaaaaaacttaaaaagatcaatcatgtaaaattgatgttactagatttatcattaaacaaactatcaaaatatataacttttttttatttaaaacatctcacttttgtagatattgttaatcaaaatagtatctcgaagactgtgtcgaagtctaaaaatacttatatttcgagggagggaatagcttttctttagcgtttgagttgcaaatgaaaatggggagcatccatccagagtagtccatgtgtgtcacgcatgcaagtattccatcggattcccctgcctgcagacttgcagatacagttgagcgtacaaataaaacatcaataaattggtccttattgcgcatgctgctgcctgcatcaattaatcgatcgatcaatcatgtgcagtgcagaccaacacgaatgatccacggtacagatcgagacagccggccccatgcacctggttttttcaattcgtcattatttggtcaatgttcacatattcgtgtacatgtacatgacaaaatgacaaccagtacttcattttacaggtagtacgtactgcactagtagacgctattataatcttaaaaatgtacatatactatactatacatcgatcagtacgtgttgcctagctcgaaacccaaaattcaattagtcaatctactactgctacaatgtaaaaggctcagttgatgatggtgttgcttaagtgtttgcctgtaagatgttactccctcccaggggcggatatacattaataccatgacaacttttgacaaaaagctacgcttaaactgtctatccgtatattataacactatattctaaatataattagtatgctatgacaccgataaacacgttatgacaccaacgaactaagatccgccactgctccctccaagctagtttgatcatcgcttaagactaaaatgtcttctcaaaatttctgtcggtgtaactctacacaatatgcaatccgcagaatatgaattgataaagcacattgctcgatgagaattaatttcagaaccatggaggttttgttacgattgatcataacatcatttgcctaggtaatgatcaaacatggatgaaggaataaaagattgagattgtatgtattaattatcaaattaagatgataacacatcaatactaagtgacaaataaataaagaacaccatgtcggtgttttaaattctttttatataatgaaaatggattatgtcggtgtcttcaattaataacaaattaataaaaaagagaaaagaatggaggtagtaactaatgattcatatacataaggcgtccatgctgttgatgagcaatggatgcatggacgaaatcgatcggatcggttggaattggtagcaaatctctaaaaaaacaattatcggttggtcgagaataaaccatatttaccaatttaactattcaatgtcaatataacagtacgatattgaaagaaactagctgggtggcccgtgcaattgcgcggctagcacaaaaaaaaatcatattttttagtataattttacgtaaaatttattatatagctatctcattgtgtctcattgtcttaagactttgaatgtccaaaccttatcatcctcgtgtttctaattatatagtttttaatagtcacaccagttgttaccccttatgtcatctcattctttatttgcttgctcgatctaccactatttctattcattcttcttgtaacctttaaaaattggattttatagtttttagagtattgtcacgttgggtttcatttttattatttctagatgttccgtcaaacgttgccattatactcctctacgacacatccactgtcttttctcttcattgtcattgagattttaaaaattgaatataattatcgtttgggtttatttttactttttagaagtcccgctaaaccgttagcggctttgctattgtaatcctctacggctcgcccgctgcctcccttcattatttcattgagattttaaaattgaacatgattatcattgtttttttaaatttttagaagttccgaacctttaaaaattggacttatagtttcgttttttataatttttagaagtcccatcaaacgatgttagctctgcaactatactcttatacaccccgcacgctacttctcctttttattgccattgagattttaaaaatcgaatatgattatcaatgcagtttttttttactttctagatgtcccggcaaccgccttactcgtttgtttcacgacctgcctgacgtccctccttttaatcgtcattaggattctatttggtgttttattaataatttttatatgccgtatcaaccgccaccactctactcctttataggcctgttacttaatttatctcgtcatgtgttttagatggtcttttattttaataatctttatttttatcaaaaattttagttatttataaattgtattcctaagtgaaatcttatttttctttttttctaattttagaattttttttaaaaatttatttaataccgtattgtgttcttttaatgtttttattttttattttcaatttcagttgttttaaaattgtattcctactttaactctcttttaatttttctaactttggatattattttattttttattctaaattttaattaatatcgtattgggttcttatatggattcttctttcaatatgcttatttttaattccgaatttcagctaattttaaattgtattcctacctgaactcttcttttattttcttttgctaatttcggatttatttatttttattccgaattttacttaatctcgtattgagttcttatatggactcttcttttaatattccttatttttaattccgaatttcagctatttttaaattatattcctacttgtactctcatttccttttctaattttagattttattttatttttgtttcgaattttgattaatcttgtattgggttcttatatggattcttctttcaatatgcttatttttaattccgaatttcagctaattttaaattgtattcctacctgaactcttcttttattttcttttgctaatttcggatttatttatttttattccgaattttacttaatctcgtattgagttcttatatggactcttcttttaatattccttatttttaattccgaatttcagctatttttaaattatattcctacttatactctcatttccttttctaattttagattttattttatttttgtttcgaattttgattaatctcgtattgggttcttatatggaaacttatttcaatatagcttatttttaattccgaatttcagctatttttagattgtatttctacttggactctccttttattttttttatttttctccgattaatgtgggaatttctagccccacagcgaacgtagcgcctcctttcaaagctgttttaataatataatagatagatagatagatagattagaaaaaaaatcaaattatatatacgactagaattagaaatgatatcacttatatatatatatagtaacgatgcccggccaatcagaaaattccgtggcaataatatatataccagcaatatacatgtgcgcatatatagagcatacattaggaaattaatttcggaaaaggagaatgaagtttgagagtgacatacatagtcttaatctggctgcgcgtatatagttagctagccaggtggtaaatggattaaggagatgagggagacatgcatgtttgtgtcgtttatattgagaaagagagaaataaatataggggggctacgacagcggggcggcgctggatggatgctgtatatatatatgtggccgggcaagagcgagcacagccggccggaggaggaattaagcaacaagctaagctaagctagccagaggaaacaacaaggaaaaggagagatcgatcgagcgatggagcggtcgacgacgacgacgacggagcagcagcagcagcagcagcaggggcggaggagaggcgcaggatggcggcgttgggcggtgctggtggcgacggtgtggatacaggcggtgacggggacaaacttcgacttctcggcctactcgtcggcgctcaaggcgtccctgggtgtctcgcaggaggcgctcaactacctggccaccgcctccgacctgggcaaggcgctgggctggtcgtcgggcctcgccctcatccacctccccctccccgccgtcctcctcctctccgccgcctccggcctcgccgcatacgccctccagtacgccctcatcctcgactacctccacctcccctacccgctcgtacgtacacacttcgtcttctctctctctcttttttttttcttttctttattatcgatcgcctattcgctttgttttaattaagcttgattattcaattagctttctagttacgagtacctataaggtgtccttccatcatgattatatacaagaaatataatggagatcttagccaactatgctgattgatcgtagtagtacgtggatgtatagaggccaaggccggccagcagggtttggagattcgagatcgatagtactagtagtagtagtaatgaagctactgatctgagtggccacaaataagttgcaatcatatatcacatttacggacgcaattctaacgtcccattcaactgctactgaattatatgtatattaaatcgatatctgagagactcaatgcatccatatctctccgtcgccgcgcccacctctcgtttttccttggcttacaattttttggaatcgtctgctgcaatcgattaccatttaccaatatactcctactgtgtattataatattgcccatgttatacatagtcaatcttatatactgtgtatctgcagcaataagttagtttctgccttaaacatgtatctggattaattgattacttcaatcaactcaacgtatattttgggatggagggaataacaaacaactcctaaccaacaacacccgcatatgccatcatcaaccacgatcaaaagtgtttatttaattgattctttctcatctcccttttaattttcataaatgttagctgcttgcgcctatttcaaaagatgaagagccaaaaataaaaatcccacacacgatcgaagaagaaacaaacaaatggttctcaagtctcagcttaaaatggtccagaaaagtataaatagctaaaactccatcggtaagttcacgcttcactcatgaaaaactcacgaacaaactaacgctacggcactatgtaaaactaaaatccattctgttactctaaacatccaggtagctctgtgtcctgaattacagttaataaaactcgctatcaaaatacccatgccagtgagtcctgcattattggcatcatcttgaattaatgccttcctgcccaactatcagtttcagcttcaattcagctttgactagcagatgaacaagctaccattcttcccccacataattcttcttacaaaaggaccatcgctacactgtatccccttcttttggtttctttctgactggtagagtggtaggtgttgatgccaactgccaagtatagcctccttccttcaacttctccatcataaacagtagcaagaaagaagcagcacatcctttttatcagttacagtaatcaaatagtctgaacgtattcctgattttagagcctataaccaatcctctgccaccataatatattttgaattacagtaataaatcttgttagactgcatagctcaaagacataattagccgtcctggtttgtcctctgaaactaaaacagcatacctagacaaggtcagcaagttaattacctattctcacttctcagaccggctgcagttttccttttctgaaaccaacggcatgaggcctttaacaaaggaacgtcctcgcaaccgccaaatcgaaggcactccctctaaaacagaagccacatcatcagcctagaacaaaattcctgacaaagaaaagcattgctagagcgtcagccatgaatgtgatgacaacaacaacttcacacacgcctgttgcattgcatttttcagtactcagaacagcatcctcaacctgctcatgcttcacatattcttcctttccttgggcagatccttcaatatcagtaggaagtatgacatcctttttacagatgaggaagcataacatcctgataaacacaaataccaattagatcacagaattattaccgaagatcatgccattacagtttttccgcaacagtacataacactctcttccaaacactactcgaagcagcaaatctggatttatcactttgttgtacaatgcattacatattagtatacttcacatcttgcatacattaaaccaggatgtatgaactgatcgttggtgcataataacttactgttaggcatgttttcctttaactttcatcaacagtattaaaccagcgatgtacggacaaatgctttttaactgtttgcagccagtaaaactgagctaaccaactgattgactaatttggatcatgtattacaatgcaggtgttcttgatctgcctggtagcaggttgcagtatctgctggttcaacacagtatgctttgtgctctgcattcgcagtttctcctcgagcaatcgcccactggccctctccctctccataagcttcaatgggctaagtgctgcattctacaccctctttgccaatgccctctcccccttttccccatctgtctacctccttctcaatgccattgtccctctcgtcgtatctcttgttgcactgccagcaatactcctctgccacccacatgacggccacctccacgttgtgcccaagcatgacaaacgtatctttcttggtctctacctcctcgcgttcatcactggcatatatctagtgatcttcggctctttcaacacaaccaactccactgcatgggtggtccttacaggtgccatggtcctcctcgccctccctctcatcatccctgcctcctccagttgttctcatgtggacacacatgaccctgaacctactgttcaactcaaccacgaagattcaagaaaaccacttttgctcaatagtgaccacagcacagagtccaatgccatgatgcagaaaacagtggaacacccaatgcaggattgttgcttgggaacagtactggagaagggacgcatgttggttctttgtgaggagcatagtgcaaagaagcttatccagtgcgtcgacttctggctatactacatagcctacttctgtggtgccactgttgggctagtgtacagcaacaacttggggcagattgcacaatcatttcaccgggaatctcagctcaccatgcttcttgccgtctactcctcctgttccttctttggtcgccttctctctgcacttccagacttccttcgcaggtccctctgtcttgttctatatacttgaatgcatcctaattctcaccagctggcccataaactaactatatatattgaatttgcatgcaggaaggtttcgtttgctcggacagggtggcttgcagctgcgttggttcccatgccaatggcgttcttcctaatgtggaaattgcatgatgtaaacactctggtagcaggaacagcactaattggtctaagctcaggcttcatctttgctgcagcagtgtcagtgacctctgagctctttggaccaaacagcattggcatgaaccataacatcctcatcaccaacatccctcttggatcacttctctacggtcagattgctgccctagtgtatgatgcaaatggcctaaagatgtcagtaatagacaaccgcaatggcatggttgacactatggtggtttgcatggggccaaagtgctactcaaccacattctttgtgtggggttgtatcacattcctggggttggtgtcaagcataatcctattcttgagaacaagaacagcttacagtgctgctggtggtcagcaagttgtaaacaccttagcgaagtttcgacttgacagaactccttgatctgttccttacgctatgaaaccatggctactttgtacaagttttgattgagttctaggtgaactaggttagtagataacatgcatgtaaataaaatcatcagagagaatcgcagagaaagaagcagattaggatagcagttccatttacagggcattgatgttgagttgttgacatccaagatgccacggaattaattttgaacaattgtttctaacataaatagtaaaatcaagaacgtttctcaaggtattttttttttcatttagcacttcgtgtatgatgcatttggaaattggatgcctctgcctaacacgcttggttattacctcaataagaactaagaaaattagctggttcaatggcacagtggacatggaatttagttaggaacacagctgggcaacctcagctatctttaatcacaaaaacccatactccagtagcagcaaaccaatgaaaagggatagtagtaatacacacacacacaaaaaagggcctgttcaacctgtccaagcctataatttccttgttatctagtatgaatcatcagtgcatcacataaagatggcatgccatctgtatatgcgtgttgaaccaaaaaatatatatcaagacatacgggtatattcttctaaagcatttgtagaagctaccacctaccatccagcagtttgagagaggtacaattactgtttgaccaactgcaaaaatgcttagtatcgaaattacctcatgaagggctacaattgagggtggccatgagcctaggactatcatttctcttgttcatcatgcttcctccatggattcagagcttctctcatggcttgagcctctgggctgttctcccaagctcttttttctgattccaacacagttaccttctcatctgtagagcagaaccaaatagaaaaatagagattgacattagcacaaagcaatgaacacaagggaaaaaataactttttttagctggggttggagcagggacacacagaagccggtgtggatcatgaagagctccatgctggcacctatggcggcgccgcctaccgcgatcttgaggtaccaccccaggaacctcatatcctttcccgtatgtccgtgatgcaatcgaatgcacagatatttttttactctcgcaccccactcagctcttgctagctgccaaagaaaaagggcagtcaatcaaatgaacaaaccatgaagggcgtggcatttttgggatgggcattcagagttaccacaattttttttgaaggaaaactgtggaaggcatgcggccagcctgaacattttagtattgatcaaaattgtaatatttacatacagattgtgaagggtacaggggttgaggggaagcaaaaggggtcctacatattacaacatgtgagaaatttgttcccccaatctactactagacattgtgaggcaaaactatctgtgctgggaggtgatcaagacttgttcgatgacgagtgaaatgttaatagttgcatcagtaggaaaacaaatactagttcgtagcaggaaggtctatctatctttttttttttaacaaatgcgaaatagttttacagaaaactcagtttaactttgtgctcattaaaaaaaaaaactgatacccgtgctatccctttgcttatttcattctaccgagagataaccaaactcattgaataaaatattctagacattagcggttgctacgagaagagttaacaacaagtgattccaaatctagactaattcttcatataggagtattatttttcgaagctatgaaatctatagttgacataaggacacgccacattccatgattcatcagtaatgaatatagaaatgaatacgaagaagagcaagaaatgggaatttatttcacctctatggctctatgaccttccggtgtggactctgccctgtgtacaggtcgtcggctccctcctcggcccgcgctgtaactttcctccgtcaaaggtagcttggccggagagagagagagatccaccgcgcgaggcggcggcggcggcagatggagccgaggtcagacgggggagagagagagagaacgcgaagaggaggcacgcatattggcgtaatacacagataaaccgacggtccagatcatcccctggagtttttttttttgtgagagaaggcccagcgccggcccagcccgacccagacccaacacagaaaatatcactgctcgcaccacacacccgggcggcatggcggcgacctcgccgccgatgacgtctgtcgccgccgccgcgcttgtcctaaccccttctccagctctcaaccgtatatcctttcccttctcccgtcgtcactgccgtagtgctgctcctcctcctcggtggaggcccacgcggtgccgcgggaagcccggtgtcacggaagttgtagccgagaaggagacttcgccggatggcgaagaggaggaggtgcgcgggcgcggatggttcatggttgatgagattggtatggacatcctcaccatcgccttgcctgctgtgctcgccctcgccgccaaccccatcacggctctcgtcgacaccgccttcgttggccatgtcggtaaggatcttgcttcctcacttgtatcttttcttttacttctttctacatttcctttgtggagtgtaatcccaattgcttgggtaacttcttgtggaaatgaaataggcaaactgggttggcactcttgataaataggggaaattatcctttctatattaaccatttcctataagaaaaatgtttccgttactttgagaaatggaaactaatgagtgaaggacttgtgtgtactttggatgatcggtatgatgagttcgaattgcggatgttttacaagaggagtacacatgcttgtatctgttttttctctgttatatgttgtgaagaaacttatttcttacaagcttactcgctacagaaatgttggtcataatctttattcagttgacgggcttcaattcattcatcaggttcgactgaacttgctgccgttggagtatccatttctatcttcaatctggtatgcaagctgctcaatgtgccattgctcaatgtcaccacatcctttgttgccgagcagcaggcagtggatgcagctgaaagtaagcaattcgcaggtcttattttctttgttataaaacttaaagccatcttgcttgtttgcataacactgattagtttttagtcctcgcataggaaatgaaatttcaataccccaagagaaagcaagtaaacaaaggaggtttcttccagcggtctcaacatccttggctctagctgctggcataggattgatggaaatggtggcactgatacttgggtctgggacactaatggacatcgttggtatacctgtcgtacgtaagactaatttatttctattagtagatgtctgagatttatctcttctctgaaatatggtgctagtggtgggtttttctcttgttagggtgtgtcatggttgtggatatctagagtttaaatcctgtgtagagttgacagctaggtgagtcaggtgttacattttgtgttccatttgtctgtctgggtattcatcttgatgtatatacacatacttcaaaattgttttcagacctattctatgtgcttcattagtcaagttttcaacagataataaaggatcaaaacaacatagtgtttgatcaacacatgaagacgaaaccaaactagaactatattataccaatatttggacaatgttatattctaagcttgattgattcgtattatttatttattgagattggcatagtacagagcacaaaacaaattacctgatgggcccttaaaacttactaccctaaaaaaggagttatggtaggcattagccaattaacaaaatttgggggacaaaatttagtacacttaacacctgctctcattttgtttattattcatttcaaactttctgagcttaatgctatgtaaccttggaattacactaaataattctatattacaaatccaataagttcttaaatcaatggcttcaatataaattctccgaacaaccttatacaggattcagcgatgcgtgtacctgcagagcaatttcttactttaagggcatatggtgcacctccagtcatagtagcacttgcagcacaaggtgcttttcgtggattcatggatacaaagacaccgttgtttgccgtgggtaagataatttatgcaaactattagagcatgttttctgaaatcctgtctgatgcatacgatctgctatagtgattgcaagtgtagatatacatatttttgttgttaccatttgtcatctttttttaaagcaatagacatatttgacttcaaatgataagaaactaatagtatgatgaatacaggtgttggtagcctagtgaatgcattgctggatgccatatttatttttccacttggtctaggtgtaagtggtgctgcattggcaactgtgacttcagagtatgttgaactcatcataagactttacagaaaattgtcttttctttcatttggagcctcttcacttctttctttaatcagtattcataagcccctaaaggcctaaactatctgcataattttacatgtattcaggtacttgacagcatttatcctcctttggaagctgaacaacaaaattgttctgctctcatggaatatcattggtggagacgttgtccgctacctaaaatcaggttgtccaacatccctcatgttcatttgcaaatacattacaaatgatggttttgttttcttgtaagagagctttgatatacaatgaaccgataaaaaactatcaatcaattcaactcccttttttttttaaggcagatcaaatttcattgacctggctttgcaagaaagcctaagcaacaaacagagtcttatacagaaagggaaaaagcaaaaacaattcaactccatttagtactacctctattaaacaagtttcatcttgctgcaatatacctctatgttaacccctttcacatgaatcattctctaggtgcactgctaattgcaagaaccattgcggtagtcctgacattcacactgtcgacatccctggcagccagggaagggtctgttccaatggctggatatgagatatgtttgcaagtgtggttaacaatctctctgctcaatgatgcactagctcttgctggtcaggtgtgtacatttagaggatcatacctttagtttctaggctctaatattttacattggcctgtaaagtattcatgatacaatgcaggctctactcgcaagtgaatacgcaaaaggaaactacaagaaggcccgcgttgtcttatacagagttctccaggtatgaagacattatataatattatgttagcaaattcgtgactatcctcttctttttactcttgcaataagattctcacactgttttatatgtagattggaggcataactggtgtagcacttgctacaatcttgttccttgggtttggatatttgtccttgctgtttacagatgatccagcagttttagatgttgcccaaactggagtctgggtaatgactatcctgagaggtcaaacttgatttatcaagtgttatgcaatgatttttataataatggctgatgaatatttgcagtttgtcactgtttctcaaccgataaatgctgttgcttttgtggccgatgggctctactgtggtgtttctgactttgctttcgcggcgtactctacagttcagatttctattcttgtcatattccattgcattgttgtcagttctagctgcagcatcctaatcacataaatattttttctgtttcagttatttgctggagctgtctcatccgcagtactgcttgtggccgctcctaagtttggtcttggtggaatctgggctggccttgctctatttatgagtttgcgagcaattgctggtctgtggaggtagtaatggatgatttgctttgggtgtaggccaattatgttagaaaaactaatttgttgatttgagtgattttgtggttttcaggttagggagcaaaggtggaccatggaaaataatctggtctgaaactgagtaaacaaaaaagatagttatgtgtactcaattattcgactaatttcttacagtcaacatctaaaggcaagtacagaacggcaagcaagaaagcagatagctggtagtcattgtccaggacaagattttctttaggagatgacagggtagctcatgtggtgatttggttacaacttacaagtagatatacttgctgctgcctctagatagatagatatagatagatagatagatagatctctttggtgttgactggtataggaagttgattcgacttgtacagtgctgtgttatagtagaatggataccctgtcagtatacaagaaagctgaaagctcatagatacaaacacattcagagccatccgtccatgtaaataagtgaatcttttccttgggagaagcatatataagtgaattcttcctctctgtttatatttcttggaatgatgtttatgtactggggattttgccaaggatcggcagcatgaacatatatattgcgtaccttgccccaggcagaccacaaagatacacagcatgaacaggaaagctatgggcctatcgtatctggaggcccaataagctccaaggatagagccggagtgggaggcagggcagcagaggcgcagccgagcagaaagaacatcaggaaggagaggctgaggcctgagggagacgacgacgagggaatcaagggattcggaatcggaatcggagaaggaaagatgccttgcctcaacgtgtccaccaacgtgaacctcgacggagtggacacctccgccgtcctcgccgacgcatccaagaccgtcgccaccatcatcggcaagcccgaggccgtacgttcatcccttttcctcttcttctctacccatacccaccctaggtttaggcgtgcctctcctggtttcttcataaattttcgcttcttgtaggcgtgctcagttcctagcttgcgattatctctattaacctggcgtttttagggattatcgctcgcttgtctggtgattcagtctgctcgagcatgattattagggtttaagtaataagtacccccatcggtcttcggcatgcaactgatgtaattgggattttgatccgtagtttagtatcaactatggtgatgttcatttggggatacaaccttaataggacgagggacagggagggagactggttgaggggatagacaagttccctattcttcttggatttccttcacaattcacatactttgtattactggtgcctgagtaaaccattatcgctcaaaataaatagtaaaccatttactctatgaaatctatgaacttgcagtattcctaagcttcatttggaatagtaaatcttcgcttcatttcgagtttggctgcaaaaatagtaaaccatttggaatacaaacttggtacttttgcagccaaaatttataaacttgccttttcttttcaacatcaaatcctcaccttttggatttttcagcaagtaataaatatttgcaaaaatagtatgccaagtctgttcatttggctgaaaaaaatacaaagtttaacaacatttggaatagtaaatcttcgcttcatttcgagtatgcctaggctgccaaaatttataaacttgcttttctttccacatcaaatccttcctcttttggattttttagcaaaaaattttaaaaaagactgttgcgcatactttcaatgtaatacatcagactatctgatatctttttcctggactgttgcttgttatgatcgtcatattgaaagatgaaatggacgaacaattttcataacagaaattggatgaaacagaactaatatagcattcctacaataaaagtaatgttcagttagtctaaactaaaatgcttataagccatgactttttcaaccacttactgaaaattttactttttccaagagtagatcgatttcatgtttttcattctaaataagtgttcttctgaaagctgtctattactagcgaatagttcttagagtgatacttgatgctgtatcagaaatagctatattgttactagtgaccagatagaggtaagatctgttgttagtggaccaaatgcgactgcagaaatggctagttttgctgttaatggactttcttttacttgaaatcaacattggttctctgattataatctgtgaatcatgatactcaatccgtcccgattgaaatgctattcgttgcaccatattgctatatagatttcagaattctatgattgcacaatgttagacctgtgctagcgacaaactgaaagttgacttccatcaattttctggtcttagcgtatgctgaagctattttgcatcgcctttattgtttagatactaattagattgcttaatgcttattcctcccacagtatgtgatggttgttctcaagggttcagtgcctatggcatttggaggtacccaggagcctgccgcttatggcgagctggtttccattggtgggctgaaccctgatgtcaacaagaagttgagtgctggcattgcctctatcctggagtcaaagctatccattcccaagggccgcttctacctcaagttctacgattccaaggtaagcaggccacatttcttattgactgttcatccatgggtcttcataaccatatagtcatgttctcattgcatctttgctgtttgttaggcccatcgtgcacaagaacatgctcaatgtttgcatgctttgcatcaagaatagatcagtgtaaatgggtcgtctgttgcttgtttaatgtcatcgtattggtttttgcagtttagtttctctctgcagtttggcagtaaacccttgccacagcacgtatactcttccatgctaattatgagcaactgagcactaataaaccccttttgattttctttttatgtagcgctcggactttggatggaacggcacccccctttaggttaaactgtatgcctgtggcttcaagatgcatgaaacctaagaattcctaatatctt

SEQ ID NO: 52603 - DNA, 11471 bp, Oryza sativa
  unsure (1)..(11471): unsure at all n locations
gcattccgcatccccgaggacctcttcctcgacgagccagaccaggccaacggcgccgcctccgtcaacctgctctccttcatcaccagcgccaccggaggccgcgtctgatcctcctcctcgcgcatgcattccaagcaaaggtcataaattctttttatattatacctatgagacaaacactatcatttattcgtatggtgatcgatgtagaacaaaaaaaaattaggggagaatgatactgctataagatgcatatatgattttgtcgatgatctagttttgtttccttttgcatttgatgtatgagaaacttgagagcaaaaagaagaattctgttattgatcctgatattgatgtgatccgtctcatcaatcgtgccggttctgttataaaattcacaaatttgttttggtttgatggatgattcataagccatctcattctgtaaagatgatatacatgaatctaggttaatcaaataatgttggatctgatattgtacatcttcatttgaacattatacaaggatgagagatttcgtttgtctgcttcttgtcagtgtttgttatgtcaacctaaacggccgagggctcttgctggcagtaaacgtttatttaggattaggaatttgtcatgttcaacttggtgggatcaggaattggtgttgacgatgggggagagagagcgctcaagggaactaatgagaccttggtttggatacatctttagcccaagtctgttggcaaatgcattacacaaggggattgcctgaaatcttgtaatccattggtcatttttcggatggctcagattgcgaacccacgtcttccctcgcttcatgccacgcttagctctgcctccctctacctcgttgcatactagacgaaatctattcagcttatattcaggcctgtttacattattactgcctaaatgaactttatcgaaatttggcattgctatttttggaattaccgcgaaaggacctgtaacctattggttgcaagacctcagtagcaccttaggtcctgagttcgactccccatgtaagcgaattttctaggatttaatggacttcgtcaatcttaaggatttggcccagtcttggaagatgctcatagaggttggaagatgctcatagagataggggttgcgtgtgtgtatctgcattgtactgtgtaattcaaagaggtaggtttgcgtgtgttcttgtactctaattaaaaaaaatagggtgacactcaaaaagtttatagtgacacgaacacataatgaatagtgtccaatgctgtttattactcgaggttggtttatgtccataataccttaatgttacatggcaaatcgtccaggtgggtttatgtcgtgaacatctgaaagttactccctccgtcccaaaataagtgtagttttgcactattcacgttcaacgtttgaccgttcgtcttatttgaaaattttttatgcttagtatttttattgctattagatgataaaacatgaatagtactttatgtgtaactaaatattttcaaatttttcacaaatttttcaaataagaaggacggtcaaacgttaggcacggatggaggtagtagtaatttggtggggcagaagcccctggactatttatgttctgtaaatccaacaagctggacaagatcggaatagtaggccaggcccaaagcaaaagaaatacctggtccaactaaaggacgggtccacagtccatcccacccgttgctttggcttctctccccaacattattaaacacaacaaaatctcctccttaaaaaacgacgacaaaagaaaaaaaaaagaagtagccgttagttggtagtgggggccatcgccgtcgccacatgacagcattcgtagtggtcagtactctcccgtgcactcctactagccgttgcgcctctcctctgctaatctcctcctctctctgctctggccacagcccacagacgcgcgcgcgcgctccagcttcatcttcttcctcctcgatcaccaactcacaaattccttccgctactcatctactctactctactcctccatcaaccaaatgcaaggaccacggaggcgaacaccacctgctcctgccgccaaacaaccagccatgctcatgctcggaccattccccgcccaccatcgctgcacactttttctcctcctcactgtcacactcctcccctcgctcgccgccgccgccgcggcgcaccaccaccacgtccacgccgcgggcgacggcgtcgtcatcagccaggccgactaccagggcctacaggccatcaagcacgacctctccgacccctacgccttcctccgctcctggaacgacaccggcctcggcgcctgctccggcgcatgggtcggcatcaagtgcgtccagggcaaggtcgtcgccatcaccctcccatggcgcggcctcgccggcaccctctccgagcgcatcggccagctcacccagctccgccgcctcagcctccacgacaacgccatctccggccccatcccaacctccctcggcttcctccccgacctccgcggcgtctacctcttcaacaaccgcttctccggcgccgtcccggcctccattggcaactgcgtcgcgctccaggcgttcgacgccagcaacaacctcctcaccggcgccattccgtcctcactcgccaactccaccaagctcatgcgcctcaacctcagccacaacaccatctccggcgacatcccacccgagctcgccgcctcgccctcgctcgtcttcctctccctctcgcacaacaagctgtccggccacatcccagacaccttcgccggctccaaggcgccctcctcctcctcgctcaaggaatccattaccgggacctacaacctcgccgtcctcgagctctcgcacaactcgctcgatggcccgataccggagtcgctctccgggctccagaagctgcaggtggtggacctcgctggcaacaggctcaacggcaccatccccaacaagctcggctcgctcgccgacctcaagacgctcgacctctccggcaacgccctcaccggcgagatcccggccagcctgtccaacctcactactagcctccaagcattcaacgtctccaacaacaacctctccggcgcagtgccagcctcgctcgcgcagaaattcgggccttccgccttcgccggcaacatccagctctgcggctactctgcttccgtgccctgccctacgtcgccgtctccatcaccatctgcgccggcatcacccgcgcagtcacgggaggcgacggggcgccaccggaagttcacgaccaaggagctcgcgctaatcatcgccggaatcgtggtcggcatcctgctcttcctggcgctctgctgcatgctgctctgtttcttgacgaagaagaggtccggaagcggcgggaagcagacgacgagcagcaaggcagccggtggtggcgccggagccgcggcggggggcgggcgaggggagaagccggggtcgggggcggcggaggtggagtccgggggagaggtgggagggaagctggtgcacttcgacgggccgatggcgttcacggcggacgacctgctgtgtgcgacggcggagataatggggaagagcacgtacgggacggtgtacaaggcgacgctggaggacggcagccttgtggcggtgaagcggctgagggagaagatcaccaagggacacaaggatttcgagtccgaggcggcggtgctgggcaagatccgccaccccaacctgctgccgctcagggcctactacctcggacccaagggcgagaagctcctcgtcctcgacttcatgcccaacggcagcctctcccagttcctccacggtcaatactctgtcaatgctactcttcttatcttatgcatttgatcttcatcctattaattaggaagacaatgcaattgataaactgtatgcattcttcagcttttacttctgctttcaactgaaactactctgaacatttgagaaaatgttgtagtctgaacatttgcaaattctggcagtgctaactgctaacattgattcagctctgtaatcaagtagatttgatacatctgaattttttttacagtgctgagtaccttttttatttagcataagaatgaacatcccatgccaatttagagattgagcattacatgtcttctgaaaattttggacagtggctatatgtcttcatggtcagtgcaaaaagtttagtaatagagtgtcatgttcaattaaaaaagttgacatattatgtagttttgaggctaatatgtgaacaattgttgatctaaatgacatgcttttgttttagtagcactgttttatcaacattattcagctttctggctctgaaatttcatcctgatgaactgaaaatctgcataactctgacacggtgacactaacatttcgtcctgatggcataacgtgaatgtgcagctcgcgcgcccaacactccgatcagctgggagacgcggatgacgatcgccaagggcacagcccgtggcctggctttcctccacgacgacatgaccatcgtccacggcaacctcaccgccagcaatgtcctcctcgacgaccactccaaccccaagatcgccgacttcggcctctcccgcctcatgaccactgccgccaactccaacgtcctcgccgccgccggcgccctcggctaccgcgcccccgagctgtccaagctaaagaaggccagtgccaagaccgacgtctacagcctcggcgtcatcatcctcgagctcctcaccggcaaatcccccgccgagaccaccaatggcatggacctgccgcagtgggtggcgtccattgtcaaggaggagtggaccagcgaggtgttcgacctcgagctcatgcgcgacggcgacaatgggcccgcgggcgacgagctcgtggacacgctgaagctggcgctgcactgcgtggaccagtcgccgtcggtgagacctgatgcccgggaggtgctccggcagctcgagcagatcaggccggggccggagggcggcgccgggccgagcgaagaaggtggcgcagggcatgtggctgctgcttctgcaggcaatgagtagtatgcagcagctgggctcttgagcagaatttgaagatgaaatcgaaggaaatgaacttgtcagtcagctagagactagaaacagagcaagctagagagtagaagcagagatactcctatatttcatttatgaattctttgatttatttgaaagcttagtagtagtagtattagtaagtggtagacattattcgtctatgttgtttttgaagcttcttgtataggcaaatattattatttgcaacacaactgaatcgctctatcagaatatcaattacaaataccacaatgccttccttactgatctactgtagtactcctattgtagtactgtgtgtgtgtttgtagatccatgtcgatgatgggaaacaagtgataatcatagcttgttgctgaatatgtcatgtatatcctggacaatgcatagccgcgtgcttgcatgagcttttcagattagcagaaagtgccgaccaatgcttaactgaaggtcatatcaccgaagtgcatggattgtaaaagtgtaaagttaacacgctttttcaactaatcatacagatcgtgtaaactgtttctggaacttccaaacattggacaattatatatatcgtggaaaactaactgtttttgacaggacatggataaatacttattcatgcatattcatttcatccccatcaaatgactgaggaacatgcatattcatttcatccccatcaaaatctgcattgtacggcgaagtggcggacaagtttaagtggaaggttgaatagggcatgattttaatgcgatgccccatgatatacattttgtgaagactgggttgccgattgaaaagaacaaaatcaccatcatcaaggtgcctttccacctgacaaaataaaacaccatatgaggagactaatatagaagacattattgtcatgtgaccatcagtaaaaatcagattctgaaacaaagttggtactcacattgtaacccagttccagatactgatcagttcttttcttcacataacaaagatcaagcctttgagcgtctccccagataatgtactttgcacctgtcttcccaggggggggggggggggggggataagtgatcattaaaaaacagtgatcatgcttcaataacagtaaagcattttaccttggaagttatatggagtaacagtttctgggtatgtaaggttcaaagcaatactccatggcactaccaattcattataatatttgaatccggtgtgatgacagtacgagctgagaaatcaacacgcttccccatcaaatttcctctactgctgcgttcctttgcttttagatacccctggacttttgctaatctgtggcgaacagcagtctgtaacacctgcagaagaaagatttcactaatgtgaaaattttatgtaaatgtataagatataaatcatgtttaaagtactttgagtgataaaacaattcacaacaaaataaattataattacgtaaattttttgaataagatgaatgtttaaacgtgtgacaaaacgtcaacagcatcatctattaaaaaaatggaggtagtatttttttttcccgcaccaccattcaattttgcacagtgttttagtatattgttatttgctgacaccggcatgaataggtacctgaaacaaccattcatattactaacattccaacacttaatcacttcttttttttaaggttactgatcaaaattaccagattcagtaatacactcctggataaggcatttttaaaccaaatcatttgcatactaacttgcaagttacagatagatgactagcaaacatacacaagtaaataaaaaagaatttgcataagctatatatataaagaagctaacaaagtaaaaaaaagaaccttgtggctagtctaacatgggggccggcagatttgaccaatgcacactaaccaaaatggtggcgcaatcaaatatcataggtaggatgacttggccatgtgcttttcccttcaagccacggagcatacggactggctcctcctcctctaaggcgccactccgcttaaccttcaagtctaacaccaagatgccgcgcttgacaatggcaagcacaaacctcttgtttagctgacacagcttggcaatggcaacactttcaaagagcttgatttcattgggtatttgaccgacacgacaagccatagacatgtcgaagccaccgctgccacgcacttcggttatttggatgtgcatcgtggcctctatggcgttgtggagaagtgctaagctaatgttcatggcaccgtagtcgccggcaatccatcgggtgtaagcttgggcatatggcaggggtagctcggtctcactgatagtggcagctctatctatgagctggagatcatcatcttctccatctcctctcttgatccttatatcgtactcaagcagtgcaggagtttccatcccaatgcctctcttagggccagacaggagtataaagggatcggagaggctgacgacaaaaggtttgtcgcgcccgcggttgaagacatagttgcgcaagcaatccatatgatctcgaacagccatgaagccatacacctgaatggggtcatcaccaatagcaggggcagtgatggagaccagcttgagtgagaagatctgcaacatggaagaacctgagtggacgatgcaaccagaccagttgggccggcaatccgtggtcggatcagacagcatcatcggcttcaatggagctgatacaacaatcagacagcgacatgtaagaacactgaataactatataaaaattattattataatcagcgagttaaatttgtagaagcagtaagtagattgggtgatggatagcactagccattattgagtttctgtaaatttggttgtctacgcatggatttaaagaagaagaagaagaagaagaagaagaagaagaagaagaagaagaagaagaagcaccgggatgatgtacatcaggctaatataacggtttagataattttgccaattctcttccgctccggctgtctatgacgccctaggctggctcctaatctggagcagcgtagcgggagtgcgccatagccagagggggcaagaggaagaaggggaaattttgtgcaatataatagggcatctgtggacccccgtttttataacaggaatcaatcgtgtaaacagtaccatttccctggatcaagtagtttggtacacacaaattcatagctggaatatcaagtgcacatacacgagtatctaatacgaattattacatcataggcccgcaggcatagtcttaaatcatcggaccgagaggtccggaatacatccaaaagcagaaatagataaggcagcagaattcaggcagcggcatgccattgccacaggcaacgaccgtactaagacctactggacgccatcgtcttcatctccctcctgatagtaggcatagggatcctccgaggcttcatctcccgcttctgataaattttatatttgcaaggatgagtaccaaccgtaatcagcaagccaccacagcaacaatgcatatgaaagggggagttcaaaggatggccatagttcttttgcgcaaagcaagttttgtaattcttttcacaagcctaagacctagcattgactgatcaaattttagtaccagagtttgtatttaaacaacgacggttctgtccaccatccattgtgatcccaaggatagcttcccgccattgattcgtcatggttttctgaggacgtccaccttcccgcctctcaggaagtggctccaacagcataaaattcatcatgcaatatcccctcccacacaagttaagaatttagagtctagccaagtgtaatacatgtcccggtgctcaataaccgcgagcacgactattcgaatagatttggtttactcacactgcagtggatgtacactttacccgcactccgcgactgcccaacacatgagcctcgtcccaacacatgagacgcgtcacggcaaagctntttgataacctcgcattggcagtacccgctccatgaacttctcatcctcatgcactctaggcggacacggtttcagcagtgataggagttctggcgcacccgggaagggaagactcacacatgcattaagttataattatgttttagattctcacatggcagtcctaccgatgcgacaccactgtagacacccgcctcgcgggcctaccaatggctgccccaccgtagagcccctgcctcacacatcaagaaaccactatgcatggatactgcctccgctcagctatctactccgctaggtctatacccatacgagaagtgcggttgtacgggggtcgtttcatgcttaacttcatggctcggtccttaattgaccagggacggcactagccttttccggacaccacccaagtcctccagccgccccagtcgaaaacagttgtttaactttattttcctttcacaaatcatgtcatcaatatcatggcaatgtggcgctcatgtctccacatgccgcatctcaattaccttcccaaaggtaattacccaagcatatagcgtttgataaatatgagtatgcatgaatctaaaatagcatttctaagcaagtgtcatagttgactagggactcgtacgtatctatggctacaaagatttaaaggtgaacaataatcaaggcatggtataatcacaagtaggacgttcataattgcatgcaattttatttgtaaacaaaacaatttcgcaattgggatcaacatgttcaaagaatagtgatgacttgccttgctcaaagtcttgcgggtcttggccttcgcttggatccgcaactccctcgggctctatagttacgtgcaagaattgatttgaattcggttagaattcaaataaaaatccaaataaatccaaataaaagtcacatgcgaaagtcgattcctttttttattaattttactatctgcgaactatgacaaacccaatttcgatttaaactattttgcgggtataaatgttttattgtcacaaatttttaatttaatctacctgagcattatatccatataataggttagagatttctagcgcgagctaactatctgacaaaatcctagaaacattatatgatttaatttagtctatgactaaacgattaaatatattacacggctataatccctagtaataaaatccgaattttctatcgttaattgcttacttatagggattacccaaaataatctataataattaccgcgaattgatctaaattattaccgcgaattgatctcctatagacattactaaaaataatctataacaatctattaagattcatctaattgttttaattcgtaaataattagttctataatcaaatcttagtactttaggtattttaaatagtaggagttcatctaacgatattctcattaatcctataattaatttctaatatgttaaatattctaaatctcttaaatttttcctttttctcttttctctttcttttctttttctctttttctctcttttccttttcttttctttcctttctttttttttctcttcctctctttttcttttcttcctctccctctcggcactcttttcctctccctctcccggctctatctctctctctcggctcttgctctcccgggcggcggcgacgatggacgcgaggggggggggaaaggttgggcggcggcttaccgacgacggcgacggcaacggcggcgacagcgacggtggcggtgttggcgcaaggcgcggcgcggcggcttcgtggcggcggcgcggcggctttaagcgatggcgtggtggcgtggagacggcggcgcggtggcgtggagacggcggcgcggtggcgtggaggagtgggtagagatagggggtggagacggaggagaagaggggaatagcggggcttatataggggaagagaaagagataaggggaggggaagacgcgacggcggcgcggggctcggggtgggggcgcgcggcacggggctcggggcgggacgcgacgggcggcggcgtgcggcgcgcggacgagcgacgacggcgacggacgagcgacgcaacggcgacggacgagcggcgacgggacgggcgacgcgacgggcgacggcgcgcggcgcgtggtgcggcagacggcagcggcgcggggcgcaaggcgcgacggcgacggacgagcggcgacgggacgggcgacgcgacgggcgacgcgacgggcgggcagcggcggcacgcggcgcgaggtgcgggcgcgggcgcggcagtggtgcgcggcgcgaggcggcgtcagcgcggcagcggcggcgcggggctcgagatgacgcgacggcagca

SEQ ID NO: 52604 - DNA, 9252 bp, Oryza sativa
ctagggagcctcgtcgaacacctagaggctaatgaatagtgtctttttcctatttttccaattttagtttatttcctatatgaatttgattctataatttctaaatcttgcataaatgaagtttactcaatatgtgtattatctcaactaatgaattcaccctagattaatattactcatattttatttttatgtaatttatttgagttttatttagggttaattcttattccatcgtatttaaatttaattgatccaaatatggtcgcgataatattttatttatttctatcccacctaatctttattttaaattataatttatttatttctttaaccaaatctaattgcagggttaatttctaattaattttcccctatttgtgatcgatgaattccgaaatcaaaatccaataaaattggcatgatgcaatttatttaaaaagtttttttttttgaagatccgtatttttagagttttgattttgtcggtcgaatttttagggtgttacagcatccaaattagtatatcggctcagtgagctgagccagccaaatacacacaatcaatcaatatacttatatacatacaaaaaaacatagggaggaatcaaggggattcgaatgataatagaactaagaaaggagattggattcggtgggaatggaggaggtctcttactttcgttggtatcggcgatacgataatagatactccagtaatcggtacccctgtagatggatccatctcgatgcttcctatcctcaagaacatcagcaggttgttcgtcgtcctccttctcttcttcttgatccatcattccttccgtgtccattgtgcctgcaaggatagtcgtccctccccgccgtctcttcctcctggatttggattcgacaaccatcttcccgaactgctgggaatcgccgccgcttccgccctccatcgatccctcctcgattcgaacgactcgactcagctagggtttgtttgccgctccaaaggggatcggttcggttgccttttatttctttttttcgcttatctagcctaatcaaatacggtttcggttttattcaaacattgattctcattgaaaacacgcccgtttgtgctttttatcttttttttttgtttttgtttttcaaaaacataaatttgtattatgaaaatgctgccaacgtgttcatcaagagagattgtgaaatcaatgtgttatctatcatgttaaaattgcccactactaccacttgtaagtgtagtagaaagactttttttttaattggatccatgccactgcaactttgtgaaattaaaaaaatgccaatattattcgtcatattggctatatgccactggaaatttctaaaattggaactatgccactcccctccctttttccgtctcctctctcacgccgtctccgttcccatcccatatgtcagtttcatctccccatcttttcctccatccggcgcgactgcaaagaggacagtggcggcggctcccgagcactcctgccgtggatggcatcgaggacggcagaggcggcagctcccgagacctcccgtcgcggatcgaggacagcggcggcggctcccgagccctaccgcacggatggcatcgaggatggcgacggtgacagctccagagacctcccgccgcagatggcgtcgaggatggcggtggcggtagctcctgagacctcccatcatggatcgaggacagaggcggcgacggcggctctcgagccctcccgtcgtagatggcgtcgagtacggcggcggcggctcccgagccctccaatgtggatgactcccgagccctcccgtgtggatggtgtcgaggacggcggtagcgacagctccatagacctctcactgcagctggcgttgaggacggtggcggtggctcccgagccctccggtggtagtcgcgggtaaggtacgttagcctcactcggcgccgtcgacccgctccctcctctccctcctctgcccaccatcttcttctccgagctcgccgctactactcgggctactgggtggcgctccgttgcatcgccgtcgtcgccatcgttatcaccggcactgatggacaagagtgcagggcggcctccgcctcctcgcggaagggggatgaggacgggaacggagacggcgtgagagaggagacggaaaaagggatgggagtggcatggtttcaattttagaaattttcagtggtatggtttcaattttagaaatttccagtggcacatagccaatatgacaaatagtagtagcattttttaaaaattttgcaaagttgcagtggcatggatccaattaatcttttttttttgtctatgtcaggcaggcacatatgttgttgctagttggaagtctgcagtaatgtaaaattttaacttgtgcggagactgagaagcggcctatctagacatttcagaaacagagcagccagagagtagaaacagagatactcttatatttcatttatgaattgtttgatttatttgaaagcttagtggtagtagtattagtaagtggtagacattattcgtctatgttgtttttgaagcttattatataggcaaatattattatttgcaacagaactgaatcactctatcagaatatcaattacaaataccacaatgccttccttgctgatctactctgtgtgtgtgtgtttctgaatatgttatgtatatcctggacaatgcatagccgcgtgctggcattagcttttcagattagcagaaagtgccgaccaatgcttaactgaaggtcatatcaccaaagtgcatggattgcaaagtgtaaagttaacacactttagaacaaaatcatgactaggtaactcagcaactgtttctggagcttcaaaagtggcaattatacagatcgtggaaaccattttttactggacatacataaaatgattttttttttgaaacaacataaaatgaattggtgccgagtgcgggacaactttttgtgtgatccgaaacagaagagagtaaaatgcaaaggaaaaagtacaccgaaggtccctcaacttgtaatcgagttacaaaatcgtcccccaaccacaaaactagatatatgacatccctcatcttacaaaaccgttcattttaagtccctcggtggttttgaccccggttttgtccgatgtggcagttgagtcagcatgagacccacgtaggccccacatgtcagattgtccacgtcatcactttgtctttcccctcttctctcccttcctcctttctctcactttttcttctcagtccgagcaagccagccggcggggcgagggtgccaggcaggagaggaagatgtcgggaggccggcgaacggcggcggccgcgacgatgtggaagcaggagggtctccccccacgccgccaccaccgccaccgccgacggcgcaggcgccagatctgcggtgacgtcctcgcgctccccgtcagcgccatccacgtccacctcgtctcccgcgcccgccctcccatgccgccggcctccgtcgcctttccacgtgccaccatggatgacgaccatggatgacgacgacggcgacttccctctccccgtcggcgccatccgcctccgcctcgtccacccgcgcttgccctcccacgccgctggcctccatcgtctctccacttgcgggcatggatgacgacggcggcgacctctctctctctgttggcgccatctgcctccgcctcgtcaacccgcgcttgccctcccacgctgccagcctccatcgtctctccacgtgcggctatggatgacaacggcggcatccttcctctccctgtcggcgccatccacctccgcctcgtcctcctgtgcttgccctcccacgccgccggagcaggagggcttccctcacgccgccgccgccgaggcgcaggcgccagatctgcagcgggcagcgtccagcaggggagcaactgcacgacatcctcgcgctggtcgggacccggcaggccatgcggacaagcatcctgtcgcgtgcgggggcgagggtgtggcggtggtgggctgcgatagcttcgaggatttcgccgacggttccacctcgcctcgcaggcctcctccccaccagccggccagcctccgcagagctcgcgtgcgctaacctcgtcgaccagggagacttcgatggggcacgccgcgtcgtggatgccgtgctctctgccgctggccctcggggcgaggttagtgaccgcctcgcgcatcactttgcccgcgtgctcctcgctctatgcagtgaagacaagggaggccatagcagtgatgaaggcacgtcagagacaagggaggccattgcggcgctcgaccgcggcgtgctcctctgttgcaccggcgaccgtgaccgtcgcaccatcctgccgcaccctggctgctctccgccggccatcgacgtggagaggagaggagagaggaagtgagttgagagggagggtaagaagtggctgacatggactgtttgacatgtggggcccacgtgggtcctacgttgactcagccgccacgtcggacaaaaccggggtaaaaaccaccgagggacctaaaatgaacggttttgtaagattacaagttgagggaccttcggtgtactttttccaaatgcaaataatcatgattgggccacaatgctctgctatgggctaactcccgttccggcctacgaagactagggtccagagttgtttgcgagctgaaacaaatgggcccatttctcattgatggaaggaaacatttccctcacaagaagcaattaaacattcagcatttcatggacatttgaaggtacccttaattctgcttccacaagtcctagttctttattgatagaatatgacatctcggaaaaagttctcaaaagtttatagagagaaaaatctttaatgtataaaacaataagatgataaaccctgtttggttgtttaattagtagcctgcatatctccagaagcacgcaaacagaaaaaagaaagtgaagatgttcctctgaaacaaagcaagaagcaaaaggtgaagaaatcaatctttccgaatgtgcctgctgctgcgcctgtaccatttcgtcaaaacgcaccactgcttcacatactcttccaatcaactcaaacagcctagtcaatacatgcagatcaaaaaatctgttgaatttaccctctgccggtagttttcctttgataaaatgttcagattaatctgctagattgacctactttacatttgtatatatgctagtccatgttgcacatatcaacatgataacccttctttacactgtgatgtggcaggtatctatgcacaccatattaatcactagtaccaaacttgggttagctaaacttgggtgtctttctgtacacacggccacacggggattcagaatccacggtaatgtgccagcatcaacatggtagcaactagcaaactcaccagtcataccaaatacaaatatgggaatggtctagcagatactagatagacagctccacaactctactccagatctaacacctgaagttaaattaggagttagagctctactaaacaggccctaatgattagaataaaaattcagcaaaaaaaattgatgtactgaaatatagaagttgttttctctgagaaatataaacgcatgttcggagaacaaatcaaccactagacatgttttccataccacgatattctactttagaggcagcacaatatttagcccgttgatcacttaccgggtcagcttttgcctggcacactacaagaaataaatgacgttccatcgtactccctctgtcccataaaaaaacgaatctagtactggatgtgacatagtgacatatctctatatccagattcgtagtactaatatatgtcacatccagtactagattcgtttttttgggacagaaggaatatatgttaaatcttaatattacactgcaatcaaggttttcaaattaaaaagtatggaccataaccatgaaacacagtttctagcccaacaggatagaaacgtctgatgtaagctcaaagtttcattgctttttctgagacctgcacaaagattaaagcaacaatgagaatgtagggggcactatgaccaaaagacattctagaagcttattatagaaaaaatatactccctccgtttcgatatatatgacgtttccgacggcatggacaaaattaaggatagagcgattttactattttgcccttcatcccttttggacgacagggaggagcacagtgcgcgcggcgcggccgtctccctccacgccggctcccttgccatctcccccgcgctgcctcgacgccggttcgctcgtcgtctcccaaacgccgctgctcgcgaccacaggaggaggaacccgctgcacaacgctcttcccggacgccgcgtcgccctttcttctccgaccttcccggtgaaagcggcgttggagcctgagatcaagcggtccttctcgattcagtcctcctcctttctcgtctccaagcagcatgtcctccccggacctcggctcctcactcgtcaccctctctgtaagtgagctcctcgatctcgccttctccaacttccagcttgtttaatttcttttttctcatttcctccaattttcattgcctaattgcctggttttgcccaatttacaatttaagcagaaggagaggagaagccctggttctggttgatctccagccgaacggcaataacgacgatgtcatctgcagatgcagtacgttctgcttggtttcagccgagtggcaagaacaacagtggcggcagcagcaagcccgacgtccggctccctgtgcgccatgctgcccgactcttgcttgccccacaggccacagctcggggtggccggttgccgccaaattggggtgcggcggcggcgcacgggaggcatgaacggcagcggcgcgtgggaggagacagtggcgagcgagtccggtcgcgatgaggacgaggcagcgccgtggcgatgttgagatggagggcaacgatggaaattaacaaacgtgactaggacggatgaactggtagcgtcaaacaaaaaaacgattctgatttgcactgtagcgtcaaataaaaagaaacggagggagtatgtgtttcaacaagcataccaccaaagattttctgtactcaagtgcgcttaaacaccttccgggacattgaagcaacagtataaagcatccttctggattcacttgacatcaaaccacgatctcccattgatttgattgtgttacacgggtggtcaatactcttggtccccttcctgctcgcttcagcacttagcaagtccttcctgcttggttgacaggatggaactatcttcagctgcaaccgacgagacaacaccgatttccagtatgggaagaacatatttctcacttcctttatggctaatcctttaggtggttgctttcccaggatctgtttacatgagaaaattagcatctgaacgtataaacaaaattataaaaacactcagatttaagtagtgagtattcattctgttgttaacaaggcaacagttgatggttatgcattatgttatcaaatatttccatatcttgttaattgattgggtcagtaggagcaaatttggaggaacaatcttgttttcatactaaattcatcgcatgaattagactcaacaaataaatttaattacgtatctcattaccattttactaacttcgcctgtatcagaagatgacttgtccgcttcaatagtttccccatagcccactgtaatcagcaatgaaattggtcatgagacagcttatgaaatggaaagcatagttccgaggttggtgtacagagtctgattgcccccccttttgcactggatgcaagccataagctttctgcaatgttccaaagttgtgcattcaccacagcaaatgactttgtaatgggtggacacataataaagtttcacagctattttcctttctagtttattttaataggatcaaccaaaatgaaacacacctctttgtgaatctgacttgccaatcggcatccccccatcatgttggtagcttcaaaacacaaataaatcaagacataaattatatgcacaaaaacatgaactgaatatatatatatatatatatatatatatatatatatatatatatataaagccaatagatgtcaaaccattcaaattttccagtgtcaatgcttttcccagaatgagcaatgccattgctttttagaattgatgaaacatgttcaacaatgtcgtcatggcgcacctacatttcaccaagaaaattgttaaaacatatcattacaaaatgttcaagggcattattccaaaaagagaattcagatatctacacttgcaggtggtggtggttgcaagacacataacagccttcaataacatcatctctcaagacaaatagtacagcacaactgaaagtcaacaatggtgttttaagcactacatttaaacaaatactaagtggtcaatagttgaatcagtaagtcattgatttggcatgctgccgacctgccatagtcaaacaactctactattacaagcttggatttatttgccatccttgctcaccgcaaacaagacaacaccaaagagcccactagggccttgtcaataacatctcttggctagatgaaaaaacaaccaaattgcccaacttatactttttgtctggaacaaatggcacattacttgacgacactatagtataacaccagaagaaaattagaacagatcttacacagtagaacagtggtatggcagcactatgccggcacacgtgtaaagcagaagaatattggcaggtgagagttgttttcggtatcaatgcacctgctacaaaccagatcccttcttgcattctgctactgagactgaagagtgttagaataattgggctaggcccaatttataatattaaatctcaaaggtccataataaatgttgaggataataataccacctcagatttaagcgagaaatatctcaacctaaatagggagttattagaggctccctgttgaccagttgaggtgggggtcggaatgccacacgcgcgcgcgcgccgggccgggccgggccgtgggcgtgggctaagctggcggcggcgggcgtgcatcacgtcgcgtcgcgtcgctatccttttgcagccactaacccacgttcccacgattccctccgcaactttcccg

SEQ ID NO: 52605 - DNA, 22460 bp, Oryza sativa
ctgtgtgcgctatgttcttgttcctgttctacatgatgcctctagcatgttatcgcgttactggtatgttcctggtttctgacattcatgatgcgcatagtatgctactggttatgttaagatcaccctacactgcttatgccatgatcattgtttcaatttcttggattaaaatatgccgaataatgactatatttccaacaatccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgacgccggcagtgagctgtatgtcatggagcagttctatgactacaagatggtcgatgaccgttctgtagtagaacaagctcatgagattcagatgctggctaaggaacttgagaacaacaactgtgagttgccggacaagtttgtggcgggtggcattattgccaaactaccaccttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggttgcaaccaattttaagaagaaaggcaagggaaaggcaaagggagactgctttgtgtgtggcaagtctgggcattgggccaaggactgtcctgagcgcaaagacaggaagtctgccaacatgatcattagcgagggcggaggaacatcggggtacggtaaaatattacctacagttctctctatttttcattcacctgattggtgggtggatactggtgctaatattcatgtatgtgctgacatttctctgttttcttcttatcaggtcgggagaggttcctccttgttgatgggaaacgggtcacttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgttggtaaaggttatgacagcggaggcttgttccgtttttctttgaatgacatgtgtaataatcataatgctgtgaaccatattagcaagaatgatgagtctaatgtgtggcattcgcgactctgtcatgtgaatttcggttgtatgacgcgcttagctaacatgagtttaattccaaaattcactttggtcaaaggttccaagtgccatacttgtgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggtctgatagaggtggggagtatttttctaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgaggcagttttgactgcatgtcatgtcttgaataaaattccaatgaagcataaggaagtaacaccattcgaggaatgggaaaggaagaaattaaatctctcatacctacgaacatggtgctgtatggccaaggtaaatgtacctatagtcaaaaagcggaaacttggaccaaaaactgttgattgtgtgtttcttggttatgctatccacagtgtgggttatagattttaaatagtaaactctggagtacccgacatgcatgctggtacaatttttgagtccagagatgctacattctttgagaatgaatttcctatgaaatatacacctagcacttctagtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcgtggatgacaccccaagaaccatagaagaggcatattcatctcctgacgctgactactggaaggaagcagtacgcagtgaaatggactcgattatgtctaatggtacttgggaagtcgttgagcgtccatatgggtgcaagcccgtaggatgcaaatgggttttcaagaaaaagcttaggcctgatggtacaatcgaaaagtacaaggcaaggcttgtggccaagggttatacccaaaaggaaagcgaggatttcttcgacacatattcaccagttgctcgcttgactacgattcgagtactacttgctctggcagcctctcatggtcttctcgtccatcagatggacgttaagacagctttcctaaacggagagctggaggaggagatctatatggattaaccagacgggtatgtactagaaggtcaggagggaatggtgtgtaaactattgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttgtgcttgtatgtcgatgacatactgatctttgggaccagccttaatgtgattgaggaggtcaaagactatctgtccaagagttttgaaatgaaggatttgggagaggctgatgttattcttaacatcaaactacaaagaggagatgagggtgggattacacttgtgcaatcccactatgtggacaaggttttgagtcgctttggatatagtgactgcaagccagctcctactccttatgatcccagtatgctattaaggaaaaaccgaagaatagcaagggatcaactaagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggcactatgagctatggaattcactataccgggtatccaaaagtactagaagggtatagtgactcaaactagatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcaaaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattgtgatcggagatcccgtgaatttgaatggtgaaacaaactattgtgtgactgagagaagagacccttgaaaagggctcattttcatgatgtgcttctcttctttcctgcatggtaggatggcttatgtcttaatgtgatccgagtggcttttccaagcagagatgttgacctgcagaacatctcagaaggaacacacctatatgagttcgactgctagtcacagtctatgaggtttgggcaatctctagatactcatgaaaggcctggagtttgacttatatgctccaaacagaggggatgcgaacggcagcccagtaccagtcaaggttctgagtgaaacctgatcacacaaaacttacaattcaaggcatagtccattgttcagttgtggtctgatgtagctcattttctaggtggaagttcaacttaacagtctccaccaaaaccctggtatatcaaacaggcacaacattgagaacatttcttatgagccttgaaatttggtggggattgttagaataattgggctaggcccaatttataatattaaatctcaaaggcccataataaatgttgaggataataataccacctcaggatttaagcgagaaatatctcaacctaaatagggagttattagaggctccctgttgaccagttgaggtgggggtcggaatgccacacgcgcgcgcgcgcgcgccgggccggggcgtgggcgagggcgaggcgtggctggctggctggcggcgtgcgtcacgtcacgtcgctatccttttgcagccactaacccacgttcccacgattccctccgcaacagcgcgtccacgttctttctcctgatagataaggaggccgcgagtccgatccgatttcttagcttctttcccggtgttagtttctccctctccgcgcctgagttgctctcgcttccccgcttctgatctcttgcgcgcacgagagattggaagaagcagtgcctccgaaaccacacctttgcttgagatctgcaccgggtaggcgggtgatcaggtttttggggagtgcctcctgcacgactgctcatcgccatgtctggagttgctgccgccgctaccggcggaggtggtgcgccgccgccgacaggagctggtgcgccgccgccgacaggagctggatccggagctggtgcgccaggaggaggtgccgtgaacgactacaacaacggaggcaattctgcctcaccatccagcggagggccattctcggggtataatcttctcctcctgctactgctgttagcgctattcctgttcccattgttagcgctatactgtgtgcgctatgttcttgttcctgttctacatgatgcctctagcatgttatcgcgttactggtatgttcctgtttctgacattcatgatgcgcatagtatgctactggttatgttaagatcaccctacactgcttatgccatgatcattgtttcaatttcttggattaaaatatgccgaataatgactatatttccaacaaagaggaccctcttccctcctcttaaatcttctttagaaaggatgaatgaatggtacatgggctcaataattggtaagcacgtgtgtaatacaaaagttggcagcatttgtatagatttagatgtaaggcccttcacagtgcaccgacctggcgcgtgatctcgttgctccagctcggattcaggtcgacgtggcgacgaggcccgcaccctagctcagccgcttggcccctatctgggatgcacgttttctcgccgcaacgagggcacgcggcgaaggaaatctgcgctgttggagtcgttgcttgattcgcctgctcctcgccctcctcgacgaccccacctcgctcctcgcgatcctcgacaaccccaccgcctgctcgtacgacggaggcggaggcggcaggggcttgggtggagacggatggggccgctccaagctcgacggctggcctctagctacaaccttgctcagcgccgccgctcacgagcccccgtgttgctgagcttgccgctccatcgttggggaggctcaattcgccggcgagggagaaccacctccgcggcggcggcggcggcttcatctttggcgaccaccgtgggggattcgaatctctctctctctctctctctctctctctctctctctctctgagcacctatcgaatccagcgagagtttatctcgtgaatccggtggagggaggaggggaggaggccggtcgagggagtaggggaggacgccggtggagggaggaggagaggacgccggcggaggaaggaggggagagccgaggaggaggagagacggcgtcgggcgtgacgagggaggaggagaaaagcggcgggcggggatgagtctggatgaaggctgattttttggggcgtgaggataagacacggcgcactagtattgtggggtaccgagcactgtgaggtgcgtgacctagagataaaatttgggccaaaatcctcgctggaatgggatggaggcacgcatgccgtgccttggactactactgccctaaggtgtcaccttgacttatgcgttgaactcataggcatctgaaaggtggtgggccaccatgcttcgctttaagaacactgcatctactcccctgtgttttcatatattttcgactcatgcattagacttgaaactagcagcatactaccgctatgctgggcctgctattcaacttcttggatttacataaaaatgggggctaaaagatgccatttaccgcatgggtccagttctttttaactcctttttataatatggatgtgactagttgatacaatgcagcaggagctcctccaactgtttacatatcaccaaaaagaaaaagaaaaacgatcaacacccaccacagctttctaaaaaaaagcgaatattagggaatgacctaatataaaataattagaatgggtgaggcttcgaagctaagccagctagcccaccacagctttctaaaacgagggtaattcgaggtttcactattagatcaaaatcatggaagtaagcatcatacaaatttgaagaaaacgagtcactattagatcaaaatcatgggaagtaagcatcacacaaatttaaagagaatgaaactggaaaatcaaaacacacaggggtagcagaaagcaatggtaacaatgaggaaatttcagcaattacctgtgaatgagtttgaatgtatccgtcaagagcttcaccagctttgtgaacaatgcacactagtacaagtgctgtaagaagggcttcctttttgtctttcaatctctttagtgccctgccattctttccctcttgaaccatatttaagccctcaagatgtatggtgctaagagcatcaccaatgcggcttttaacaatatcaaacccgttcagagaggctttgccactgctcttgttaaggcgaccacggagctgcttttcagcagcgagcagcaaaattgctgcctggacatgcttctcttcatgctgaatgtaattccatacctcgtcgacaatgttgtccgtctgtttggcaattaatctagtcgtgtccaagaacattttctgcatgtcagtagtacgtatttgaaatgggctaaatgctctggcagtggcagtaatataatagagggatatatataggaattgaataaagaagaaaaaccatctcaggaagacaaaggaggaagatgaggttgatgatatggtccccatgagcccaatgatcctcaatgtacttgtgcatgctggcattctccacagcaacatggagagggaggaggccctcaatgacgttgtcgcccttggtgcggatgttggcggacgcgccgcagcggaagaggagcttgaccatgtcgacgctgaagttctcggcggccatgtgcaggggggcgaagccgtagcggtggcgggtgttggggtcagcgcggcggcggcaacgcaagagaggagaggtgccctggagtgcgaccctggcacaacgcagagcgttctgggaggccatgttggtgaggatatcagggtaaagaaactctcccagtcccatgaaacctgaccaacaattatagacttgatagaattgcttcacgctatccttctgaattgctggacgaagtttcggcaatacaacacgaacgtacgtacttaacttctcctacaatggcaataatatttatgatagattgatccatcgatcgattgcatacaataaaataaatatatatatgctggtgaggtcaaaattaattaattaattagtttgcatccatggatgatggatcgaagaaaatacgtacctcgaacttttcctcgaaatatgctttatatttaggattttttggcatgataccatggataggatcacagttgatgagatcctcaagcttctgcttcagtgtccatgatccgtaatcttcggcttggctgccactgggggcgactgctggaggacagcttccatcttccatggtcatcgtacgttgaactagctagctaggtggctgcggcgggcggaaaccctagattgatacccgggccggcggccggcgctgccggagaagtactgcagagcaggctcaggcggcggcagcgtcgatctattctcgcgtttctttctcgaacgtggcctgggcctcgtgggctagcaatgccgcttgggccaaatgacttatttggctcaattgttttttttattattattattgaattctactgactgtttagcttgttctagccttctaggaccatcaaaacatattagtcgtattgaattaaaaaaaacatattagtcgtatttaaaacaaaatttaaccattttaagatttcttttcattcttgtacaaagtacatgttcgagacttcgagtttgtttttccctgataaaagtgtcactataaattatccaatttagaattttttttggtagaaagttgtatattctggtagaacttttaacaattgttggaagtttctaatatatatttttattttcgtataaagtttatggttagaatcttccgcatatgtgaagagaaattttacagtccttgagagatacaaataagtaataatatttttagtgcaaattctgtactggaggttctgagaagtatcaaattttacattagaaaatgtaataccttccaatacatttttaagcacgtaaaatcactcttgtgtgaaagtttttcgagagaacatgcagactctgccgttcactattatattagaagtaaatgtcaaacaaggtttagtcagtcacggtgttacataaaggaatacagctagagcagtcgccgcgttcatgtagaaaattcatggttagaatttttataagcacctttatcaattcttcctccaccgctgaaaactcaaccgggaaattgaaacctgaaagtattccttttctgatgacgagaatttaactttgtgaaacgcgaataacattcagcaattcagaacacttctcctaaaattaattttccagaacaagtatcacagatacacacaacgcattgttcgatcagcattcaacgtctccctcataagaagcaaacattcagcaattcagtatggaaatttgaaagtacccttaattttgcttccagaagtccatgttctttattgatagaatatgacagctggggaaactgtttataaaggagataaaaagcctacaaaaggataaaatactatgctctgtttggttgtttaattagtagcctgaatatctccagaagcacgcaaacagaaaaagaaagtgaagatgttcctctgaacaaagcaagaagctaaaggtacagcaatcaagctttctgaaatgtgcctgctgcccttattcacggcaggccaaaaaactctgagcctgtaccatttagtccaaactccaaacgcacatttcgtcagttcaattaaacaacttagtcaatacatatagtcatgcagatcaatcaatctgttgcatttttctctctgttgtttcctttgataaaatgtacaggccgcgaaaaatgtagagactaatctgctactgacctagtactttacagttgtatgctactacatcttgaacatatcaacatggtatcccttcttttacattgtgatgtggcaggtgggtatatgcacaccatattaatcactagtaccaaacaatttgacattctagcttaacacctgtgttaggtagctgcatatgtcaatactggaatcgtgtttgctcaagagaaaagatatgtttacataaaacaacctcacctgaatacccttcggttcagttggttacctgttccatagctgttgtactgacttggagtcgatcacttttacattagacaggaattttttcgaagaaagaatgttggatgttgacagactctacatattctccttgttagttaccgtcgttctcaccataaccctccttaacacccaccacctactactaatgctacaactattctagcatttattcttcatagctccatcttactcttcgctactcaagtaacttatctacaaggattcatttggaaatgcaaagtaatttcttgggaatgacaactgtgaagagctttgtagtgacaatgcagttattttgtagtgtcaatggtactgcatcacttctatggaagttttaggaaaatgattcctgttaacttccagcttaagggccatgatgtctagctatttgttaaaggacaatgatgacatttactaccatatacaactccatgaaccaatcctagcattccaattcaagtttggttgatgtatgtcatgaaaacttgacatctgaaattaattatcattgtacctaactttttgcaacaaagatgacaatctgttatctgaatgttttttaatgcttcttttgctgtaacatcttccttcaaaaacgtttgttgcaccctttttatgaaaatataatcatctaaaagtttaataaggtttagaatattagtgacggtcagtactcatgcttgttggttgcataactgcacactcctttggctccccaccactgccttcgtgccaattcaatcaaccattcataatcattaatcttttttgtctgagatttctctcatatgttgagcgcagccaattgttcagattcataatacacctggtcagtcaagtaacgtacagcagagtgcaatttagagaacattgtggggcattcagtgcatatgcaccaacatgtgaagcatcttttcaattttgaaaggacaagtagtggagcaccagggttgttaaatgcctccaaattggtatcaagctatatatcagcctcagcctaaaatattttgccaaccaaggaaaccatcctgatcctgctcatgccaatagcatgttccttcattttgaagattgttcctagtgttaacattttgactttagattaccttgaacagaagaaaccacataaagctaaaggggttggacgtttgcctactaacagtccttgcaattgaatatgtggtagttagcagcttagcacctgcatgcttcttccaatacttttgccaatcagagcttgtggaaatgaatcatttgatggggcaaggatttggcccattatgtagatccgaatttcaactaatagtagctccttttccctttttatgttgaagagaaaattcatttgcctgaaatatacattatttacttattactcacaagagtatctgcatcacgagaacttctttaacagggaaattaatatataggtacatgtagtccttcaaacaaaaattcacaattctaaaaacttttgatctctacctccataaccaagttacctttgttagtgtacatcacatcttagctaggttccttggactctagcaaatggaatggtgcgatcaaacagcagtaaacaccatgtttaatccattatctaaaaaaaatgcaaatgtctagagcacaagcccaacaactcctaccagagcaaagaccacgcagtgtaactgctaactacgagtagtaatcacagttttagttatgcatatgctagacaatgatggaaaggaagggagtgattcatggattgattctattgtcaaaaagaagttgttaatcaagcacttaacctttgttgacatgggggccatagagacttggaaaagtctcatcctgttaacaacattttgtttcttggacttgaaaaaaatgttgtcttttgttctaaacaaaatgaggcaaaaactaaagttacttttttggccagtggagacttgtgggactggtggctccactggaaatgatacgttaattcattcctcatgattccctgaaacgggagaaaagctcagtataatttgaggtcagaatttcttgatatagagggctcaccatataattatagaaatggccggtcatgcacatgcaagatgcaacatgcatctctgtgatatttatgcatgtcataaaaatactgatcgaaagactatagctttaagcaccgtttttaagaactgaacttaagaaatggacgtgttaaatacttagtttacatttgttttttctcttgctgaaagtgaaggaagggttttgataggatgaaaaaaaatcttaagatcattatagatagtactaggtgaagttgatgcgtgttggttcactgattctttagtacttgtaggacagaagataaaatcaagaacttgcatggggttagcatgataccacattgactaaaataacacttgcagtgcaaatcaaggtcgcaggaatgactctacgttttaacactgcaatccatcatgcaacacagtaggatcatatctcgtttgtgtagttttaggacaaaatcttgaaatgtcacattcgttagtcttggagtgctcttatgattgtgtcatgttgtcctgggggaaaacataacttgtgatggacgcatcatatatcacacgagttacctgaagcgcaaatattccatcgcatgatcggtttgtaatcaaaactgtagcaaaattcactaagtactaatcttgcagaatgaattaaaatggaaggagttacattaactatgaattcattggcaagtacattgaacaattaattagccaatgcgcatggaccatggattgattgaggaggcagcttgaaatgaagaatgcaaatgcaagtgtgaaattaatgatggcatgtatatatgtagattaacgagagaatcaagtgctaaagacctacctattctttccaacaagaaagcatgcaaccggccggagtctactacctgtagcccctttcttttcatatatatactctgatctcatggatgtggtcgatcggccaggctgctcctatataaagggcgagctgtattgcaacagatataagctgcattgctgcacgcaatcaattcagtctcaggtcttgtaagcttgcatatagctatccagatatgtttggttgctgacaataagcatcttgattgatcgaccgatcgagttgcagtatatagttagtttcagactatcaagcagcatgccaagcagagggtgttcatgctggctcttaagcctggcactgctctgctccctggctgctgccaaggagcaataccatgagtttgtggtcagtacatatatacatgatcatttatatgcagttacttagctcgtctgaatctcatcatatatatctgcagcagctagcttaatttggttgccatttcatcatctgtgctgcagatcagggagacaacagtgaaaaggctgtgcaagagccacaacataatgacggtgaacggtcagttcccggggccgacgctggagataaacgaaggggactcgctgatcatcaacctgataaaccgtgggaggtacaacatgacgctgcactggcacggggtgcggcagatgaggacggggtggtcggacgggccggagtacgtgacgcagtgcccggtgaggcccgggcagagctaccggtatcgcttcacggtggcggcgcaggagggcaccctctggtggcacgcccactcctcctggctccgcgccaccgtctatggcgccctcctcatccgcccccgcgatggcaccagctaccccttcgacgtccagcccaccagagagctcgcccccatcctgctcggtacgtacgtttcttctgctacatgctttttaattattatctgtctcactattttggccgccaatttgtttagttaatttgacttctggtatttttctttttgcaatcgcatagcagatgcatacacgccgctacacgcacacacatgcttctatgttcttaacctcactgaaatcctaccggtttattctaacacattttgatcatgaatttattatggatgatatcgatctatatgtttatacatttgcaatgtagtacttaagtaatatggtttatttgttaatacctatgattttatctttaaagtataaatgttcacacacaaaaatgccaactcaaaattgcaaagtattatgaaatggagagagcatttttttttcaccactattgcctagctggatagtgtacacacattaccaaacctacaaaaaattgtgcaaccatcatcactgaaatttcacgcagccaatcacttacaggtcaaaaggtatgtcctggccgaaatgcaaaagatttataaagccaaagaaaaagaagatgcatttttatgcttcctctatatttttttttcatgatcaggaatagcatgccgcgagctaatgatagttatagcacattaatttattggaattaaattgatctcagagccacgattggtcggtcggtaccattgctatagtgtggggtcaagctgtcataatttagctgcttttcacgcatgttaacggctattaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttatcattgttatcaaccacatcttcctttcatcagaaaaaaaaaaaacagctttctagcccttaggttggttggtaccagcttactacaagctgcttagctcaaagtcaaaacacatgcatgagtcagggcagggttaccaaacaagtaagcatcagtgtatcatagctttccaaagagccatacatgatctatctcaagaaaaagctagctaaccaatcatgtttatgtatcaaaaacttcatcattgtgcatgtttctcagatccttctttactcatcaatctgaattctggcgcaaaacttaaacatgcacatgctgcctatgcaaaattgatgctgaaagcatgctcaatgctcaatattcctcagagctagccagctacttttacaaacatttttatactcctacatgtacctgaaccttaagaactaagatatcatctttctcctacaaagtacatttgaggtttgtctcaaagttttgctccctaataattaagaaaatattctcaatgaatgtgcaatgcaaggttgcaatacatactttttatttgttaacaaaagaaggttgcattaaaagttatcaatttgtagagagatgcatacactagtctgaacatgtcaaaagtgaagaaaatgttcttaggagcatatgtcccattgtttgaaaaggttcgtcctcagtcctcaaaagtagaactttcggggaaaccacataatcaaaaattgcacaattcagccatttattcagaatgtcgttgtgagcttgtagccgacatggctcaatgtatagggttagctattcccttttgtatttttagtggttgaataagaggaattcgtatttttaagcaaaagaacatgttggtagttacaggggtcacttgagcacaagaaaaagacaaagattagttgaaggttgaatggttaatagttgatacactacaagtctgataagcaaaatggtttggtgctactgtactgctaattaaggccatggatttccatgttgcaaatccatgtttactctggcagtttggtacaattaacagaaggaatgtcactataccagcaggctcattacatgtttgattctcaataaattaaaatcagtaaaatcatattctctccggttaaaaatacggtatttttttcgcaaacgtgtaaaataattgcacgtcaatatattaaaagaaaaaagtttttgttatataacacaattagccataccagtttatatcaagagaagagagaaaaagaaaaacaaaagctgaagtggaaaaaacttctacagcggctaaacgcaactctgaacgttttaaaatacagtcaaactgatttatactaaaataagtttataaaatataattagtttacgatattataattttcaatgcaaatccacgtatatttttttaagaaaatctaagcatttttttaaaaaaaattaatgtttgaaatttaaaattttttatcaaatctgaggagttgagccctgaaacgtgtaaaattggttacaggggagtggtgggacatgaaccccgtcgacgtggtgcgcgccgccacgcgcaccggcgctgctcccaacatctccgacgccctcaccgtcaacgcccagcccggcgacctctacagctgctcctcccacgacacggccgtcttccccgtcacctccggcgagaccaacctcctccgcttcatcaacgccgcgctcaacacggagctcttcgtctccctcgccggtcacaacatgaccgtcgtcgccgccgacgcctcctacaccaaaccgtacaccacctccctcctcctcctcgcccccggccagaccaccgacgtcctcgtcaccttcgaccaacctcccggccgctactacctcgccgcccgcgcctacgccagcgcccagggcgtccccttcgacaacaccaccaccaccgccatcttcgactacggcgccgccaacaacgcctccagcgccgccatcgccatgcctaccctcccggcgtacaacgacaccaccgccgccaccgccttcacgacgaacctgcgcggcctccgcaaggcggagctcccgtcgcgcgtggacgagagcctcttcttcaccgtcggcgtcggcctcttcaactgcaccaacgccacggcgcagcagtgcggcgggcccaacgggacgcggttcgcggcgagcatcaacaacgtctccttcgtgctcccctcctccacctccatcctccaggcgcaccaccacggcgcgcccggcggcgtgttcaccgccgacttcccggccaacccgccggtgcagttcgactacacggcgcagaacgtgagccgcgcgctgtggcagccggtggcgggcaccaaggtgtacaagctcaagtacggctccgccgtgcaggtggtgctccagggcaccaacatcttcgccggcgagaaccaccccatccacctccacggctacgacttctacatcctcgccgaggggttgggcaacttcgacgccggcgccgacacgggcaagttcaacgtggaggacccgccgatgaggaacacggtgggcgtgccggtgaacgggtgggcggtgatacggttcgtggcggacaacccgggggtgtggctgatgcactgccatctcgacgtgcacatcacctggggcctcgccatggccttcctcgtcgacgacggcgtcggcgagctgcagtcgctggaggcgcctccacccgacctgccgctctgctagtgcctcgaccaacacatcaaattaatcacctcttaatctcttatgttattgttagcagctgattaatcatttggagatcagcattactcaattaattacatgtatcatttttcacatttgattcattaagaagagaacagcattcacttcaacgcccaattgcatgtataagtataacaacaatacagattgaagtttgttgcatgcatgtatcaagaaaagtccttacctcggagagagagaaagatattcacctgaaagattattaatgggttaattatctcctggaaaagagctgctaaggacaaaactacaagtgagcttgataaatgacagattcacttcatcggtatgtcatacacaacactactctgttgcatgcgaattgtgaattgcatctcttatgctattagcaactgattaatcatttatttggaggcattgaattgcatgtaccatcatttttcatatttgttcatgatcaagaaacggcattctcattaacacagattgctgaggttgcatgtatcaatagaaatccacacctgccaaattcacctcagagaatggtctatctcctgcctgaagagctgataaatacagcactgaactcgaccactgagagattcagttcgttcatttgtcgcacacaacacaaactgaaagtcaatttttctttcatttgcctctttatactcttagagtatacagaaaatatgaaaaagttatttcattggtttcttcatgcactttctcacaccagcaaccataccagccactagcttctaaataatagcttttatgctctcatgtgcatccttcaactatctatcacacacaaactactgtacatgtatcacacaccagcactgtacatgtttcaagaaatacaaatatgtgtaactgcaatggccgctcccccagcctcccagggaacaaaaaaattgatcaagtcaagagaaataataaaagagaaacaaaacaattgaccaattcattatgtattgagagcatcgcaggtaactccataacttccactctagtatgcttttcacttttcacttggggggaaatgatcgattcttataccgaggtggcctcatctcattttcaggggcatcactcttgccgctgctgctcttgcctcttaatggctcggtctctgaattattagagatgtggttctgtcgttgtcttctttcctgcaaatcaattgacatgtgtttaattcatgaggcaatgacagaataaagccatgatttccttatggtagacattaataccatgttatgcaatgctctttatgtccgataatgctgataagacaggtatataggatacaatcaaataggattgctcatgttgccatctgtcactaattttactgtgagatgaacattggatgtacttataacacaatatagcacgaatatgcatgatttccaggtaaatcactaatcgtactctttaggtaaaggaagagtttagagctacagcctttgcatctgatatgcacacagctatatgatatatatgtatgcacatttatttttgaaacgaatcaaacctcttgaggaatgggttcattagagtccaacatccggaccacctggtccatccttggtctcttctcagcattcaaatcgatgcacctcagagctgtcaaaagggcacgtttgagctcctttgtcgatggtcttctctccaggtttggatcaacaacttcttcagatcgtctgtgggcaaccatcattttaagccagtcaactaggtttacctacaaaagatcagtagtgtgttacagtacttgtcaaatcataagttcatagcttcttgattgcttaacaagtgattgtagttgcatgcttttatgtaataacttggtactgaacaatacagaaaaaaaatcaacaagtattacctcatctgtagggcgatcatagtcaatgggatctctacctgtaatagcttccagcagaaccaccccaaaactgtagacatcactcttttcattcaaaagtccactgttagcatactcaggcgcgacatagctgcaaaataataacacaatgttgagtaccattagtgattagcaccaacagaatttttctgaaattacagtggccaagatttgaacgtaatacaaagagaacatgcctcaatttattatacaaaggcatgaaaaacttacccaaaagtacccataactcgagtagcaatatgacttttaccagcacctagcatcttggccaaaccaaagtcagatattttggcgttaaactcatcatcaatcaatatattactggccttgatatcacgatgcacaacttttggttcaattgcctcatgtaagtaagcaaggctgcaaatgtggtggttcgtacaaaattagtatttaccaagcagtaagatgatacaatctatacttgttttatattcatgatagtatagacaacgactacttgtgaacagtactgactagtaagcctttaatcacaaagctgtcaagattgtaacatgcacaacagtttttaatagagcagctatcaagactggatgtgcttgtgtgaatcaatcagaaggcgacatttttagttctaaggcatttaatggaatagatatagatccaatcagttcacagtttgcaccacgcaaaatcacaaatacaatgttgacagcaaacaattgatctagaatggacatttgaatccacaagaagcaatagattagactcagtgatggagttactcacgcctttgcagtacccaaaagaattttcatgcgcgctagccaagtgagagaactatattgggataactctccatgtaaccaactttcgagattcccattgttgacatactcatacacaagcatcctgattatcaacgcacaacaaacaatttcagttgagacacaacaggtcatagtctaagcaatgaatcctaataatacccatacctttgagtgccttcaacacagtaccccaaaaggcgaaccaaattcttgtgtcggacatgaccaattgcttcaacttccactctgaattctctctcagcttgtcctctgcccaaggcaagtggtcatagcttaagtaaaaggaaggacaacaaactaaccaatgcactgccactgcatcaccaaagaattgttataagaaaaaacgaaaaatactcacagattgttaaggattttttgacagccactggggtgccatttgataatctgccacggtagacaacaccatatccaccctcaccaattacattatcctttgaaaaacagttggttgcaagttccagatccctgagagtgaaccaatgaccccagccaaggtaagagaactcaggtaagcctggcaacagaacagagtcgacgggagcatgcgaggaagactgttcacatgtggaaacagattgaattacatcatagttgtccacgtaatgaagaggaacaggactgttttcttctccttgtatcgtcttgtcctcttgagcaaactgattcacatctttatccactggttcaacaggttcattctgaatggcgagtagaagcccatcatgtacaacgaaatcattgggcaaaaattcgtccactgccctcacttccttgatatctttggatgcagaaggtatttgggtaattggaatttccttgaatgtcctacgtgcccgtttgatccaagtttgtaaggtgaggatacaataagtatgagaagaacaccaagtagggatgctccaacagatatcccaattacaacccaaagtttcaggccaaaaacaattgttctctcatgaagagaatctgtcagagtggagtttgatgacatcttcggatcatcaagtacctagatggggaagataagaacatgtcactcacaaatgcaaatcaccattccctcaacataaaaggagtgcatttctgcaacagcatataacacatgccatgacagtaaagtagaaagaaataatcaaaaagagtacgtacatataagcttgctagccgatcaaatgttcttagtgttgccacaaagacaaggcatgaatgtttaacagaatggtcaggaacactacaactcgttgagtcggcaacactagtggtcatgagaaagctacatggtagcaaccagataatgaccatgagttcaagacaacacatcgccatttggacagtatcaattatcaatgaagcaggtctgacctgtcaactaccgttcccacttattgttcagaatcgaacagctacaggttgacataattaattgacatagatgattacaggcgtttgaagat

SEQ ID NO: 52606 - DNA, 6544 bp, Oryza sativa
tccctgctggacctcgcgcagtcgcgctgtgtgtgttttctttctttttcttttttttctttttattatttgagatgacgtactcgcgctgtgagatttataaggagcgagcccaaacggattaataacgtgttttcgagtgatcgactaatttattaacaactaccgatagtaaaatgatagcggcggagcaaaggtgaccgcttgatctgaccaagaactccgccactttgtttttattgggctctaatgcaaactaataaaggaaaacttaatactatattcctaatttataaggacaatagtattaattttttctttctagtttgcattagagcccaataaaaaatatgtggctttacatatatgccttgtatttatgtctaacatataccaatatgcatgctaggatggagaagaaaagggagaaggatttgagaaagtgtattttcatccctcgtttcttgcatatcacttaaatagccattaaaaattttataaaattgaccagatagattaatatgaaaaatatcactccacaaacatgcaagcaaggtcaaattcaaattctacaatgttaacaaatataaccgtgaatatatgttaactattttcaatttaatatattctttttgttgtaatttgtagaagttaaatttagcatacacatataaaagttcaatttaatttgttcttattgatcttcgttcatttctttcaaaatccgttcgagcctgctcaggatgtagttgttgattgccgggcattgtattccttgccttttaaccgatccttgcaggtgattctggagtttggtcacattgaaccccttaactctcttgtggcacgctaagcagcggccgtcatcttttccaagcctctccccaagctcccagaccctgcttacttggtgacctctaacctttcccccaatttgtggcctgcaaattcagtgtttactagtttataaatcgatcataagtgacaatgagaacactacactaattaattagtattaaacaatcaattgttgtgtgcgtgcagtactagtatattgcaataggcagaggagcatgttagttaattcaatgcaacaaattaagtttaattacctgtatgccgggaaataaagcttcaaatagtcatggatcgcatggcaggtgttctccatatgggtcgtagcttcatcttctcccctgcaacaacacagatcaattatcagcacaacacacacgtaatgcaattatattaattattatatatggaagattattaacaactgaaaagatcgagtgctagtagccaagtgacactacaatggagtatctctctttgcattaacccaatcccggatttctttcaaaacaccaccgttgacaaaggcacttccggtatctcctgaataaatggactcaattttgtcatgataatagcgcattgcagcagcagtattgccagaacgcatcagccttagagcacccgcaatggtaaagtaaggtgttatctataaaacatgtatatcttagcaatagactagattaatagtcatctcaatagtatatctacatgggtatctatatctctcatacattgcctcgtttttctctatagattatctctaagttagtagatagttttgttctctctcttcatttaatatcttccatgtaagaaaatatgctgacatagatctcttgtagagagtctatagataaccattgtgggtgttcttaggtactcgcaaaataacgatctcgggatgagcaacataaatgtcttggggtggcgcgtcaggtacagggccattgatggcttcaccattacggaccatgcgcgtcagccgccgcagagctccctcccaacgatgttgttccaacaaattatccaaactcagcctgcaccatgtagtagaaaccaagaggttatatataattttgtggtgtgagctggtgcaacgtttagttgactagctagaatgtcaaatatatgaatgaatctgcttgcatgcaagtagtctcacttgtcatcctcatcttgatgtggctcaactggattttgctgatctgcagcggcttctggttgggctttcaccagttgctctaattcatcaagggcttcttgttctatcagctctgcaaccgcagcgtctatctcctgatgcacttgtatccctccgccaggcaattccaagatctcaggttgtttctcttctattatcaacctgcaaataattaagtaaaagagcatactgatgcattttcaacttgctatataatactccaattagtttagtgcttatatatgtcagtacgtgtgtgtatatatataggtaaattaactggtgctacatggagtatgggctccaagattcaaattgagtatatacacaatttgaatgagtatgaaatttttttaaatgtttagatatgaacattaacttctttactaacaactttgaactgagtttgaatttttttttgttcaattttagttctaggtgtataacatccaaacatataattcgttaggtatgtaataataaattgtgaaataaagttgagtttgagttgttttgttgttaggtatttgtatgaatcaaattcatatacctaggtatatactcacaatttaaaattttttaaaaatttgagagaatttgtgtgttttataccttagaacccgggcaccataaagtcccatataggtatcctatataggtatatagtaagtacatatgtactaaacctgatatacataagcagttaactaatatatatatatatagttaactgcttatgtatatcaggtttagtacgtatgtacttactgtaggatctgctggcgttcatcgttttctcctgagtatgcctctttctcgttggcggtgaagccccacaaatgagacctataatcactcataaacaaagggaattattaacccagtagtgtagtttgcatgcatcctacgacacggtgcaagcatcaaaattctagctttttatatgcctataatgcagtactccattattaactaaaatttattctcttccttcaaatatgtcacatcctatattaagttaatttattttgggacggagggaatataatccagcataatctccccatttaaaaataaaccaacctaagtaacgatgtgacataaactagctaataaatctaaaaatagggttgttcagatttgttgcactaggttgtgttacatttttggtttatttcaggacggagggagtatatatacatgtgtgtgagatagctagctagtaggaagtatcgtatacttaataatatatcttctaatacacagtatatgatatgatgtgtaacacgatatgcatgtatacatgatatgtaactttgtcaatttttttgttcaatcttccgccactacgtactccctttgtcccaaagcaaaatgttaaaatttatcttaaaatgtagcaatttctctacctatatatcttctccatcaatcacagcattcctccgtttggctctactacctccttttctcaactaattaataacaaccttgttgcatttaatttcaccaactttcctaatcctatatctaatctcaaaacctgttatattttggtactaggaatgaagtagtacctaacattacaaatacgaaagaagctaaatgtacgctgcaaaatgatgagaacacaattttctaactagcaaattggtgtacatagcaaattaaaccagcagtaagtgaaggcataaataattaagatttatatcaatttattggtacagaattatggaacaactcgattgtgctagagagataatattcatggatgtaaagctattatggccccatttggcacagctctagctctcaactccaacttacctggagccggagttgtgccaaacgtccaaatccactttttttgagtggagttggcagagctactcctagaaaatgaactacgggggtggggctggatttttgctgctccacagctccactccaccccaaaagacccactaccctctaatttttttagagtatttacacgaaaatgctactcaactacccctacaatcctcctttcctcccgttctctctcctcccctcccaatcccgagcgggcgccggcgacggcgggcggcggtggcagcagcagcgtcggcggcggtggcggcgggacgacgacaggcggcgacaggcggcgcggcgtgacgatgacgagcgggtggaggccagcggcggcgggctgcggcagcgtcggcggtggggggccacagtggcgctgcggcggccaggggctgcgggacgaggacgggcggcgcggcggccgggacgacaacgggcggcgcgcgcggccggcggccggcggcacggctggggccgattggtttcgttttttttttcagatctagagctgaaagtatagccagacacttttaacgagttttcaactccaaccggagctagctctcactgaagttggagtttagagttaggagttggagtttggagccctaccaaacggggcctatatacaagatagagtactcaggtatataactcctatgcacccatgctagtatgttcggaagtcactttttcatttctattttctcgttttttaaaaaatgatatctttttgcacaattttttttagaaaatttactttagaaaataatattaatctatttttcaagttatttctaacaaatgcttaattaatcaactaacgggctatctcattttccgtgccaacgggggaagttcccaacttgctccatcaaacagagtattaatttaattataactgtgtccctagtctaaggcatactaacataggcatgaaacatgataaaaaaataatcaaattaatgtgtttaacataagaatgcaagcaccgtaaggatcggatatgcaactagccagactggaacatattgatcgccaatctatcggtgaagcatgtatgtatacaacacatgaatgaataggagcagcgcgattgatcaaatttctacatgccattagatgcacatatatatttccagcacccaaattaaactaaaatgcacttaattaaagacgtcagctatagcctatagcagcgagcatataactataattactaattaactacactgtaattaacaaaaacactgtgatttaagagctagcgtgcacggccgggcggattccataactagcagttttgatcaacagtgcgcaatgcaaacaaatcaaatcagagcgagcgaaacattaaatgaacctatccaggcaatcagatcattatcgatcgaacaaaaacgaatataatgcgctaattcacaaaataaaacaccaaccaactaactagttgtgcaagcggcaagtcggtcgatcgtggatgcatggattatagtatattgaattaacagcaacgcgaacaaaacacattaaaacaactgaactagcatcaacgcgagagaaaataacaaggcaggaaggcgtggcagtaggcgatcgatcgaagcgagtcggcgagaaatcaaatatctaaacaagcaggcgatcgatccatgcacgctagggcttgaagcaagtagcagggaacgtacaggagggattcgtgtgtgcatactgtggatacccgtgggtggccatatcaccgcggcctcgcctccttgctattgagcaatgcaggaacaactaataataatgcttcatctagtgtgtatatatgtagccaatcgatttatatggattccttagtttggtttttaccgttatttttcaggagatcggtttttttcttgtaagagatcggtttctgcaatcaaccgatccatcaggaaaaatgttaaaaaaaccgatctatacttgggttcagtgtcggtttgtaccgaagataccgaccaggcgctctacaaacaaaaaaaggaagaggacgtacgtgctgatgctgtattgttgctgttgggccatcaaatccctcaagctccacacaatgggcctttgggcctgcgatcatccgactgggctagcgttgcctagtagtagtgcagcactaggaataagtccattttgcctcccacatctcttacccttgcgtgaataacatccctcaaccggaaaaccgggtataatgactcctccttctctgaaaaccagagcaaatcacctccctcggtggttttgctggcggtttcgtccaacgtggcgtgttgacccggttgacaagctgactcagcgtggtgggacccacatgtcagtgtgtagctctctctcccccttatctctctccctcggcctttctctctctccctcatctctggcgcgtgggaatggcggtggggagcagcgcaagcagttggaagccgtgacggtggcggcggggacggcggtcggaagcggcgtggggacggcagtcggaagcggcggcggaggcggtggcggtggcgacggtggtcgggagcggagaaggaggcggcggcgacggcagttgggatggcggtcgagagcggagaaggcggcggtggcggttgggatggcggttga

SEQ ID NO: 52607 - DNA, 11910 bp, Oryza sativa
gaggatgtcgccgggaggtcgcgcgctgggaagggagctcgctggtcggcctcgcacaggtaggggagctcgtcggccggctgcgcgcgggggaggagctcatcggttggccgcgtgttgggagaaagctcgcaaggtggctgagcgctgtggagggagctcaccggggcggcctgctgctgttgctgcttccacaccgccgccgttaccgtctctactccatgaccaccgtaggcgctgtctgctgcttcggccgtccccaccgccactgccgtcccaaccgccgttcccgaccaccgccgccgccgacttttccgctcccgaccgccgacgccaccgccaccgccgccgcccccgaccgtcgtcccaaccgccaccgccgctgccgccgccgctgcttccgaccgtcgtccccaccgccgccgccaccgcttccgaccgccgtccccgccgccatcgccaccgcttccgaccgcctgcgccgctccccactgtcgttcccacgcgcaagagatgagggggagagagataagggggagagagagctacacactgacatgtgggtcccaccacactgagtcagcttgtcaaccgggtcaacacgccacgtcggacgaaaccaccagcaaaaccacagagggaggtgatttgctctggttttcagagaaggaggcattatacccggttttccggttgagggatgttattcacgcaagcgcaagagatgagggaggtaaaatggacttattccgcagcactactactagtgctcgctccagtcggctgtgaacgatgtcttcggttttatcaggagctcggttcacgccaacaaaaaccgatctgtaaaccgaaaaccgatgcatctcaaaataaaaactggcttaaaaccgcaaaacccgctagttcggcttagcttggtgcggctcggttcgatctttgtcttgggtgtataaaacccacaaaacccgcaaaacccatggaggcccttcgccacctaatgggccagcccgggaagaccacctcagggcccataaatgcaaagacattgtatacccactttaatgtctctagcataagggtaaccatgtaaattcccctataataaccgaaccctagagggtatgagcatatactaggagtataaatagccccctaggtacgccatgtaatggagagattccaaaatttttaaccgattaatatattgctttaccattccagttattcactgaattaccacctccttcgacgtgacgcagttgttattcgacaacaatgtgggttaattgtctcaaaattccttttaattaatctattttttatatgaaatgtatgcatgtatggttttgattaaataagattatcgtggtcatttgtctatcctcctaatttgttttaaattagctagaattttaatttttatgggacagtgagttttaaattagctagaattttaatttttatgggacagtgagttttatgggcctaagcccaacgtgcatatggaacggagttttgggcccaaagcccatcaagaaaaatactactatctgacaaaaaagaaataagttcaccggacatccctcaacttaagagcgagattttttaaggtcccttaaccacaaaaccagaaatgtatacccctaaactcacacaaaccgtacataaaaggtcccaagacagtatatatgtgggtggtttcgctgacgtggcatcctagttaaaaaaaaatataaaaaagtacatgggcccacatgtcagctgcacatatttttttttcttctctattcttctcctctcctcttttctctattctcctcttcttcaggccagcggcgggcggagagcaggagagacgatgggcacgcgcggatgcgggcggcgggcagagcggacggcggagcgaggcggcagagcagcgaagcggcggcgggctgccggcggagccgacggcgggcgagcgcggcggtagagcagcgagacggcaccgggcgggggtgcctggggcggcgaagtcgagggcggagtcgtcggagtcgatgtgggagggcgtgggagatggcgatgtggacgaggaagaggagggagagcgggaggacgaaggtggcggcgatgcgggcaaagagcggccggtgggcgcgcaggatggatgccgcctccctgtagatccccaccacgcccaggaactgcagctcctccggctcgcattccattggactccttcgattgaggattggatttgatttggattcctcgtccgctacactgtcagtagcttattaatttggtaggtagctaacgaaacgagatgagatgagcttgagatgggattggggattggggaattttggagaagtagtcgtacgtaagcaattggttggggaagcgaggtctcggacacggcagcgtcggtcgagtgcgcggtctgcctcagcgtcgtcgacgaggaggaggtgaggcagctcctggcgtgcgggcatgtgttccactaggagtgcatcgacatgtggctctcgtcccacgcctcgtgcccggtctgccacgggaaggccgcgccagccgacgagcttgtcgacgccataaccgtgtgcatatcggtgacgcgcgacgtcgtcgtgccagcctccttgccgccgccgagctcgcccgccgctggcctgaagaagagaagtgagaagagagaagagaggagaagaaaagagaaaagaaatatatgtgcagctgacatgtgggcccatgtactttttttaaattttattttgctgactaggatgccacgtcagcaaaaccacccatatatactgctttgggaccttttatgcacggattgtgtgagttttgggatatacatttctggtttcgtagttaaaagacctcaaagaaatctcgctgttaagttgagggacctccggtgaacttattcttgaaaaaatgaggccctattaactccttgctgcaagccactagctttctttttacatcctggcatgtgccaattaattaaccagctgatcacttcctcttcttaattacttcctctatccacaaaatttatacctattacttttgtcatcaagatcaaagagaaatttaaatcatcttagatattacaaaatcaaggagtgaatgtaaatatgcaaccaatgagtatttagagcaggtacaatagtaggctataagctagctataaacatattttaaagagataacagaagagagagaagagcagcgggctatagatctgcagccaaatacagcacggactctaagatgtaatgtgtgtatgaaaggtgggaccagatattaatagtttagtaagcaactattgtatgaattagctattacattggctatagatgatttggagctagtagttggctatactattaaacttactctaagatgactccttgggttctaatcaaacatttaatttatctcttcatttataagttttaaatgtataaaaaacaaatataaacaacttatttgaaaaaacttaaatgtgaaatataccatatctaacagcctcatcggttggccaaatactttggctgatcagccaaagctgtctccaattcagccaaacttcaatgcaaattagttagcttattttgcttaaatagctgatcagccaaagcatttgccatccgatcagggaataacctttgtggatggagggagcaaatgagtactccattttaatttacatacaatgcgtatcgttttaagatgcaaatttactcgagtgccgccggtttgctactccacctacaaatataatgtacggatggcagccaaagttgactagtactccaaactgctccagctcatagaaaatgtcaactataattaacttggaattggaattatctatccgatagatgatcccggttcaacgccgtagcacgttcgtacgtacggcatgaatgatgatatggatcaacacatgaaaagtcaatatacttgcatgatgtcagcatctagctcaacaagaaagcaacatatatatgccatgtactcttaccctttctctttaactaactttatgtacgtcttcttgcataaatcagccaactaattaagttctggagtatatatatgtgccgcttcaaactggcgactcattccgccaacatgcagctaattatggcataattaccttgtatacatatatacgtacattggttcgtacgggcggatgaacacatgcaccggcaattatattatttaagtccagctttcatgcttggttaacaatgacgttattttgtcatgataatagcgcattgcaacagcagtattgccagaacgcagcctaagagcatccgcaatggtaaagtaaggtgctatctataaaacatgtacatctcagcaatagactagattaatagtaaatcatctcaatagtatgtctacatgggtatcaatagctctctaatacattgcctcgtttttctctatagactatctccagattagtagataactttgttctctctcttcatttaatctcttccaagtaggaaaatatgctgacatggatctcttatagagagcctatagataaccattgtgggtgcccttagtttactgggggaggcatcatgttgcacggaacagtactgtactactaacgatctgtgtgcgcgtggtacgccactatttaatcaatcgtcatttactaaggtagcatcaactggaggagtagtatatatgaaagcaactgcaataatcatgtcccagttggagttacccctagttgcacattttctcaaaattttggtgaggaaccttgtgtccctagatattacgaacagatagttatattttcatataaatatattgatatcctatatttatagttggcccacgtcttttaataaattttgataaagttctcaacttaccttcctcgttttttctcgtgcatgtttttcaaaatattaaacggtgtatttttttaaaaaaaaatctatacggaagctactttaaaaaatcatattaatttatttttttcaaaaaaactaatatttaattaatcatgcacaaatgagtcatctcgttttacgtgtgtgagggattagctcctaaccccaagcaactaacacagccttagggccctttgaatcaaaggattcatataggaatttcataggattcaaatcctataggaaattttcctatttggccctttgattcaaaggatggaagctttccaaatcctatggaattcctatggaatggcacattgcatgtggattttggaggaaatttagcaagagcttcaacctcttggaaaattttctttgagtctatctctctcattcgattcctgcgtttttcctgcgctccaatcaaacgaccattcctgtgtttttcttgtgttttgcaatcctctgttttacacttcaattcctgtcagaattctatatttttcctatttctctgttttttctaccctacgattcaaaggggcccttaacttttgtagaatcaaaacaattgcaggttagagtacggtgtagaagaagccttcccaagaagagaacggacaaggaggaatttttactggaaatgcgagcagataaagataagcaatcagctggtgcctactcctgtacttgaagcgccttttctttcaagattttgggtgtacatagtggagtctggagtggtggtttggagcgagtgcttatcaggacaggtatgtactgaggaggagaggatctagctagttcatgttccagtaccaaacggaacggaacggaactgaattctgtcctttctaggtacggcgtgccactcagaccgaccgacctaacctgctttttattattcagttttttttccatctctccacatgcatgaacggctggccagatatatgctttcaccttttgctaattgctactgcttttcgatagccttttggcttcaattgctcgtgccacgtcatcactgcattcataatttcatttgcttctctgtttccaaacataagcatttttaggtataaattttatgtgcaatataaacatttttgatacactgattctaacaaatttaaatattttcatccaatcagacgcttagaaggaatccaagcaattcaaaatctaaaatttcatcaataaggtatcaaaagcagagaacatttctctttaatcttacgccctttttatttagggttatataagctagttaatgagtcagaaagtctaagtttaaacaaacaaacatatttttcgtttgttttttaaagtcataagttactattacactattaagccaaaaattagtatagaaaactttttttttcttatgtgagttagaggtatgactccactttaaaacttatgattttaaatttactggcttataaatcatatgagaaaaaaactaacttaaaatcttaagccaataaatctaagtctaaaaaatggcccttaatattaatttgattaaatagcctataaatggagcactactccagagacatgagctaaaatggatggttggttttaggtatgagcatacataccaagatacgagttatcacttttgtagatatgctcaagctagtggctgcctgcatgatggacagatagcttattccttgtgtgtctcattcatgctttctatcgaagtggagagacaaatacctaatatgcttttatttcaaaagaaaaactaatatgttggcttttagaattcttttactatatcatcaacctgattagatttgaaacaaatcaaacataatttgatatactttcatccctataacccctctgtcaaaaaaaaacaactactaagatgtgacacgtcctctctatgtccagatttgttgtactaggatatatcacatcctctctatatccagatttgttgtactaggatgtgtcacatcctaatactaggttgccttttttgacagagggagtacatacatatatattacacaaaatatgattggcaacggcatgataccgcggttgaacaacacgagtacatctctactactataaaatcgcagacgacatgttccctctccctcacatcactcgcataaccacccatcctcaaaaaaaacaaagaaaaatcaaactattggttaaaaggaaaaaaatcggttcaaaaataccggtcagattgtttcggtctatgggctcatgcaacctattctcatatggtcctgttgtaatgtatgagcatggcaccgatcatgctcttgtaaaggttaaaaagtaaaaaccgttgtacgcaatatgttacatgtgactacttatgtaccactatctaactgtgactgtatctgtatgtgttcgatgatgtatgtaatgtggaaaaataattatatatcaaatcatcatttttggaagtatacaaatttttgaaagtataataattatataattatatcattttttgaagtatacaaatgctgaaaattttcacaataacaaatcatcgtcacgagaacgacatgcgaacactcaactagttcgcgctgaaaccttgcgaactatagccatggtcaataagatcagatgtggacaccacaaaattgcaagaattcgcacaggcatgaagcgaagtaattttatagggccgcgagatggcatattttctatgtaaactgggccgtgtggtcacgagctcgcaccatgtctgcatgcactcgttcgggtcagtccgaggacatcatcgactttgcatcccatctgcttgaactcgtctggatgctggcgcatgatgtcgtcaatcaaatatgatcacaattatacagaaaggtaggtggatttaattacattattacactggtttattatgttggctcggcatttgccaactcaaatgcagcaaagtactccatccgtttcaggctataagatgttttgactattaaactacttcaagtttgactaagtttatagataaatataataatatttgtaacaccaaattagcttcattaaatcaataattaaatatattttcataataaatttttcttgagttgaaaatattcttttttctacaaacttaatcaaacttaaaataatttgactttgaccaaaattaaaacgtcttataacctgaaacggaggtagtagctcacaagtttgctgagttatatgatgccgtctttaaactgaccctcgcgttctcaagcaatagtccccgctatgctgaagacaacatggtatatttgtgcacgctaattagaagtcatatattaatgtaaattcagggaaaaaaggtatatttttaaatctttttgcatataacgtgtgcgtgcaagcagaaaaagaaaatgagaaggaaaacgttatgcaaacagaaagtagatgcagaacccacggattgagtgcaatggcgactcccttccttcacccaagccgagccgtccccggggtgcacgggaccagtcaacaactcccccaagtgcagcgcgtcctcttccacttccaacatctactatcttttctcacgctttttccgttacccgcgaagagctgaatacgaggagggcccatgcgtcggtgggtagggtgaaaagattccatgggtagaaggagtagttgtgtgatttcgtacgagtccgcactcacaagctgtacgatccgttccgttcgtcctttgatccttttctatctctcctcccccgcatcgccccctccccacttgactctctccactcgccttcgctttccacttctaccccaccctgtactctctccgtacattaccgtcccttccccacatttaccattccacccccacatgaccacgtatattaccgtcctttgccagccatgcttgtacttggacgaggggcaaatacggtaacccagctggtgacctctcctcacccagatcgaggcgccgccggggcactctcgtcatctcatctcccccttgtttcgtttcttcctcccttcttctccttctccacatgcgccgcgccaaacgcccaccattattactaccttcccttcccttcttcttgttgcagtcaacctcgccatggcctcgcctatgccaacgcctacccaccgcgtcaagcgccgccgcctcgacctctccccgcccccgcacctcaacgacctcgccgacgagctcctcttcctcatcctcgaccgtgccgccgcccatgacccccgcgccctcaagtccttctccctcgtctcccgcgcctgccacgccgccgagtcgcgccaccgccgcgtactccgccccttccgccccgacctcctccccgccgcgctcgcccgctaccccgccctctcccgcctcgatctctccctctgcccgcgcctccccgacgccgccctcgccgcgctccccgccgcgccgtccgtctccgccgtcgacctctcccgctcccgggggttcggcgccgccggcctcgccgcgctcgtcgccgcgtgccccaatctcacggacctcgacctctccaatggcctcgacctcggggatgccgcggcggcggaggtggccaaggcgcgccgcctgcagaggctctcgctgtcgcgatgcaagcgcatcactgacatggggctcggatgcatcgccgtcggatgccccgacctgcgcgagctctcgctcaagtggtgcatcggggtcactcatctcggactagacctcctcgccctcaagtgcaacaagctcaacatcctggatctctcctacaccatggtacttgtgccttgcctcttcatctctctgttccatttcatttactgtatttcttattgtacctagacgacagaaagggaaaaaagaactcccttttccccttccattcgcttcttgatttcaaggtcaggttttttttttaggaaacttaatttagtggttttttttttcttgttcttgtttgtgaatctgccggttctctgcacctgacatgaatattgcccacaaaataacattagcctatgatgacagaagcgctttggaaattggactattcttgatctgcagatgctcttatctatacccaaaatgatatttgcctcaccttttcaattgtcagaaccagtagtaactacttctcccgttgatttgttttatcatcattttttggttataggttaattatttgccctgcagtttagatcacactcatcagactaagaaaaaattgttgtgcagattgtaaaaaaatgctttccagccatcatgaagctacaaagtctacaagtgttactactggtgggatgtaatggaattgatgatgatgcccttactagtcttgatcaagaatgcagcaaatcactacaggtaatcatcaacccctatctttttcactgtgagcattgtgctagctaaatttaaatctgattaatatccttgtttatcgtcttctgctctgagtatattcagttagcttctcatgtaaagtaggtttgcaatgctaatgttgtagggatactaacatgtatatacctcgtatattgtttggtacatttcaattcaggctatatggatattgcaactgaaacaatttggactaaatcattgttagccttcaacaataagagtatcacaatttctggtaactgagagctgaaattatatctgtactctttcaggttcttgatatgtcaaattattacaatgtcactcatgtcggtgttctgtccattgtgaaggcaatgccgaatctgttggaactcaatctatcatactgctctcctgtaagtagcccactgtctagttttatcacctgacaattggacataacttgagctcagtttatctacacttttcttgtggcaggtactcttctatgtcaagcagcttcgaaatgattcataaattgcagacactgaagctggatggttgccaattcatggatgatggattaaaatccattgggaaatcctgtgtttctttgagggagttaagtctgagcaaatgttctggagtgacagacacagatctttcttttgtcgtgccaagactgaaaaatttgctgaagctggatgttacttgttgtcgcaaaatcactgatgtttcattagctgccatcacaacctcatgcccctccctcatctctctgagaatggagtcctgtagccttgtttccagcaaaggactacagctgattggaaggcgctgcactcacttggaggaattggatcttactgacactgatttggatgatgaaggtttgaaagctctctctggatgcagcaaactttcaagcctaaaaattggcatatgcttgaggataactgatgagggccttagacacgttagcaagtcctgtccagatctccgagatatcgatttgtacaggttattccctacacattgcatatttgatttcctttccttccgtgataggagccaagactaactaatagcctctctttcaggtctggggcgatcagtgatgaaggggttactcatatagctcaaggatgcccaatgttagagtctatcaatttgtcctactgcacaaaattaacagactgttcactgagatcactttcaaaatgcataaagctgaacacattggagattcgtggctgccccatggtttcatctgctggtctctcggaaattgccacaggatgcaggctactttctaagcttgatatcaagaaatgctttgagatcaatgacatgggaatgattttcctttcccaattctctcacaacctccggcaggtattagcccattctgctgtaaaagaaataatcgcaataccgtgcttccaattgtcttaataacatctcctcatcactgcagataaacttgtcatattgttcggtcaccgacattgggcttatatccctttcaagcatatgtggcttgcagaacatgaccattgtgcatttagcgggtgttacgcctaatggactgatagctgctcttatggtctgtggttt

SEQ ID NO: 52608 - DNA, 11251 bp, Oryza sativa
gtttccatatgctaatggtggtttaattttgaagcatggttgttacatgctccagaaaccccggctgaaagttgctgaactttttttttatcacactatggatattactgcatcgtgatggttcggatagaaatgctagttgcagatgaacattgcaaatattaatcttctggatgcactgttccctagctgtctactgtgtatcgactagaagtgatttttgagaagataccgagaggtgcgtaaaatttgatatattttggtaccactaatagaaggtatcaaatctacgctaaattaaaaaaattaatatctttttatgtgaatgaattttagtatattttatatttcgtcgtaggttgtttatgagtaattcaggacgaaggaagtaggtaagtgtgtatttagttcgcgaaaagaaaattgttgggtgtcacatcggacgtttgaccggatgtcggaaggggttttcggacatgaacgaaaaaactaatttcataactcgcctggaaattaccgtgagatgaatttattaagcctaattaatccatccttagcagatgtgggttaccgtagcacttatggctaatcatggactaattagtctcaaaagatttgtctcgcgattttcatacataattagttttttatctatatttaatactccatatatgtgtcaaagattcgatgtgacgtttttggaaaaaaaattgggaactaaacaaggacaagcatcacacgtttttgaaaattttttttggaactaaacaaggacgagcatcaccaacagtctacctatcttattcccaaaactgatttggagggattttagccaaaaaaaaaacagcttcaacggatcccctactatcctacccgagttttagagttcccttctcccgattccttgttcagtttgtatacggacactaaagttgctcccaatctcgccctcccgcctctctcctcccgttcccacgcgtgggagatagcgatctttctgagcgtgaaagaaaaaaaacggaattttctcctcccgttcctgcgcgtgggagatagcgatctttcggcgcatgaaagaaaaaaaatggaattttccgttggtagtttaacagaagggcccacttttaagttttggggattgaatttagactatctgttagaggaggagttttttcactttctattcttctatctactttatagttcaacaaatgctttcactcattctttcattcatcactcaactattcaaatcatctggtgaaaatccaacggtccaaatagatcactagcctcccacctccatcgaacgcgtcatcgcgctgcccctaatcgcctccctcaatcccgcgccgcatcctcctcccttcctctctctctctcgcctatcgcctcgcctcccccagacgccgccgccaccgtcgcctcccccagacgctgtcgcctcgcctcgcccgccctatcgagcccaccccctcccttcctcactctcgcgcctcgccggggggcgggactggcatcctcaccggcaatggcgatggctactcggccgccttctcctggtgaacagtgggggcccacctcgcgtttaggaagcccgtggtggtgctggtggtggtaccatcggcaggccctggaagcgttgtagaagcggtggtcgcttgccatgcctccggccgagctccacggcggtgcccatcatcccttcaatcgtgcccactctccagcatcaaagctccatcatcgcccccatcctcgccgcgttctccgcatcttttgctagacgcggcatgctctccacgaatccaccaatggcatgccttgcctcactggctcacttctgagtcatcgtcctgactatgccggctttgccctccatcttgttgagattttacaggttggttggcgaccttggaccttggtcatttcttttcttgattcttccctcatgttacatgtatatgtggttattcatgctttctgcacaacttttcttgattcttctatcatgttacatgtatctgtggttattcatgctttctgcagtctgcagatctctgatatccaaatacgatatgtccgcttcccacgatactaccaaatgttgctaatagtgatcagatttacatagtatgttatgcctggaaataaatagagaatgcactgatcaacttaaattcccggttttttgttacagaaaatatcttcttcatttgaatggagatgtgaccctgtatgctcttgcttcatgctagcagtgcatggcatgcatttgacattttttttaaagcgggcaattaatatatggatcctctaatctttagtaattttattggtttcttttcgagaataaaagagattgggcacactccaggactgattcacgcacatacggatttatgtggttgtctgtcctcgtaatggtaattctgtgcattgcactatcgcagttcttctttttcgaagccttttctaggtttccgttatcaaaagatatctaatttgcagaatatatactaggtggtggagattttatttccttcaggacatagatgttgcaagctattgcaaaagcttatgcctctaaacaatcatattcttgcagagtggaaatttaatctgggggtaaatcttgcatatttctttgtttcagcagcagttattacgctcacattttttctagcaatgttggttccatgtgcacaacttactattaactttcaatgtgacagttttaacatattcgatggcgctgaacgtaacatcccaaatcatgaattgctggtggccaggtgaagccacctaatggttctcaaatcttagttgtgatgtggcggtgatgagcaagcttggacaagagcccaaataagatatgacttaaagtggtgcaagttaatcaggacagcaaagacgcttagtcttatgaagaaatgtcacatatacaggaaaggatgagattggccaaaatgtttttttagtcttctgatttgcagatgcttgattggagttatcctgctcctgccacaaacaggaaatggtaagaactaagtagagtgtatactcacatgcatatatatcattgagttgggtgattctaaattaatatttggcacattgtagaaaatattggtttcaagctattttttttatcaagcatacatgacctaaaaggcatatggtttctatcgtaacggttgataactccatattgatctgttctttagaaattcatgaaatagacatttgcatgacatctggaatggttatcttctttgttgaatgttctttcaagaacttgcacctttttgtttaatcttgtaaatttgatgtgtaattgagcttgtagggtgagagaatcaagtgtgattgagcagatctatactctatgtactgagattgtgtagagtaaagacgatgtagtatttccttttataatacaatttgtcacgcttcatttatttttcttatggagcacatgttgatttcaatcattggaatttgttctacccttttggtatgaaatttctcttactgattaaatgatcttggtatgaaatttcccttttggtatggaatttgttatacctgtcctgatgtgatgtccactgctagagtcctactatttagcagaaaatcagtgagataattgatagtcccccttgaccataatggtgtatcaaatctgttctgggacaaggtaggcaacatggcatcaagccactccaaaggacaaaatgttgctttgtgacaagtgaataatacagccactttctggtatcgagtctaggttgcccattttttatttttcttgattttttttcatgttcttaaaaaaatgcttcaacagaaggatcatttgagattaagaaatgatcctttgaagatttttgtttttttgctgttaaagcctcatcatatatcttgctaattatgctatatgagcaatcatacaatcaattatttatgcaaagatgattaagtggaacattcaagattcaaagtggtatataatcaagtattcttgctgccattgcaagtatattaattagatcactgctggcaattggatgttgaaaatgcaataaaaatgttgaggcatggagatttatggtatttgacattatggcccatttgttttattggtcaatggcatgtgtcttgcccatcagcactgtaaatttgtaggttgcgaaaccaataaactaattagttgggctattttattagttactgaagtgtggaaaatgaactgcagatcacttttttttttcaggagagctgaacatcattttatagataagcataaatcttttttatgaaacaacactgaactattttatgttatgtgcaagtgcaacccccacaaagtgatttttttttaaaaaaatattttggttccaatatattaggtttaatttgtatgttgatcataacgtgcatcggtgtgcagaggctatactgctcaaaatggattttcttatcttccaaagaagcgcttaagctcaaaatgataagtcggtgaagtgcatattgtgttgttcaagaaacctggagcgtttgatctgcatatgtagctgttgagctcttttttttttgtcgaacctattgagcgcatatttcactctaaatggttttgggaactcatatgtgtggcatgactgttctgttatttccttcaattaagcctagcaagtacatgattaaaaagattgttcatattattcactgcatatttatttcatcaattcttttgtgctgtttctcctcaggagagaatgagttggtgtagatgcttctttcccttgtcattatgttttcttccctgaattcttttatctgctcttccatttcatgccatgttgatatcatccccatgtgatatggtgacaatgttttcagtattctgccattcacttgttaagatctagaagattaaggtatttttcgaatatctattcattggttgccttgtcccttgaacctcatagatgggaatcattatcaatctatcatcctaaatataaactactccttactgcgcatgatagccattctattttgagttttatagagccatgatacaatgtctgtaagagataagcgacggatacaccaccgccgccatctgtcaaggccttgagaggccgagaatattctctctcggtattacgaaccagctcagaaacatactctataatgtccattcaaaaacatactctgtaatttcagagaggagtaagtgccaatatagtggttttaattaacatccaaacaatatagatagaatgcgagcatgtgatacttctttgtttataacaattttgtgtatcaatcttttttgcgaatttatctcattctagacttggcaaaatatgttttctttcttacggttgttcgatatatatcattaaacattgccgtagcgttagcacgagcggattactagttttcagtttagaaaaaaatatttttttagagagagataatagataatctgttgctgatgctctaaatattgaaagagtctaacgagtctgaccggcgacgggcgaccgcccaacttcctttcattccgtggaatcttcccgttggcgattgaccggttggcccttcggtttttccgcaaccttggtttttccccccaagccaaccccaattccccccgccggccgggcttttggttcccttcccccttgaacaagggccttcttttacctttccaaggccgctgcattccattaaaatccgaacttccgtgcttccccttgccacccccggcaaaatgcttcaggaaccaacccacccaaaggccaaacccctggccttgccaggaatggtaatacgccggcttccgcctgagaagcgcatcctgttgatgaagaagaagaagaataggaagaatacaaggcaggtagtatgggtattgtcccatcttaaattttatattcagcctgcacctagcattttgatctgtttcgcctccaaatgagacgattatcagcagtggtaggtagaggattattgtattacttgtgggaaaaccataatattaatgtatgctactgttggtactggggagtgagaactcgcccagttggaactgcccacgatttcggcttcgtttcatgacaagagtaatcaaattgaccaaatgcaggccttccaggaatttgaagatgcagatatagttgaccttcacacggacgaccttgcaaccgcttctacctacctgaaatatgattgatgatagtagtttcttcctcagctgcacttcttccacctcctccaatctgcacttgtgcagcctgtgacgcctgagaatacatcaagtgaggctccatttcgtaactgctcgtcgctcgtccgtgcaggagcctattaacctacaggtaccaaaatcgaatttcttgtcagttctaatttcctcctctatttctactttacttttgccaaaacatgatatagtagagtgcccgacatgggatgcgtaggaaacgctcattcttgaagttgaaccgattttgaaacttaaaaggggactgttgctatttgaagaccctattatacatagcatagcgacaaccttctccaaacttgttactaacagactagcctcttaattctattcagaaatagcatatcaagatcatagaaaggagaagataaaaaaacgaagtccctttttttacatcaggaacctttctagtgttccattggcatccccatcactccgccaaaaagaactttatcaaatactagttccttgcagctagcagtatagagcactagtacgttatgagtaactataataaaattgtcatcctccaaactgtcacccttcaattattatcgttgattcagttttctggcagattcaagttccactagccccattcctgtgatgattgatcagattttgcacctccctctgcgtataattggttatttccttcatcttaatggccaatgtagttggtgttagggatcgttcttacacctttttccaaaagcaagaaaatttggttttaaaaaaacatggaaaatatttgccatgcacatacatataacatagggagaagaataaaaggggtaaaatcctaaaacataggccaactgggtgagcaatgtttatgcatataaagccttcattctttcatataaaatatttttctagatctgtactgctataaataatatttatcatatatatttatgtgacaactgctaaaattagctctgtcttgccacatttgtttcttcaaattaaaattgtctcatcttctattcgcaataaaactaaccagaaattttacacatgacttcctcagaaatcagaaaagtattccatgttttctttttttttggctttgcacattataaactacagaaaaaagatatatagtgatttcagtaatgcaccatcttcatgaatttgcaggcacaatataactatatcttctgttcactcttatgggagattggtatgaacaattttcacaatcttttaaggatgctgctaaggaaatgttggcaaaaacagatattgatccaaacgttaagtgcttcacaagaaagcagatgaagcgcatttcaaacaactacagaactatccttgggaaagggggcttttctgtggtgtacaagggtaggctcaatgatggccgtgcagtggcagtcaaaaaatataattggaaaacacagaaaaaggagttcacaaaagaggtaatcatacagtctcagtttagccataagaacattgttaggctattggggtgttgtgttgaggcagatgctccaatgttggtcactgagtttgtccccaatggtaacctttccaaccttctgcacagcaacagtagccagtttcctgtttcattagggacacgcttacagattgcactggatgtagcagaagcacttgtatatatgcattcctcccaaaatcatccaatccttcatggagatgtcaagccttcaaacattcttctgggtgacaaggatgtggcaaaactctgtgactttggaatatcaaggctgttatgtatggatagtgacgaatacacgggatttgttataggaagtagaggctatgtagatcctgtgttctgccagactgggcggttaagtctaaaaagcgatgtctacagttttggggttgttcttttagaactcatcaccaaaaagaaaggaattgatgacaagaaagtgtgccttgcagaaacttttgctcgcatcagtagaaaaggtaatggacacgaactatttgacatggacgttgtaacaaatgagaatatggagtttcttcaaggaattggcaggcttgcacttgaatgtataaagtttgaagtagaggagcggccagaaatgaaagaagttttagagcgcctttggagtctcaaaagatcccgagataggagaatccgtgagatgcaggttatggtacggagcgagattgaagtactttggagaagatgtggctttggtaggtttatgatctcgaaagagagaatggacgatatgacatactacttcaaaactgttctcaaggaatgtgcatcaggcaaggcttacatagggagattttgcaacgcacaactgctggtaataaagatgtcgatttcagttttagatcaatggaaaaacatagtctggaacgaattgaatgtccaatctagaattaagcactggaatgacgccaagcttctcggttactgcttagatctttgggaaggtctagtgcttgtatacgagtatggtgcgatgagcttgtatgatgttctttctcatgatgcaaggaaggtatctcccttcatttgtggcctgcgcctgaagattgcggttggcgctgcagagggccttgctcacttgcactcacttggcattgtgcatggcaatgtcagcactgtcaatatattgctggatgatctttcggtactcaaagtgattagccgcaattacccagtaaagattgcaggctatggaacatcagggctccctgacattgacaaggcacagcacacaggattcttcatggaggattcgcttgtaaccagtcatgggaaggagcatgacgtatactgtttcggtcttgttctcctaacgctcttcacatggaagaaggtgtcactgcaagaggcggataccgtgtttgagcagctctgggacattggaccgccacatgatgtgaattccgagcctgagaaacctgggcaacagctcaaggaagccatccttagatgccgtcatcttgaggaggttaagagcctggtttcacggtgtctgacgtccgaggtgacgaagagaccatccatggtggaagtagcaaaacatctcaagaacataaatgatttacatgatagcacagcttgccatgagctggcgatttatcaatctcgaatgctttcgggctaggctaggctgcaagtagcagtcgtacatggttcttctttgagtaaattaaggtgccgtagtagatgctataatgcaagcgccaagcaacatattacatatgtgtattttatatcccgacaaagaaaaaaagacatgtgtattgcatatattttgtaacagcaacggatgtttgtcatgttgattctcgtggcgctgctgccatataatgttgattgacagatccttggggaaccaacggatgaactaatggacctctcggcatcctttgccaatgactcttgcttcttctgaggtttggtggctctttcttgtttctaattcttattcagtgcatttgcctacatctggccctttggcctttctttcttgtggccgattttgctcgatctttattttttgtgtaacagaagaaatttactacggctcatttgctccagtgcatgcaggtccttgtggccctttggatggtactgtttcttgtatttatgtatttgtgaaaatttccagttttaacctctcttgtggccttgtgggctccaggtggaagtgtgtctggggtaaaaaaatcttttgaaaggttttgccttaaaagagtttccaaagttcatttccatatgtggagggatgatggtcctgattgtaaatttgtaattatacacataataatttgctatccttacgatgacaccattgctagggccggtcctgacattttggaggccctaggcgaactgcgaacttacactatgagcccttaagaaattaatgattttttttacttctaatatatatactctatataaagcacattgatttatcatagagtgacacagataaacatttctaacatgataaattataaataaagcagtttgcaaattgcaacagagcaatttattctcgatagataatatcgatagtataattgacaactaaaaaaacaccatagaaataaattaatatgaataccttaataggagaccacaaatatctcatgtcccttataaaaaaaaaagagcttcttcacacattttttgaagcgaaatcatcgatgacacaatgctacatatagccaagccattcaaactttcctgtgacatagttgaccaaaaattgatattctcgttttcttttgttttttttctaaacacccaacaaatatttcctaggtaacattattataacacctgaaatagtgaaattgcaaagtaaattatataacaataactatgaattgaaatgatagaggcatagccgtatagagccagttgggcagttggttcttgcactggtggagaaaggggctttactcccggttggggaccccctgtagtcccggttatacaaccgggactacgaatccgggactaaagatgggtatctttactcccgggtgaaatcttttttcttaaatcgatttgctccctaaatatccccgatcacattcccaaatcatccccaaatcaaagtagcatcacagatctaaaaagaaatacatcacatattgaaaagaaatgcatcacagatcataatacatcacatcacagaatcttaaacaaaaaatacatcacaaatcctaaaagaaatacatcacaactcccagatcagatccaatatcacgtacatcacagatcaaatccaatgaatcacaaattcaaaaaaaaaaatcggcaacagagaggatggcgctgccggcctcccggccaccgtcctcgcgagctcgcccggccgaccgccgcgcccgcccgcccggcaggccgccgcgcccgcccgcacggcggcggcctgcccgcccggctgccgcacccgttcgtccgcctgccgtacccagacagccggc

SEQ ID NO: 52609 - DNA, 14434 bp, Oryza sativa
  unsure (1)..(14434): unsure at all n locations
ggaggggggggtactccatcctctttagccgatgtcgtatgtcggcatctgcgcgacgacgaggatgacctggagccatcagcggcgcggattggggctgcggtggtgcggagcgtcggcgatgtatggagcaggcaggatgagacgacggcagggggcggcggtcgaggggggcgcgggtataggggaaggctctatgagggaggagggggagtcggtggcggcgggtgacggattggggtggcgccgtttttttttgttgcggaggaatcgtgtgcgcttttttttcggaagaggagttcgtcgctctcaacgtgtcgatgtacgtcgcatgtctaccttggcttcaccatcaccacgtagtagagataactgtgccatgtgtaattgtattgtaaacatatgaaatttccggtgtattaaattagagcccacagctgttcattattttctgatgaaattacacccgtactgggccgagtcgcgcatcccccgagtcccgagtcgcggtcgcgcatcgcctctacgcgagggtgcaaagacagaaggagggatgactgaggcagcggcggtggcagtggtgccggctgcctcctctctcgcgactagggcgccaggcggaggtttgggcggcgccggctggaggtttggacggctgagggctcacggcggcacttggcagtgggagcggctccccacagccacggaggcgcacggcggcgccgcatagaagatctggtgcaaggtaacccaaaccctagactctctccctcaaaccctagacatctcaaatctggttcattttttgggattgattgcctggatgctggttaaaatttccgatatctgtgtctattattgcttgattttttctgtatacttcaaccacattatcactgtacttgccaacttagatttctagaaagatttggtcagcaaaatttagtaccaacttagattggatacttgtactatcgatccatagatatagtttacatgagatgtacaccaaaccaacttgtgaaacaacaaagaaaaccaactgtaacatcgaggaaaaaaatactattcaacacctttgagacgacagagggtgaggtgcacacctttaataaggcaatgcacctcatgtgtaagcctgccagtggggcgggtttgatttggtgaaatgggctggatgctgatttggatggtagtggttggattaattttgaattggagcgggttggcctgtgaagaattgtggtttggactggagtggatgcgggatggcctgtgaggacaatccatggactcagcccatgggttagccagtgcacctgtgcactgcgtgccgccacgcgcggcgcagagcgctgtcaccgccgagcgccaccaccgctgagcaccgttcaccgccaccgccgagcgccgtcaccgccgttcgccgccaccatcgccggactcactccccggtctgcgaggaggcagccgagaggaaggtcgttttaggcctcgtcaagaagagggatcgggcaggcacagtcgcttggcatcccgctctccaccctcgacgaccacctgcgcatcgacctcgccatcgacagcgctgaggttttgaccttttctttcacttctttttgattaattcagttccatgctgattgtttgtcctgcaatcccttctacctttgctaacttccctcgcgagaaaaaaaaagttgtagctttatggagaaagtagacaaaaaaaaagaaaacttatatggttgtgggtaaggaacttaaattggcagctcatgcaggaggtcacgttccagattatgaaggagagaacagtcttagttgtcagttcttgattatgctgttagtggcatgaacttcagtggtagtcaaccatgcaaaaaatttgcccccattgtactcctggatggttggaggacaatctgtcttttttttttttgtcatgcagattagctagtagcattcgagagggtctatctttgtcattttctttttctgctgtgtagatttgcatctgaaaagtggataatttagcaatatgtctctctgttgtaaaggggtggataggaactagtaccaagtaaataatttaatatgatgctttaattgtaatgataaatccagcaagattataccatgatttgcaaatattaatcattcccatctgtaatatatgtcattagtaaaaggaaacttaggcgtatgttggtccaaagtgtcatatattgataactagagctttatgttggatctgaatgactatctcctaaatcattgccaggtctggtagtatgagtgttaatttcatatatgcaaagaaccatattgccagaagcaaaattgttcccgccaacactccgaccacataaaaattcatgaagtatttttgtggaacagtaaacttctgcagattggaaaagatcaattcgagattatcagaaaaatacagaagttgaatatgagatgaactacaccattagggatcctcaattttctggaatggtatcttagcatggatgaaatattttatcatcagctcttcagttttttttaggatcaaacatgaaattttccacgggttgtttcctaactgttgctacctatttctaacttcacaatcaactagtggacaagattcacaaaatatggtttatgagatggctggttcctgattttctagttgatgataacattaatccacaatatttacactgtgctttttgaagaccatctatcatgataagcttttgctcaaaatgttccctcacttttgctattttacatgtttgagatttgtgaagacaattcatggctagagctattagcagatgaagtttcagaattatgcatagacatgcttacatttactacttgtgctaaaaactagtgaaatgataagcacaatgcaaccatgacaatatcatgtagtacagtataaacagagataagtgtgaaaagtaataagattagtgataatcaacagagttaatagaccaaatggtgtagatgaacttgcataataatccaaatatccagtaatagctttgataatccaataatcaacagagatttgaattatttatatttttattagcaactttcaaactgtaagtgttgattttagtcgaattgtgatgctatgagatataatctattatattattaaaggaatagaaaaaggagcctccacgttcgctctcatagcctagaaattctcacattagtcggagaaaaagaaaaacagagtccatatagaaatacaatttagaaatagctaaattcggaattaaaaaataaggaatattaaaagaggagactagagtccatatagaaatacaatttagaaatagttgaaattcggaattaaaaaataaggaatattagaagaggagactagagtccatatagaaatacaattagaaaataactgaaattcagaattaaaaataaggaatattagaagtagagtataaaaataaggaatattagaagtagagtatagagttcatatagaaatacaattaggaaataatagaaatttagaattaaaaataaggaatattagaagaggagactagagtccatatagaaatacaatttagaaatagttgaaattcgaaattaaaaataaggaatattagaagaggagattagagtccatatagaaatacaattaggaaataactgaaattcggaattaaaaataaggaatataagaagtagagtatagaatccatatagaaatacaattaggaaataatagaaattcggaattaaaaataaggaatattagaagtagagtatagagtccatatagaaatacaatttggaaataattgaaattcggaattaaaaataaggaatattagaattagagtatagagtccatatagaaatacaatttagaaataatagaaatttagaattaaaaataaggaatattaaaagtagagtatagagtttatatagaaatataattaggaaatagttgaaattcggaattaaaaataaggaatattaggagtagagtatagagtccatataggaatttaaaactaactaaaattcggaataaacataataaaattaaaagtagagtttagagtccgtataaaaatacaatttacaaataactaaaatttgaaattaagaaaaacatgggaagaagagtttaaagtcaatataggaatacaatttagaagtaactaaaattcaaaattaaaaattaaagaatattgaaagatgagtttagagtccacatagaaatataattagaaataataaaaatttagaaataaaaataaataatattggaaaaagagcctagagtctatatagaaatacaatttacagaaaattcgaaattaaaaaaaaattaaagacgagtctagagtccatataggaatatatataatttacaaataactaaaatttgatattaaaaataattaataaataacacgtatataaaatacaatatcaatattacacattggtagtattggtagttttgtaatgttattgtgaaatttaaagttatgttgtcaatttaatatattttagtaatataatgagaaaacatatatgctactatatgagataaaatataatgatgttagccgcacaatctgcgcgggccaccatgctagttgctttattatgtcataatccgagcaaattttgtgggctcacggtgttataaaatttttgaacatgaagtaggaacacccaacaagaaattcgttataaaatttttgaacatgaagtaggaacacccaaaaagaaattcctggagttgccattgcggcgtcgccttccatggagagcgagggctggcctgccctccagcctctgctgtgcttcgcctggatcgccgccacactccccatcattgccgctgcgctgccaatccccacggccgttggaggtcacctccttcgccggctgctctcggccttctcctcccgcggcaagaccgtgaggccctcccccgcctcatcctctggttcctcctcttctaaggcggtaagatcggttcaaggtgccgcaacacctatttgctgcttcgccttttctgttctcattggactatcgcatggagttcgtatgattccttggtaaacgtaacttggttagaccttcttaagttaaacggaacttgttcaaagcaaatataagtttgggttgtttaagtccaaagtagctagctactgttttgtagtgtttagttgatgcaaatctgaaatactatcgattgatcttgagaagatgataacattttgaagaaattcgttcttaatcgttggggaaccactcccgagttctggacttaaaacaaattttttaattggtgtttgtcgacatgatacagtcagtttttctgtcaacttgaacattcagttatgctaacttagctatacaaaaaatacataccaagccagttttgtgagtagaaactaacattatatagtaggatcgaattgattcctcatcggtttttcttgagcaattgttcatccaattgatgatcaattgcacatgagaacactcaccaaatctgtagttcatctcatattcaacttatgtataattctgataatctcaaattgatcttttccaatctgcagaagttcactgttccacaaaaatacttcatgcatttttatgtggtcggagtgctggcgacaacaattttgcttctggcaatatggttctatgcatatatgaaattgacaccattattgcttgagtcatcaagttattccacaattttcagtcatcttgtaggctcaaattcattctcttttggtcgtgttcgctcgcgcaccatgggacacaagtatcgtgtctggcgaacagtatttgcacttctattgatggaagttcaagtgctgagacgactatatgagactgaacatgtgttccactacagtcctgctcggatgcatattgtaggatatttgacaggtctattgtaagctccatcttgttttatatcttttatgttctagatctcccatggcacatttgttgtgaaaaatagcccacttgagtagttatcatgtcctttactttattctgttgttatgttacatgattatgcttaaaggtttataaataattcttgtatgcagtttctgcagctcatacatgtaggttgtccacaaaatatacacccgtctaatgagttaatttactgcatgatttttcattgacctgaactaataaaaagaaataccacttcgttagaaaatagcccaagtgatgctgataactacactgttcaattcttgacattttatttgctttcttctgccacagtgcttatattaggaagaggatatgcattcatgctaccgatgataattttttcatattattgttgttgtacttttgttttcatgtataacattttcagattgacttatagtttggtttttcttcatgccagctactatgtagctgcaccattatctctcgctagctcttgtattcctgaagcagcagagtattttcaaggtcaagtacctgagttcgtagtaaagggtcgtgcgagaatgccagatctagtaattgattcatcatctctactacagcctcttctaaagttggggtggacccagtggataggtgctgttatattcatttggggttccctccatcagatccgttgccatgcaattcttgtaagtatctgctctctaatgtccctagatatactagcaagtttttttttacatatatcggcagcatcagaaatcttcctaaggaagaaaaagaaaagaatgaaataaatccacccatatgctgtaagttggaactgtcaaactgcaactgcaaccataacttgttagtgtaaagctgaaggtatggcttgctggaactgttctattttttgagagggtggagcccatcaggcttaaggaaccccatttacacaaattgcttggtcaatcaacatcaggaatcttccatgaaatgccaatcatatttaatgggttatgcatgtttttctgtttctgtatgtcagaaactgtggtattattcatcgttgtcttggaaacttctaggctgcggttaatattttgaatttcatggtttattttttattgcttttacagggatcgttgcgtgaacacaaagattatgatgaatatgtaattccttgtggtgactgctttaatcgggtctcttgtcctcattaccttgctgaactagtgagtgtttttcctatgtcctcattttcagtatgtggcatatactgttttgcaaaatatggcaggtcttgttactctgcttatttaacaacgtcaagttagattaggcctatcaatattttcttgggtttgtcaataaaaatcatcttgggaaagtttggacggattccaattggtggaagcactggactgagtgtctgagtagcttctggtccagcttcaactcctggctggaataggttgggggagaagcagagaacttgtatgttgcttttgctgggatttagagtttttacacggaagctgaattccagtgcagacttctcatcaaatttgttctgttacccatttcatcaccgtagttctctgagtgcagtaccatctgagagtgaatatgtccttttagtatcacccgtactgacatatgcgaacattctttgcatggcttaaagatgataaaactggataatatcttttgagttttcatattatctcacttgtgtgaagtaactagatgattctaacatgacagcacatatgtttccgtgtagcagaattggtgctttttgacttgacagttgatgcagtagggcactgagctactaaaagagctcctgtggttttaaattattatggcattaacatttacagttactttggcttgtaggtaatatattttggcatgttggttgctagtggtgcagaagacattccagtgtggttcctgttcatatttgtggtacgccgtacagtaactttttgaacaaagatactcagaatccaactaacgtgcaattatcatctacatttagtttcttttgtttttgttccagtagattgaactatcttttttcttttttcatttttgcagatcacgaacctgtcatttgcagcagtagaaacttacaattggtatcttcaaaagtttgaagactatcctcgctctcgctatgctatcattccatttgtatgctagtgtctacgaaatggctacattatgtaaagcttatgtatttgcacacaattacgacatgtaacttagcttgatgtaaatgtgataacaatcatacaacgtactaccgtagaggctggaagtttaatatcagagcacctatgtacgttgccagtagtaatctttgtgcttctacagatttaaattacatgccaattatgtcatcgatgaaacatgtttggcattttaaacttaaatgttctgcaactcaaagtgatctagggtatgttgtgctcgtcctttgtataaggaaaaaagtgccgtcatgtttagagacccaaatacctgatctggtctggaaaacggaagacttctggatttatcagagcgataccatttgaactttaagctttaggcagatgagttgctataattttctcaaccaaccacaagtttaatacagtgacaaggtcatcatcctctaaagtagcacgccgtcaaagcaaattaacagaaggatagcctactaaaagaagaagctgagctgatgaaagtgagcaagaggtgccagccaccaaccctcacacctggccggtatatgggggtgagaggcgtttagttagaaagcacatccactgatccgcgagaggggacatgctccttgtcttttctcggctaatcctccctcgtggacatgtattcaatcacattgccgactcggatcttcttttgaagggagagcgctacgcgtcggacatacggcgtgagacgaaaaatcggacgcatccatgagccgtctgatccgcacacacgctatcagccacccgacgtcatcaagcattcatacatgcaaaactattttaaactattattttaaaaaatatttatccaaatcatgattcgattgcactattaaattcgttgcaattaaatctttaaaataagaccacacatggatatattccgatgaaaaaaatagcttattattgattttttttttaaatgttgcatgttattccaccaagtatattggaattttttcactagttagatcgaaaatgtttcaatcgtttaaatcgagcattgtttcaccttatatgaaaacaatgttttagaaaatagcgaaagaatgtttcaagtcaccacaacatttgatccatataaagtaaaacattataagtacactaggtgaaatattttttgtggaacaaagaatgaaatgaattatcttaatagagagattccataatatgtggttgatttattgcaaaagaatttttcaattcgctgcaacattagatctatacatagtgaaacattgtaagtacactaggtgaaacatttttagtggaacattgtaaatacttattgaaacacttaaccaatacatatgcaacatttacaaataaactagtgaaacacaataaactacttactgaaacatacaaatagcaccatgagatacattaaagaaaagatatatacattgtgacaataataaatatgtgcaacataatagaattttagctgaaacatctgattctcacatatgaaacattaagtttaattggttgaaacatatgtgtgtgtttttattataatatagttatgtgagatcttgttgtaaagatttaattataacgaatacaatggtgtaatcggattgtagattggatgagtaatctagaagaaaaatcgttttcaaatttgctaaaagggtgttatgtacatgcaaataacctcgtgtcatctctcctttatgcatattaatgctcagaaaggaagcatatgtaacagatagaggatctgacaaaggctgtatgcggcaaaatcataataagaggtgtccgatttttttctcaagatcgaacgatcggattgaagcattttccttcttttaagtgttgtttactacagctcttactagtataatccttgttcttttgcacggctaaaacactagctcagactactcaacgacagacaccatcagagctgaactttccctggttcaggtgttgggatatggaattagaatctatccgtggaactcagaaaaagaaatttgcaattgccactgttttatcagcgagttgctagtgcttgttcgtttgctcgctgcactatttactttataggagcgtggtgacgttgcaggagttggtgccggaaatccgttaactgaaactaatgagataaactcagaactgatagtgaaatgccgatacagtagagtaggcgcctgaaaactgacgaacataaggcataattggaatccgacgtttctcaaggttcgttcgtcaaaattttcagcttcgatttccaacgtcactgaattggatgccaccgtgtgtatagcctaaacatctcatttttaatgagagaagagatcaaattcggcatcgatcaattcgatggtttcttgatggtcctacgatgagaagttgagaacgatgtgtgtgtgatgtgagagccagtccaacctctgccgttttggacggctttgccacgggcagcggacaataagcgaaaacgcgacccaaaccttctttcggcagctgcctctcgtcgtcgttttcccgctcattttctgcatttcggctgggacttggagtcgttttcttctacccatgaggacacgcgaggtctccgctcggagtgtgtgacagtgtgagactcatccaagagcaacaatggtgtgatttctcttacgctttgtacatccacaagttgacatttattgttttttttcgctctccatatttcttcacgattcaatcaatctgccatggtgaggtcatgnantanctcttcnnccatnagtnnangncctcaccgccattattcagtttctgtgtattgggcttcttgtttaagaatttgagatgcgtccttgatgctttgtgnntttnggnnaannaaattnaaagtggaaanncttggatctaggaatgcttaattattttcagattattcacctgatatttgcacaatgttggaaaaaataacattttggggacaaaaaaacattcttctattgtatacttagaccacttattttaaattatttattaatgttgtcgaatgacaactgtgtccgtcgaagaacgtggttcgctcttggtggaaataaagcagaaaattaatatttttattgaaattgttgggatcctcccattacatgccctatggggcctatttttaggcttagtacatgcccctgcacgctagggttactaagtagagagaaatttatatggctacccttatgatagtaacatttatgagggtaattatagacaatatgaccttgggcccttatatgggccactaaatgggcctcatagggccattcggcctgcttggttattgaggctacagcttcgggggcgaaagggctcggccctgtggtgaaggcctcaggcttcgcctagcgcttcaccctgaagtccttgtctttgcgatcctcggatctctaccgcatgtggtacgccttggtggttgtggatggcgtttcggtgacatggtcgaaggtcctcatggcatgcctgcaacaagcccttcacgggtaaggatgagtagtgagcttcggtcgagaccgtgtaaagccccgggtatggcatgaggcgccccctttcggccaatattcccgtcgaaacctatctacttttgagaaaaaaaaagtcataagtgaaaaaatctatttccttttgtcgacgtttgatgtcgcgattccggtatttgcatagtatggggatcgttggtactaggatatacacgagactggggtaaaagagatggagacagcgatttttatacaggttcgggcccctgcattgtcaggtaataaccctatatcctgttggtcgaagccggttgttgctcttattcatcataatcacaccagtacaatatttggggtagcctatctaactgttgtcgacatggcggtctgaaggtctgactcgtagtcgacaacagggtagctttcctcctcagtccgcatccggcgagatcagagacaacgctatatctctcctgacggtatccgtaggcaccgtaggggactagctatgcctatctctgaagtcgatatctggcgtcttggcttggcgtatgttggcttgtatgttgtggcttctgttgttccgtgtcccctctcctcntagggagccttatatttatacccataggtgtccccttgtccaagtagaactagggaaaccaatatagatacaatccgagtagtccttgtcgtttccatgtagaactctattcatccttccttatgcagaactcttcctatatccgaaagttgtttccgtataagatatggtatgtggtgagtcctgccgagatttatcaactactattaggtatgtggtatccataaccctgacacctttgcatttatgggctctttggtggtccatttttgccttgggagctaacggttcgcattcggccttttactgtgtcatttgcccctttttattgtgcggcccacgggctatcttcgcgcagatagccgttggttcaagggatgcatgccacacatcgcacatccatcggtttggcactcaacggtcgcgagggcggaggagtataaatccaacctccccctttcccccggaggcttacctcagttttttaccgcagcacttttctcctcaattcctgcttcttgcgctcacgcgttccaggaagacagctattcacccagttcccctttcacctttgtagcttcgccacttctcaagccgaaatggctcctaggaagactgcttcggccgcgacaaccgggcccgatctcggagcgatgccggatgacttgtccagcttcttgggcaagttgtttgtcaaggagggtgatctgggcgaacttgtcgcctctggggcagtcgtcgaagggcaagctttccttagcgcgagaaaaatataattatgaatagtgtacattgttattagaagatggttgttccactaaaatgctacatgagacaattttcactgtgcgcgtgatcgacagtttagcaccgttgttatgagaagacagttccactaaaatgagacgtggcatttttcactgtgctcgcgatcgacagtttagcaccgtcacgtacccctatttgaggggtggctcggctctttctcctccatatagctaattcagccttagacacatggtctgaccgcagtgtattgtcctgtctgaccggccacacaatggcggtcagactggcctttgcggtaaatgtcctcccaacggtgacacaccttctcagacaaacagagatggcttgttttccttcaactatctgccatgcatgtatgtctctaggatcatagaaatcaaaaggatgctcaccggagaggaaggaatcggccacggcggcatttagccggagttggagaagacgaaggcaatctccatctccggtggacgaatattgggaaatcttgaggtattttggagaggacctcgaggggaagctggtggcgcgacgactcatcttggcgtggtccagatccacggcgctcggtgcatgcactggagctcccgtgggcatggcggcgttcccgtcgttgcagtggatgaaatgaggtggtgtcaaaagggaacttgttcggcatgaagggtagaatatggaatgggaaagagttggtgatggagatggctcgacgacgggtggctgcctccttcttcttcacggccggcaacgaagaagagatggaagtgggaagctagagctacatatatctcttggtttttcagcttagagatggagaatgaagtgtggcgacgtgatctggaggagtagagcgaaaagtctaatgggcgatcgatcgcctcgaacgatcacccccctcctccacatggtttcctttttaggcaccgcattactttcctattttagtaaatttatgcgcctaaagtttgtacacctcaagtttacatatctaaagtttatacacctaaagtttagagacccaaagtttataagtcaaaagtttatatatccgattcaaatttaaatttgaattcaaatattttttatatatagtattttctatacatccaaagtttatagacccaaagtttataagtcaaaagtttatatacccaattcaaatttgaatttgaattcaaatatttttttatatagtatttctatacacctaaagtttagagacccaaagtttataagtcaaaagtttatatatccgattcaaagttgaatttgaattcaaatattttttt

SEQ ID NO: 52610 - DNA, 21394 bp, Oryza sativa
tgaattcaaatatttttttatatatagtattttctacacatctaaagtctatagacccaaagtttataagtcaaaagtttatataaccgattcaaatttgaatttgaattcaaatattttttatatatagtgtttctacacataaatttttctaactttgttttttatttttttaaatttatggtgtagtaataagagaagaaggggaggaggaagggggagaggagcgaaaagtctaatgggcgatcgatcgccccgagcgatcacccccctcctccacgtggttttccttttttggcaccgcattactttcctattttagtaaatttatgcacctaaagtttgtacacctcaaatttacacatctaaagtttatacacctaaagtttagagacccaaagtttatatatccgattcaaatttgaatttgaattcaaatattttttatatatagtattttatatacatctaaagtttatagacccaaagtttattattcaaaagtttatatacccaattcaaatttgaatttgaattcaaatattttttataatagaaaaaatgcccatgcgttgcaacgggtgaaggttattttaactttattattgttatacgatttagttaaggtgaaattcattgtgagaattcgcttggatatatatattttcccacgaaattatgagctataattaggagtccgatcatcttgtcgacggtgagtaaccgtagaccggatatagagggtattggggtacgctggtacgaggatctacgtagtacgacatcaaggaaacaagagagaaagattataatggtttaggccccttagtaggtaatagccctaatctagttgatatgggattatatggaaataaccacagattacaaagggaatagtagaactcggtggtaccgacgagattgtagtcgagttaattagactagaccacccggcgacttggctcctatagtcttcggcttcgtaggctgtggtcgtcgtgtagcctatgagattcgatcccttaggtccccgcggggggtcccttttatatcgcaggtcaggcggtctccaagtaggactcggaggcatcggaccctgcacaatatagtaacgacccagtcctatacgggtaggaacctttccattgacagactttgtgatggacttccttagcgtattcagaggacgtccgtatatgcaccgacataccgtattgccgtatagcatacgtccaagggtagagggtataccttatccgtaaccctgacaatagcccccgacttctacttaaatgaactcatgtaaccaatcgcgacttctgatgtcggaattgttgtcgttctcaactggtcgatctcggtgtgaggaccgtagagacaaagagtgttcgacaacaccatgcgaagtccaacggttatgagtaaatttaaattaaagtccaagaaaccgcctgacgcaacggacccagaaatttccggtggccatctctctcctttccttggaattcgcaccgtcggtagtgcgcctatttaagggagttttgggaatccattttggagtccggctgttgcgagaaactttcaagccttcaggagctcttcgtcttctccgcttctgcacaaaccctagcttgttcctctcagccccttctccggtgatcttcgacggggatggagctcgacaagtccacttctaccagcgcgtcgctgaagaagttgcaggaggaaggcgctctccccggtcgcaggaccatggagagggaaccaggaggtattgaacctaaacctgtcctgggccgcatggttgcagttgaggactatattctctgtggtttccttcctcctccctctgagtttcttcttttggtcttgaatttctacggtctttctctgctccatttgaaccccagctctatcgccttcctcagtatcttttctcatctttgtgaggcctatattggggttgacggagctcgtggctcctcaccgggagaccgcgcaggcccccctttgccagttcggccgggggcttagggtgaaatctcaagctctcgctctctctgtatgtggaaatatcgtatgcccgccagaaaacacgagacaccgacgatctatacaggttcgggccgctgagaagcgtaataccctactcctgtgttttggtggatctgcgtatgaatgagctacaagtgtgagctgacttctcccccgttctaagctcatcatctgggaaagaatcaaccaaccccctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggaacatggctgtgcgctgacgatatggtcagtgtcagaccggtcacaaatcggtcattcttgtccaccgcgtgtaaacttggcaacgtgcatgtttgcccttcttcacacaacatcttgcctgtaatggttaagatgaagcctggcatatatcgaccgggtctaacgtgtcatctctaagggataacacgcttaacgccggcttgagacgagtgactagaggctttcgtcttgacgggatggggcatggcgtgcgtcagaccgccagtcgccacctaacccgtgatctgaccggtctgtgactggtcacagaccggataaagggacgcgccgtgctgcactgcatgcagcgtgacacgcttgaccagactgcaataaatgctgttaggtgagcacagctgtgctcacttatcccatatacgtggcgcagacttcctaaaggggtcggggtgcctcggccctcggggccggggcaagcgcaacccgacccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacaggggtagagccgtttcttgacctctttcgcttctactatgagttgcgttggatggaatccaacagggtgtcaggatgcgttggttttcgacttagggatggcctgaagtcgcgctatatccccttccagtgcccctcttctcgtagtaaatggcgggtgaggtggttagaaaattcggatccggtcttggttgttcccgaggagcaaccgaacaatatttcgtcttggactgccaagcccgccttgaccccctcccttcagtctttcatcgatgtcatcgatgacctccgagtgcgagggttgtcggggtatgaagtcgctgctgacttcatcggtagacggatccagccgctctaggctcgagcccatctagcctttgactactcagggccggaggatgcgacccgggtttctcctcagggtatttttctcgtattctgggttccattccttaagtatatgttccccctgacttatcaattttggttctcgatctataggtttgaacagcgaaactgtagagcgccgcgttggtcaagtgatgatcagcggccctacaacggcgagcaacgtccctgttgctctttgcgagaagggggcagccgaacgcgaagccaccatcaatgtaagtgtactcagcggcccttttgcatttttctttcgggatcgcattgtgacttcatgaagcgtatgctctccctctgactgatattatcgggccactcgtggaccatcaggcggcggcgtggctgaaggagaacgtcgccaaggaggtgtctgatgttgctgctgctgctgccacaacgagtggcggcaacatcccgagaagggggaggaaattctcctccgtgatcggaaatcgtcggaaaacgcccaccccctcgataagctctcctggtcgttcatcgcgtagtcggaaagcttccacctcacatcatgcccgttatactccaggcctcggatgcgtctccccgcctccgcgacggcagcggcttgtgacgcttggcgagaagtaagtggatgaacttgaggttttgtcgcttcgttgagctcttgcagcctgtctcaattgcagcctttcacagggcggcgcgggcgaaggcggcataagacggatctggagggacttccagcgcgtctcctgccgtgtcctcgactgatgtcgtggtcgtgcccaggagccgcgaggcgacgcccagcggcccagtcagcgatctcgcggctggtcggggtccgccggctgtcgtcctcacctaggaggagctccaggtcaagatggggcgcctcctcgaggctggtgctcgcggcattagccacgagatcgtagaggcgagggcggcggcggcgtcgtcggcgaacgagcgcgccgaccggctgacgcatgatttggcggaggtttgcaaggacctccagaagatgagggaattggtggccggcaacgagcgacaacggcaggggctcgagcaccgtatgtcggagctcgagaacaacttgttggaaatctgtggctcgctgcgggtcacctacactggtctgcaccagctcgccggggagtgcggtgtcaagaccaccatccctgcgaatcccaatgaattctcgctgatgacttcgcttgcggaactggcgacggcgatggaggcgatcccctccaagcacgcggccaggatcgaagaggagatgtctaacgggatttataccggggcgtgccatgtccttgcgtgtgtgaggctggcgcatcctgaactcgatcttcggaagatcctggatcagggggtggctagcgacgcgcgcaaggatgtgatggaggaagtcagagacctgggggagtctgtcctccccctttttgaagagtaggaccgccgcttgtttgtaccccttaaccaatcgtgctttgtaaaacttttcgttggttccaactgcttttgtgtgtgcaattgttgccttagttttctttggcattttgattccaggtactttgtctgttgtttgtagagatgtcggtgtcgagaatgtccagcagcgcgggcagcctgaattgcttgaggttgcttcgacacttgagctcgagccgtacatgccgcgggatggcatagaccaggatctgcccaaggagacggacgtggtgtcgacttctttaggttggctcttgtcggttccctttcctttacctcgtctgtcttgattgggttgacttagatgtttgcatgttgagcagacctcgagagtgtgcttgctgatcacgaccgtcgcatccagtattggaggacgaagtttgaggtcgccgaacttgagaggactatattggaggtgaagagggatcgggctgtggaggcgctccgaggtcgcgaggtatggttcaactcgtacctcaggagttgttgcataaccatggccgttgtctgcagagagctccgagtacctcgcggggatcccgaggagtcagcggctggctacatctcgtggctgaacggggcttgcgctcagcttgaaggcatcggcgggtgtatcgacgaggccctaaaacaggaatgtcgtccatcgagtcgatacgccggagggcacatactggcgtgtatacgagatcatcgtccgcagttgcacctcgagttccttcacgaagggttttcccgttctcggaggaaccctacggagatagacaacctagcgaagttgatggctccgctagctgagaaaatcttccattcaatggattggcattggccttcttggtagtgcctatatatctgtgacaaacatcttaagaaaaaagtaatgtattctggaattctttgcgatctgtaagaaatgcttgtgaaatagaaaggaaatctatctaactaagctttcttatgctgggtacggtgtgcacgagtgtcttctcacttcacgacttcgatcagtcacttgagttatacactctccctagcccccagccttgtcgtcggagaactcttctcggaagataaggctcttggactctcgaccatccttagttgaataagcactgatccttgcccccggccgtgaagttggaaaaatccatttccgattacacggcttggttaatacgcatggcgagaacacttacacgaccagatcttacatggtctttcgtctctgaaggatccgacaaggccttatcagctctgggcgtccccagccgaagttcccttaggttctttggaggccttgtcaagatggcgtaaagggacatgaggataggtttcaacgctaggtgtcgtctgggtaagggatcatcgggaaggggcactgtgattgaaatctgtgccttaaaacagactttattgaagttgtaagatgtcttacaaatgtggacactattgacttatacataaaatttatgcaattggtcaatgttccatgaatttgctagctcacgaccatcgccgtccgcaatcttgaatgagcctggccgcaagacttgtgtgatcgtgtacggtccttcccatttgggtgagagtttgtttcgccctgcctggctttgaactcgtcggaggacgtaatcgccgatcgaaagtatgcgtgctcggatgcgcttctcgtgacatcggcgtagggcctgttggtagctagctgctctgacggcgacccgttcttgatgttcttcgagtaggttcatgtcgtcgtttcgctgttcctcctgatcctcgtcggagtacttctgtagtcgtgtactctgatgacataacttggtagggagcatggccttcgagccgtacacgaggaagaagggtttctctttgttggacgttgtcggtgtggtgcgcacgacccatagtaccgaggggagctcttcgacccacttcttgtcatgtgacatgagcctatcgtagacacgggtcttgatcccttgtagtactataccgttagccctctctagccctctcgacctgtccgttactctgagggtgagaaaccgaagcgaagcatatcttgactcctagtccgatgcagttgtcttggaaatcagcgctgatgaattgggagccgttatccgttatgatgcggtgaggcaatccatatcggcaaaatatccccttaatgaacttgatggcgttgtcggccttgatttcccccgtgggtgttgcctcgatccatttagtgaatttgtcgatcggcacggacaggaatgtgttgcttcgatccatttggtgaatttgtcgatcgccacgaacaggaatttgtagccgccctgtcctcatgggaatggaccgagtatgtcgagcccccagcacgagaacggccaagtgagagggatggtttgtagtgcttgcgttggtagctttgtgtgtttgctatgaaattgacaagcttcacactgttgtaccatatcgcaagcgtctttgagggcggttggctagaaaaatccttgtcgaaaggcttttccgaccaatgtacgaccggcggcatgtgacctgcagaccccttcgtggatgtcgacgaggaagtgtttgccgtcgtcagacgaaacatattttagaagtactccgtttggcgccttcttgtatagatcgttcccgatcatacagtagatttttgcttgacgggttattttctcgacttctgcgtcgtcctcgggcaactcattgctgcttatgaatttaatgagtggggtccaccagtcatccctggtctcgatgtcggcaacggcacaatctgcctctgtagcccccgagccgatgtcgggggtgactgggctatcttcgtcatttgcctctttcactgatggttttgtcaggatatctagaaaggtgccgggttcgagtagctctcgtctggacgcacgccgtgctagatttgatgggacctcgatcccatcaaatcttttttccagcttcttgacttctgcaagatatttggatagctcagggctagagcatttgtaatctttgtgcacctggtttgcgactagttcggagtcccctttcacgatcaatcgcttgactccaagtgcagctgcagctctcatcccagcgagtagtccttcgtactcggctgtgttgttggtcgccctgaagttgaggtgaattgcatgcttgaactgatctcccgaaggtgatgtcaagatgaaccccgcacctgctccttggctgttgagcgcgccatcgaatgccattgtccatgtttcgttgtcggtctggctatctaacctgttttcaggcatagttcaatcggctacgaaatcggcaagaacctgggacttgatggctgttcgtgtataaagtggatgtcaaactggcttagctcgactacccatttcgtaatgcggccgacaacgtctttgtttctcacgacctcgccaagagggaaggcggagacaaatgtgactctgtgggcttggaagtagtggcgtagctttcttgacgtcatgattactgcggagagcagtttttggatctgtgggtaccttgtctttgcgtcgtgtagagcttcgttgacgtaatagattggtctctgcaccttttctctttcgacaacaatgacagtactcacagagtagggcgtagtggcaatatagaggaacaattcttcattaggttggggagcaacaagtacaaggggatttgacaagtagcgcttgagtgcgatgaacgcctcttcagcttcctgtgtccatacaaatttgtcttgcttttttagtagtgcgaagaagggctgtcctcgttctcccatcctagcgacgaacctacttagcgccgccatgcatccggttagcttctgtacgtccttgagccttgtgggcgacttcatgttctcgattgccttgatcttctcgggatttgcttctattcctctgccagagacgaggaatccgagcaaattgcccgacggtaccccgaacgtgcacttctcaggattgagcatgaggcgatatcgtctgaggttgtcgaaggtttcccgtagatcgtcaaccaatgagtcgcctgtcttggttttgacaacaatgtcatcgacgtaggcctcaacattgttacccagctgatcgctaagtgccccttggaccgtatgctggagtccaaatggtattttgacgtaacagaatacaccgaacggtgtgatgaatgttgtcttctcgtcctcttttgccatgctgatttggtggtagccggagtaagcatcaaggaagcttaacagcttgcaaccagttgttgagtccaccagttggtctattcgaggaagaggaaagtgatccttggggcacgccttgttgaggttggtgaagtcgacgcacatcctccacttctcgttggcctttcgcaccatgactgggttggctagccactctggatggagtacctctctgatgaaaccagccttaagaagtttatcgagctcttctcgtatggcctgtttccgatctgatgtaaatctccgcagtttttgctttactggcttggcatcgggtcgcaccatacgtttgtgctcaatgacctccctggggacccccggcatgtcggacagctgccaagcgaatacgtccacattgtcgcggaggaaggtgatgagcgcgagttcctatttctcgttcagtgatgccccgatcttgaccgtcttgtcggggttgacactggagagtgggacgattttgattgcgccgtctggtttcggcgtcttagtcgttttgatcactttcttgggtggctcggctgtggcgggtgggctgggagtgtactcgaccatgtcgaggcttcgcttgtcgcattggaccgccagcttcgcattcccttggatagtgattgttccctttggccagggcatcttgagtacctgatacgcgtagtgagatgcggccatgaacttcgtgagtgccgttctttcgatgacggcgttgtatgctgtgtcgaactcagtaacatcatatgttatctgctccgttcggaagttgctcgcttggccgaaagtcaccggaagcatgatcttgcccaatggcttggacgaagattgaggggtgattccatggaagggttgatcggtaggtgtcaactcgcctcatggaaatcccattgcgtccaaagtgttggcgaagaagattgatggagctgccgccatcgacgaggactcgcgctaccttgatattccgaatagtgggtttgaccacgatcggatatcgtcatggtataacagcagccttggggtggtcttcatctgagaactcgatcttctgttcagaccacttcatcttgggtgcagccccctgccatgtcgaacaaacctcacgctctacttttttgtattctcgctttgaagagtatgttgtggaacctccgaagatgtgtgagacatgaagatcagaatctgggtacgcggagtccgagtcctgagtggttgcctcagttgccttctcgactacacgtactcgcttacccttctctaaagccagcttcctttccgatgattttttgaagatgaggcattcctccagagaatgtctgtccgacttgtgtatggggcaccatattctctttgtatcactgccctgtgggtctgggtgtttgggcgggcgttcgtattcagatgcaaggacttctgtttaagctttcctcttcccattcttgccgcttttcttcttgcttgattcgggcgcgtccttggctagcttcttctctcctcccgcctttggtttgtcgtttttgcgtctcaatgcgtcgtctgcatgggcacatcgatcgacaacctcgaataaccttcgagtagtagtgattcaccttgttgccaactcctgggtagtatagcgatctctgacaccggttttgaaagcgcggatcacagaagcatcggtgatatcggggatcgtatttctccactcattaaagtgccgaacatagtccctcaaagattcaccctgattctgtgttaacacgtgtaaatcgtcttcgatcgcgtgacgcttgtaagttccctggaagttcgcgacgaattgttgccataaatctgcccatgaagagatcgagtaaggtgggaggtgcatcagccacgaatgcgcagaacctttcaacgccgtcggcagataatttactaacgcgttgtcgtctgtcccaacggcgtatagtaccgtggagtagacctggaggaattcttcagggtcagaacttccatcgtacttctctattgctccgggtcggaatctctcgggccatcggacatcacgtagagaacggttgaaagccctacacccagcgctgggggcagtgggttgtcggcgatcgtgtgtcctccgtggacgtctatcggatgatgaagacggagatgatgatgacgatgacgacgatggctcactaggctccggtgtgcgattccaagggcgacgttcaggttctcgagagttctgtcgtcgtccaccattgttgtcctgcgccgatctccattatcatcaccgtcatgctgatgccctcgaccaacatcgtctggtgtccgatgttcgtgatcgtcgcggtcgcggcggttgtgacgattacggtggtgttggtctccgttcgagcgtcctcctcgatcttcgccctcgcgacgtcgtgaagaaacacgatgtcgggaacgattctcgttgtcttgcgcgcgtcgtgcttctcggcggccatttagatggtcgtggagatcgccggtgccgcgaggtggaggagtagctcgtctcggcgacgtccgctgctccggtggttcgccgtcggtaccgtcagccatgggtcgttcaggttgtgctctggtagcagcttcctcgaacgcgttactgagattggccaccgattcccgtagtcgttttgtccaacgtgcgagatcatcgttaagcacaggttgtaaggagcttctctcagtattgcgttgacggtgccgagatgctgggccggcgtacccgtctggttctccgcctctgcgttagcctgtgcggatgtgctagtcccaccgatggcaaacacgtcgcgtggtgtactggaagatgacgagccacaatcttcgagtaagtgaaggaccgatggctcgtggggattgatgtcgattactccaacgaatcaatccgaggtcaacgtcactccttgttccttgcctgtatcctcgagagaggttcctgactgccggaccttaggaggcgtcgtcttcatggcgcggagaaagaccttgcagcttgagaagtcatgattcttcgtcttgtgaataggacaatagacatcatgagttggagaagtacgctggattccacgctctttgcaagcacggatttcagtttgtacgttgagaaaaacccagcaagcttgcaagttgtgcttcctggacttgtggataggacaccaggacttggcgacctcggaagctgtcctcgtcggctcgcagtccttgtcggaaggacaaggctcggccgcgctaggaatcttctcgggctcgcatgacgtcgatgttccgttctccgccacggcgggaggatccttcgacatgggaccgtccgggtttataaccacggcgttctcgtttccggttattgatgaaccagccgagattggcaccgtggtgtaaaccgggaagacgatttcgccgacttgagtctacaccagcattgttgaagcagggattccttggatggggccggtgttgactctgttgtcgacgaagctcgatgtcatagtagtagaaccttgagcaccaagtccctctacctggtgcgccactgtcgacggtgagtaaccgtagaccggatatagagggtattggggtacgctggtacgaggatctacgtagtacaacatcaaggaaacaagagacaaagattatactggttcagaccccttagcaggtaatagccctaatccagttgatatgggattatatggaaataaccacagattacaaagggaatagtagaactcggtggtaccgacgagatcgtagtcgagttaattagactagaccacccggcgacttggctcctatagtcttcggcttcgtaggctgtggttgtcgtgtaggctatgagattcgatccttatatccccgcggggggtcccttttatatcgcaggtcacgcagtctccaagtaggactcggaggcatcagaccctgcacgatatagtaacgacccaatctatacgggtaggaacctttccattggcagacttcgtgatggacttccttagcgtattcagaggacgtccgtatatgcaccgatataccgtattgccgtatagcatacgtccaagggtagagggtatatcttatccgtaaccttgacacatctgaagttagcatgtaattttttttaaagaaattccttatacgactggtaatgtatttaaaaaacgaacgaacttaattcaaaattataatatgttgtacgtactgcaagtactaaatttgtaatcaaaattatttgtctttgttaggttgcataattttttttcatatatttactttgttatgattttatagttatttagttatttttaattttggatccatcctaacaatatggaatatccatataattttagctttggcctgtttcaattttgaacgttgttttaaccttttgagtaggtgcaaagccgcatgcatgcaaagtcagcccaacgtgtgaacatgcaaagtcagttgaacgtgtgagtggcttgaactgacatgcagtcgaaggcttgcatgtgcatgcatgccgcgtccctagaggacccggtcacacaccgacacacgaacgagtgaacgacgccgaaaattcgaacgggactcccatgcaggcgacgatgaacacgcacatgacattgaaacaaacaacgagacgggtaggaatcgaaaacggtaacttaccaaaaattttagcaaaagcatcttcaatttttataatagtatttttatacgcataaagtttagagaaacagagtttataagtcaaaagtttatatatccgattcaaatttaaatttgaatttaaatattttttatatatagtattttctatacatctaaattctatagacccaaagtttataagtcaaaagtttatatacccaattcaaatttgaatttaaatttaaatattttttatatagtatttctacacataattttttctaactttgtttttttattttttaaaaaattatggtgtagtaggaagaggagaaggggaggaggaagggggagaggagcgtgttatgggggatagcgatcacccgcccattagcgacacccggagtagagggcgagaaaagaggagtttgaagccgttgacacgttgtggccacgcgttgagcgcgtccgagagcggtcggcgccggttttctttttctctctcgcgttaagcggtgaggaatgaagatggacagggactgggctagctggggaggctgccaagtgggtccaaaccgtggtaacctaggctagagagaaagggaagggtagaaacatgggtagactagattttggatgattttccaggtttatttctcttcccatctttgttaattcatatattaatttgtggtgcagataaattcatgtagattttactggagttaggtgattatacctagatttcatttttttttgcacttaaaaattatgtgcagtttgctctcagaaaaatggagaagatgggctcagcagaattttgtttgattgttagaaggtctaaacagaagaaataaattctggaaaattatagttactcttgataattaacctagtatttgaataaattatttcccttatacacttcccacttccatgcagtttaatgcatattttggtgagttaagattttagccaattaaggtttataattagtctattattagactcgtttgactgatttatttgaggtattagcttaagtgataaattctgaccaaaatttcagtgtgttgtacacattggatagtattcatgtgaatttttccaagatttaattatgtataaatatttttttagtaattgatctagtctatcctttatatgtattttcatctcgaaatgcatttgagcatttatagattttatatttgaacacttctttacctaaggtgatattattaaacttagtttcatacccaacatgcacacaaggactcaaacctaaccatgatctatatgcatatgcatgcttacactttgttactcaaattccattttggtttggaaaggaaaagttttaactagccccaaaattccctatatgcaaaagttgggttgacctacctaggtttaaaatgaaaattttaagctcgcaaaaataaaaaatttatcttccaacaattttgacaaggaattttaaaccctagaatttaggtatgttacagtcctgcaacgggcctactattcgatctgttcacctcgaaggcagatgattattatcagtggtgtatttatgagtattattacttgtaacaaaactaaaaggatactccctccatcccaaaatttgtatgacagtgacgttttttcatataacgtttgaccattcatcatattaaaaaattgatataaatatcatttattttattgtggtttgttttattatcaaagaaattataatcttaatttacacttttgcatatttatactaaactttaaataaaacgaatgggcaaacgttatgcgaaaagtcaacggtgtcatttttttgttgggaaggagggagtatatagtattagtggtaggatctctttgatctaaaaaaaaaatagtgtatgaactcgcccagttggagtacagcccactgcccacaagttcatttcatgaaagttataaaagtcaaccaaattcagcagtgtttaatctttcggtttagtcatttatatcaaggtggccgaaataccaaaatttctaaaatttcggtccaaaattatatgaatttttaaataaaatttgattaaatttgaaaaaaatattacctaattcatgaaaaaaatttaaaaatttcggccgaaataatatcatatccgaaattttgaaccctgaaatgcaggccttctggaggggtagatagttgacctttatgccgacgactctgcaagctgcaacgaccgcttctacctgcaatatgattgatgctatatagtttcttccccggctgcacttcttcatttcttcctcctcttcctccgacatgcacttgtgaagcgactcgaggaatccaataagtgaggctagctccatttcataacagctcatcgggcgtccgtgcaggtactcaaatttcttgccagtaatatttccatcatctatttctgttttacttttgcaaagcatgatggagtagaaagtccaacatggtatgtgcttggagctttacgaaacactcggtcttgaagttgaactgatatgattgttgaaacttaaaaggaactgatgctattcaaagactagataaatccattcatgttccagtcttaagtattatgcacagcccaacaacaatcttctccaaccttcttaccgctaacagactagtttcttaatcacaattcagaactgccagttcaaaatcgaaggcaggagcaaaacctgaaatcccttacttcacatcaggaaccttttatatctatactcctttaaaaagagtagtgatggtggtgattggtgaatctgccaccacccccaccaccaactcaggacccttttggagtaaggtgatgccaaagggtccacacatcaaccacctccaccactttgttgtgaaggaaaaatgatattgtgaggccatagggctcatgttatttaccgatatatctagaatttaagaaatgatgtataaaaaataatgataatagtatgttttttttttggtaaatctcaaagaggacaaggagtgcatgttttcatataagaagaagaagaagagagttggtctagtttttgaatgataatagtatgttaatatcatttttcatcaattaaaatcccgtgcaaaatgctagttagcattaagaatgcatatggacgaaagagactacccattggcatggccaacactcagcaaagaactttttatcaaggttttcaattttttttaaccaaagagatctgtaaatttttgctatacacaccccaaaaaataaaaataaaataaaattttctccgggtatctacttcatgtttgattcacgctaaaattggaagtttgattgaaattgaaacgatacgatggaaaagttgaaagtttgtgtgtgtaggaaagttctaatgtgatgaaaaagttaaaagtttaaagaaaaagttggtatctaaaccaggactttttctcatcccagatatcaactgtttactgcatttagaccatttactatgtgtactatttccctgtttcctaatgtaccctacttttgatgctcaaccaaatactagttccttgtagctcagcagtccagagtattagtatgcttgcgagtaactatcgaaggaaggagtaatagttttccatcctccaaactgtcacccactcaccctccaagtattatcttttgattcaggattccagcagattcaagttccgctatccctttttctatgatgatcaatcagattgtgcacctccctttgcgtatccttgattcttttccttcatgcagttccgccagtgcagttggcgttttgggaccgttctcacaccttttccaaaaagcaataaatttggtttgaaaaatatggaaaatatttgccatgtaaatataatgataggcacaacatagaaaaaggtatccctctaaccaaaaaacccaatcctagctacgaacctggacacgcatatgtttgtctttttagacggagtagtacgtacctaataaaatagaggtaaactgggcgaggaatgccttctttcttgcatatctaaggaatttagtagatctgtactgccataaataatatttaacgtgtatattttggtaataacatgctaagggcctgtttagactttagatcccactcaaaattttacaccctatcacatcaagcgtttgaatacatatataaagtattaaatatagacttaaaaaaaattaatggtacagattgcgactactttgcaaggcgaatcttttaagcctaattgttccatgaattgacaatgtggtgctatagtaaacatgtgctaatgactaattaattaggcttaataaattcatctcgcgatttactaatggatactgtaattagtttttttattagtgcccgaacacctcgtgtgacaccctatataatacccgaactttacatccctgtatctaatctacccctaagattagctctgtcatgtcgcatatgtatctttaaattaacattgaattgttatggtcagtagcggagctagtggcggagctagccaggagctacgcctagggctcatttatattatcttgttctaatgttctactaatccacacagattttagaaatttaaataaaatttacatggagtcatgaacccaggcctagggcttgagccctggctgccctaggcctggttattgttaatccggtaggccataattaggagtaaactggagattatcaaacatgacttgctccaaaaggtgttccatctgtttaattaggtggtgtttggatccataagtcctatggacttattttagtcctaggactaatcactttagtctatggctgtttggctatatggactaaaagggactaaagtacattaaatgcgctgtacaatgaccatattgccccataaaaccatgcaaagtggactgcaccatgccccttgctgcagcatgccgtttgctgccgctgctaccactttgcaagccaaaacattgttgttgcacgactgcacaaccaaatgcaagccaaatcaatgtttcaccccaacatcacaagcattaacccatcataatttggacaaatacacaccttcagcaagccgaatcacaagcaataacccatcatcattttcattatcaatatcacaaccaaatcacagaaattcaaagaagctcatacacatctcaagttgtcgaaatacatcacagaagtttcaatgttacaaattacaagcactcatggttcaattaacaagttcaaccaaatacaattcacaataaatttgaaccatatattacattcctttcaaagaccacaatccatcggcaacccagtcccgaaattggttcatcacatgcgagtccaaatcatttgttggttcgctagatggagaagaggttccacccaatggatcataattttcatcttggtcataattatcgaactctgcatcagccatttgactgtctctaatgaaattatgaagtgctatgcatgcatgaataattctgctttgctttttctgcgagtagctaggtaaattaaacaaaatcatccacttgttcttcaagaccccaaacgacctctctatcacattgcaacacgaagaatggttgtaattaaagtgctcccttcttcccctaggcaatgtgctttcgttgtacttttggaaatgatatgttatacccttgtatggtgtaagataacccggcctatttgggtatcccgagtctacgagataaaactttcctggaggtggctttggtaacttgccactaaatctagtttgagcatcattgaataccctcatatcatgaaccgaaccaagccagctagcaagcacgaaaataaatctcatatcaaagtcacagacgcacataacattctgactcttctccttatgtctattcctatgttaaacagcagctgaatttggcaccacaacttggatatgagtaccatctattgctccaatgcaattatccaaatatggtatgtactgtggagaaagcaattttttatggactgttgagaaaagaggatcttttggcctaatgatatcttttgcaagtcttagtagagcggtcaaaactgctttgaacttagtatgtactgttctaagagacctaacaaatcggtcttgggcttgcctaattgattggggagcacctactatccacaaaaaaagacccaaagactccatggaatccattttgtttgtggacttcaactcatatgattccacaagcaccgaatgtaacctctcaaaaactggcatgtgcatcctaaacatgttgtaacaagcagttctattggctaatgttctcataacccaatcatgtccagactcaggtgctactcttcttagagccttattagagtaaagttccaagtaatacgtaccaatcatgccagcaagcatacatgctcttctcctgttcatttctcttttcttcaaaatagaaatgataagatcaatctcctcatcactgctgtcttcctcacagctatctttatcagcattgccctcaccatcctacatgactgacatatgcatagaaaggaagcacatcataaatataatatgaacaaacttcaacaagaaaagaagggaaggtagttaaatagatccacacatcacatgttgattacatcacatcacatcaaagtagtagatagttcaacacaaaagtagttcagaactaatgcagctaagacccaactaatgcagataagacccatctaatgcagctaagacaccataatgcagctaagaaagacaccatatgcagcaatggcagagtgcctctagtgcagctaagaaaggcatcatctaatacaaattcttatgctggcaccatctcttcaaccacataaatcttgcttcattagtgctaatattctcaaacataactctgttatgtttggaagcaaacaactgtgtggcacaaaagtattccacattgtcttctgctgcaccacactctactgccaacttctgacagtgtgtcaaggactcagccatttcttctttcttctgctcctttaacttcttgctgttaacaagttcagtaattagggtattggacttatcacttttagaggtgaaagaattgagcagccccctcatgagcttcaccactgggctcttgcttttttttccaagacttgaagctgtggacacatcacagctgctactccctctcttcctgctgttagtgctcatggggctattctcaaaaccatcccctacagctctttcccctctagctgtctcccttgcatcccctgcttcctcttcttcttcctcttcatcttcatcttcaaaaccagggatatatgctgtggaaccatcaactgcaactccttgaaacatctctataagaaaatctaagtactcaaggttgccatggcgaaatttcttggcatcccccttctcctgtattgacacttaatcaatatcacatatatctccaaaatcatgtaaactatatcaattgttaacaactgcgtaccttaaagttttttcccaccaaacattggatgcaattatttc

SEQ ID NO: 52611 - DNA, 17107 bp, Oryza sativa
tgtcatatgtattctaggaaagaaaaacatgatttaaccctaaattaaccacatgaacagcaaatgacatattacaaatgcttagcccacggcatgcatagcaatttcaatatcatgagcaacaattgacatatttcgaaagcaataaaacaaacggaacagatttgaaccatcggggtttaccatgcgctgaccatcaggaccgaagtcctcttcgtcttcgtcgttgccgtcgtcctcagccacatatgtcccttgagacgacgacgcaccgactcccggtcctcctccgaagactccaaagtcgaaggcgggtggcccgctgtgcgacatggatgccgcatgacctcggaagcctccatcgccagatgctgagccagggggaacccatcctcagattcccctgccagatccaacgccattggtcaacgacctgccgtagcctcatcctcctcctctccctccacgacttctgccgcgtccccctccccccgctggaggacgcgacggggcgatggtggatctgctccctgcctgaatcggaggtaacccaaggctacccggttgaaggatctgttagtaggaggggaaatcagggaaggcgtcggcctgggagttcagatccaggccccccgatccccctcccccaaaatggatgccagcgccagatccagcatatcctgaagacccctgcgagaagccgtagtcggagccgtccatgtgggcggctggagcttcattgaacgactgggagaagaaatcgtgaggatttccccccgccattgctgatgcgcgattcgtgaggcttgcgcgagtggcagcggcttgcacgacgccagcgagccaatcggcgggcagaggacaagctagcgcgaagcagtggtggaggctagcgcagggagatggcggcgacggcgcggggtcgagaggagcaagagagagatgacacgaggaagagatgaggcgaggaagagagtgggcgaggaaatggatagggttggctaccgtgaaggggcagcgggtggaaaagaggcactttagtcccaataagcacctccatttgggacttctggactaatgcactttagtcccattttaatccctcctgtttgggactctagggacttaaagtgacttaaagtggaggaacttcttttttagaccctcaaagaaacagggccttagctttgcgcattgtaagttacagataaataataaatgcagtgctttgaataatgcaccggcttcacgaatttgcaggcacaatataaccacatcttctgtgtcactcatatgggagattggtatgataaactttcacaatcttttagggatactgcgaaggaagtattggcaaaagcggatattgatccaaatgttaggtgcttcacaagaagacagatgaaacgcatcacaaataactacagcactaccttgggaagaggagggttttctgtggtgtacaagggtatgctcgacgatggccattcagtggcagtgaaacaatataattggagaacacagaaaaaggagttcacaaaagaagtgatcatacagtcccagtgtagtcataggaacattgttagattattgggttgttgtgtggaggcagatgctccaatgctggtgactgagtttgtcccgaatggaaacctttctgaacttctgcatgggaacattggtcagcttcctgtctcattagagacacgcttccagattgcattggatgtagcagaagcagttgtatatatgcattactctcaaaatcatccaatccttcatggagacatcaaaccatcaaacatacttctaggcgacaagtatgtggcgaagctatgtgactttggaatatctaggcttctctgcatggacaatgatgaatacacggggtttgttataggaagtatgggatacatggatccagtgtaccgtgagactggacgactaagcccaaaatgtgatgtctacagttttggggttgttctgttggaactcatcaccagaagcaaagggattgatgatcagaacagaagtctagctagagtttttgctcactctagtatagatgaaagatataaactatttgacaacgaaattgtaaccaacgagaatgtggacttcatacaggaaatggcaaaccttgcacttgattgtttgaagtctgaaatagaagatcggcctcaaatgaaagaagtcttggaacatctttatagtctcaaaaggaaaatgttggaacaggagaggaagattgcagagttgatggaagagagaaggattgcagagttgacagagcgaagaactgtggcatttagggaaatcaaggccatattgcaagatattggttttgaaagactcgtcacaaaagaaaaaatagattccatcgtaggcaacccgaaacaggtatcaacctcagaggcattttcaggaaaaagtagtgttctcattcagcgtgccattggcaagatttgcatgggacatttgaaaaacattcgatttatcgtgataaagatgtctgttgaggctgatgagatttggaaagagatgtttctttatgagatgatcaagcaatctagaattgagcattgcaatgtcgccaagctttttggctgctgcctagatcatgtggatgccccagtattagtttataagtatggtgacataggcttgcatgatgctcttttcggtaacgcgtggcagcagtttgattgtcctttcgcttgcgaaatacgtctagagattgcagttggtgctgcagaaggccttgctcacctgcactcacttaatgtggttcacggcgatgtcagaactgccaatgtagtactggatgtttattctaaatctaagctcgaaatgcctgggataactgcatttatggcaaagattgcaggttatggaacacaaaggctcctttccttggataaggccaagcatgaaatatttctaacagagaacatccattacaaggatccacacttcctcaagactgggctcatggctaaggaatatgatgtatatggttttggcgtggttcttgtggagctcttcgcacagaacatggtgcaaatgcatgacgtaaacatggtgctcaaagaacttgatggcattcctgctagatgccatcatcttaaggaaattaagaaacttgcttcttggtgtcttgcatccaaggtgacggagaggccagcaatggacaaggtagtacgatgccttcgagctgtcttgacaaacctgcaaaatcttcatgatccctgcaactgcaagtcaatgtataataagtctgcgatgcagtccgagcaaattaccagtgccaagtctgccagtagctgatagctccacaattgtgatataggaagttaatacaagttcccaattaatgtgacctaaatgtaatattaatatatattggtatatatgtgtttgtagaactatttgctggtcaaatatagggcaaagccataaacagtaataatatttcttgctggattttctgctgggatccagcgattggagagacagaaaatgtactgttagtagtagagatggcaataatgacaacacaaacccttctaattgtgtttccagcagatatccagatcttaagatgctgtttatatatgtgtaacattatccaattttacaataaccctcgtgatcgacaatacgggggttaaattcatctcactagagcttttttggttgttttgttgtttgttctgaggtttggttgttgcatgtttgcggaattgcatgcgccacagatagcaagtagcaaccgctgtatttagttctactagttagcgtgcacgtgcaaggcacatcgaattatatctaatggagtacaccatgttggttttttacactaacaatgaagaggagaaatatcaattcaaaaaaaacacattgcttgaaccaatcgagatacaatttatgttgtcaatcatgttcgaagaacgtgcggaagcattaggaacacagagccacctaggagtgttcaaccctagcacatgtggtggttagtgggggtgtggcgtcacaacgctccatatttaaggttagaggacttttacggtacattctacttcaagtattcaagtatatactgttagtatataatagggtaggttcggtatttgttaaaaatctgaaaagggttgtttagtcatttaaaatagagattattttggtttttttaatcatgaatagtgataaactttcccgtggttttttttctgttgtggatatcgtcatccgcgtgtagcgcttcttttcatttcatccggcgtccccggcgacggaagctcccggcgcacctcgctcccgccccggcccagcgcctccatcccgatattacctccggcgccgggagaagccgatcttccatgcgcccggcgtcttccgccgttccgcatccccggtgccttgtctctagccctagcctgttctcccccttatccgacctcccacagcttctgtcttccccaaaccacggcggcgagggttgatggttttggagtctaaacatggtttatatcgtataaagttcgaaacgatgttaatggttttggagtctgaacattcttctttcacggccttctctggaagactggaacgtgggagttgaatggatagtagtcacagaactgttcatacattagttatattggcatataaccatgctaattatacattagttatgctaattatgccgccctgccgctgccacctgccgccgccgggctgcccttgccgctgcgagctgccgcagctgcacgccttcttcccggcgccttctgtagctccgcctgcccgccgcctcccgcagacagggcgtatgtcattgaactccgagttgaggatggtgtcgaactcaacgacgaagaggtggttggtcgcgttaacgtcgccatgccatcaaagctgagattcgcgccagtgaacccgttgaagacgaactgctcgtggccaccgcctttcgcagcccgccggcgccgcctcccgcaaacctgacgaattggggattttcggaagaactaggttttgggtgaggaaaagggggagggaaattgaatcgattcccgatggcagcgacgccggttgtggttgtcgacggcggtgcggcgcggcgtgctcgcagaagcagtcagcgacagtggtcgcccacgcgcggcttcgagaaaaattcgctttgcctgtgcacctaaaggccagatctgactaagtgagaaacacgaatttacaaaattacccccacgcaaatagataaaaaagacaaatatgccccattcaatttatactgcagaataattgggagaaagatcagatgaatttacaccgttagatcaaatatattggtagtatatacttcaagtagaatgtatcttaaaagtcctctaacggcttgtttggttggagggagttttgaataaggaaatgggagtttaggagattgagctttttaatctctagtttgattagaggacttgggaattttagagggactggcatagagaattaatctatccaactcccaccgatcccatccctggggacctgttaattcacgagacttggtgggaattaaacagcagaagtccgaaatacccctctcccgcacactccgccgtccattgccgcgaaaaggaataaaaacgcgcgaaaaatcctgttcactgccgcgaggaggagtaaaaacgcgcgaaaaatccccatctcagcgccactttcctcgcccactccgttggccaccacgagaagcaataaatcctgtgaaatatcaccagcgattctccccattcacacgcgaaaccacagccaaggttaggttctgacgcaagtttgttgtgttcttgaaaactctccctctttctccctctctcctgtacagatcgagaccacagcctcatgaggtctggattctctctttccccatctttctgcagtacatgactgagaaatttgtgtctttctcctgtacagatcgatggaagcagctttgtaaggggaaaaggtggggggggggggggaaaaggtggttctgatctgctgttcgtacttctacgtctgttgttgctcaaggctgatttttttgtagttttgctctgcagtttatcacaccaaaagctgtaggtactgatgttattctgttctctatttttttttcatcagtcgattgccttgtttgattttccaagacagatcaatcagatttggtattttagtattaatggtagtaggcattttcccagtgtatagagtagacctgttcttaatttttttttcatcagtcgattgcctttatagattttccaatatagatcaattcgatttcatattttagtattaatggtagtaggcatttaatctgctatagaatgacacatagtgtattcgtcaatttcatacgtgatacatacagaatggagggggatatgatcagtatcaaaattcatcatgggggatctttttcaaaggagggtcaactttgctatgttggaggccaagtctctatttttcgcaattgtgacagcgaaaggatgtcatacttttgtctagtagacatggctaaagatgtaggtttcaagggtggagatgaactattctatgctatccctggttatagtcttgaaaatggaatcgacaaacttcatgatgatcattcagttcgtaaaatgttgaattttgcaaagaaaggcaagtcaatggaaatttatattaagcatcttgaataaggtgtaagtgctactccaatatttggacaggatgttgaagataatcatgtggaggaggtactgtacttagaaacaacttttcttttccttccgtattttttttctgatgtgctgacgtgtgatactgtgtcatttcgctatgtttttttttgttgtttgtgctgcttgtgcattttttttcctcatgagcatggtaccttgataaagtatagttagtacttgatcttgacctatttaaaatcctaataaatttgcaatataattttgttgacagacatggctcgccctccaaccaatcgagatattgtaatcttttggaacagaatgagaacacgtagagtgaaaatagtgatgacattgtatttattgatccatagcggactgtggagactaactgtggtgttgttcaaggccaccagcatcattgaggcccctggactggcagcggcagcgagaggtctcagcggcctagggtcgagtgaggattgatgtgcatagatgtaaatccaaacgatatcgtttcaatgacaatgtgagaataaaaaataaaataaatagaatatatagattatttgacaaagcagagataaccgttctttcgtttacaactatgccgtaggttgccttcaatatgaaataatcattctagtgctgcgctgttttaaagctaaacaggttgaatagagaattgacaagcataacaagtcataatagtgtcagtaatcagttacaaaaattgtcatatatcatgaactgaacatacaggaagcaaacacattctgtcagttagaaaaaaatgaaaagttatcaaaaaaactttcattgattttcagcctacaaatcataagaactctcattgattttagcgattccagttttcaattgtttcaatcgatctctagatcttgatggtactaacaacccattcaatataacttgattgtttctaggaagggatgatcatggacgtaagtaatacatacacttgattgtgaatcaatgagagtttcttttgttgaacgactgaaaaatttctactgcacttttgagtgaaatgatggcgaaaagaacacagtgaaatcaagaacggcctgctgctcaccgagtcaaggaggatgttggatgccttgaagacgctagatgaccggtgtgtcggcgtagtgaaggaaggcgagccccttcaccgcaccaatggcagtctacatcctcctcatccatggtacaggactatcgagaccttcacacaattacagttcaggtcagcttctacaagtctttccggaattgacacagaggtggtggtgacaaactgacggtgaaggtagcttttgtagcgtgaggttcagaatgaataaatgacattgcagactattaatatactgatggaaaacattgcaagatgtgtctagacaatgaactcaggagataacgataaactccagagcaaaacatggctgtccaaggttatgaaagattacaacgtagcccatattaatttggtaaatgttcagaattaggattataaatttagatacgttatatgaactataatccattgttttccataacagaacaaagatacaagtccaacgtagcccatattaatttggtaaatgttcagaattaggattataaatttagatacattatatgaactataatccattgttttccataacaatacagtaattcacaatccaaaatgcagattcaagtttagtttatggactgaaaaaaataatgtatgacaaggttcagaatcatttaatcaataataaatactgtcaaattttcaaaataatcaattcacgttcagtttcatcaaaacagtacatgtaaaaatgcaacattcaaataatgctgtacaagcatcaattgcatcgttccctcggcctctgccaagtgccaagtgaccaacatggctaaagagatcaatcatacagcattaatgtttcattgttggcctgataccgtaatgatacaacatgaaatattcatgaagtgaaaaatttctcaaaggtataaaataaaaaggaatttagtccatctaaaggcactcttagttttatatgcagagcatgctcaaaaccaggaatgacatggcaagctcgatgtttacataaaaatctctagaaagtttagaatgcgaatatacttaaacaaacttcaaagttttaataccaaaatatattaaatgaagggattttgtgaatctaaaggaaaaggtatcatcaagcagagtagcaagtcatatatatgggattagcatcatttacctctctcctgaaccccagttgttctcttatttgctgctggaccaatgcattccattcattccagttattgcatcaacttctgctacaggatcactaacaaatttcacaattccataaacctattaacacacccttaactgaaaggcaatggaccctaaatgcctcttgtagcatgtagtctgcaatatctgcagccagatcccaactacaatggcccaattcaatcgaaagaccatctcaacattcagcatcatttgtgcagtgtccactatatgtctgatgaagaacttgatcagcagctgcctgcaacgcttgtaatctcaacaaagtcataaccctgaagttgtccactttgtttatcccagataagcttcacagattgaacctgcaaatcaatgcaaacatcacaatatggtcaggcaaaaacacaaagttgacagcagtagttgttgtcattcatccattatcactggagcaaaaaaaccaagtcacatatagcagctatgtaactgttatatggtctgcaaacttttttttttttttgaacggaaaaaacagcacagtagtgctttttcattgaatatagaaggagaaaatacaacccctaggggtaaaacaaaaagatctttagactatacactatacagagtgcgggatgagctcgcgcaatcttttagccccagctaaagcccacaagctggcctcctctttgatttttgctaggagaacacctgtctgcaaacttagcacccatgtggaaacatgtggaaacaatagataagtagaaacaatcaaacaaaaccttccaaagcccataaattagaggaagtaacctgttcatatttcatgggcacagctctagaaaaaaataatcagagatcagattgaacaaatatctgctgctgctaacaggtcaacatctatctagccaaaagcaaaagggttgcaataaagttaagtggaacctgtatcataaagattatttattcttcgttaagcaaaatataaaatgcaactattgaattgcagtgtgataagacactgcgcatgttatgaataaattagactttgtacacctttgcaatcagtattattatgatcaaatcctttccaaattgctctaaaaaaattgtatctcatcagtattgctccgatagaaatatatttccaatcagcattgctcctatcaaaattaattgagatacatgccctgaaaaagtatataatcacatccaaagtttaattacaacgataatataatcatgtgtttgcagaaacctcaaaaatatggattatacataaattgagctgtaagaagcatgcatgaactaaaagtaaaaatatagttagaatatgtatgcctattgcaaactaaaatgcaatcttaaaaataaaatcatgtttaccttgaagccaatgtcacatggattgaaattcaatctttaagctcaaaatagggtggtaggctgaggcgaggagatgattgacctaaatacctacaggcgcacaactcaaataactcccaccttagtacctgataatatcactggcttatttggagcagcacacatctgttctacttcctccgtttcacaatgtaagtcattctaacattttccacattcatattaatgttaataaatctagatagatatatatgtctagattcattatcattaatatgaatgtgagaaatgctagaatgacttacattatgaaacggagggagtaacttctaaatcaccttgcggtggctgtcattaatcaacccagtaatattaccctccactttaagtgtttacttccagaggctcacatgaagtagtcacattcaaaaataaatataaacattacttaactgaacctaacaaacacgttcacatattttactgttcaccaaaagaaaatgcaattattttgcctggtgatgttacaaagagtgcagaagacaaggaaaaatctgaaactaaataagcaaatatctgctactgctactaacatgtgacatcaattcactcaaaaggaaaagattagacattaagtgggattggaaatttttactacatgtgttcgtaacgatttaaatgccaatactaaaaattaaactttgatgaaaaaactttaaaattaagttttaaaatttaaattttggcagcggctgattttgtatagaggaaacgaggggagagtgttcggatcaccttttggttttacttttattgggacttgcatgttgttctggaactgaatttggcaagggcactaattgggtcagatatatgaacctgaaacaatgcacatgtgaattttcaaggctgaaaactcttaccttggtatattttgattccatggtataataatatgtgagaatgtaccaaaattagataaagcctttatctcagcatgacacgacaatgaatcaacagcttcgcagtcctggccgggagcaactcaatgagaccctgctcctacctacccgctggcagatttactgctccacaagcttcatactgcaggccaaacaattgtccggctggaactcaacataaattcacctttgtcttagacaggagcagcgagggagacgtgatccggatgagtttgcgtagggggggcagcgaggaatcgcggtggcggcgcagtggacaccggacatcgagggatcgacggcgaccggacagcaggagatccggtgccggcgcgaggctaatgcggggatcgacgatggccggactgcgtgggatcgacggcgaggtgcgatgcagacacaagggcgaagcggctcgacggagactagatgacgatatatcgacggcgccctgacagcggggatccggcaacggcgcgaggcggcgagggagaggcagcggggtggtgctgggaggatccaacacttcgtataagccgttggatgaatatatctaaggataaaaaaatatatataggtgtttgatgaagtcgtactttttgtgtgacaccttgaaaacctcaaatttgtaaaaatcaagtctaatttgatatatattaacaaataggtagaaccgagtctaatttgatcaattagcataggatttaggatttagttttagatttatttttcgagcctacttaagagtttatccgacggactttaatttgaaaaatgtgagccatattgtttgatcaaatttacttttggcccaggtcttcccaagcaggcccaaacttgggctggcccatcatcggcgagttgagtcaattcgacggcccttaagctgagcggctgagcacggcccacatatgcggggacggtccgatgcacttccgcggcccattgggcgcagcgtaatcaatagcagcgacggcccaacgctaggcaaatctgagccgtccaatctaatggacggctccaatcgtccccaaatccctctctcctgattccatttctctccggcgacgagcgccgagcggcctggacctcgtcggcggtaggggcgacgccaagccgacgcttcccgtcttcagcaaaggacggtggaggggtgcaccaggacagtgcgtgcgcagggacacgactgcgaggaggtgaaggtgcggcggtgccgcttcccggaaagctccggtgagctcaggggcttcaagtccgataagtaacccgaaccctcaggggcttcaagtccgataagtaacccgaaccctcagcttaattgatttggatttgactcttatggttattacctgaaattagggttcttcgaattcagagaattttgtcgagaaatttcaatatattttattcccccttttcgagttaggagagtttcattatcgtttatcctcttttaattttaggaacttcaatcaagtttatccctttgctcaattttgttttttttttctttggctggcgtttcatcgcgcggatggggacggagggcgccgctcgtccccttggaaagattgagattaagataagattttcacggacaacggaagtaaattgaatcgatctttttttttgttttaatgtttttttcgctattttttcgttattacggacaacggaaacatttttaattttttttaagtagtagagatagagaagatagagatatatagtaccgtgtcaaatataataggattcgatttttttttttccgcgtcacatataattcttcttttttttattccgacagatttgtttttttaattttttttttgctctttttttaccacgtccacgcggattcgtttttttctcgccgatcttttttgtcacctgtttttttttcgcccgttttttaggaatcggacagattccttttttatttctttcgccttttttttaccgtggaatcggattccttttttttttccctttttttttgccccttttttgatcggacgttcttttcttttttttcccccttttttgatcggacgttcttttctttttatgcccggttattttcgttcggtttttttcccgttttgttttggatcggacagattttttttcgcccggtttttttcgacagacgacagaagcaactcttattttttaagtagtagagaatagagattaatatcaatataaaaaaaactacatactacatctcatccatttggcatagacccaaactgattcgatgtaagctgcataaatcatctattcaccgatttcactcgtttgacaggtgccaaattctggtgcctggaatatgatgcagagaagtgtgctcactgctctgttttatcgtcaaggtaggtagcaagttattaaatctgtcaaatcccctttgaacattatatgaatatagtatatcaagttatcaaatgtacattacatcaaaattgttagtggagaaaaaaatacagcagggctggtctgctagcagtaacaggtaactgggtcctcttatttgtcaaaaaaaaaaaaaactcctaatattgccgtgtcacaggtatagcggttcttttccactggatctttcattagaaaatcaaacaatcctaggacaagttgattgaaaagatttatgggtaccgcacgatgcctctagtagtctagtagttaattggttagatgcgaccaacgtgcacaggtttctataactttcagcttatatggtttcatttcacatgttgtaaagaactactttcagattctttggagatatcgaaatacatttatcaataaaaatgttacttatgtgtatcctcttgaactcccatggtatgattcctcctctccacagaccactttaccattgtacacctaacatagtaagttgattagaaaatacacccatgactgtacattgatgtgatttgctaaattgttctcagcaaacctgtagcaccaaaataatttccagatgtgaatgtttgattggatcgcttgaacgttcaaactttagctattagggaaaaaaagattgctttaaaattcaaactttagctatgacaaaaaagaataaactgaaatagatggggttggcaattttttcttattagccaattaaaaccttataattgacaacatgctggagaacaagccagattaactaaaagtaaaagtagcacagtagtatcagattcagaaatgccacacaatcatgtcttggttgctcctttgatgtgaataaatcaaacgttgagaacaacaggaaaatattatggtccccttaatcaagatcaaccactcatcccccctaatcaaacgccatacaccaccaacagcaggtaaaatttggttagagaagaggaggaaacaggaggggaaccaccacacctggactcctagagacgagaaaatggacatttcgccatgttcaaaacgcggtttcgctagaatgccatctcaaaaacatgattcgataaaatgccaatatagagcgtgcgtctaccgccactttgccatttttgccattttattcattttcgaaaagattttctctcctctactaggtgatgagacaaaattgccccttatcaactcagagaacacggtgaaagatgagacagaataggcaaggagacagagagaaggggcggcgacgccgttgctgcccacaactactctaccggccggtgcgccacctctccccattcctcaacctcgccgctccccgccacaccccacgccgccaccacctgtgctcgccgccaactgaacagccaccccgccgacaactgccaccaactgtcatcgtcgtcggtcgcgccgggacctgcggcagcggcggcgaggaccgcatcagcaacctcccggacgaccagttgtgtctcgtcctacgctggctcgacacccacactgcggtcgccacgggggcgcttctcttttcttctcctcttcccctcggtttctcttcctgttccccttttctctcttccttcttagctagcgaggaggcgcagctggtgcagtggcgaggctgggtgcggcggcacggccgacgacccgaccaaggcgatggcggttggcccagcgcggcggcggcctaagggcggccaggcggcgtcgggtggatggggagagaaggccggtgcggcgaggaggtgccggggcggcaccggttagaggaggcagaggtggaggtgctgggtggtcacggaggcagaggcggcgcgcaaggaggcggtgctccacacggcgcggcggtgtcccagcgcccatgaagacggccatgggggcgctcgcgttgctcggccggcaagctcggtcttgccccatctcacaccaccgtcgacgccctcgtcagcaacggtgaccacctcgccatgctcgatctcgatcccctttcaaccgacaaggaggggcaatttagtctcatcaagccgaattccagtgaaaatggatttgaaaatgacaaaaatggagaaaatggtaaagtgactgtgatcacgcgcttcatattggcattttagcgaaacatgttttcggaatagcattccggcgaaatcgctttttgaaagtggccaaatgtccatttctccctggagacggcaaggtcatccattgtgtagatgaagtcaaagccctggatcttctatcggtcggcactgtcaccacgaggagagcgggcggggccatgggggcgtccaagcagcgcaccgccactgctgcccttgcgttcacgcgaatcaccagcacctcctacacccgatgcagcggcgcgcaccgtgggagtcgagctcaatggcggtgcttgaggtgccgaggggtggccctggttcctcctcctgatgcgacgcgcaacgtgggggtggctgcgactgcagctgtgcaccgaaaccggtcctctccaccgtcggctcggctgcctccctaagcagtccgtcgccacgtttttcctgatgtccgccatcgccggagctccatccctccgtggctgtcaacgaatgtggctggacacggtcacagagaaggggaaccgaagatgggaggccgccctgggatgggagtggtgggaggacgggatttagggggtggatggagacgggaggtgaggcggtggatcggcggcgagggtgaggtggcgtgggagggcgaggtcgggcacgacgattggggcgaacacgtgatggacgaggagcgggagtgcgggcacgatgacgttctggcgggggagatcgtcggcaacgtgtgaaacgacgagagggagagaggattagggtggcgtggaggtggaggagacgcagggcggggtggtggggttgagatctgagcgaagggcgtggggcggtgggcggaggagcgaggccatgaggggcgtgaagggatcgatgtggagcactggatgtcgcgatcgtatcattaatatcacgcgtgtctatcacgttagtgtcaccaataccattataaattttttaagtagtaataactaatatctctatttctatctctatctctatctctactactccctccgtctacttttaataggcatatttcatcttagcacaatgaccaagaataagtaattctacttatcatccatttaaacatgctactctctccgtctacttttgatagacatatttctaaatctaaaaaaaatatttttgatagacatatttcaattgaaccacttatcatcttaatgactttctcggatttaa

SEQ ID NO: 52612 - DNA, 1161 bp, Oryza sativa
cccacctctatccgtccatcccgcgccgctgccgccgcttcgttcatagtgagagagagagatagagagagaagggagagtggaagaggagtatgataggtgggccccatattttttatcaataaaatgtagattggactatcacgcgtacgctatgtaggtcaaaactgctctggattgggtcgaggggggtaaattgtctggtattgaaagttcagggtgaacgatgtctagttttcgggtttaggggggtaattcggtcggccacgatagttggggggggtaattcgtactttttcttattttatattgtctatatttgataagcgtcttctattcttgtatgtaagataagatctcaaagtttcatatctatctatacatagtcttgcttcatataaatattccgtatgcatacatttaggggagcaaatcctatatgttatacaagtatttgatccaaattattcactttcatttaattgggatctttacatttgagcatacatttgagtatatgacacttatggtgttgattaatactcatcatttattcatattcttttatacatgtgatctgttggtcaacaagtgaaggttgacaaccgaatcattcggactaataaatacattgagttgaacaagaaaaataggtcccatgaattggaaaatgtgctgatactcgatagagatcatgacacctaatgatatcaagaataacaaagtgaagttattggaaagtggggtacgaagtggcaagacggtgaaggccaagtgatgctcgccgcgatgaaccatgcggtggtgaaggcaagcaaggagcttggcaccgaaggaccaaatccagtggtgaagggcgagtgacgactatgtctgatggaccgtgcaaggccatttgaagctacaaggagcacgcatcaatctttaaagaatactagaatataccctgcgtgatgttgcgggagcacatggtaatttttagctcaagatgattgtactgcatgtgtggccactactgacatatgaagtgaacatatgtatatactattatagtatatgcacatccataaacataggcaatattcgtcttttttatgtatttacatgacataataagttttttgtctagaatgttgagcgattttttatgtataagatagt

SEQ ID NO: 52613 - DNA, 8360 bp, Oryza sativa
  unsure (1)..(8360): unsure at all n locations
ccacaatttaaggttaccacatgtttaaggttaccacaaaattaaacatggattcaaaaactaaggttaccacatgtgatgatcgcgtggttttgtaaacgctggtgactcacaggatttccaaacgtaaccaatacggctcccaccgttcagtcaagagcctgcacctcaacaaaatgtcaccattcatgagcacgattacatgactacccaaatacccaacaaaacttaagccttcaatccagagaacaaataaaataggcacttgcaatctggtactaaacacatgaaaaacaatcgcagcagaacacaggccaaatatagtattatcaaaacatgtgacagaacatttgctctcacggttgtggaatcaaccacgcagaaaacccatcacgggtttaccagcatccagccagctccataaaatgacagctgatccaaaaaagaaaatcacgcgatctccatcaatgactacaagctctagcattcgttctttcaggcaagatcaccaaacatcatttctgtgaacctaaatatcaaaaactataaagaaagcatacataatgttcagataaatataatggccatgtgcgagagttctgaaagggctggccaccccccatctatacccctatacaaagccaatctgcaagcgttttcgtggtaccatggaggcaggcgatagcggctgcaccttagacttcacggcgccagccaatcctgaagtattgacatcgtaccactataagctccattttgtcttctatacaggtgaagcgatgtgggtagcgtcgtcagcatctctcagtgcacaagttgccacctcttgttgtcaagccccactgtgaactaccatgacaagaaagagatgtgttgcaatccttgtgctcctcagcaatggtcaatggtcgacagccatagccatcttgtacaaagcttgcctcaataaatatccatgtagtgctccaacatatgcttgtgcccaatacttgcaactgatgtctatgcaccatcgtttctgcattacagtgcagaaaggcacaaccaagctgctgtgggccaaggatacaacccatcaaacttccaaaacttaatgcgggttcagcaattatatcacaagctttcctgatcactggggaggaggttggagagactgcggttgggtgttgtaatgagcatatgactgagagtagagcgggttcatcatgggctgcaaaatatcatgttacctacacactccctgagaaagataaagttacaattaaacagataatgaaaaaggataaaccacctgagactgaagaccaggaccagccattccaaaatgcatctgtgatgactcatcttgtgaagagtcattgtatcccgcttgtgtaaacattccatgtgaaccatgggccatgtgatcctggataacactaaaaggttactcacagaacatacacataaagaaggcttgaaaaggcagttacttttcgtaatagttatgaccgagatagaacagacctgagagacaatgtcatttgctgcacccatatgggaataccctgggtgtgcattttggttcaaataattcccaggatatccagattggggtccttgagagtagtcaacaccatagcctccttgagaagcctatatatgaacaacttatattagaaaactcttccccagagtaaacgcaaactttaaactttacggcattgccataatttactttccaattggttgacaaatcagatttaactgaataaatgaattggcacagaaatacaagagacatttgaaacaatgggtacctgagtggaaaaatcagcaatgttgtatgccacatgagatccttggctcttgaaatcatctccaaagaagtcctagaaaacaacaaaaccaaattttgtcatcaaggatagaacaagatagtaaatggcatgcatgcatcattaattgctagtacctgagacatcccaccaatggaaaacccatcgcggaatgtttgactgagaccttggacaggcatctaattgcaaaaggcaaatattactagacaggtacttttttttgtatgacatatattaatagaaataaacaaacctgtgtcatcaatccagtctgggacattggacctccaccagaaggctgactgctcggattctccaggccaggaaagttaaaagctgaccccatgcctcccatagcttgctgagaactctgttggtgagcaaggtgcccaccaatagggccaccagtatttccacgaggtccaaagtttctgtttccaggttgaggcacaggtggaacagctccaatcggtccgtgcaatgatccccgggttggaatagcatagggttgagaatgagccccagcaaatggagggaaaggcatacgaggtaaaggatagccagatgggtgcacaccaggtttatgagccccatttggtgggccaaatggaacaaaggaatgccctgcatttcagaaaagaagaggagcgttaagagaaaagagggtaaaattagccaaaagttacttagaagcagaaccaaacaaaattaactatctacctttccccctaccacttctcttatctgccactgggtttgtgcctgcagcaccaaaactagctccttgcataacaccttgaccgccacccaggaagagtcgtcgatcattgtagatctactcaagcatatactttgttaatttaataaaacaaaaggaaccataatgtttccaacaagtatctataagagtggaagaaggcacccaccttttttggcttttgaaattgcaccatactctgctttaagttgttcaaaggtccttctaccaaacactcatgctcctaaacacatggagattatcgagtgaaaattcaaaaactcagaagagctccttactttcaatatctactattagatatgcttatccaatgaacaggaatatctctcaaatagtaccaagcatcacgtgcttatagatttacaaaatttaggctgagtttggtgcaaaaattgtataagtttcttaaaaaaaatcaataaaatcattcgcaaatgctccgtctcgttttgcatgaaacaaattagcccagccaaacgtccagctcaaacacacctttagttatataaagaagcaagaaataatactgaaacaggacaattggaatggaaccacttatccgtttgtcaaatactcaaatgtaaaagaccttgaacacatgcaggtagaaaatacacatgttccatcaacactacaagcattcaattctactgtcaggaaagataacctgttcaaaaaacacctaacaatctgggcataaaccccaaaaataagcaacctgaacagggtatgcaaagcattgttatgtactgaaggaaagcttataccttataatgtgtcaataaactattccagagtggctgcttgcttagaactttagggttcccaagaataactataccgtaccgagcacgagttaatgcgacatttaacctgcgtggatcattaagaaacccaataccctgaaaggtgaaaaaaaaaatatcatgtcagttaacacaaatttgcgaaacaaaaaggttgttcttcaagcaggaaaagctagaatatgcacagacaacacagttcaatccttgcacaaaatatacaacagtctgcaagttaaactactgcctagatgcttaacataagaatttacaaagacaggcttaccaccctcaactgtcattgccaatgagtttgaaaacataaatagaattttcactaaatagaaaaggccaggtcagagtacatctataacgccctctagaagtcaatgtgaaatactgtcaagaatattatgctgcaaaccaagtaaaacagcaaagattacctggtgctcattgcttctaacacaagacaggattatgtaatctttttctcttccctggaaggaatcaacacttgctacctgaaataagtataaatcttatatgacaaggcagctttcaccttggtaggtttaacggaacagtatacatgattggtggttaacctcaatttctttgtatagttgttggcgaagagagccattccttgacatataattcacaatatatgccctttgtccttcataaggtgtgataactccaatctacaatacattccacaaaatgtgatttctttttttataaaagaatcaagtgctgcaaaatgttactagtagatgaaaaagggatcatcactgcatacctggcttggtacaacaccactccttaaaaatgtagttacaatcttttcaacatttgcagcttcagttctattgaggtatgatgtcccactggcactgatctcttcttgtcccatctacagaaaatcagtacgagtctcttgtgtaaataagcaagaagagcttttgcagttaggaagtacagaagaacaaagatcaattggtggtggtccaagaaggtacctgcacgtagaagaacataggccgatttggaacaggccaaggaaaatcaatcccaggtgtctgtctctcgtttacagttactccattttgcagtgtgccttcatagaagcagttggacgggaagtctgaaagacaagggtgcatcctatattgtacctgtaataacagatgattatgttagaactattagctttgttcccaaggaatgttaattttcgaacgcaaaatacttggatataactcgtttcaatggttacttgggtataatttggtgaattgattgtgtaaaaacaacgacaatatcgggatgaacaacagagatttgatgattcatccccaaaaaaggcttaaagaaaaaccagaaaatgcaaagtgataagtaatgttggaacatgtactattcttaataattcaaagttttgtccaatgatatgacaacgaatattaagcaagacagtttgttcaaattagaatgcctgcactaaattgtacctgacatacacatacggggggaaaccatttttcaaagaatcctcacaaaagtaacatgatttatgagcaatctcaggataacttaaaaagaatgtatcagttaggctttaaatccaccgcttccaaagttttgacatcaatgtcacaggacaaggcatggtaagcatactcacaccatggtaataatgtggagaaacagaacaccagattcaacaattacctgtagcctgaaaggcttgactccaaggataacaagccgttcaaagagcgattgtgctaatcctgcacgagctgcctttttgcacatgatgactgggcccagttgacaatgatctccaacaagaacaacctaaagaaagagtataaatatagcataatggaaagaacaaaaaaccaccaattaattacttgttacctgctttacaccaagcaccaatggaatgagacattcaggctctgttgcctgtgtagattcatcaataagaacctgacataaaaaaaaaaagaagaaagaaactccatcacctcaataaagagcagacatcaaaattaaactgctattagaaagaaagtattacttgacggaatcggaagtttgctaaacgagggtctccagcaccaacacaagtgcaacaaatcacatcagcactttgtaatatctctctctcagtagctcgttttaatgccttgtactttttctcatcactgcttgacaattcacctataaaaatagaatataagaaaattttctaattcaaccaaacagaatggccgagagagtttaaggaccttgttcatctttgagttgctgtagcttatgcaattcactcttttcagatgtatcaaggtgccgaacctacgttttatgcataaaggaacatcagtgacatcatcaagcgtatggctatttcacaggtaaacaactagccaagaatcaagaatgtacctgataatgaagtgtcaaatgctcaacaggagatgaaacagcttccctagattttgcacatagcctgacaacctgcaatatgcaaccacagttactaactggaaatgtaaatagtaaagaatgtatgagatgtactagtaatttaacagtttcaaaacgcgtatatattcaacatggcaaaattactcctgcgaaccacaggagcatacaaaaaaagctcagtatcaacatcgatagaagccaagcatgtaatttgaaacttctatcttaaaatggttttactactcaatggactgtgtcaaacgggatagcagacaagtcaaaaatacaggaaacagttgatacttaaaataaaccataaattattgtttaccttgagaccagtagagcttatcttctctgccaactgatcaacggctacattacttggagcacatacaaggacctgaaatttcaaatcagacaaggttaacaatagcatcaaattatgccagcagagcaaatgccatgcactcttatacctgtccttgcccttgttttgccatgtgatacacgatcgcagcagatgtgacagttttccctgtgccaggtggaccttgaatcaaactattggcttctgnagaccactttaactggctaagacctgaatagatgcaccacaagatcagaatagaacattagatccacatatagtgtttaattctacttcagtgaagctatggcataatagctgaacacctgaagttagattaaaaaaaataggttttgcacggagatgaagaaagttggtggaatttaatggggaaagattatgattggtgaagaagaggatgtagatggagaaattaaatgggagatggttgtgattggttgaggtgaaggagtaggtgaagtaactatgttttgggagaaattttgaatggtaaaggtagctatattttgggatggagggagtagataagaaacaacactaaactgatggatcgacccatttttttagaagcacaaaaacatacctgttagcctttagttttggaagtcctggtgcaccaaagcgtttcggtagtgtattacggattatttgatggtcaacttcatgtcccaaaaggtgatgggatatggacctacgttgaagcaacagaagagtaagaatttcctcatgagacatttgaaaagattggtgattatccaacaaagaatccaaatacagactagggatattttgcgagagttcttcccaattcatcagggtcctatcaacctttaaccatatccccaaaaaaggtaccaacaaccataaacttaaaaaatagctaaaaatatacattttttacttaaacactttgttcaatcgcaaagaaatgtgtgttcatccttaagcagtaatcatagtaaaagcaatataaatatgactagaggaccagaaattctaagtatacacgatatagatgcatctaactcacccactgacacttgtctcatccacagcaaaagttttcattgccccctgcatcctatcaaagctagtactcttccagacaaaatccacactgaatccatggttcaaatcaacaggaactccctgaaatcaggaaagtttatgatggaaaatgggagcagtaaaaggttactaagaaaaacaagtgagagctatactcctcatacctgactagcacgaagttcaagtgctacctcctcttgtgccgtaagtttaatctgaaggaataatgcccttaccattagcactaaagtagaagtgaccctgttggtgttattgtagagctatcaattaacatgtttctagggcacataccacatgacccacagactgccatgcagggtgtgaagaatcaccagaatatcgaagccgcagctcatctcctgggacaagtctcaattcattgtcttcctaaaatataaaattgattccacatgttagaaaaataaaaagtgtaggtgtattaaatgatataaaaagtccatgataattacaaggagcaagggaaaaatggttttgacaagattccaggccctatgttatcagatcttgtgcttccaagttcttaatctaacctttggaaacacgaaataggctatgcgcttcttgttcagtccaatatcccaccgcacggtcaagctgtccttgctctgtgactctttcatcatctacagaaaaataacaggaggcaagaaacttcagtacatatacatatatcatagtctggttccaaggaacaaaatgttttaagaactatcagcacattcaggaaatattatcagaacatagtaccttgtcataatcagcctcaagctttatcagtggagcaaacacattttgatactggcaaaaaaaaaatgaaaacctgtgttagttaccatatagaaaaacatggaagatttgagtgttttaaaagtgttagtatagaatcaaggtgcaagatatcaaaaacaggctcaggaaataaatgcccaaat

SEQ ID NO: 52614 - DNA, 10920 bp, Oryza sativa
ccctggattttttgaaccaaagttgaattctactaaccacccgcagacatgatagcaaattgccatgtagcacaattgatttcaaaagaaaagatgtaggattgcaatttatcataaatttttgtattgcaccacagataacaaaattaggaacaaataattttagtggacaaggcatcctgatgacataaatgcccttatgggacaaagcatgctatcaagttttaaacatgagtattctacactaaaatgccaataaataaaaaaaatcgtttcgctactgaaaattttcattgtatgagctggcaagctaatcctcagaatttccatccagcatgctcataaattttaccaaaaatgaggggagaactgactggttgagcaatttatcaaaacaatcaaatttgattaacctaagcagatgaaagcaattcaacaatcacaataattcatctcttcaatatagttgattgccgcatcctgaactaaatgcacttttttggcaccataggccaccaaaaaatgttatcaagctacaagagatcatcatctgcgagacaaacttgtcacctacttaggttggcggcaaactcctaccgaattcacatatgatcgatggattgatcttaaaactgaaagaaactaagctgttatgaccctaagctgttatgaccgtaattagcacgagaaaaagacagggacacgcaccaggtggttaacgatgtgggagccggacgtgttcccccgcgagttgcagaaccacttgcggcaggacggcacgttgcagcgcgcgacgcacgcggggttgtggatcccgcagtaccggcacgcgtgctcgacgaagtcgcccttgccgtagtcgtacccgtcctccccggcgccggcgccgagcggctcctcgaagctgagcgccgcgaccccggaggcgagcccgtccgccgccgcggcggacgccctcgccttggccgacgcgcgcggcgacggcgaggacgaggaggccggcggggtggtggcctcccgcggcgcgagatcggggtcctgcgaggcgtccggcggcgggggaggcgggggcggccacgacgaggacgacggcgacggcgagcccgcggagccaggcacccccggagccgacgtggggggcgcggatcgggccggctgggagagctccgggaagtccgggtagtcgaagtcgtcgccctgggtgttgaactcgaggaaggtgtaggcgtcgccggcggccgaggcgggcgggtcgggctgcgaggccgtctcgtagaggtcggcggcggcggaggaggagggcggttgcgtcgccatcggagcgggcggggcggggatgggggcgaggggaagggctccccctcctccctagggttagggttttgtggttcggggagtggggagagacgaggcgaatcgggggagggggagagacgggagagagaagaggaagaggtgaggtggtggaggagaagttgatttgattaaaaccgtctcccctctgtgggatttcggatttggactcttcgcgtccagccgtctcgtgcaggaggagtttggactttggagggtggagccgtggagaccggtttggagaggtttggagagcttttacgtacgtacctttggtacaactctaatttatgatatggacgtgactagtcacagctagataaaccagcgatcacttcatatatgagagactctatctacctatactttaaataaaattttctcttaaactatttatccgatctacgattcgattacaccattgtgttcgtaacaattaaatctttataacaagatctcacataaatatattttgatgaaaaaaatataaattacttttacaaatatctaaattacttttagatttcactaaattacctcatagacatataaaagtaaattcaataaagtctaaaagtaatttacatatattatagaagtaacttataacaaaagaaacgtaactttaatgcttgacttttttcattggacgtgactacacaactagtcatgtttttaacccaacaacgaatttacttctaatgtcgtgacaaaattacttccgttttgttttaagttacttttataatatgtaaattacttttagattgtattgaatttacttttatatgtctaagaaataatttagtcaaatctaaaagtaacttatatatatgataaaagtaacttacgtatataataaaagtaatttacaaatataaatattttttcatcgtagtataatcatgtaagatcttgttgtgaagatttaattgtaacaaatacaatggtgtaatcggattgtagatcgaataagtaatttgagaaaaaactttataagaatgaagaaaaagacatgcatgtctaagagaaataaagcatgcatgtatagcagtacttcttctcacaattgattggtcgttggttaacactaaaccgagaggcttctcggtttagattttgccttatgatatactagccctaaaacatattaaattctaattaattgaaatacatttttttatatttagatatttttttaagtaggtaggtaaaatgatatggttggatttaatttttattaaattctccatattaactacactttaaaattttcttgaaatttgttgtgcttaattgctaattttaataatacaaacatcatttcagcattaatttaaataaaaatcattctttctctatgggccattttcagcccattttcttcttcagcccgcaaccgagccgacccacttttcttaggccgcaagcgactaaagtctaactaacatccccatactcctcgtctcacttccacgtttgtgttggaccgccggcccgtgtacggccaagtgccacggtccggtgacggaggccagcccgacgctcgatcgatgttagccgtttgtttcgatggacggctcaaatcagttccaaatcaatcaaaaccctggtgcaaccctaaccctagattcattctccccctccctctccctgcctccccctgcccaacgccacctccgcctcccccaccccccaatcgccagctgcctcctcccgccggacaccgctcccctcctcccccacgggggccgcctctccccctccccttccctctggcgccgtttctcctcccctctccctccgggggggccactcctcctgtccctctccctcccatctcgccggcacggcacggcgacggcagggtacagcgacgacggttgtccctcccctctccctctccccgtcggcctcaatggccgtccctccctctaggcctctttatttctgtcggtgatgacgccctctccaccctcaagatccgggcggtaccctcccaacgtcggtgtcgacagcgacggcgacgtcggtggcttcctgcgagcggattcagtgccggcggcttcctgcagcggatacaacggcgacgtgtcgatccggcttcacagacgacgccgacagcttcccatggacagatccggtggcgacgacggcgttggcggcttcacggtgatgtttctatttttcttcccgttctttttctcaatcactggattgtccgattagattgtcatgtggaatcctttgtatttatagggttaatttcatccgattttgagtacaaatcaagtttgtatccaattttcgtgtggtggcggaatcggacagggcgaagattattttcgctcttttttaattttaagacggaaacgttcacaattttttaagtagtagtctagcccgattggattgtcatggaaccctttgtatttacggggttaatttcattcgattttgagtccaaatcgagtctgtattcaattttcgtgtggtggcggaatcggacagagcgaatattttttgttcgctctttttttattttaagacggataacggaaacgttttcaaaattttaagtagtagagaaaagctagtttttttaaaaaaaagaacaaacatctataatatatttataggtcccggtttttcacaaccaacacatatattgatcatctatattagtcttatagatgaatgttctttgaagaaactgacacctatttaaaaaaccggataccgacccctattagaataaactagtcagagccaacctaccaatcaaccaaccttatcctcacaatcctagccatccatccttattgccacaatcccaaccgacctaccacccgctcctcttcctccctcggtacctccaccccacaccgtcgcacgactcccgcccgacccccagcgctgcccacctcctcaccaccacccctacccctgccacatctgcctcccgccaccggacctcaacgcgtggccgcgcctcctcagcctcctcgacgtcgccttcttcctccctccctctcggcatctccctagtttagcagcggcacaggggcacaggtcgacagctcccggctcggtggctccccggcggcgcggcggctcggggcctccatgacggcgaggtggcgaggaggaggttgggcgaggagcagcaaaagcgtccgctcacccctccctctctactcctctgtgatgtgatttattttatgatttccacctcttctctctaattggatcgtctcctatcctggatgatttcgattggataggattgggatttagtttttgggttagatttacaatggtttgggattggttgtgggtgcattgatagatgaatcggagggaggaggtccgctactaagacggacgaaaatcctgatttgtgcggttcattttctcttcctctacgttctatgtccgattggattttgtatcgatccttcttctttttttttcaccctcttgacggggttttttgttttttatcgccctttcttaccggctttttttatagatttttttctgcgtcaaattgaatcggactttccttttttgttttaatgtttttttcacctctgttattacggacaacggaaacgttttcaatttttttaagtagtagagagtagagatgtggcatagctctagttccaacttcatcctttttgaagctggagctcaacgaaacagattcagtttcatttaaaatgagagtgcagttgggtgaaacattctcacaaaattaactaaaaaggtggagcggagtttaggctgctctgcaactctattctaaactcagctcctagagctaaacttaggagtttgagctctaccaaacagacactaaatttaactttagaaggtggatctggagtggacctgtggagcactgcctaaacctagctctaccttgctagttcttttgagagagcgctccacctagctccgctcccattttaactggagttgaaaaattagtagtagtagcttctttcgtctctactacttcccaatcaattcagatttttatttagattctgtgaatctacaaaactaaaaattagaagctaaaaaatctaagttttctagatcctcacaagctagctatcacctagttgcttctcataattttaaactcccctaaacaggtgaatgattgtagggttcgtgctgatagtcgcttttatagggcccgctcgttggccacttagagggagaactgaaataaacagtagtaattatcattatcctctcaattataagaatgtgttttggagattgaaaaagaagaagattaagaaggtacaaagaacgagatgagtcatgatttaggtggtgcttggatccagagactaaactttagtccctatcacatcgaatgtttggacactaatttggagtattaaacatagactacttacaaaactaattacataaatgagagctaattcgcgagacaaattttaagcctaattaatccataattagataatatttactgtagcatcacataggctaatcatgtattaattaggctcaatagattcttctcgcgaattagtccagagttatggaatgggttttgtcattagtttacgtttaatacttctaattagtgtccaaacatccgatgtgacagggactaaaaagttttagtcacatccaaacacccccttactaactatttcaaacttaaaaagtgtattaataggatttttttaaagcaacatttctatagaaacttgaaaatgcaccgtttaacggttcgggaagcgtgtgggcgaaaaatgagaaacttttatcttccttgtgcttgtctcaaacacagcctaaggacccatttgaaactcctcaatagcacatgattaattaaatattagctattaaaaattgataaatatatttatttgatattttcttaagagacttctatatataatgttttttaaaaacaccgtttagcattttagaaagcctagaaagagccattttggatcaattgataccaaaaaaaatgttatttattattttgaaaattaacacccattttatttaaatgaaaagcataggaattttgtagtatttcatttatatagatttttttttcaaatggccctttgatatttcaaaggactagacattgttgaatcttatggaattcatatataatgcctcattctatgtttgttttggagaaaattcaacatgaggtctaaccctatgtaaagttttctttatatttatctatcttcaaattcatttgatctaatcaaacagtcatttcctctctttttctttttcctttttatccctgtcttttgcaatcgcttgttgtacttcttattcgtgtcaaaatcatgtatttttttatatccatctactttcccaattctgcatttcagaagagagctaaatgttagtgtgattggtttggattagaacaaaatcattggtaatacccatgctctgtttgggaacactttataactttccaaaccatatcaaacatactgtctgaactccacactaagtaattagtaggtccagggaaacaaatctaacatagagtatttttttcaaagtgaaagaaaatcaaggtttctatggaaaacttcatcaaagtccaaagctaatggaatttagctcctttgtgccttgagccttgagactgagctccctgccactatattcaagtcttgaagaagatcttttattgcctccacaacaacacaatcgaatgtgagggagatctcagaaataagatagcaatgagaatcataataccataggttgagttgaggaggagaactgaggaagatgagtcctttacaagaaaaagcaatatagaggcaaaagaagacataaaaaaaaatcaatcgaatcttacctttggtagatcccctcctcactttgaagtgaatcgacatttgagatgccctacatttcgctcgaaactacctttttatttcttgctttacccaaaatactaatattgaaattaaagaatgttttcctacaattcatgttaggttaaaccagaccaactaatactagactatcatattaaagctatataaatcgaaacaaaagccatcaaaaagtaaaagttgagtaaacaaaaataggacaacatggccacaaagttaaaccaagcaaagaaccatggatgatgcatgacatcatcttctttttggcacgttcccacaggtctcaactctcaaggtgactacactaggcccaaaggcctcaatccctgatgttggtctgagtggtgtttggttggtgccctgaagtgaaaggactttgatgtcgcctaaagtgggggggtaaataggcattcctaaaaattatcatatcttcatagcatattagaatgatgggaactttcaattcaaattgaaacttccggtacgggattgtaagttccggtctcaatcaaaaagtttggagaataacagaataaaacactagctatgaacttatagctcgaacaaacaaaatatatatggatcaaaaggtgacaaacaaggtatccaagcaagatataaggtcaccaactatatcaattaagcatacaaatagatcaggtaaaaccaagctcaaacataacacgagagaaggcaagaacgagcgaaccaagagaggagacgcgtgacttgtttcccaagtttggatccacggattacgtcttcgttgaggggccacaaaggccgggtctctttcatcccttttctacatgaggttgcacaaatgcactcctcgatttcactcttaatttcttcccttgcagagacgaaattgaagccttcacaaactttttgtggcacaccacaaccttcggtgctcattggcgaccttagtccccaagagtaacaaacacaatcgaaaatttacttgctatgtactccaatgctcaaagtatagagtgaagctcactagctctcaaactctcttcccaactctcttctcttctcaaatcttactcacaaagatctaccacttaggctggagattggagatgggatatttggctttggatatatctatttcatgcctaagaacaacagccactcaaggaggggatggaggcgtttatatacccgagcctatcaaaactagccgtttgaggcaaatattccatttttcggaactttcgaaatgcattttcaaaaatatccgaaaaacactagagagcaaacctgagatttctgtctttttcggaatttttcaaaatccaaaaaacacgagagagcaaaactagaatttctatcatttttggaatttccgaaaacaccaaagagtaaaacaaccataacttttttctcgggagtcccttttttatgatcttggactctatggaaagctcacttagaagactaccaactcaaccagaagcaaggtttaaaaccactcaaaggataggttaaagtttggctttctctcaaggtagcactaggataggttattttgaacactgagatatacacaagcacaacaacattgcgtccctattaatagtacgatattcttatactcaaatataaataggaaaataattataccaataggaatgcctttataccatcttcctttctttgtcttaagggataccaacgctaaaaccgtttcaccgtatcctatatacctatacaagtcatccccactaattctattttcctgctctctcgctttgccacatcactatcgatttccatccgttggatcactccacttcaaccgatcaggttgcttttagcctgcctcagttctttattcatggatggctcccaaatactcggcccagcccagcccacatgcctgccgctcccgcaccggattggctccctctcccgcatcacgctactgccacccccaccgcatgtctctcgccgtatcgcatgccctccctccccgcatcgcacttctccaccttccccgccgcatttctcgcaccccaccccatccccttcctatctcgcatcgcgctttgccaatcccgtcgcatcggcgccgcacggccctccctaggtctgtttcgcctccctcctcccagtgctagccgcatcgccttcctcgccccatcctaagagaaaccttcgccgcccactaagagcagacttatgattgccattaacgcgttaatttcattcgcctctaattaaagccatggcgatatcattgcgggcctttgcttattaccgacgaagttctccagtccatacagaagcagaagcagaagtaggttcttggttgttctccacgaactgcttggtttcatatgaatcttcattgcataggtacatattattggattggtttaaactacagtgatcgttttgtagctttattttcatgcctttgaatctttcatatctaccgaaggtatttgatggtgtggtacctactccttccttctgaatttgttatgtgcctcctgtggattttcattcaggaaagatcaatccgtatgtgcttccttttcaatttgacctatcatctctttggcaaattcatgaataagtagccttcactgtactcgaggattattgggtgcaattggattcaatcttaacaaggtctgtcgtcttacgacagcttcttttcggtggatctcccatctgtactaaacacaccctattctcctcctcgctcagtaagtatgacattttattttgccttagactctcatctcttggttttgttaggtatcatatccgtatcttctatctgaagataagggaatttgttgatttttcatgacggacctcacaactgattgtataagttccattgtattcctgtacgtttattcgaggatccagagtattcaactccgttgtgttcctgcccgtatcgaggattccaggtaatcagatttgctcagattcaatcagctttgttctaatcaaatttgctcagattcaatcagctttgttcttgcagatttaattggttattcatccacagtttatccttatggtcttgcaaatccaacatggaagaattaaacatcttacaggtatgttccatcttagaatcaaactgacgaaagtttttccctcagcactttcagtaaattttgtcatgttacaggtttgcagtgaagacacaagaagactggggaaaatacatttaacagcttgaaataattgaaattttattatattcttttccctgcttgaagtgattgttgcagtattcatctttgttcgttcaaatgcccttcatagagaatgttcttcacgtttcttaaaaatggccttcccctgcttgaaattttattatgttcttcacgtttgttctggcaaaaaaaactgtactcaaacaaaatcattgtatagaacagagaatggtcatgatgtgcatttgttaaaagcaaaatctaacaagacgcgtacagtttctaatcttacaaaccaatatttaagtaaacaaatttaattcttgggcactatatacatggcacgaactattccaatcatgcttcaactttaggtggaagctaggcacttcttatacttttgaaacttaatattccactaatgatcc

SEQ ID NO: 52615 - DNA, 3519 bp, Oryza sativa
cgccaccactgcgcgtcccgcgtcccgcggcgccacccatcatctgtcgccgacccgtaagagagagaggaagagtgatacgacccaaataggggtgatgtcccgatcttcacggcgtaggatcaagaaccaataactagcctcaaagagacgaagataactagctgcaagtagccaagataacagtgcaatctgacgatcgaactcgaagctaaccaccatctctacacggcaacctaaatcgaggattcgcccaaccacactaagttaccaaccaacacaacctagaatcaatcgaggaaaaatcctcaaagggactaggagcaccaattgggaggcgtcgaacgccgcttctataatcccacaaggaaaccacaagaacaaaggggtagagatctctctctaaatttgttagcacgcagctaaacaaaaggggttcatattctcattgtcaaaagtcttctaaatgataaaacatgtgggacatttatactaggaacaaccctcctggatgggaatgaaaggtcttaggagtttactggacataggctaactcaaatatcatactaagtgaattcccgagaggaatcgcacatctgtttggcttctgagcagtcctcaatgatttatccattactccttattgggaagtcgaaatgacgaaccgttcgtttgttggaggtgaaactatattaatcacaggtagccaagtgacggtagtggttactgttatgattgataaaattagcaaattttggtcaatacctacaattaatacttataagacataatccaagtttatccgttctgaggcacatcaccaaccaaacagctcaaccaggcatattccatcaaaatctcagggaggcatgttgcacacggcaacaaccaaacagaccctcaaaatattttggaacaatgccttgtcagaagtttgtgggtgactactggttattctgcggactagtaatcttacacgtgcaaggcacgtttcccacattatattacactaatcatgtaaaatcacctaaagattattctaaattttccacaatatatatcacactcaacatgcaaacaaccaaagttcaagaattattgtagtgtaaattgcaatatcttaataactcttccgtagacactttctataaaaaaaaatgcaaagcagagaatgatacgaaatgtacaatgctgccatagctttgatatacactaaactcaactctatctacaacatctaatcgtgaaaaaggcctcccctatctcagtaatagaatgtcaaatggcccccaaacaatctgcaataaaaatatcatttaaatgatcaccaataaatacctcccgtcgcatcaccagtaacgaaaaccacaagccttagtattgtatacttgattaagataaatgtttacttattgatattgatattcaacagaaccttgttgaattctccagcttggtattctactttgtaatctcatgggaaaaaagcactttgctttgcagcaaagtctcaaaggggtgttgttccaagcagcaaacaacacaatttctatggtttttcctcaccgccgctcgcccgccacgcctcccgcgtcccctgcccctctgctccgcccgcgcccggagacgccgccgctccgcctgctctagccgcgcaccgcccacgcccagagccgccacttgcccgccgccgtgctcgccaaccgcttgccgctgccgctgccacgctctcccggagacaccgccgctctgcctgctctggccgcacgctgacactgcccctccgcctactccggccgcgcgctcacccatcgccgcccgccgttggcaaagagagagaagaggaaagagaggaggaggagagaaaagagaagaaaaaaatgcagctaacatgtgggccccatgatttttttttaatttttttttctgactaggatgccacgttagtgaaaccacccacatatactgccaaaggatctccgatgaatggtttgaatgaatttaggagcgaacatttctggttttaggttgagggacctcaaaaaatctcgctgttaagttgagggacctctgctgaacttattcctaaataatacgaaaagaaggcaggcgacctagcccaaatatagaaacggcccagcccaaagtcgcctccactcccactgaccacaccagggtttacgattccggtcggatttcgcgaaatttcgacgtttcgacaaggctcgaaagtagaaaccatctgagatttcgaggagtttcatccaaattcaaatttgaattgataaaaaagaaaaaaaatcaaataaaatcttataaatactatgatattcatgtaacctattgggatataaatttttttaaaaaatgaagtattgtgtgtatttatacatcatgaaagaatagaataaaaaattaaaaaaacacttacatgggccagattgcatgaaataggcccaattactgatcgaaatttcgatgatttcgatcgaaatttcaccaaaaccgaccggtttttgagaaattatcggtaaactcagggaatttgtattcaaattttggtttatgaaatttcttcagaagttaccggttttccacttgatttcgtgaaatttcgaatttcaccggtgctcgaaacggaacggaagggcatatcggtcgtaaaccctgaaccacactcatcacctcgccctccaaatcgcccacacctctggaaccccattccacccacccgcagccgcagcgaggagaggagaaacgagagagagagaaaaagaagaaaaagaaaaatgctgcgccacgccgcccgccgcctggccaccacccgcgccgccgccgccgccgccgccggccgcagcagcagggtgctctcgacggcggaggtgccggccgaggcggccaccgactccgccttcgcggaggcgtggaagaaggtggcccccaacatcgaggcccccgccacgcccatgtcgctcatgcagccccgcccccccacgccggcggccatcccctccaagctcaccgtcaacttcgtcctcccctacaagtccgagatcgccaacaaggaggtatgcgcggaccgtgtgcccccctctcctttgccctacattagctagagtttgtgtctgaacattcagtgtcaatgttcctgatgtaaatttctttggttgagaaaatctttccttctcaagttctatgaataaaactgcatattagtatagcctactattcacttatattttactatgctgcataagaagcttttttttttttaccgtgcaccagttatactccctccggtccaaaatcttgtaacctaggactggatgagatacatcttagtgcaatgaatccacaagtttataaaaaaattagtaacatctacacaaccaaattagtttcattaaatataacacggaatatattttgataatatattcgttttatattggaaatgttgttatatttttctaaaaacttggtcccactttaaaaactaagtgtaactaaagaaaaatc

SEQ ID NO: 52616 - DNA, 20635 bp, Oryza sativa
  unsure (1)..(20635): unsure at all n locations
atttccaatataaaacaaatatattataaaaatatattccgtgttatatttaatgaaactaatttggttttgtagatgttgctaatttttttataaacttagtcaaacctatagaagtttgactaagaaaaaaacaaatcaacttataatatgaaacagagggagtataagataaatggatatattttcctttactaaaatctgtaaaaaaaaatgaaaatagttctcctttagttcatatagtttcttgttattaggctgattgctacgggtcatggaggaggcaatccgctctggccatacatcaccttcccatgggcacgattgcagccaagattctgccgtgggaagcgccatctcgtgagaccctactgaggacaatcaatgctgctctcgatgacggcaatgtcgacgacgtgctgcaagcatttgccaattacaagaccctgcatggccttcctgagccgcgggtgttggacaggatgatcgtgtcgctgtcctatgcgtctagcaggagatggcttcagagggcattcgacatggtcttgtcagtttaccaatgcaatggcaaccttcttaattgtggctcgctgatgaagctagctctggcgcttgccagagatcagatgccgattccagcctccacagtggtgaggatcatattggagagcggcaagcttcctgatgttgatatgctgaccatggtgtacttgcatatggtgaagtcacaagtaggatcctatcttgctgctgatgttttgtgtgagacctgcgagtgtttcttggagcagattggagatagaaggcagctgaaaaaactggatccaataaagagtaatgttaccttgtttaatatggttttgaagtcatgtgtcgatttcaaatgcatgatcaaggcccaaagaataatggagcttatgtcgctggttggggttgtggccgatgtaaatacagtggctatcgctagccttgtctttgagatggttgggcagcaagttgaattggtgaacatgaaaagaagtatcgattcttttgcatctttgccgttcattcagcactatctatatttttatggaagtctgctgaacctgcatttcaaatataatgacatggatgccgctgctcagcttttggttgatctgtatcgacaacaaaagcctcgtgcttttgttggtgatagtgtccataaacaaggtgtaatacagataggctctggcaacctgaaaactggattcagaataatgtttgaccccataaaagtggacaaaggtttcgttttagatacagaaagtcaatttggccttcttgctgttattgatggaaatattcgtcctagtgagaaggctcttgctaaattcattgttggctgtttgaaagcaagtaaagtgcgtgcattgtctagctttcttattacattacacaaggaagatctaaaggggccatctcattcagatgtaattagtgcatgcattctgatgggatggttgcatgctgctcatgatatcctggatgatttagagtcagctgagattcctgttctaatctgtacttacatgtctcttttgagagcatatgagaaggagaataaaccggaagaagttaataggtttctccaacagatacaaaagaaagcatatacaatggctgattttcataccaatccatcctttaccataaaggatgttgccaaaatagtcaaggatgagatgcccctcagaaattcgtctttgctttccagtttggttcaagaaatagaacattatagctctcgagagcacttaacttttgagttcaataattcaattcttttcttctgcaaggcaaatatgatggacgatgctttgagcacatataagcggatgagagagcagaatgtaagacccagtctgcataccttttgccacatactgtgtggatattcttcactaggcatgcatagggagattgccatgctgtggggagaaataaagcgcagactcgaatatggagagctaactgtggatagagacttgcttgactgcttgattttgaatttcctaaacgctggctattttgcaagagtcatggaggttttaagttacatggcaaaccgtaaaatgtactgtgacaagtggaaatacaagcaagtttttctaaagctacacaagaatctgtatagaaatttgaatttgctgcatgaaaaaacagaacaacagagtaaaagaatagaagatgtcagagctttcagatcctgggcaggcgtcaaataggtaaaatgactgcagcactgtaatccttttgcatttagagaacactcttcttgtgcatgcacatctgtacagaattcttccgatgtaacatcatccgcatctgttgtataattctgtattgtcctttcaagtctttccatttattcttgatggttagttccaattccttagtactcactgtaacatcttacatgcatggattttttttttctttgacctctaaatccactttcaaggcttctaaatcaactttcaaggcttcaactatcgatttttttttatataaatggcccgtcttttctttcatctgttttggcatggatcatgaatctcatagcagcacatatttcctcttcaggttccaggtggttgctaattcttacatttaaatatgttgaccattgataatcttattgataattttattgtagtactggccttgtggcaatcttagactactgtcttaccaacagtaatgtttctttcttgtgatattctacaaagaggctatgctgatacagaagatcatgctgttgcttcaagttgtcaagtaattatttttgtgggaaaccgactccttgaccttacgtcacaagcaagatcaattgcatagaccacaaatggtatttattattttgaaacagttgtacactttgacatctctgacaatcatttattaccgatttcaagtttttaatgaaactgatgaacttgtaggcctgatgggagtttgatagagcacttgcagtccagaccttactggctactaaggtttgccatcactaataccagaattgtccagtactaccatgtggggtacacaacttgaacagtaactttttttagaggaacttgaacagtaacttggcatgcttaactagttgctgtggttctagaggacacagttatgaagttgaggcagatattctaattgtgatattctttttaatatagtcatatgacataagtcctggaaactctctatttcctaaatatgtgcagataatagagcaaaaacaggaaaaatgtttcaataacacagttgatgttcgtgcttaatgattccaacttttacctaaaaacgctcacatgttgaaggatgccatattgctatgaatactaattttaggaagtttttccttttagttgagcatagctgtccatcagctgctcaattacaagaaatattttacttctaatagtttttaggctttaagcatatattgcatttgactttgcacgttaaaaactgatgctaagtttccacatatcaatttctttactgttggtgtgttcattatttgattcggtgcctctttggaagcacgggtaattggtttggcttctttcttaactttagggctgacatcattgttggggatttctgcaggtgctgtgtttataaaacccaaaggatagttggattgatcagttggttctttgtaattttagttaaatgcaggactatggctatgtcacagtatttatctagtaccaggttgatgtaagcaggtgcattctgtagatcgtgtctttccgaaatacctagcttggttgctcttatgctaaatataatcaattatgatgtgtctatgctttctgggtgcactatcattttgccatgaacttgtgattgttcccatccaaaacgtggctatttgtgtagtctggttcagaaagaatgcgatcatcctcattgcaaacctctgctttgtattataacccataaataaattaaaaaaatatatttctttaccggaaaaaatgagaaaatgtttaaggaagaaatgagtttttttttttaatttagaagaggagaagaatggaacggtggcatgttttccgatgtaatttttgtaaaatatttttatatatgaacttcctagaataccattttaaatccatttttcgagttgataatagataattcatttgtttgtatcctctaataattgtcaaaacgcttcgtccattaagcatgaaaaaaagtagccatttaacatataagaactatgtgtgctgtggattatctacttgattatatggataaattaaacattttaataaataactttaacaaggtgttctaagcaatccaataaaaattctttttttagaaagcatattcttagaaacgcggagtaaataatccattttaaaaaatccaataaacaatatgaataagttcacttgagacccttaacttgttaacgaatctgattttcacctttcaaccggaaaccatatacccggtgcaacataggtcccataatggtttgaacggtggttttagctggcatggctagtttgacttgatctttatcccatatagcatccacgtgacgtttaaagtggcaatttgatatggaaatgtgttctcattcgctcctttctctctctctttccacatgatgaagagatgacagaggaggaagaagaacgaccgggagagagaagaggagggagtgagaatgacacgtgggcctcaccatttttaattattatttttattatagctgacatatgggtccacggtttttattatttcccagatcaaattgtcatggcaatgccacgtagaataaagaccgagtcaaactagccatgtaagcgacatggcagcgaaaaccaccgtccaaaccgccatgggacctatattgcgccggttttgacagttgtgggatccgttatatctatttttttggttgaaggaccaaaatcggattcgttgatcagttaagggacctcaagtgaacttattcctaaatgatatgaaaagaaggcaggcgacctagcctaaatatagaaacggcccagcccaaactcgcctccactcccactgacccacactcctcacctcacctcgccctccaaatcgcccacacccctggaaccccattccacccacccacgcgcagccgcagcgacgagaggagaaacgagagagagaaaaagaagaaagagaaaaatgctgcgccacgccgcccgccgcctggccaccacccgcgccgccgccgccgccggccgcagcagcagggcgctctcgacggcggaggtgccggccgaggcggccaccgactccgccttcgcggaggcgtggaagaaggtggcccccaacatcgaggcccccgccacgcccatgtcgctcatgcagccccgcccccccacgccggcggccatcccctccaagctcaccgtcaacttcgtcctcccctacaagtccgagatcgccaacaaggaggtacgcgcggaccgtgtttgcccccccccccctccccctctcctctgtcctcctcggtccccagatctgtgcgtgtggcgtcgctagggtttcgggtatgtgcgcgatctggggtttgcgtcgtgcgattagggataggggttgggtgggtcaaggcagcgcgatccgattcgtcgagctggtgtggtagaggtctcgcatccagactcttcatccgtaggaatatatcatggtcaatgcttctatcctccgtttatcgtttgcccagaatgtttgtgatgtggccatttgttgggcgtgcgtatttgcaatcctattaacacgaatgtgtggcggtttacggttgtacatggctgttgaatcataccaggtatttccttgttttgttgctatgagttggagatgttctttcatgggacaaacataacgtagcgtgattctccaggtggctagatgtcatatgactatagaatttctgctcaacatttgattgctgttgagtgttggtagcaaattgcatttcttttttcttgtttggggtgcttgtgtgccttaattgcaaggagcatagagaattcataaattgatatttcctcgccttaaaagactgtgtttttagttagctatgaacctggctaaattcgtgattcatacaaccaaccaaacaaaatcttcaataaacacggtccgctccttggggacagaggtagtagtagtctagtgaagtatcttttggaaaccccgttacattttgttaatcagattgaggattccaggtcgctccttgggtgtttcttatttatagatttcaagtttctcttgctaggattgctgtgtgccaggccaagttttaattctgactacaacagtgtattcagacctgtttatctctagtgtttgtagtgctatgcggctttatgcattgtctggatttatcggtatagttgcagtttctcttgtttacattaactagagtttgtgtctgaacattcactgtcaatgttcctgatgtaaatttctttggttgagaaaatctttccttctgaagttctataaataaaactgcatattaatatagcctactattcacttatattttactatgctgcataggcagcttcttttttgactgtgcgccaattatagcttttgtccttgatatatgttatttgccctgtgataaccaagtctaatactacttgtttagttttgtggtgattttctttgtttcatgttgtttcctttagcttgcttgttggccttgatggtttggtactgtttacttaatggttaatggcactattaagaagtttcagatcatcaatttttccttaagtatgttgctgagcgtcatgttcttttgttgctattgtgtatgaaatataattggttgatggtgttcgaaggttgtctatgtttgtgttgttgcatttcaacagatgataggcaaattatctatcagttgattcacatagattttgtatgtcaatgcttgattcaacaatactactgttaatgtaccaattaattcttcccccatcatcaatattgtcttctgttgcttctttcccttgcttatgtctttgcttgtctatactcaggttgacatggtaattgtaccagcaacaactggtcagatgggtgttttgccaggccacgtttccacaatcgcagagctcaagcctggtgttctctcggtacacgagggaaacgatatcaccaagtactttgtgagcagtggctttgcatttgtccatgcaaactccatcgctgatatcgtggctgttgaggctgtccccctggaccagatcgacccagccgcggtccagcagggtctcgcggaattcaacgccaagcttggatcggcctcaactgaactggagaaggccgaagctcagattggagtggatgttcacagtgcgctcaatgccgctttggctggttgatcaatacgtttttaagttgctgtccctctctctcttttgcatcttcatttttagaatgtgagctgaagtttgcaaactcatggatgatgggatggagggaatgatcttaaataaattatactccatctcaaagacagaaccctgtttcttcttttaacttgactcctgcatggatttttgtaatagtgaatatttttctccgagcctacaaagtcgaagttttctggttccagttttccatcctgagtttacgcttggatcaaatgacaaaacacaaaagccgttctgtttctagcttctgatgaattctcttatgtggagagtgtagtcgtcaagattaaaatccacttttggtacggtacacatcctgtgttcaaactatgtggtgatgttaagaaatcagaaattgctgctgtttttcaaatgaagaatatcccaatgccgtacttaagagaaaccaaaacacttattttttgaaaaaaaaatgatatgcacagcacaggcttgcaatggtagtagaacaggcgagagcaagtcatcgaaacaaaatcaggtcgtaattatcccaaaaattagtactctttccatttcatttcgtattataaattgtttgattttttttctagttaaactttatttagtttgaccaagttataaaaatatttttttatctaatatatcaaattagtttcattaaatctaatattgaatatattttgataatatgtttgttttgtaaatactactatattttttttataaattgatcaaatttaaagaaatttaacaaaagaaaatcaaataacttatcctccctccgtttcacatcaatatgaacgtgagaaattctagcacatcaatatgaatgtgaaaaatgttagaatgatttacattgtgaaacggaggaagtaatatagaataggaggagtagattacatgatagaatagtagtgcgtttgaactttgaacacagggaggtctcaagtctcaccatgctgcgtgcctgcgttgcatgtagctgctgccttcgtcatcttcatgtgcaccagcctccgcgccgccggcgccgcgctcgcgccagccgccagcttggccaggtgcgccattcgccgccgcttcgccgtcgctgccttcttcgcctccggggaggaggaaccggagccggcgtggcagcgaggaggcgggggcgatccctcctccggcggctcggggggaccatccagctcgccgtgccgcgccgcgcgctccagggcccgcgccgcctccgccatggacgggcgctccccggcgcggtcggcgaggcacctccacgcgagcgccgcgacgtcctgcgcggcgcggtgcgagtacctccccgcgagtcgcgggtcggggagcctcgagaaccaccgggtgcccgcggggtggcggcgcgcccagtcgacgagcttctggtcggggcgtggccggctccggtcgaaggcgcggtggccggtgaggagctcgagcagcacgacgccgaagctccagacgtcgctcctcgccgtgaggcggcccgtctccacgtagtccggcgccgcgtacccgtacgtgcccatcacctgtttgattttatgcccgtttcatacacatcacacgttgttgttgattgttcatgcttgcattgctcagattaatacataataatcctattattcctgtcctacttcgcactaaaattgatttctaatgtaccaatcttttgataaccataacacccaatgttaaaattgtacttcctccgtttcacaatgtaagtcattctagcatttcccacatttatattgatgttgatgaatctagatagatgtatatgtctagattcattaacatcactatgaatatgagaaatgctagaatgacttacattatgaaacggagggagtagccattagtctccgatcgaattttattttattttttttgcaaaagtttagccattagtttgaactttgaactaaattggaccgccaactctcagatcttaaatttctaggggttgcattggttagcttatttttgttgaaagggtggaagtttcgcattcgttgaactgcatgaatctttttgtgaaaacacatctctccaggtgaaaacagattatatgtcaggacaaatgcctgaaacgatggtttggccgcctaccaaactttctagaccgttttgatgcccgattcgaaccaaccatgaaattattcaagaaaatactgtaattctacttttttttttgtgcagattgaatgcaagtagttcttaaggtaaatggtaaccatcttgctagtactgatgacaaatgacttaccgctgtggacacgtgagtttgtccatccactgggccctcccttgctaatccaaaatctgaaagttttggtctgaattcctcatctaacagcacgtttgatgattttaagtcgcgatatatgacctgtaacataaagagtgtcataactacaagtctacaactctacaacatgtgaacacaagcatcaatagttcagaatataaacactggaaaactctgttaatttgcgctaacaagtatagaattatagatcagaaagccttctgaatcatagctcctgatacatatccctatgagactatcattgcaaaactggaacaactgggagttgtcacttaactctgagcacttgggttttgagatagcattaatgggaaacagctgtattatttgtttactaatgtaacatagctctagagccctaagcttctaataacaactaatagtaaggattaaagaaaacagcagaaaaagcagaagaaaagaggaggaaaaaaagagcactgctatttacattgttctctgaacttgtaactgacaatactcaatatatcgattatcgaagttgttagaccaatacctgaatttccaacccttcatgcaagtactgcagccccttagcaacgcccaaggctatgctaagccttgttttccatggaagtgttgggtatgctttattgaacaagtgatattttaaggtcttgttaggcataaactcatacaaaagggnttttggggggaaatttttaattttttttcttaaagggggngggnttttccccctttttntttttggttttttttttaaaagggggggggcccccccaaatttttaaaaaaaaaaaaaccccccttttnccccccacacaagaagtctctgaggaccttgttcgccgtcgtcagtcccgcagtagccaatgagtttgacaagatttgggtgatccacaacagcaaggaactgaacttcagccagccactgcttatgaccctgaaagtgatgtaattgaggaataaatcaactttttgaattgatggtcatactggaagaattgtagaagtataaataacatttaaacaaatttaatggaagaatttgttttttcagattgctactccaagtgcatgattcctcaaaatgttgtaattactgcattctagatgttaaaacttacaagccatggggggttcattttccttttttgcatataagacacaagaaattcgtgaggcataattttctataacatgcagctataatttgacagttatatatttgctgagtattatgcatgggaaatgcaaaatatgaactaaaaatgtattttaccagtagtctacatttgagaataattttgctaaaatccttgtcatcagtcatcctgaggctaacattcacattccattccataagtgataataattttgaccaaaccatcctgcccaactttttagagtactaaatgcgatttgtataaaaattgttacacagcctggaatcctacattaaataatatactcggcacgattcgaaagtaaccaatatgtgcagaatcagtatatttacttatgcaatttgatcccaggctccctgcatccctttgtttcataataaaaggtatgcttcaactccatttaacaattgcagtgtacatagaaacatgattatagcatctaacattcataaggtctatcgaagacaatcaatacctgcattccattaggattgagcttcttgacagccaccaccacattgccactgtcattcctgagccccaaatgaccgcaagaagtttttaggaagcccttgtacacactcccaaaccctccttcccctatcttgagctctctactgaagttaccggtagcacttctcagctcggcaaggcgaaaatcacggagctcatgcgcacgctcctcgtatagctccagtatgctccgtggtgatgaagcaacaaccaggctgcatgatctgttggccttcttggacatttcatctctgaagtcatctttgtctacggttagtgtaggggatgaccttgattgcttcttgttcttattcttgttcttctctcttgagtagaagaagcagcccattgtgattgtgctagaatgatttggataagtatggtagttttttcagaacagagtggagcattacaattgtaaatcttgtcacgattgcaagaaggaagagaaaacaagagaaaatcaaagtataggcagaatgatgctagcaacaaacttaggcatgtaaacaaggcaaggattctttgcaagaaagcagtggaacatatgaacttgcaagaccaactgaagagctggaagtaggatctcaggaaaatgagaggataaaaaaaaaagttaagaagaattcatgaatgttcaactttgtcaaagaaaggtgatgccaatatttcaccagaagaaaaacaaacaagtgaaggctgttcaaatagctcagttctggacgctcaagatgtaaagaccacctcctttcctagaagtccaatggagctacatagagagatttcagtagtagagaaagccatggttacaaagtaagggttgaagaaggttagttacttctaagaatgatttaggtacatagctctgctccaagaatgtgtgactttaatatgtagtgtatataatgcaagaaggcatcacaaagtcgcacaaaagagaatcaaggaaggctgtgcttactttgaccggtgaaactgatgtatatataatcttgtgaagaaggcatggagactgccaaaattcaaccactaaagttagaagacctcattgcacagaagaggagagatgtctggttctgaagcttggagagagactggagtgtgatttcatggtaagctctggaagaaatactggtcttctctgtctcttctctagtagcttagaattgtattttcactaacctaatctagagcactaaatacatagccttacaagttacaccaaccctcttgacttattgaccccactgatgatttcaacccctatcattctcttgtgatgctttcattttcagtaaatttggttgacctttgggagctgggacttgcaaacctgttgcatgtagtagttccataatgttttctgccaatttagttactaaaattattacatcacatggactgcttcttgttacatatctggcccatgcagtttatttcatttagtaactgaaggtttggcatgttttacatctacaatctagttattagtttgtggaactagaataatctccacattttgatgtcgtaaatgatactatttccaaaactaatcaatcatgtctagcaaattatgtctttttctccttgttagtacttactaataatcttgaaaaaataactagttgaataattcatacatgattaaatgatattcagcaatcgttgttttccatgatctccctctcttttaagtatgaatttattttgataagaattacaaaaaaaaaaaatctggtaggattctacttctgatgtacattatgctaatgtgagagcaacggacatggatatcaagcatttcgtttcagaacaacatgtgaaacttagtatcaatgtaaagtttcttactgtccttcattacagctcattaaattgatctaaaagtttacaattagaattaagaatggcaaagcatggtctgatcatagctgtccatggcttacaatattggtggagtcttcttaggacaccaagtaaaatgcttctttagtgaatatttttgtccttaaaatctccaaagatcaattcaactcatatattaaggactatggaggaatgatgccctgttttgtgccactgacactattgaactgcatgtttattgttttctgttatttccgaagtaactgctgaagaactgacatgtcagcttaaactggaacctggtatccattatcaacgtctccccatcgtcttaaatgctaggaatagtttcttttttcgtaagtcaaacagatctctgatcgaaacacatattgctctgttgagttacatatttctggatctgaaatttgcagatagcaaagctgcggcaatataaactgtctctgttgaatttgtgaatactaagagttcctttcttaaacattatctttgactcaacgagttttagctttatattaactctgttgttcaatagataacgccattaacttttggcatggcgtttgaccattttcttactaaaaactatataagtatcatttatttttttgtggcttcttttatcattaacataactttaaaataacttttttttcatatttacactagaatttgaaataaaacgaatggttaaacgttacactgaaagtcaatggcatcatctttataaaaatagaggtagtatttttctattcatcctaaacaatggttaagtctatgctaattggcatgcccacgagaggtgaaggtgtaaattgatcttgggatatgagagcatcaaacagctctttttaaagttaagcatgattaagcaaagtcaatcctacctccagaacctcatgtgacttcgatatattttccatgtattatcatctcccacatctttggagcttcagttttggtaagaggaaattactcctcttcattagtctcaaattaccgtaggggatattgtctattcactggcacaaattttaaggaaaaatatcctgaaattttatctaattatttacctcaatgtctccttccttgaaatctgaggcagtgaataagggatcatattttttaaggcaaatatgaaggatttgctttctaaagttcatggtactcaggatttttttaaaaacattgtattgaggatcttagaatagcaaaaactatcccaccaagtggaagcaccggcgggtagagtcgtgggtgcatgacttcacccaccaaggttcaaatcttcatgcatacgaatattatgcacatgtaagtagacttttaacatgtttttagtaagattagggatgtgtcgctagttctcgtctcttaacagcggagttgtctccattcctctcccactagctgtaagctgttagatctcaattctccttccatacctatctcctaccccattgacttgttagatcttgattctccttccatccctatctgctacccatcgatcgtaaacaatgtgactcatcctaattatatgggtccaagcaatgcaccaatgtctctgactcatcctaattatatgggtccaagcaatgcaccaatgtctctgttggtcgaaaattgtactactccccaaatataacaactttctagctatatatctttatctggataagagcatattcagatatatagctaaaaattactatattttggacgaaggtagtagttatgtctcaaataagtttatttttcacatatcccacatataccaatataaaaaaaagactacaatatcctcattttatcaaaccccaatgcaattattgctctctatctattcccaatacatttatcccctattttcacaaacttcggtacaatggttgctcaaaaataacttattttgggacaatagggaaagacaaaaaaatcttagggcctgtttagttcccctggcaagttttttcaccctgtcacatcgaatgtttggacacatgcttgaagtattaaatatagacaaaaaaaactaattacacagattgcgtgtaaattgcgagatggatttattaagcctaattgctctatgatttgataatgtggtgctacaataaatatttgctaatgacggattgattaagcttaataaatttgtctcgcagtttacaggcgaaatttgtaatttgttttgttattagactatgtttaatagttcaaatgtgtgtccatatatccgatgtgacacggcaaaaatttttaccccctggatctaaacacatccttaggaagtgtttgagaggagggaaaggagaagattgagaagatacacaaaacgatgtgaaccattagcacataattaattgagtattaagtatttcaaacttaaaaatgattaatataatttttaaaagcattttttaacgttttcgtagaacttctcttttaaaaaaagacattgtttaacaagtcaggaagtatacgcgcagaccgaattctacggcgaagggagtactttctctgtcccgaaaaaacaaacatcgtctcgcaaaaaataaatattcagttttagattttttttttttgacggagggagtagtttgctaggtttccctggtaggagtatatgcttgcctggtcgaactgatgggagaaaaaaaacaaaaaaagggtactttttgtactgtgctatgaccagctggtactgcctccagcttgagcttacctgactctcagactgaaagcaaccattcatgccactagcctcccattctccctgtgtcttcgagtccctgtcacagtctaaagttgctggctggctctccttacaaagtctatctggtagtacagtacaagaccaaataacttatttttattaatcaagaaaagttgtatgagaccaaataatttggcctggatgacttgggagaatcgcttatcgcttatcgctaggccctatttagtccccaaaacaaaaattttcacgcaatcacatcgagtgtttgaacacatacatagaatattaaatgtagaaaaaaacaattacacagattgcgtgtaaattgcaagacgaatcgtttaagcctaattgcgtcatgatttgataatatggtgctacactaaacatttgctaacaacggattaattaggcttaataaattcgtctcgtagtttcctgaattctacagtaatttgttttgttattagactacgtttaatacttcaaatgtgtgtccgtatatctgatgtgacaaccaaaccaaaattttttttccccaactaaacaaggcctttttggaatttggaagtctttttacagccacggttcatgaccagcagcaaagtaaataaatgaatgattataacacttctactcttattttagcagttcaaaaggccgaggattgaaaaatggaaggcgcctaaaaccattacaataattctaaaataaaattctactagaattaccagaataccgagcactgaacatcacttccatccaccatgatgatgaattgtgtggatactccgagcaagcaacagaataccagatcaatatggaccagaataccggcctgcccctgtcatccctcgccttccaattgcaggcatgaaccttgcttacaacttacaagataaaataaaccaatgcctggggcagcacaccattttaatcaaggcacaaacaacatcggctactttagaattacgggatcccacagattcgctaattaaagaacaattggaattacgttacaacattgatcgattgatgtctttttatagctacacttcgaatgtggagtgggcctgcctgccaaggtgcatgcatgcggcaggcctgtggaggtggcagtggcggcatgatagagaccatcgctggcaaatgccccccactcttgcagtagtccaccagggtgtctccaagccctgcaaaactccagtctccgcctcatggcttgtggagcttgaatccaaatacacgaggaacgtagcgctgcgagggtttctgaggcttgaggtgctcgtacgtcatcagaaacaggtgcgggaatgttgtcccaaagtatgcgccgtcgatgtctgaacatggtcaagaaaacagcagaatataacaacaaaatggcagttctatgtaactatgatatcaatgtaacacagatgagagtgtgtggacttcatctaataagcgataatatatattggcactgagaacactaagaaagcaaaagaccatgcgttaaagattactgaattgtttatgtccttagtattgatattagtcgtcctaacaactgtatatgtctgcctgttaaaacttgtcaaagcatttgccaaccactcctatcagcgaattagggcaaaactattagaatatagtaatgctggaaatccaaaggaattctattttcttccagagaaaaacaaaaaaggaacgctcatatagacagtatgataagagagtggttaggatactgccttggtacttggaccgtggatagtagatgtcttcacacttggggcagtatatcttcacagtactagatcggtgtatatctgattgtccaactggtaaacagggttgaccacagcaataaactcgtgggcatcttccaaaatcatagtttttgtacttctccagctgtgacaaaaaatattaacaactgtcaatttatcataaatcggaagtacaacaatataaataccaaagaaaggtaccattgcagccaatcctttactggtcaaaatgtatcgtgcatgaatcagcccatataacatctctgcagctgactccactagctcgttttgttcttcggtgaacatgtcacctacatattgacacaatcaagaaacattagcaaaaagaatgagaacagtagaaaagagaacatggattaaagggagctactgcattatgatgccataaagaaggctgtgttacattactgatgggttatggcatttaaaatagcagacaaaacaacacacatatcctctccatgcttgctaattactaccacaccatttactgccacagaaacctaaagcaatctattagcaacatcactcttaataacattagggcacctaaacaggtgaccaagaacaaaacaaaatcacaaggtttaataatagtgagaattaattttccatgtaatagaacagaaagtttctaagcatgtactatgggtactatcaaggagcaaacgacaagtaacgcatgatggtgcagccatatgcagagttgcaaaagagacggtcatccagaatacaaaagcacaataactaacagtaaaagaaaaggccttttgacctgcactggttatttgttcataatcatagaagttgataacagagatcaattcgaggagaaaaaaaggaacatctatgttttgtgttctttctaggagaggtaccttaaattagtcatggtactccacaatatctaatatctagcttaagagttgaacaaatatctaagaattgtatgtacttttgtttaaaaagtctaagttgacctctgtttggacatcatcaatacaagataccagtttcaactattaagcagatcaaggaagaaatacaggaaacattttttgctcaaatacatccaccatttgtttcatttgcatacgtaaatacagggaacatttaccgtgagaagattcgatatctaaaatgagatcaagagcataatcataatatggaacttgactgctaagcccacagaggttgaagtcatcttgtatataatcatcatcaacctcacagaagaattcattccctcttagactgcagtaccatgaaatccatgagtgatcctctccgtcagaaccactaacatctgatgcttcactatcagattcagactcccctgcaatgtcaagcatggacttgtcaatgcaaaggcttttacaaacaatgatgcaaatgcagcatacctgtaaacacagtatcaaatctgaaataaaacatagcatgcttaatcaacacctcaaaaaacttaaaagttatactccagttagacccgcaatagcatagatgaattaaactaatggactcctcaacccgactggcaacattcatgcaaagaactgggcaatggaaccaaatttaagcaatcaatgaagcataaaaataagatattactgatcgtatgggccacttgatttttggttttggtaacggagaccactccaggaatgtaatttcaattaacctttaaatcaacaacacatgcaaaaaatttcaggattgtttttatttttgttgtccttggagttgtttttgttattcttgtacgtaattaagccacgcgttgtatttgcatataaaatcatgaagataagtgatgttagacaatgccgttaatcttttttgcggtgcacatatggaaagcccaatgggaggtaaggccatttaaggcatttgtgtgcttttacacaacattaactatgcgtctatgcctgaaacaagcagatggtaaatcggatacaacaagcaaacacttcctcaataagatcctacatcagcatcttcaaacatcatcaaaacaacagcccaattaacacaaccctgaaacacctccaaaaaaacttaaactgacatctctacacacatatagaacaaataaatcaactttcatagtcttcaacacatttaggatacattaaacagatcattgcaaaccagtcacaatacctccaacgctccaacaacttcgccgctaatgaaaatccacaatcaacaatcaattacattcctacgtcaaattagttattccctgttaagttctatagttccaaacaggttcataagctcatgccatcgatcaaacaccacatgtgacgaatggttccctcttaggaaagctccgcagacatcctaatcctaacgtttaaaatcaaacaataaatttctaccgcagccgcctgaatccccataaagacgaatatatgcaatcactaatcatatcaaacacaacggaataccaatccagaaccagttccctgctgccgcagcgcaatctatcccctcccatggccgcaaccgcatcagcgcaccacgcaaacgacggatttctcaatctcaggcacgacgcgccacgcgagacggccaataaaaaaaaaagaggagggggaaggcgagtcggtcgcgtcgcgtcgcgcgtgacgtcaccttcggagcaccgtcccttgggcatggacgacgcggaggacggcacgacgaggcgctggtggtca

SEQ ID NO: 52617 - DNA, 2573 bp, Oryza sativa
gcaacccccgaccttgatttaatctggtttggctctgggtggtgtgtgtgattaagtagtgttgactggtcaagcatcaatttcgatattatttgaggggaagtgcagtttgtgatttgaatttttattatcatgagtgaaatattgtttgaattagtgtatactgtgtatgtgtctcgtttttcacgtggacgtttcctaaacagttaaactgtgtgtttttttttgaaaaatctatgtaggaaaatgcttttaaaaattatattaatttatttattaggttttttataatatttaattagttatatactaattcacagctccgttttgtttaacaacccctcaaacgaacgcaaccttagattattatagggatggaaatgatacgatggtaaggaactaattggaatggtaataatatattgatatagtattcttgtaagcggtgtcacattaaaaatataacatctatggtttcgaaaattccgatcaaaccatctggttgaacttgtcaactaaaagaagaaaaatagtatgttgattctgcttgaaaataaaaaaacctagccatgtgaccagtttcaagaaaagaaccaactccggctacattttgcgtgaaaatgtctcctacagtattttagtgcacgttaatacagcaaacaacgactaaggctgagtttgcgaaactccaccttcccgcacgaaaaaagggtgttcctcattaacgcatgattaattaagtaatacctccgcttcagtttataaaactttctagcattgccaacattcatataaatgttaatgaatctaagcacgcacgcgcgcgctattatatatatatatatatatatatatgaatgtgggcaatgctaaaaagtcttataatattaaaagcaacttttttacataattttttttttaaaaaaacacacatttagtagtttgagaagcgtgtggacataaaaagtttgcctaaaaagaatgaaatgagttgggaaagaaattgaagaacatagcctaagggctattttgattatgttggatggtcgttgattttccgggcacgaaaatgcgaagagtcattacctcatgcttaatagtgtatcgattattttaaacttaagaagatttttaaaaatatatatatatatatatatatatatagaaacttttacatacaatgtaccatttagcatttctaaaaaagtgctaacgaaaaagagaaaattaaaccgtttcaagttattaaaaagaactcagcttaatacaaagaaaaatcatagtcatgtactatctttggttgacagttgatatctatcctcaatgcgtgctgctagcacaaagcacttgtttcctatattacttaggtctcgtttttttttcaacaagagttgaattaagattaaaattttagtggcactttttcaaactgctaaacggtgtatttcgtacgaaaactgtctatataaaagttgctctataatatcatattaatctatttttcaagtttataataattaaaactcaatcaatcatacggtaataccacctcgttttgcgtaaaaaaaacttcatcttcatcttcaggagaaaataacaccacagtttaatattacctccgttttttaatagataacgccgttgactttttctcacatgtttgaccattcgtcttattcaaaaattttatgcaaatgtataagatataaatcacacttaaagtattataagtgataaaacaacataacaaaataaattataattacgtaaattttttgaataagacgaatggtcaaacatgtgagaaaaaattaacggcgttatctattaaaaaacggaggaagtagatcatgtttcctttttcgtacttctgcaagtgaatccacctaaagtttaaacactactacccatcaaatgtgccttttaacattattaaatgtttgcaaaaataaacctttagccatgctacgtgattaaatccttatcacacccttggtaaccaacgtgatggtattttcttgtcattccgatgaatatgacatgatgatccgaatatactttttcataattatgtttaaaattaagtaaattacactagcggttcttaaacttgtaacgaagtttcacttagatccacgaacttgcaaaatacgcattgagatacctaaacttggtttaatgtatcatcccagtccaaagcctggtttaaccgtggtcttacctatgtggcatgccacgcggacgatgatatggctaaatttcttttccccttttttctccccatcttttctttccttcctcaccttgcgtggtggacgaggtttccggcgacggtcaccgtgcgttcttgggcaccggccggcgggaggagaaaaacagcacgcttgcccgggtggtggccggtgaggagaggagcggcgcgcgtgctcaggcgcccggctggcagaagaaaaggaccctcatacgaaggcccagggggaagaaaaggaaaaggcgccccccgccaacggcaacctatgatttctccctctacttcctcttccgccgctgcccaagacgagaacgatggtgat

SEQ ID NO: 52618 - DNA, 3266 bp, Oryza sativa
aggcgtcggtgagctcagcgtgagcagggcgggcgcaagctcgatggcggtagcggggcggcagggcctaccaattagctccgaaaaaaagaaggtgagcttgttgaacttgagcagctgccgcagcaggctggagtggggggcctttcccctttccctcctccttttccttcccgtcgatgacatcgttgctgctgccggcctccccaccccctcgccagcctcgcggggcgttgacaggtgggtctcacctgtcagcggcagaagggagaggaaggaggcaaagtggagaaaaaaagggagaagaagagagaaaaaaagaaggaagaagggagaaaaaaattccatatcatcgtccacgtagcatgccacataggcaagactatggtcaaacgcagctttagaccgggatgatacattaaaccaagtttagagatctcgatgcacattttgcaagtttatggacctaagtgaaacttcgttataagtttaaggaccgcttgtgtaatttactctttaaaattgaactagaggagtgcacttattttgagacggaggagtattatttaaaaagtttacaaaataaaaaaatatagttgcctctcctgtaccactctctccattcaaaaaaatccaatctaggcaaggataaaatataacctaggacttattcagattcactgtactaggttatatttcaccccgtcttaagttgatttttttaatggagtggagaactctctcccttaaaaaaaaaaatccaaccaggcaaatatggaacataacctagtagggagaatctggaacctatatactcatgttcagattcatattcgttgtactaaattatttatgtctcattcttattaggttggatttgttggatggagggagtatgtggcagggacacacttatcaacacatcatgcatgtatatccccttatgattaagaatattatgttttctatcatctccttttggcaaagattggcacggcatttcaagagagtaaaagtaagcataatgtaattattcttcaacaacttgcatttccttcttagttttttcccttgacagcacgaataatgccctttcatagttcggagatcaagcttaacataaaggcataaaccaatcatagctcataagtttggagttcataaagccaaagagtaatcatgtttcttcttgcaaatattgttaaagcagttcatttccatttttaaaaggcatcttcagatacccaaacattgatgttcgacatgtcgccacatatttgatgctctgcaattaaaaggaaaaaaaaaggcactaatcttggaatcaggtacctggtttcattacagcgacgcattatttcgacatttcaaggggttagccaatacagatttccgaagagtcacagcatagcccagttctgtccagaaaatagtacagcaactttttttctgaattcatattgaccaataagaacaagtgggtagcttgaccattccatgtacagatctgagattcttgcgtcgattcatcattttgaagggttcatcagcgagaaagaagatttatttttttctgagatcatcttccacagggactcttcaagaccagcgtaatagctctccaatttgatctattaccatcggtcaggaaatgttgcattcctcatatcagtggatccctattgacatctttatacagcaagtacctcgtcttggtttttccaagggcagcgtacctggaacagcaaggcaacggtgatgagctgcctacaaaagccaattccatgaatgataaacactatgttgacagatactaaccattgaggcacaaacggtgccatccaaatggtgtcccctgattgcaccgggtacctgtattagcaaacagaacaaatattcagtaatcagctaagtaggagactaatatagtctataatgttacaactgtcagtaaagcatatacttagatgtgaagggcggcctctaaaaaaatgttgaggacagtggatggaagcagaaacacatgagtcatgacaatagtgccatgaagtagattaggctcatacgcacccatattttgtaaatgtcaagctcaataatgagccgttaatctatatacagtactcagtacacatcttctagaacttatattaaaataagattatgatatcttccttaaacagcttgtcccaggaggaaacaaggctgggaacctgggactctgaagtctgaacgttgcacaaccaaataaagcctaaaaggaaaaaaaagaataatacaaaaaaggaaatgttttagatcacatccttaccagctgtctcccaatcggtatattccttgtccctctaaaagcagcaacccatgttgattgtaatgaacctcctgtttataattaacccccaaaaaaaaagcagcttcagaatgtgatgggtgcatagtggctagtcactagtgacatgaccaagaatgtagttcacacattgcagattttctggtgggagcccctttgtaattaatctaatagacaattaaaatatgaacacggtttaaaacatggtactagcacattaggtctgaaatctcctaagaaatattaaaatattcacaaaccttcacattaagatattccccaggctgaaaatccattatctgcaagtgagaaataaggatatcagaaaaagtttagctcctttgtagtctagaaataacctacgaataagtttaaagactctgataagtaatgacttttgcaagctcaggttgccagtgtttcagagtttgagttcttatacaacacaatagcttattacacttatttcaatgaataactaggagaacaaatagcttgaatctaatgcttggtttgccgaaatttatgggcactcacattcagtggaatgatgttatacacaccaagttaaacaataaacccaaattaatcagacttacatggatattaaagtcataaggcagagaagtgggtagcagcttcctcaactcaaatacctattggaaaaaagaggcaagaatttcatgtaagtgcttgcagaatatatatcagcaaaaaacagtactacaatattgtctgtagcaggggaaaaaacagcaattatctatatgaatgtcacagcaaaaactctacaatattggcaacacaaggccaaatgatataaattgaaaactgaaaccagtttattccaaccctcttgaaaatgcatagtataaattaaaggcgtaccactcaaatggcaggcaaaccaatttat
